(12) United States Patent
Cao et al.

(10) Patent No.: US 7,901,882 B2
(45) Date of Patent: Mar. 8, 2011

(54) ANALYSIS OF METHYLATION USING NUCLEIC ACID ARRAYS

(75) Inventors: Yanxiang Cao, Mountain View, CA (US); Shivani Nautiyal, Portola Valley, CA (US); Charles G. Miyada, San Jose, CA (US); Christopher Davies, Walnut Creek, CA (US); Gangwu Mei, Fremont, CA (US); Alan J. Williams, Albany, CA (US); Eric B. Schell, Mountain View, CA (US); John E. Blume, Sunnyvale, CA (US)

(73) Assignee: Affymetrix, Inc., Santa Clara, CA (US)

(*) Notice: Subject to any disclaimer, the term of this patent is extended or adjusted under 35 U.S.C. 154(b) by 14 days.

(21) Appl. No.: 11/695,599

(22) Filed: Apr. 2, 2007

(65) Prior Publication Data
US 2007/0243546 A1 Oct. 18, 2007

Related U.S. Application Data

(60) Provisional application No. 60/788,520, filed on Mar. 31, 2006.

(51) Int. Cl.
C12Q 1/68 (2006.01)
C07H 21/02 (2006.01)
C07H 21/04 (2006.01)

(52) U.S. Cl. ............................ 435/6; 536/23.1; 536/24.3
(58) Field of Classification Search ..... 435/6; 536/23.1, 536/24.3
See application file for complete search history.

(56) References Cited

U.S. PATENT DOCUMENTS

| | | | |
|---|---|---|---|
| 5,118,604 A | 6/1992 | Weissman et al. | |
| 5,217,889 A | 6/1993 | Roninson et al. | |
| 5,474,796 A * | 12/1995 | Brennan | 427/2.13 |
| 5,576,204 A | 11/1996 | Blanco | |
| 5,580,730 A | 12/1996 | Okamoto | |
| 5,710,000 A | 1/1998 | Sapolsky et al. | |
| 5,786,146 A | 7/1998 | Herman et al. | |
| 5,871,917 A | 2/1999 | Duffy | |
| 5,912,147 A | 6/1999 | Stoler et al. | |
| 5,942,609 A | 8/1999 | Hunkapiller et al. | |
| 6,017,701 A | 1/2000 | Sorge et al. | |
| 6,017,704 A | 1/2000 | Herman et al. | |
| 6,156,501 A | 12/2000 | McGall et al. | |
| 6,200,756 B1 | 3/2001 | Herman et al. | |
| 6,214,556 B1 | 4/2001 | Olek et al. | |
| 6,251,594 B1 | 6/2001 | Gonzalgo et al. | |
| 6,265,171 B1 | 7/2001 | Herman et al. | |
| 6,300,071 B1 | 10/2001 | Vuylsteke et al. | |
| 6,309,823 B1 | 10/2001 | Cronin et al. | |
| 6,331,393 B1 | 12/2001 | Laird et al. | |
| 6,333,155 B1 | 12/2001 | Lockhart et al. | |
| 6,383,754 B1 | 5/2002 | Kaufman et al. | |
| 6,509,160 B1 | 1/2003 | Sapolsky et al. | |
| 6,514,698 B1 | 2/2003 | Lopez et al. | |
| 6,562,569 B1 | 5/2003 | Dale | |
| 6,582,908 B2 | 6/2003 | Fodor et al. | |
| 6,605,432 B1 * | 8/2003 | Huang | 435/6 |
| 6,613,511 B1 | 9/2003 | Schmidt et al. | |
| 6,649,347 B2 | 11/2003 | Luo et al. | |
| 6,677,121 B2 | 1/2004 | Lizardi et al. | |
| 6,713,258 B2 | 3/2004 | Kilian | |
| 6,858,388 B2 | 2/2005 | Markowitz et al. | |
| 6,884,586 B2 | 4/2005 | Van Ness et al. | |
| 6,916,621 B2 * | 7/2005 | Shah | 435/6 |
| 6,936,419 B1 | 8/2005 | Berlin | |
| 6,958,217 B2 | 10/2005 | Pedersen et al. | |
| 6,960,436 B2 | 11/2005 | Cottrell | |
| 6,964,847 B1 | 11/2005 | Englert | |
| 6,979,728 B2 * | 12/2005 | Bradley et al. | 536/23.1 |
| 7,108,976 B2 | 9/2006 | Jones et al. | |
| 7,112,404 B2 | 9/2006 | Laird et al. | |
| 7,118,868 B2 | 10/2006 | Berlin | |
| 7,132,240 B2 | 11/2006 | Luo et al. | |
| 7,144,701 B2 | 12/2006 | Huang | |
| 7,153,671 B2 | 12/2006 | Berlin | |
| 7,186,512 B2 * | 3/2007 | Martienssen et al. | 435/6 |
| 7,195,870 B2 | 3/2007 | Olek et al. | |
| 7,214,485 B2 | 5/2007 | Belinsky | |
| 7,229,759 B2 | 6/2007 | Olek et al. | |
| 7,247,428 B2 | 7/2007 | Makrigiorgos et al. | |
| 7,285,394 B2 | 10/2007 | Lofton-Day et al. | |
| 7,368,239 B2 | 5/2008 | Zon | |
| 7,405,040 B2 | 7/2008 | Olek et al. | |
| 7,407,749 B2 | 8/2008 | Berlin et al. | |
| 7,425,415 B2 | 9/2008 | Pfeifer et al. | |

(Continued)

FOREIGN PATENT DOCUMENTS

EP 1344832 9/2003

(Continued)

OTHER PUBLICATIONS

Herman et al., Methylation-specific PCR: a novel PCR assay for methylation status of CpG islands PNAS 93(18): 9821-9826 (1996).*
Huang et al., Methylation profiling of CpG islands in human breast cancer cells. Human Molecular Genetics 8 (3) :459-470 (1999).*
Eads et al., MethyLight: a high-throughput assay to measure DNA methylation. Nucleic Acids Research 28(8) : e32 (2000).*
Yan et al., CpG island arrays: an application toward deciphering epigenetic signatures of breast cancer. Clinical Cancer Research 6(4): 1432-8 (2000).*
Hatada et al. A microarray-based method for detecting methylated loci. Journal of Human Genetics, 47(8) : 448-51(2002).*
Liang et al., Identification of DNA methylation differences during tumorigenesis by methylation-sensitive arbitrarily primed polymerase chain reaction. Methods 27(2) : 150-155 (2002).*
Wei et al., Methylation microarray analysis of late-stage ovarian carcinomas distinguishes progression-free survival in patients and identifies candidate epigenetic markers. Clinical Cancer Research 8(7) : 2246-2252(2002).*
Adorjan et al., Tumour class prediction and discovery by microarray-based DNA methylation analysis. Nucleic Acids Research 30 (5) :e21/1-e21/9 (2002).*

(Continued)

Primary Examiner — Ethan Whisenant
(74) Attorney, Agent, or Firm — Thomas J. Siepmann

(57) ABSTRACT

Arrays for genome-wide analysis of methylation are disclosed. In a preferred aspect arrays comprising a plurality of probes complementary to a plurality of identified CpG islands in the human, mouse and rat genome are disclosed. The arrays may be used to detect methylation within CpG islands in samples from human, mouse and rat genomes.

9 Claims, 5 Drawing Sheets

U.S. PATENT DOCUMENTS

| | | | |
|---|---|---|---|
| 7,524,629 B2 | 4/2009 | Olek et al. | |
| 7,611,869 B2 | 11/2009 | Fan | |
| 7,781,161 B2 | 8/2010 | Sidransky | |
| 7,794,929 B2 | 9/2010 | Baylin et al. | |
| 2001/0046669 A1 | 11/2001 | McCobmie et al. | |
| 2001/0053519 A1* | 12/2001 | Fodor et al. | 435/6 |
| 2002/0137086 A1 | 9/2002 | Olek et al. | |
| 2002/0197639 A1 | 12/2002 | Shia et al. | |
| 2003/0036081 A1 | 2/2003 | Adorjan et al. | |
| 2003/0096289 A1 | 5/2003 | Suzuki et al. | |
| 2003/0099997 A1 | 5/2003 | Bestor | |
| 2003/0104464 A1 | 6/2003 | Berlin et al. | |
| 2003/0143606 A1 | 7/2003 | Olek et al. | |
| 2003/0148326 A1 | 8/2003 | Olek et al. | |
| 2003/0148327 A1 | 8/2003 | Olek et al. | |
| 2003/0152950 A1 | 8/2003 | Garner et al. | |
| 2003/0157510 A1 | 8/2003 | Olek | |
| 2003/0162194 A1 | 8/2003 | Olek et al. | |
| 2003/0170689 A1 | 9/2003 | Stamatoyannapoulos et al. | |
| 2003/0175908 A1 | 9/2003 | Linnarsson et al. | |
| 2003/0212455 A1 | 11/2003 | Van Steensel et al. | |
| 2003/0215842 A1 | 11/2003 | Sledziewski et al. | |
| 2004/0023230 A1 | 2/2004 | Olek et al. | |
| 2004/0029128 A1 | 2/2004 | Cottrell et al. | |
| 2004/0038254 A1 | 2/2004 | Peoples et al. | |
| 2004/0048275 A1 | 3/2004 | Guldberg | |
| 2004/0072197 A1 | 4/2004 | Jones et al. | |
| 2004/0077074 A1* | 4/2004 | Ackley et al. | 435/287.2 |
| 2004/0086944 A1 | 5/2004 | Grigg et al. | |
| 2004/0102905 A1 | 5/2004 | Adorjan et al. | |
| 2004/0146868 A1 | 7/2004 | Cottrell et al. | |
| 2004/0203048 A1 | 10/2004 | Tran | |
| 2004/0234960 A1 | 11/2004 | Olek et al. | |
| 2004/0248090 A1 | 12/2004 | Olek et al. | |
| 2004/0248171 A1 | 12/2004 | Palmisano | |
| 2005/0009059 A1 | 1/2005 | Shapero et al. | |
| 2005/0021240 A1 | 1/2005 | Berlin et al. | |
| 2005/0064428 A1 | 3/2005 | Berlin | |
| 2005/0196792 A1 | 9/2005 | Fodor et al. | |
| 2005/0227230 A1 | 10/2005 | Carroll | |
| 2005/0233340 A1 | 10/2005 | Barrett | |
| 2005/0282157 A1 | 12/2005 | Olek | |
| 2006/0110741 A1 | 5/2006 | Asai | |
| 2006/0134650 A1 | 6/2006 | Gunderson | |
| 2006/0183115 A1 | 8/2006 | Wang | |
| 2006/0188986 A1 | 8/2006 | Millar | |
| 2009/0023137 A1* | 1/2009 | Van Der Zee et al. | 435/6 |

FOREIGN PATENT DOCUMENTS

| | | |
|---|---|---|
| EP | 1312685 | 11/2003 |
| EP | 1362929 | 11/2003 |
| EP | 1568786 | 8/2005 |
| WO | WO 00/26401 | 5/2000 |
| WO | WO 01/38565 | 5/2001 |
| WO | WO 01/77377 | 10/2001 |
| WO | WO 02/00927 | 1/2002 |
| WO | WO 02/04686 | 1/2002 |
| WO | WO 02/18649 | 3/2002 |
| WO | WO 02/34942 | 5/2002 |
| WO | WO 02/083705 | 10/2002 |
| WO | WO 03/023065 | 3/2003 |
| WO | WO 03/025215 | 3/2003 |
| WO | WO 03/027259 | 4/2003 |
| WO | WO 03/048732 | 6/2003 |
| WO | WO 03/064682 | 8/2003 |
| WO | WO 03/076666 | 9/2003 |
| WO | WO 03/080862 | 10/2003 |
| WO | WO 03/087774 | 10/2003 |
| WO | WO 2004/048555 | 6/2004 |
| WO | WO 2004/096825 | 11/2004 |
| WO | WO 2005/021778 | 3/2005 |
| WO | WO 2005/021802 | 3/2005 |
| WO | WO 2005/033332 | 4/2005 |

OTHER PUBLICATIONS

Chen et al., Methylation target array for rapid analysis of CpG island hypermethylation in multiple tissue genomes. Am. J. of Pathology 163 (1) : 37-45 (2003).*

Yan et al., Dissecting complex epigenetic alterations in breast cancer using CpG island microarrays. Cancer Research 61 : 8375-8380 (2001).*

Adorjan et al., "Tumour class prediction and discovery by microarray-based DNA methylation analysis," *Nucleic Acids Research*, 30(5):e21/1-e21/9 (2002).

Bernstein et al., "Genomic maps and comparative analysis of histone modifications in human and mouse," *Cell*, 120(2):169-81 (Jan. 2005).

Chen et al., "Methylation target array for rapid analysis of CpG island hypermethylation in multiple tissue genomes," *Am. J. of Pathology*, 163(1):37-45 (2003).

Eads et al., "MethyLight: a high-throughput assay to measure DNA methylation," *Nucleic Acids Research*, 28(8):e32 (2000).

Faruqi et al., "High-throughput genotyping of single nucleotide polymorphisms with rolling circle amplification," *BMC Genomics*, 2:4 (2001).

Frigola et al., "Differential DNA hypermethylation and hypomethylation signatures in colorectal cancer," *Human Molecular Genetics*, 2005, pp. 319-326, vol. 14, No. 2, Oxford University Press.

Frigola et al., "Methylome profiling of cancer cells by amplification of inter-methylated sites (AIMS)," *Nucleic Acids Research*, 2002, vol. 30, No. 7, e28.

Gao et al., "DNA microarray: a high throughput approach for methylation detection," *Colloids and Surfaces B: Biointerfaces*, 2005, pp. 127-131, vol. 40, No. 3, Elsevier.

Gitan et al., "Methylation-Specific Oligonucleotide Microarray: A New Potential for High-Throughput Methylation Analysis," *Genome Research*, 2002, pp. 158-164, vol. 12, Issue 1, Cold Spring Harbor Laboratory Press.

Hatada et al., "A microarray-based method for detecting methylated loci," *Journal of Human Genetics*, 47(8):448-51 (2002).

Herman et al., "Methylation-specific PCR: a novel PCR assay for methylation status of CpG islands," *PNAS* 93(18):9821-9826 (1996).

Hirschhorn et al., "SBE-TAGS: An array-based method for efficient single-nucleotide genotyping," PNAS 97(22):12164-12169 (2000).

Huang et al., Methylation profiling of CpG islands in human breast cancer cells. Human Molecular Genetics 8 (3): 459-470 (1999).

Larijani et al., "Methylation protects cytidines from AID-mediated deamination," *Molecular Immunology*, 2005, pp. 599-604, vol. 42, Elsevier.

Liang et al., "Identification of DNA methylation differences during tumorigenesis by methylation-sensitive arbitrarily primed polymerase chain reaction," *Methods*, 27(2):150-155 (2002).

Lipshutz et al., "High density synthetic oligonucleotide arrays," *Nature Genetics Supplement*, vol. 21, pp. 20-24 (Jan. 1999).

Oakeley, "DNA Methylation Analysis: A Review of Current Methodologies," *Pharmacology & Therapeutics*, 1999, pp. 389-400, vol. 84.

Rauch et al., "Methylated-CpG island recovery assay: a new technique for the rapid detection of methylated-CpG islands in cancer," *Laboratory Investigation*, 2005, pp. 1-9.

Robinson et al., "Stable methylation patterns in interspecific antelope hybrids and the characterization and localization of a satellite fraction in the *Alcelaphini* and *Hippotragini*," *Chromosome Research*, 8(7):635-643 (Oct. 2000).

Sadri et al., "Rapid analysis of DNA methylation using new restriction enzyme sites created by bisulfite modification," *Nucleic Acids Research*, 1996, pp. 5058-5059, vol. 24, No. 24, Oxford University Press.

Shi et al., "Expressed CpG Island Sequence Tag Microarray for Dual Screening of DNA Hypermethylation and Gene Silencing in Cancer Cells," *Cancer Research*, 62:3214-3220 (Jun. 2002).

Thomassin et al., "MethylQuant: a sensitive method for quantifying methylation of specific cytosines within the genome," *Nucleic Acids Research*, 2004, vol. 32, No. 21, e168, Oxford University Press.

Tompa et al., "Genome-Wide Profiling of DNA Methylation Reveals Transposon Targets of Chromomethylase3," *Current Biology*, Jan. 8, 2002, pp. 65-68, vol. 12. Elseveir.

Wei et al., "Methylation microarray analysis of late-stage ovarian carcinomas distinguishes progression-free survival in patients and identifies candidate epigenetic markers," *Clinical Cancer Research*, 8(7):2246-2252 (2002).

Xiong et al., "COBRA: a sensitive and quantitative DNA methylation assay," *Nucleic Acids Res.*, 25(1):2532-4 (Jun. 1997).

Yan et al., "Applications of CpG island microarrays for high-throughput analysis of DNA methylation," *J. Nutr.*, 132(8 Suppl): 2430S-2434S (Aug. 2002).

Yan et al., "CpG island arrays: an application toward deciphering epigenetic signatures of breast cancer," *Clinical Cancer Research*, 6(4):1432-8 (2000).

Yan et al., "Dissecting complex epigenetic alterations in breast cancer using CpG island microarrays," *Cancer Research*, 61:8375-8380 (2001).

Yan et al., "Use of CpG island microarrays to identify colorectal tumors with a high degree of concurrent methylation," *Methods*, 27(2):162-9 (Jun. 2002).

* cited by examiner

ANALYSIS OF METHYLATION USING NUCLEIC ACID ARRAYS

RELATED APPLICATIONS

The present application claims priority to U.S. Provisional Application No. 60/788,520, filed Mar. 31, 2006, the entire disclosure of which is incorporated herein by reference.

FIELD OF THE INVENTION

The present invention relates to arrays and methods for detecting methylation of nucleic acids.

REFERENCE TO SEQUENCE LISTING

The Sequence Listing submitted on compact disk is hereby incorporated by reference. The file on the disk is named 3791.1sequencelist.txt, the file is 108 MB and the date of creation is Mar. 30, 2007.

BACKGROUND OF THE INVENTION

The genomes of higher eukaryotes contain the modified nucleoside 5-methyl cytosine (5-meC). This modification is usually found as part of the dinucleotide CpG. Cytosine is converted to 5-methylcytosine in a reaction that involves flipping a target cytosine out of an intact double helix and transfer of a methyl group from S-adenosylmethionine by a methyltransferase enzyme (Klimasauskas et al., *Cell* 76:357-369, 1994). This enzymatic conversion is the only epigenetic modification of DNA known to exist in vertebrates and is essential for normal embryonic development (Bird, *Cell* 70:5-8, 1992; Laird and Jaenisch, *Human Mol. Genet.* 3:1487-1495, 1994; and Li et al., *Cell* 69:915-926, 1992).

The frequency of the CpG dinucleotide in the human genome is only about 20% of the statistically expected frequency, possibly because of spontaneous deamination of 5-meC to T (Schoreret et al., *Proc. Natl. Acad Sci. USA* 89:957-961, 1992). There are about 28 million CpG doublets in a haploid copy of the human genome and it is estimated that about 70-80% of the cytosines at CpGs are methylated. Regions where CpG is present at levels that are approximately the expected frequency are referred to as "CpG islands" (Bird, A. P., *Nature* 321:209-213, 1986). These regions have been estimated to comprise about 1% of vertebrate genomes and account for about 15% of the total number of CpG dinucleotides. CpG islands are typically between 0.2 and 1 kb in length and are often located upstream of housekeeping and tissue-specific genes. CpG islands are often located upstream of transcribed regions, but may also extend into transcribed regions. About 2-4% of cytosines are methylated and probably the majority of cytosines that are 5' of Gs are methylated. Most of the randomly distributed CpGs are methylated, but only about 20% of the CpGs in CpG islands are methylated.

DNA methylation is an epigenetic determinant of gene expression. Patterns of CpG methylation are heritable, tissue specific, and correlate with gene expression. The consequence of methylation is usually gene silencing. DNA methylation also correlates with other cellular processes including embryonic development, chromatin structure, genomic imprinting, somatic X-chromosome inactivation in females, inhibition of transcription and transposition of foreign DNA and timing of DNA replication. When a gene is highly methylated it is less likely to be expressed, possibly because CpG methylation prevents transcription factors from recognizing their cognate binding sites. Proteins that bind methylated DNA may also recruit histone deacetylase to condense adjacent chromatin. Such "closed" chromatin structures prevent binding of transcription factors. Thus the identification of sites in the genome containing 5-meC is important in understanding cell-type specific programs of gene expression and how gene expression profiles are altered during both normal development and diseases such as cancer. Precise mapping of DNA methylation patterns in CpG islands has become essential for understanding diverse biological processes such as the regulation of imprinted genes, X chromosome inactivation, and tumor suppressor gene silencing in human cancer caused by increase methylation.

Methylation of cytosine residues in DNA plays an important role in gene regulation. Methylation of cytosine may lead to decreased gene expression by, for example, disruption of local chromatin structure, inhibition of transcription factor-DNA binding, or by recruitment of proteins which interact specifically with methylated sequences and prevent transcription factor binding. DNA methylation is required for normal embryonic development and changes in methylation are often associated with disease. Genomic imprinting, X chromosome inactivation, chromatin modification, and silencing of endogenous retroviruses all depend on establishing and maintaining proper methylation patterns. Abnormal methylation is a hallmark of cancer cells and silencing of tumor suppressor genes is thought to contribute to carcinogenesis. Methylation mapping using microarray-based approaches may be used, for example, to profile cancer cells revealing a pattern of DNA methylation that may be used, for example, to diagnose a malignancy, predict treatment outcome or monitor progression of disease. Methylation in eukaryotes can also function to inhibit the activity of viruses and transposons, see Jones et al., *EMBO J.* 17:6385-6393 (1998). Alterations in the normal methylation process have also been shown to be associated with genomic instability (Lengauer et al., *Proc. Natl. Acad. Sci. USA* 94:2545-2550, 1997). Such abnormal epigenetic changes may be found in many types of cancer and can serve as potential markers for oncogenic transformation.

SUMMARY OF THE INVENTION

The present invention provides methods and arrays for analysis of methylation status of sites in genomic DNA.

In a first aspect, the invention thus provides an array of more than 250,000 different sequence probes that are complementary to regions of the human genome that are rich in CpG dinucleotides.

In one embodiment the array comprises probes to more than 25,000 CpG islands in the human genome. The islands are selected from annotated islands in public databases, preferably the UCSC genome browser. In preferred aspects islands are selected that have a GC content of 50% or greater over a length of 200 base pairs or greater.

In one embodiment the array comprises at least one probe set for each CpG island to be interrogated and each probe set comprises 8, 20 to 30 base probes that are perfectly complementary to a region of the CpG island over the entire length of the probe.

In another aspect, the array comprises three probes sets comprising 8 probes for each CpG island that is greater than 5 kb in length. The probe sets may be distributed so that the probes in one probe set are complementary to regions in the 5' approximately 1,700 base pairs, one the 3' 1,700 base pairs and one the central 1,700 base pairs of the island.

BRIEF DESCRIPTION OF THE DRAWINGS

The above and other objects and advantages of the present invention will be apparent upon consideration of the following detailed description taken in conjunction with the accompanying drawings, in which like characters refer to like parts throughout, and in which.

Figure 1:
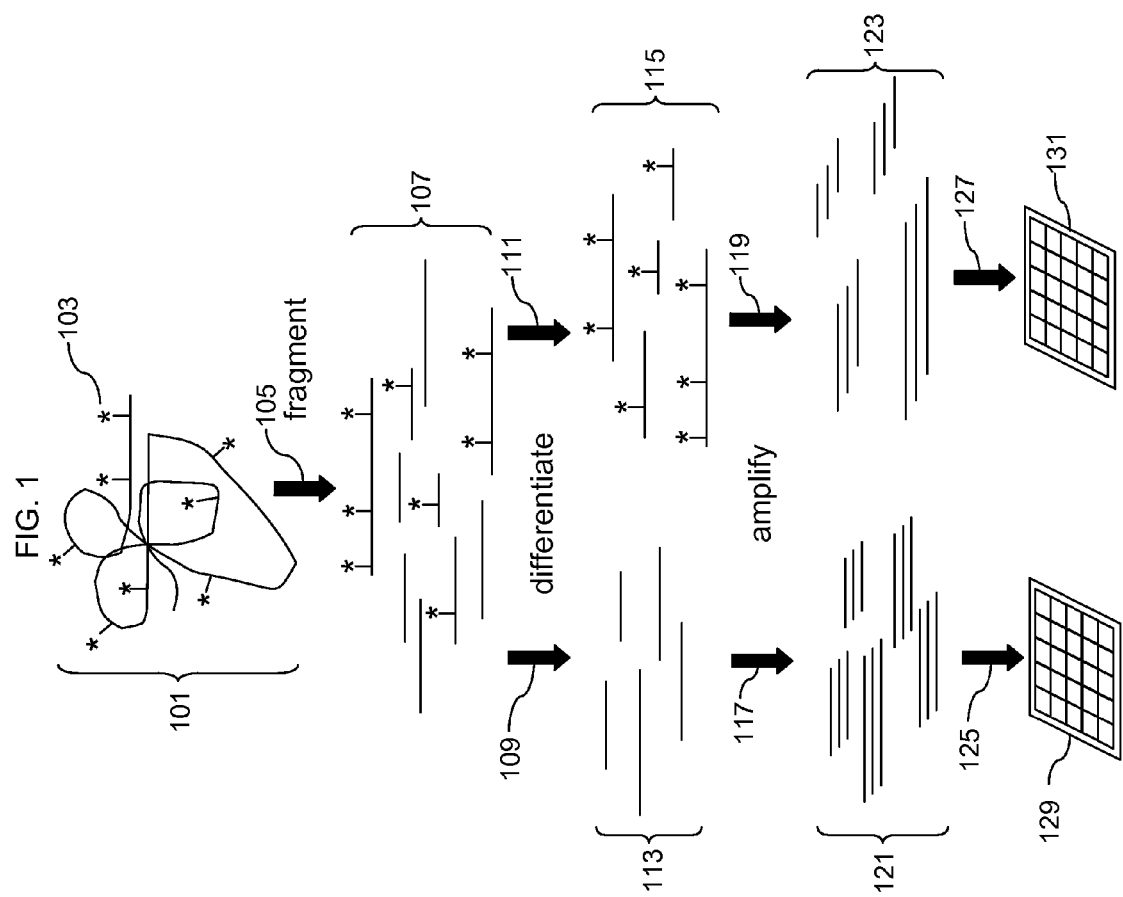
FIG. 1 is a schematic illustrating a method of analyzing the methylation status of genomic DNA.

DETAILED DESCRIPTION OF THE INVENTION a) General

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being, but may also include other organisms including but not limited to mammals, plants, fungi, bacteria or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series* (Vols. I-IV), *Using Antibodies: A Laboratory Manual, Cells: A Laboratory Manual, PCR Primer: A Laboratory Manual*, and *Molecular Cloning: A Laboratory Manual* (all from Cold Spring Harbor Laboratory Press), Stryer, L. (1995) *Biochemistry* (4th Ed.) Freeman, N.Y., Gait, "*Oligonucleotide Synthesis: A Practical Approach*" 1984, IRL Press, London, Nelson and Cox (2000), *Lehninger, Principles of Biochemistry* 3$^{rd}$ Ed., W.H. Freeman Pub., New York, N.Y. and Berg et al. (2002) *Biochemistry*, 5$^{th}$ Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication No. WO 99/36760) and PCT/US01/04285 (International Publication No. WO 01/58593), which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 10/442,021, 10/013,598 (U.S. Patent Application Publication 20030036069), and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with hybridization to an array, the sample may be amplified by a variety of mechanisms, some of which may employ PCR. See, for example, *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); *PCR* (Eds. McPherson et al., IRL Press, Oxford); and U.S. Pat. Nos. 4,683,202, 4,683,195, 4,800,159, 4,965,188, and 5,333,675. The sample may be amplified on the array. See, for example, U.S. Pat. No. 6,300,070 which is incorporated herein by reference.

Other suitable amplification methods include the ligase chain reaction (LCR) (for example, Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173

(1989) and WO88/10315), self-sustained sequence replication (Guatelli et al., *Proc. Nat. Acad. Sci. USA,* 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245), rolling circle amplification (RCA) (for example, Fire and Xu, *PNAS* 92:4641 (1995) and Liu et al., *J. Am. Chem. Soc.* 118:1587 (1996)) and nucleic acid based sequence amplification (NABSA), (See, U.S. Pat. Nos. 5,409,818, 5,554,517, and 6,063,603). Other amplification methods that may be used are described in, U.S. Pat. Nos. 5,242,794, 5,494,810, 4,988,617 and in U.S. Ser. No. 09/854,317. Other amplification methods are also disclosed in Dahl et al., *Nuc. Acids Res.* 33(8):e71 (2005) and circle to circle amplification (C2CA) Dahl et al., PNAS 101:4548 (2004). Locus specific amplification and representative genome amplification methods may also be used.

Additional methods of sample preparation and techniques for reducing the complexity of a nucleic sample are described in Dong et al., *Genome Research* 11, 1418 (2001), in U.S. Pat. Nos. 6,872,529, 6,361,947, 6,391,592 and 6,107,023, US Patent Publication Nos. 20030096235 and 20030082543 and U.S. patent application Ser. No. 09/916,135.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y., 1989); Berger and Kimmel *Methods in Enzymology*, Vol. 152, *Guide to Molecular Cloning Techniques* (Academic Press, Inc., San Diego, Calif., 1987); Young and Davism, *P.N.A.S,* 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference.

The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 10/389,194 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800,992, 5,834,758; 5,856,092, 5,902,723, 5,936,324, 5,981,956, 6,025,601, 6,090,555, 6,141,096, 6,185,030, 6,201,639; 6,218,803; and 6,225,625, in U.S. Ser. Nos. 10/389,194, 60/493,495 and in PCT Application PCT/US99/06097 (published as WO 99/47964), each of which also is hereby incorporated by reference in its entirety for all purposes. Instruments and software may also be purchased commercially from various sources, including Affymetrix.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., *Introduction to Computational Biology Methods* (PWS Publishing Company, Boston, 1997); Salzberg, Searles, Kasif, (Ed.), *Computational Methods in Molecular Biology,* (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., $2^{nd}$ ed., 2001). See U.S. Pat. No. 6,420,108.

Methods for detection of methylation status are disclosed, for example, in Fraga and Esteller, *BioTechniques* 33:632-649 (2002) and Dahl and Guldberg Biogerontology 4:233-250 (2003). Methylation detection using bisulfite modification and target specific PCR have been disclosed, for example, in U.S. Pat. Nos. 5,786,146, 6,200,756, 6,143,504, 6,265,171, 6,251,594, 6,331,393, and 6,596,493. U.S. Pat. No. 6,884,586 disclosed methods for methylation analysis using nicking agents and isothermal amplification.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

Additionally, the present invention may have preferred embodiments that include methods for providing genetic information over networks such as the Internet as shown in U.S. Ser. Nos. 10/197,621, 10/063,559 (United States Publication No. 20020183936), 10/065,856, 10/065,868, 10/328,818, 10/328,872, 10/423,403, and 60/482,389.

All documents, i.e., publications and patent applications, cited in this disclosure, including the foregoing, are incorporated by reference herein in their entireties for all purposes to the same extent as if each of the individual documents were specifically and individually indicated to be so incorporated by reference herein in its entirety.

b) Definitions

"Adaptor sequences" or "adaptors" or "linkers" are generally oligonucleotides of at least 5, 10, or 15 bases and preferably no more than 50 or 60 bases in length; however, they may be even longer, up to 100 or 200 bases that may be attached to the ends of fragments. Adaptor sequences may be synthesized using any methods known to those of skill in the art. For the purposes of this invention they may, as options, comprise primer binding sites, recognition sites for endonucleases, common sequences and promoters. The adaptor may be entirely or substantially double stranded or entirely single stranded. A double stranded adaptor may comprise two oligonucleotides that are at least partially complementary. The adaptor may be phosphorylated or unphosphorylated on one or both strands.

Adaptors may be ligated to blunt or sticky ends of fragments and the adaptors may have blunt or sticky ends. They may comprise a substantially double stranded region and a short single stranded region which is complementary to the single stranded region created by digestion with a restriction enzyme, also referred to as a "sticky end". Overhangs may also be converted to blunt ends by filling in an overhang or removing an overhang.

Methods of ligation will be known to those of skill in the art and are described, for example in Sambrook et at. (2001) and the New England BioLabs catalog Methods include using T4 DNA Ligase which catalyzes the formation of a phosphodiester bond between juxtaposed 5' phosphate and 3' hydroxyl termini in duplex DNA or RNA with blunt and sticky ends; Taq DNA Ligase which catalyzes the formation of a phosphodiester bond between juxtaposed 5' phosphate and 3' hydroxyl termini of two adjacent oligonucleotides which are hybridized to a complementary target DNA; E. coli DNA ligase which catalyzes the formation of a phosphodiester bond between juxtaposed 5'-phosphate and 3'-hydroxyl termini in duplex DNA containing cohesive ends; and T4 RNA ligase which catalyzes ligation of a 5' phosphoryl-terminated nucleic acid donor to a 3' hydroxyl-terminated nucleic acid acceptor through the formation of a 3'->5' phosphodiester bond, substrates include single-stranded RNA and DNA as well as dinucleoside pyrophosphates; or any other methods described in the art.

Adaptors may also incorporate modified nucleotides that modify the properties of the adaptor sequence. For example, phosphorothioate groups may be incorporated in one of the adaptor strands. A phosphorothioate group is a modified phosphate group with one of the oxygen atoms replaced by a sulfur atom. In a phosphorothioated oligo (often called an "S-Oligo", souse or ail of the internucleotide phosphate groups are replaced by phosphorothioate groups. The modified backbone of all S-Oligo is resistant to the action of most exonucleases and endonucleases. Phosphorothioates may be incorporated between all residues of an adaptor strand, or at specified locations within a sequence. A useful option is to sulfurize only the last few residues at each end of the oligo. This results in an oligo that is resistant to exonucleases, but has a natural DNA center.

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a 1 column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Perfectly complementary refers to 100% complementarity over the length of a sequence. For example, a 25 base probe is perfectly complementary to a target when all 25 bases of the probe are complementary to a contiguous 25 base sequence of the target with no mismatches between the probe and the target over the length of the probe.

The term "CpG island" as used herein refers to stretches of DNA in a genome that are rich in GC relative to the rest of the genome. Typically the GC content is 50% or greater in these regions which extend over hundreds of base pairs and sometimes thousands. Often these regions mark the 5' ends of genes.

The term "epigenetic" as used herein refers to factors other than the primary sequence of the genome that affect the development or function of an organism, they can affect the phenotype of an organism without changing the genotype. Epigenetic factors include modifications in gene expression that are controlled by heritable but potentially reversible changes in DNA methylation and chromatin structure. Methylation patterns are known to correlate with gene expression and in general highly methylated sequences are poorly expressed.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "hybridization" as used herein refers to the process in which two single-stranded polynucleotides bind non-covalently to form a stable double-stranded polynucleotide; triple-stranded hybridization is also theoretically possible. The resulting (usually) double-stranded polynucleotide is a "hybrid." Hybridizations are usually performed under stringent conditions, for example, at a salt concentration of no more than about 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations or conditions of 100 mM MES, 1 M [Na$^+$], 20 mM EDTA, 0.01% Tween-20 and a temperature of 30-50° C., preferably at about 45-50° C. Hybridizations may be performed in the presence of agents such as herring sperm DNA at about 0.1 mg/ml, acetylated BSA at about 0.5 mg/ml. As other factors may affect the stringency of hybridization, including base composition and length of the complementary strands, presence of organic solvents and extent of base mismatching, the combination of parameters is more important than the absolute measure of any one alone. Hybridization conditions suitable for microarrays are described in the Gene Expression Technical Manual, 2004 and the GeneChip Mapping Assay Manual, 2004, available at Affymetrix.com.

The term "hybridization probes" as used herein are oligonucleotides capable of binding in a base-specific manner to a complementary strand of nucleic acid. Such probes include peptide nucleic acids, as described in Nielsen et al., *Science*

254, 1497-1500 (1991), LNAs, as described in Koshkin et al. *Tetrahedron* 54:3607-3630, 1998, and U.S. Pat. No. 6,268,490 and other nucleic acid analogs and nucleic acid mimetics.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The term "label" as used herein refers to a luminescent label, a light scattering label, a radioactive label or a molecule that interacts with a detectable label. Fluorescent labels include the commercially available fluorescein phosphoramidites such as Fluoreprime (Pharmacia), Fluoredite (Millipore) and FAM (ABI). See U.S. Pat. No. 6,287,778. In preferred aspects biotin is incorporated into nucleic acids and is used to detectably label the nucleic acids through interaction with streptavidin.

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but include other undesirable populations. For example, a complex population of nucleic acids may be a sample which has been enriched for desired messenger RNA (mRNA) sequences but still includes some undesired ribosomal RNA sequences (rRNA).

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

Restriction enzymes or restriction endonucleases and their properties are well known in the art. A wide variety of restriction enzymes are commercially available, from, for example, New England Biolabs. Restriction enzymes recognize a sequence specific sites (recognition site) in DNA. Typically the recognition site varies from enzyme to enzyme and may also vary in length. Isoschizomers are enzymes that share the same recognition site. Restriction enzymes may cleave close to or within their recognition site or outside of the recognition site. Often the recognition site is symmetric because the enzyme binds the double stranded DNA as homodimers. Recognition sequences may be continuous or may be discontinuous, for example, two half sites separated by a variable region. Cleavage can generate blunt ends or short single stranded overhangs.

In preferred aspects of the present invention enzymes that include at least one CpG dinucleotide in the recognition site may be used. Enzymes with a recognition site that includes the sequence CCGG include, for example, Msp I, Hpa II, Age I, Xma I, Sma I, NgoM IV, Nae I, and BspE I. Enzymes with a recognition site that includes the sequence CGCG include, for example, BstU I, Mlu I, Sac II, BssH II and Nru I. Enzymes with a recognition site that includes the sequence GCGC include, for example, Hin P1 I, Hha I, Afe I, Kas I, Nar I, Sfo I, Bbe I, and Fsp I. Enzymes with a recognition site that includes the sequence TCGA include, for example, Taq I, Cla I, BspD I, PaeR7 I, Tli I, Xho I, Sal I, and BstB I. For additional enzymes that contain CpG in the recognition sequence. See, for example, the New England Biolabs catalog and web site. In some aspects two restriction enzymes may have a different recognition sequence but generate identical overhangs or compatible cohesive ends. For example, the overhangs generated by cleavage with Hpa II or Msp I can be ligated to the overhang generated by cleavage with Taq I. Some restriction enzymes that include CpG in the recognition site are unable to cleave if the site is methylated, these are methylation sensitive. Other enzymes that contain CpG in their recognition site can cleave regardless of the presence of methylation, these are methylation insensitive. Examples of methylation insensitive enzymes, that include a CpG in the recognition site, include BsaW I (WCCGGW), BsoB I, BssS I, Msp I, and Taq I. Examples of methylation sensitive enzymes, that include a CpG in the recognition site, include Aat II, Aci I, Acl I, Afe I, Age I, Asc I, Ava I, BmgB I, BsaA I, BsaH I, BspD I, Eag I, Fse I, Fau I, Hpa II, HinP1 I, Nar I, and SnaB I.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

The term "tags" or "barcode tags" is used herein to refer to short nucleic acids sequence of, for example, 15 to 50 bases, that may be used to mark a molecule or mixture of interest. They are preferably part of a set of tags that function together as detectable markers that share common hybridization properties and are not found naturally in the molecule or mixture of interest. In preferred aspects tags are selected from random sequences of the same length that are not found in a genome of interest, for example, 20 mers not found in the human genome, and have similar melting temperatures from their respective tag probes which are the perfect complement of the tags. They may be designed algorithmically to maximize discrimination on a microarray displaying complements of the respective tags; a 1:1 correspondence as between tag sequence and nucleic acid to which it is appended permits each such nucleic acid to be identified by detection of the bar code uniquely associated therewith. See, e.g., Shoemaker et al., *Nature Genet.* 14(4):450-6 (1996); EP 0799897; Fan et al., *Genome Res.* 10:853-60 (2000); and U.S. Pat. No. 6,150,516, the disclosures of which are incorporated herein by reference in their entireties.

CpG Island Arrays

Mammalian methylation patterns are complex and change during development, see van Steensel and Henikoff *BioTechniques* 35: 346-357 (2003). Methylation in promoter regions is generally accompanied by gene silencing and loss of methylation or loss of the proteins that bind to the methylated CpG can lead to diseases in humans, for example, Immunodeficiency Craniofacial Syndrome and Rett Syndrome, Bestor (2000) *Hum. Mol. Genet.* 9:2395-2402. DNA methylation may be gene-specific and occurs genome-wide.

Methods for detecting methylation status have been described in, for example U.S. Pat. Nos. 6,214,556, 5,786,146, 6,017,704, 6,265,171, 6,200,756, 6,251,594, 5,912,147, 6,331,393, 6,605,432, and 6,300,071 and US Patent Application publication Nos. 20030148327, 20030148326, 20030143606, 20030082609 and 20050009059, each of which are incorporated herein by reference. Other array based methods of methylation analysis are disclosed in U.S. patent application Ser. Nos. 11/058,566 (Pg Pub 20050196792 A1) and 11/213,273 (PgPub 20060292585 A1), which are both incorporated herein by reference in their entireties. For a review of some methylation detection methods, see, Oakeley, E. J., *Pharmacology & Therapeutics* 84:389-400 (1999). Available methods include, but are not limited to: reverse-phase HPLC, thin-layer chromatography, SssI methyltransferases with incorporation of labeled methyl groups, the chloracetaldehyde reaction, differentially sensitive restriction enzymes, hydrazine or permanganate treatment (m5C is cleaved by permanganate treatment but not by hydrazine treatment), sodium bisulfite, combined bisulphate-restriction analysis, and methylation sensitive single nucleotide primer extension.

Aberrant DNA methylation at CpG islands has been proven to play an important role in the development of cancer. Genome-wide monitoring of alterations in DNA methylation patterns will lead to new insights into the early epigenetic events of tumor genesis and the discovery of biomarkers for cancer. CpG island microarrays to interrogate the vast majority of CpG islands found in the genome and methods of using CpG island microarrays are disclosed herein. The CpG island microarrays may be used for rapid screening and high-throughput, genome-wide surveys of DNA methylation status in, for example, mouse, human and rat. The array design strategy, examples of detecting DNA methylation and data analysis methods are disclosed. A promoter tiling array may also be used as a complementary method for methylation detection in human promoter regions. A promoter tiling array with over 25,000 promoters from human genes is also discussed. The microarray technology disclosed herein may be used, for example, for methylation research and biomarker discovery.

In a preferred aspect arrays containing probes that are selected to interrogate regions that are candidates for methylation and for regulation by methylation are disclosed. Some embodiments are defined with reference to the sequence listing that has been incorporated herein by reference. The sequence listing contains the sequences of 743,256 probes. Each sequence in the sequence listing represents the sequence of a probe that may be present on a CpG island array. The sequences include a plurality of experimental probe sequences and a plurality of control probe sequences. The experimental probe sequences are SEQ ID NO. 1-668,564 and the control sequences are SEQ ID NO. 668,565-743,256. Approximately 90% of the probes of the array are experimental probes with approximately 10% of the probes as control probes.

The sequence listing contains experimental and control probes for human, mouse and rat arrays. The experimental human probes are SEQ ID NO. 1-222,822. The experimental mouse probes are SEQ ID NO. 222,823-448,233. The experimental rat probes are SEQ ID NO. 448,234-668,564. The human control probes are SEQ ID NO. 668,565-693,466. The mouse control probes are SEQ ID NO. 693,467-715,779. The rat control probes are SEQ ID NO. 715,780-743,256.

In one aspect an array for analysis of methylation in humans is disclosed. The array may comprise a plurality of experimental probes selected from the probes represented by SEQ ID NO. 1-222,822. The array may further comprise control probes selected from the control probes represented by SEQ ID NO. 668,565-693,466.

In another aspect an array for analysis of methylation in rat is disclosed. The array may comprise a plurality of experimental probes selected from the probes represented by 448, 234-668,564. The array may further comprise control probes selected from the control probes represented by SEQ ID NO. 715,780-743,256.

In another aspect an array for analysis of methylation in mouse is disclosed. The array may comprise a plurality of experimental probes selected from the probes represented by SEQ ID NO. 222,823-448,233. The array may further comprise control probes selected from the control probes represented by SEQ ID NO. 693,467-715,779.

It should be understood that while the probes of an array may be selected to be perfectly complementary to the sequence of a selected organisms, for example, human, mouse or rat, that the array may be useful for hybridization to related species that share sequence homology. For example, an array designed to be complementary to human genetic material may be used to analyze a sample from another primate, for example, gorilla.

In preferred aspects the arrays contain more than 200,000 probes that are perfectly complementary to regions of the genome that are predicted to be CpG islands. The probes are preferably between 15 and 100 bases, more preferably between 20 and 50 bases and most preferably between 20 and 30 bases. In one aspect more than 90% of the probes are 25 bases in length. Probes are arranged on the array so that each different sequence is present in a distinct feature or geographical location of the array and that location is known or determinable. Not all probes within a feature area need be full length.

In some aspects CpG island arrays may vary from other arrays in the frequency of CG dinucleotides in the probes. Since the CG dinucleotide occurs at a relatively low frequency, genome arrays such as expression arrays or genotyping arrays typically have lower frequency of CG in the probes. In one aspect more than 80, 85, 90 or 95% of the probes of the array contain at least one CG dinucleotide. In preferred aspects more than 50, 60, 70 or 80% of the probes of the array contain at least two CG dinucleotides. A CG dinucleotide is a 5'-CG-3' where the G and C are contiguous in the nucleic acid chain and not separated by another nucleotide. In one aspect at least 25% of the experimental probes have at least 3 GC dinucleotides. In one aspect at least 7.5% of the experimental probes of the array have 4 or more GC dinucleotides. In preferred aspects there are more than 100,000, 250,000, 500, 000, 750,000, 1,000,000, or 2,000,000 experimental probes on the array.

In one embodiment, probes are selected for the array so that for each CpG island that is less than 5 kb the array includes a probe set of 8 probes that target that island. For islands greater than 5 kb 3 probe sets of 8 probes each were designed and included on the array. The 3 probes sets were spaced roughly so that one interrogated the 3' region of the island, one the middle and one the 5' region. If, for example, the island is of length 6 kb a first probes set may be designed to bases 1-2000, a second to bases 2001-4000 and a third to bases 4001-6000 of the island.

In one embodiment all of the probes in a probe set are selected to be within the same 1600 base pair or smaller region. This increases the likelihood that all probes in a probe set are on a common restriction fragment in a methylation assay.

In a preferred aspect, probe selection for islands that are greater than 1 kb and less than 5 kb, begins in the central 1 kb of the island. For islands greater than 5 kb, probe selection of a first probe set may start within the central 1 kb of the fragments, the 3'-most 1 kb for a second probe set and the 5'-most 1 kb for a third probe set.

In one embodiment the quality of a selected probe set may be evaluated after selection by assessing a probe set score. For those islands that have a probe set score of less than 1.44 (probe set score is 0.18×the number of probes), the probe selection region may be extended by 150 bp at either end (300 bases overall) and probe selection is repeated. All _x sets were automatically failed and failed probe sets were not rescue based on an average raw probe score. For regions that failed a second round of probe selection the region may be further extended by 150 bp on either end and probe selection can be repeated. In one embodiment probe sets that are subjected to a third round of probe selection may be allowed to have fewer probes, for example, 5-8 probes per set.

In one embodiment, during probe selection, probes may be pruned versus the repeat database 'Repbase', and pruned versus the islands themselves +/−500 bp of genomic sequence, and the *Arabidopsis* mRNA clones. This eliminates or minimizes crosshybridization to repeats, and reduces cross hybridization between islands, such that the signal detected should be specific to a given island.

In a preferred embodiment the array is a 400 format array with features that are about 5 microns by 5 microns. Increased or decreased array and feature sizes may be used, for example, array format may be 49, 100, 700 or 900 format and the feature size may be 1×1, 7×7, 11×11, or 18×18 microns. Smaller and larger feature sizes or a mixture of the above feature sizes may also be used. In a preferred aspect the 400 format arrays with 5 micron feature size have about 250,000 different features. Each feature may be a different probe. Some probes may be present in more than a single feature. In a preferred aspect plus strand perfect match probes are used. Controls may be GC matched antigenomic controls (about 2600 probes at 100 probes per bin—each bin is a different GC content). Additional controls may include, for example, *Arabidopsis* genomic controls and *Pseudomonal* genomic sequences. Controls may be selected to have GC content that is similar to the target sequences. In one aspect probes to well characterized genes that are known to be associated with cancer may be included on the array. In one aspect probes to ten or more human genes that are known to be associated with cancer may be included on the array. Probes to repetitive sequence and to 18S and 28S ribosomal RNA genes may also be included.

In one aspect probe sets are included for genes that are known to be regulated by methylation. In one aspect a set of 15 genes was selected, and the orthologs of these from each species (when available) were tiled as 40-probe (perfect match-only) sets. Probes for 14 human genes (16 CpG islands), 13 mouse (13 CpG islands), and 11 rat genes (11 CpG islands), were tiled. The gene names and the location of the CpG island associated with that gene, if any, are shown in table 1.

| Human | Mouse | Rat |
|---|---|---|
| CDKN2A chr9: 21964579-21965306 | Cdkn2a chr4: 88280326-88281746 | Cdkn2a chr5: 108916025-108916249 |
| CDKN2A chr9: 21984102-21985910 | Mgmt chr7: 131261988-131262200 | Mgmt chr1: 196779125-196779347 |
| MGMT chr10: 131154939-131155700 | Mlh1 chrX: 87947039-87947267 | Mlh1 chr8: 115672549-115673779 |
| MLH1 chr3: 37009233-37010360 | Gstp1 chr19: 3826567-3826865 | Gstp1 chr1: 206783223-206783432 |
| GSTP1 chr11: 67107505-67108529 | Brca1 chr11: 101372865-101373065 | Brca1 chr10: 90586958-90587201 |
| BRCA1 chr17: 38531661-38531986 | Cdh1 chr8: 105898932-105899662 | Cdh1 chr19: 36447500-36448076 |
| CDH1 chr16: 67328536-67329845 | Timp3 chr10: 86260784-86261356 | Timp3 chr7: 19736510-19737381 |
| TIMP3 chr22: 31521935-31522821 | Dapk1 chr13: 59260184-59261075 | Dapk1 chr17: 9778756-9779643 |
| DAPK1 chr9: 87342069-87343371 | Rassf1 chr9: 107619881-107620907 | Rassf1 chr8: 112821629-112822624 |
| RASSF1 chr3: 50349269-50350633 | Thbs1 No CpG Island | Thbs1 No CpG island |
| RASSF1 chr3: 50352808-50353544 | Rarb chr14: 15071137-15071693 | Rarb chr15_random: 195605-195857 |
| THBS1 chr15: 37659820-37660859 | Trp73 chr4: 152632046-152632968 | |
| RARB No CpG Island | Stk11 chr10: 80238679-80240278 | |
| TP73 chr1: 3589603-3592793 | Apc chr18: 34443822-34444584 | |

In a preferred aspect the arrays are used to analyze a sample that has been treated to differentiate between methylated and unmethylated sequences. Methylation is an epigenetic modification of DNA and information about methylation is typically lost during most methods of nucleic acid amplification such as PCR, random or semi-random priming based amplification, or locus specific primer extension based amplification. To identify regions that were methylated in a starting sample methods, such as the method shown in FIG. 1, may be used that enrich for methylated sequences relative to unmethylated prior to or during amplification, and those enriched sequences may be detected by hybridization to an array such as those arrays disclosed herein.

In FIG. 1 the genomic DNA 101 with methylation sites 103 marked by an (*) is fragmented in step 105, for example, by restriction digestion, shearing, nebulization, sonication, or endonuclease treatment. A mixture 107 of methylated (marked with *) and unmethylated fragments is obtained. Aliquots of the mixture 107 may be treated differentially in steps 109 and 111 to enrich for methylated fragments in step 109 or unmethylated fragments in step 111. Step 109 generates a sample 113 that is enriched for unmethylated fragments and step 111 generates a sample 115 that is enriched for methylated fragments. The enriched fragments are amplified in steps 117 and 119 to generate amplified samples 121 and 123. Amplification does not preserve methylation but amplification product 121 is enriched for sequences that were not methylated in 101 and amplification product 123 is enriched for sequences that were methylated in 101. The enriched amplification products may be analyzed in steps 125 and 127 respectively by hybridization to arrays 129 and 131. In a preferred aspect arrays 129 and 131 are arrays where more than 50, 60, 70, 80 or 90% of the probes on the array are complementary to a region that contains at least one CpG dinucleotide.

Alternatively methods that enrich for regions that are unmethylated relative to regions that are methylated may also be used. Methods for separation of methylated from unmethylated nucleic acids have been described, see, for example, US Patent Publication Nos. 20010046669, 20030157546, and 20030180775 which are each incorporated herein by reference in their entireties.

Figure 2:
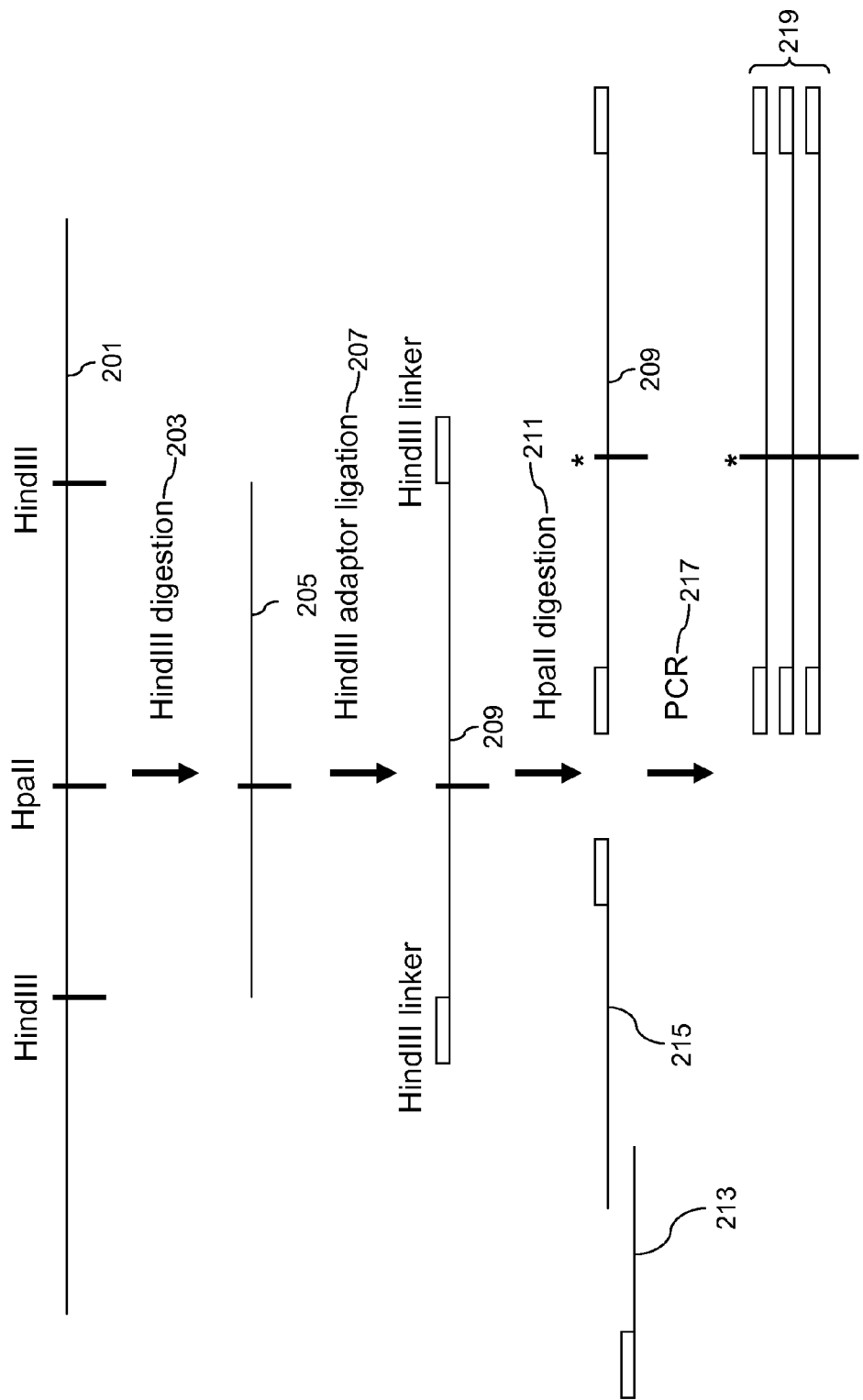
FIG. 2 is a schematic representation illustrating a method for enriching for DNA that is methylated.

In a particularly preferred aspect, illustrated schematically in FIG. 2, a genomic sample 201 is fragmented in step 203 by a method that is not sensitive to methylation, HindIII digestion, for example. The fragments 205 are ligated with adaptors in step 207, the adaptor ligated fragments 209 are fragmented in step 211 using a method that is sensitive to methylation, for example HpaII digestion. If the HpaII site is methylated (indicated by an *) the site is resistant to cleavage by HpaII and fragment 209 remains intact. If the HpaII site is unmethylated it is cleaved to form fragments 213 and 213 which have adaptors on only one end. In a subsequent amplification step 217 only the intact adaptor ligated fragments are amplified to form amplicons 219 and the sample is amplified by PCR using primers to the adaptor sequences, see FIG. 2. See also, Huang et al., *Hum. Mol. Genet.* 8:459-470 (1999), Yan et al., Clin. Cancer Res. 6:1432-8 (2000) and U.S. Pat. No. 6,605,432. For an explanation CpG islands and methods of analysis of methylation using microarray methods see, *Promoter and CpG Island Microarrays*, Winegarden and Takashi (eds.) DNA Press (2005).

In some embodiments the methods include treatment of the sample with bisulfite. Unmethylated cytosine is converted to uracil through a three-step process during sodium bisulfite modification. The steps are sulphonation to convert cytosine to cytosine sulphonate, deamination to convert cytosine sulphonate to uracil sulphonate and alkali desulphonation to convert uracil sulphonate to uracil. Conversion on methylated cytosine is much slower and is not observed at significant levels in a 4-16 hour reaction. See Clark et al., *Nucleic Acids Res.*, 22(15):2990-7 (1994). If the cytosine is methylated it will remain a cytosine. If the cytosine is unmethylated it will be converted to uracil. When the modified strand is copied, through, for example, extension of a locus specific primer, a random or degenerate primer or a primer to an adaptor, a G will be incorporated in the interrogation position (opposite the C being interrogated) if the C was methylated and an A will be incorporated in the interrogation position if the C was unmethylated. When the double stranded extension product is amplified those Cs that were converted to U's and resulted in incorporation of A in the extended primer will be replaced by Ts during amplification. Those Cs that were not modified and resulted in the incorporation of G will remain as C.

Kits for DNA bisulfite modification are commercially available from, for example, Human Genetic Signatures' Methyleasy and Chemicon's CpGenome Modification Kit. See also, WO04096825A1, which describes bisulfite modification methods and Olek et al. *Nuc. Acids Res.* 24:5064-6 (1994), which discloses methods of performing bisulfite treatment and subsequent amplification on material embedded in agarose beads.

Bisulfite treatment allows the methylation status of cytosines to be detected by a variety of methods. For example, any method that may be used to detect a SNP may be used, for examples, see Syvanen, *Nature Rev. Gen.* 2:930-942 (2001). Methods such as single base extension (SBE) may be used or hybridization of sequence specific probes similar to allele specific hybridization methods. In another aspect the Molecular Inversion Probe (MIP) assay may be used.

The following Examples are offered by way of illustration only, and not by way of limitation.

EXAMPLE 1

Human CpG island array. Sequences used in the design of the Human CpG Island Array were selected from NCBI human genome assembly (Build 35, UCSC hg17, May 2004). Repetitive elements were removed by RepeatMasker. There are total of 27,801 CpG islands annotated by UCSC in NCBI human genome assembly, as defined by an algorithm that measures expected versus observed CpG composition, given the GC content of the segment. CpG islands were also filtered for GC content 50% or greater and length greater than 200 bp. For a majority of the CpG islands, 8 probes were selected as a probe set to represent each island. For the islands larger than 5 kb, three probe sets (8 probes each) were selected.

The 27,801 islands represent an initial set of 27,771 that was identified in a first analysis. This first analysis missed 30 islands on random chr2 and random chr10. These 30 were subsequently processed and added to the total to obtain 27,801. Of the initial 27,771 the size distribution was as follows: 5394 less than 300 bp, about 16,000 between 300 and 1,000 bp, 5064 between 100 and 2000 bp, 1237 greater than 2 kb and 177 greater than 5 kb. For the 177 islands that were greater than 5 kb probe sets were designed and included on the array for each of the 3', middle and 5' probe selection regions (PSRs) (3 distinct 8 probe sets for each island).

For the 27,771 islands there were 28,125 PSRs (27771+ 177+177). 988 PSRs failed round 1 and the failed PSRs were extended at either end by 150 bp and probe sets were re-selected in round 2. 261 PSRs failed round 2 and were extended by a further 150 bp at either end and probe sets were re-selected in a round 3. 155 PSRs failed round 3. Of these 49 had probe set scores below a cutoff threshold and 106 had no probes selected at all. Of the 106 failed islands 62 were from 5 satellite repeat regions on chromosomes 4, 7(2) and 19(2). These satellites are not likely to play a role in gene expression. The 30 islands from random chr2 and random chr10 all passed probe selection in the first round.

The 27,771 islands were analyzed by in silico restriction fragment prediction. Exemplary results are shown in Table 2. Column 1 is sequence id, column 2 is sequence length, column 3 is CpG island length, column 4 is first position of cut site i, column 5 is sequence of cut site i, column 6 is first position of cut site i+1, column 7 is sequence of cut site i+1, column 8 is length of restriction fragment generated, column 9 is number of CpG's with the fragment, column 10 indicates where the i and i+1 cut sites are relative to the cpg island: where "l" indicates left of the CpG island, "i" indicates internal (within the island) and "r" indicates right of the CpG island (the first letter denotes site i and the second letter denotes site i+1), column 11 denotes the probe set name and column 12 is the number of probes found entirely within the fragment (for the 27771 islands).

TABLE 2

| 1 | 2 | 3 | 4 | 5 | 6 | 7 | 8 | 9 | 10 | 11 | 12 |
|---|---|---|---|---|---|---|---|---|---|---|---|
| chr10_0 | 2774 | 774 | 717 | aatt | 1954 | aatt | 1258 | 78 | lr | CpG.1.1.S1 | 8 |
| chr10_1 | 2552 | 552 | 835 | aatt | 1604 | aatt | 790 | 69 | lr | CpG.2.1.S1 | 8 |
| chr10_10 | 2284 | 284 | 959 | aatt | 1533 | aatt | 595 | 35 | lr | CpG.3.1.S1 | 8 |
| chr10_100 | 2237 | 237 | 790 | aatt | 1395 | aatt | 626 | 23 | lr | CpG.4.1.S1 | 8 |
| chr10_1000 | 3149 | 1149 | 593 | aatt | 1938 | aatt | 1366 | 137 | li | CpG.5.1.S1 | 6 |
| chr10_1000 | 3149 | 1149 | 1959 | aatt | 2722 | aatt | 784 | 29 | ir | CpG.5.1.S1 | 2 |
| chr10_1001 | 2249 | 249 | 247 | aatt | 1395 | aatt | 1169 | 52 | lr | CpG.6.1.S1 | 8 |
| chr10_1002 | 2414 | 414 | 104 | aatt | 1931 | aatt | 1848 | 84 | lr | CpG.7.1.S1 | 8 |
| chr10_1003 | 2461 | 461 | 839 | aatt | 2014 | aatt | 1196 | 62 | lr | CpG.8.1.S1 | 8 |
| chr10_1004 | 2351 | 351 | 663 | aatt | 1409 | aatt | 767 | 44 | lr | CpG.9.1.S1 | 8 |
| chr10_1005 | 2313 | 313 | 728 | aatt | 1344 | aatt | 637 | 50 | lr | CpG.10.1.S1 | 7 |
| chr10_1005 | 2313 | 313 | 1383 | aatt | 1441 | aatt | 79 | 0 | rr | CpG.10.1.S1 | 1 |
| chr10_1007 | 4587 | 2587 | 965 | aatt | 4382 | aatt | 3438 | 302 | lr | CpG.12.1.S1 | 8 |
| chr10_1008 | 2300 | 300 | 485 | aatt | 2069 | aatt | 1605 | 73 | lr | CpG.13.1.S1 | 8 |
| chr10_101 | 2231 | 231 | 944 | aatt | 1522 | aatt | 599 | 33 | lr | CpG.15.1.S1 | 8 |
| chr10_1012 | 2221 | 221 | 1136 | aatt | 1452 | aatt | 337 | 18 | ir | CpG.18.1.S1 | 4 |
| chr10_1015 | 2928 | 928 | 825 | aatt | 1059 | aatt | 255 | 10 | li | CpG.21.1.S1 | 1 |
| chr10_1015 | 2928 | 928 | 1080 | aatt | 2135 | aatt | 1076 | 102 | ir | CpG.21.1.S1 | 7 |
| chr10_1017 | 3688 | 1688 | 1191 | aatt | 2764 | aatt | 1594 | 229 | ir | CpG.23.1.S1 | 8 |

EXAMPLE 2

Human Promoter 1.0R array. Sequences used in the design of the Human Promoter 1.0R Array were selected from NCBI human genome assembly (Build 34). Repetitive elements were removed by RepeatMasker. Promoter regions were selected using sequence information from 35,685 ENSEMBL genes (version 21_34d May 14, 2004), 25,172 Refseq mRNAs (NCBI GENBANK Feb. 7, 2004), and 47,062 complete-CDS mRNA (NCBI GENBANK Dec. 15, 2003). The probes selected for the Human Promoter 1.0R Array are a subset of the probes used in the Human Tiling 2.0R Array Set (P/N 900772).

Oligonucleotide probes are synthesized in situ complementary to each corresponding sequence. Probes are tiled at an average resolution of 35 bp, as measured from the central position of adjacent 25-mer probes, leaving a gap of approximately 10 bp between probes. Each promoter region covers approximately 7.5 kb upstream through 2.45 kb downstream of 5' transcription start sites. For over 1,300 cancer-associated genes, coverage of promoter regions was expanded to include additional genomic content; for these selected genes total coverage spans from 10 kb upstream through 2.45 kb downstream of transcriptional start sites. The array interrogates regions proximal to transcription start sites and contains probes for approximately 59% of CpG islands annotated by UCSC in NCBI human genome assembly (Build 34).

EXAMPLE 3

To test the method of enrichment of methylated fragments in a sample and detection of enrichment on an array a set of *Arabidopsis* genomic controls was used in combination with a CpG island array that contains probes to the *Arabidopsis* controls. The general scheme is as shown in FIG. 2. Briefly, control DNAs that are either methylated or unmethylated were fragmented with HindIII and ligated to a HindIII adaptor sequence. The adaptor ligated fragments were then digested with HpaII which is a methylation sensitive restriction enzyme. Unmethylated fragments are fragmented while methylated fragments are not. Fragmentation of the unmethylated fragments blocks PCR amplification using a primer to the adaptor so only the fragments that were methylated at the HpaII site and were not digested by HpaII will be amplified by PCR.

Figure 3B:
FIG. 3B is an image of a gel showing the results of in vitro HpaII methylation of *Arabidopsis* genomic clones followed by digestion with HpaII restriction enzyme.
Figure 3A:
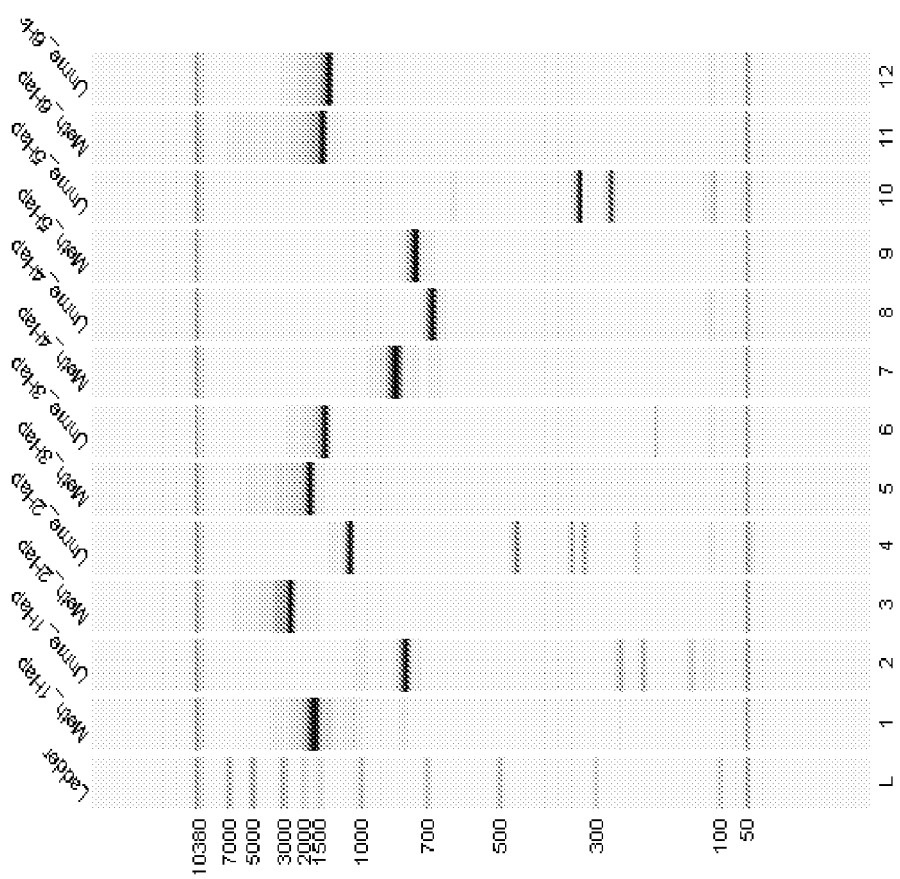
FIG. 3A is an image of a gel showing the results of in vitro HpaII methylation of *Arabidopsis* genomic clones followed by digestion with HpaII restriction enzyme.

Seven different control DNAs, Ara1, Ara2, Ara6, Ara7, Ara8, Ara9, and Ara10 were used. The controls are each a different clone of an *Arabidopsis* genomic DNA region cloned into plasmid pFC47 (Affymetrix). Inserts were confirmed by resequencing. The clones were either methylated by treatment with HpaII methylase (New England Biolabs) or are unmethylated. FIG. 3 shows confirmation of methylation by digestion of the methylated (odd numbered lanes) and unmethylated (even numbered lanes) controls with HpaII. As expected the methylated fragments (lanes 1, 3, 5, 7, 9, and 11 in 3A and 1, 3, 5 and 7 in 3B) are resistant to fragmentation by HpaII and the unmethylated fragments (lanes 2, 4, 6, 8, 10 and 12 in 3A and 2, 4, 6 and 8 in 3B) are not.

Figure 4:
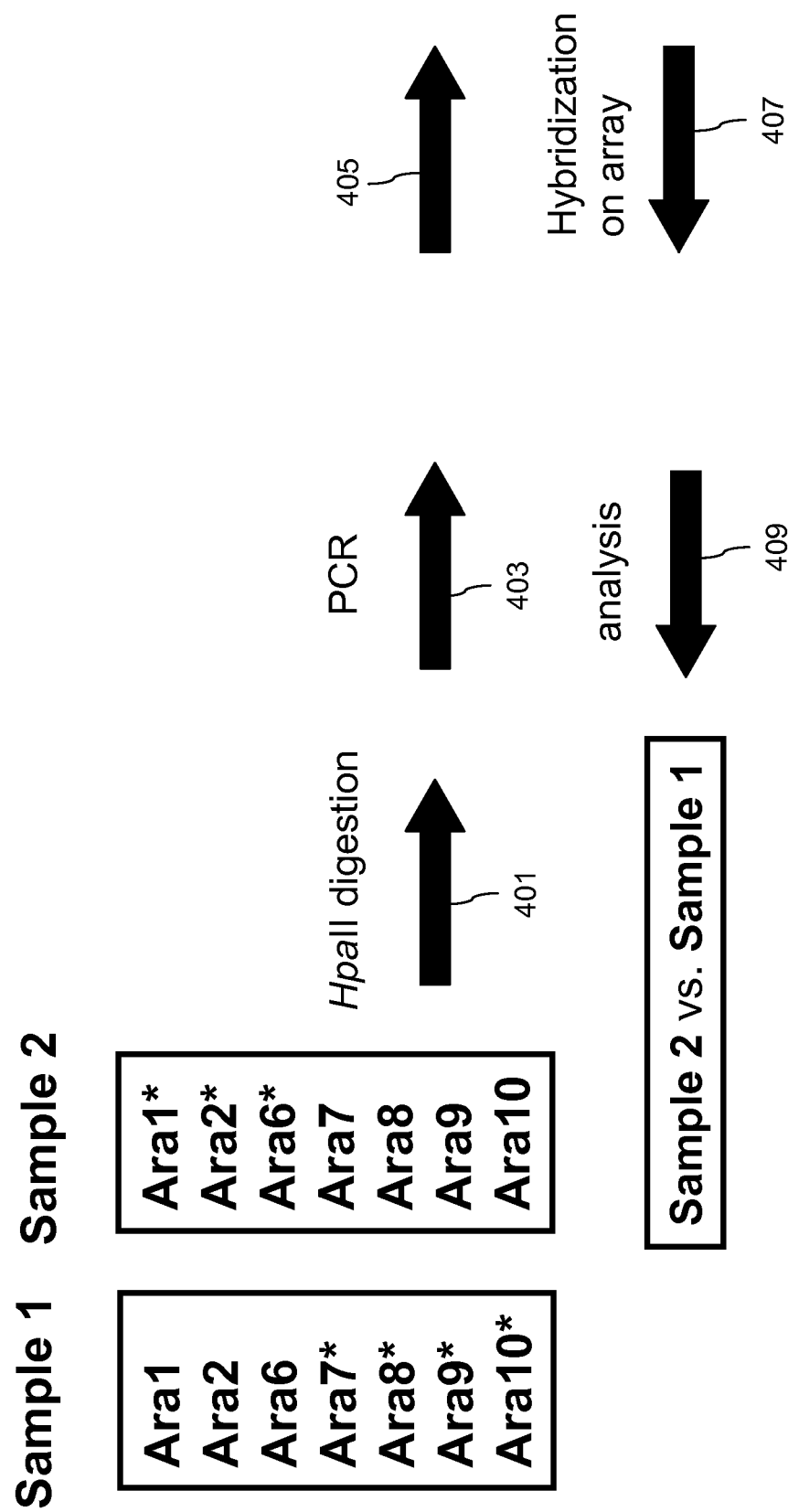
FIG. 4 is a schematic of an experiment to detect methylated DNA enriched according to the method illustrated in FIG. 2 using hybridization to an array.

Enrichment of methylated fragments in spiked samples. FIG. 4 shows the experimental design. Samples 1 and 2 are mixtures of the 7 control DNAs discussed above. In Sample 1 DNAs Ara 1, 2 and 6 are unmethylated and Ara7, 8, 9 and 10 are methylated using HpaII methylase. In Sample 2 DNAs Ara1, 2 and 6 are methylated using HpaII methylase and Ara7, 8, 9 and 10 are unmethylated. The fragments are digested with HpaII restriction enzyme in step 401 and subjected to PCR amplification in step 403 using common flanking priming sites present in pFC47, and common primers "458" and "428". The PCR amplicons were mixed with a complex background and the mixture was fragmented and labeled in step 405, hybridized to an array in step 407 and analyzed in step 409. The results for sample 2 were then compared to the results from sample 1.

Figure 5:
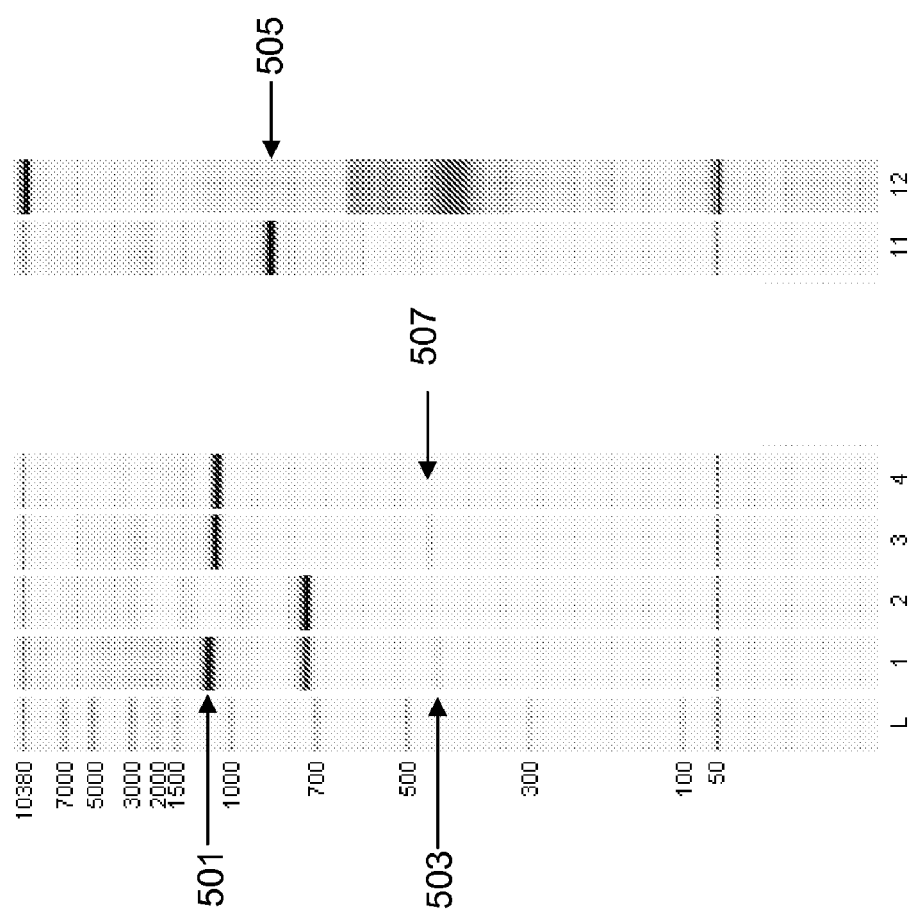
FIG. 5 is an image of a gel showing PCR amplicons of methylated and unmethylated control fragments amplified following digestion with HpaII.

An aliquot of the PCR amplicons for Ara2, 3 and 9 were separated on a gel shown in FIG. 5. Lane L is a ladder, lanes 1 and 2 are methylated and unmethylated Ara2, respectively, lanes 3 and 4 are methylated and unmethylated Ara3 and lanes 11 and 12 are methylated and unmethylated Ara9. The position of the HpaII containing fragment amplicon (501, 503, 505 and 507) are marked by arrows. The gel shows that after HpaII digestion the fragments are observed only in the methylated samples, lanes 1, 3 and 11 and not in the unmethylated samples, lanes 2, 4 and 12.

The PCR amplicons were mixed with 18 micrograms of human genomic DNA, fragmented and end labeled using DLR and TdT. Triplicate samples were generated. Approximately 1 pM of each methylated or unmethylated Ara genomic clone was used in a final 80 µl hybridization solution. The labeled, fragmented samples were hybridized to the CpG island array and the hybridization pattern was analyzed to compare Sample 1 to Sample 2. The arrays were hybridized in 1×MES, 0.7 M NaCl, 20 mM EDTA, 0.01% Tween 20, 2.5× Denhart's solution, 20 µg Cot DNA, 10% DMSO, and 40 pM oligo B2 at 45° C. for 16 hours. The arrays were washed with Affymetrix fluidics station using protocol FS450-0003 and scanned using the Affymetrix GCS3000. Cel files were generated using GCOS. Tiling Analysis Software (TAS) was used to obtain the signal intensities and p-value of pair wise comparison. Integrated Genome Browser (IGB) was applied to display and view differential signal intensities of the probes with genome location annotation.

As expected enrichment of HpaII containing fragments of Ara7, 8, 9 and 10 was observed in Sample 1 relative to Sample 2 and enrichment of HpaII containing fragments of Ara1, 2 and 6 was observed in Sample 2 relative to Sample 1. Methylated fragments were enriched relative to unmethylated fragments.

EXAMPLE 4

Mouse CpG island array. For the mouse array the data source was UCSC mm6 (March 2005). Initially 16,100 islands were identified, 5 of which were greater than or equal to 5 kb, for each of these 5 islands 3 probe sets (3', middle, and 5' PSRs) were designed and included on the array. For the other 16,095 islands a single probe set was included on the array. The total number of island PSRs used for probe selection in the first rounds was 16,110 (16,100+5+5).

During probe selection, the information was hard pruned versus the repeat database 'Repbase', and soft-pruned versus the islands themselves +/−500 bp of genomic sequence to eliminate cross-hybridization to repeats, and to reduce cross-hybridization between islands so that the signal detected is specific to a given island.

414 PSRs failed round 1, and were extended by 150 bp at either end, and subjected to a reselection of probe sets in a round 2 of probe selection. 98 PSRs failed round 2, and were subsequently extended by a further 150 bp at each end and subject to a $3^{rd}$ round of probe selection. 56 PSRs failed round 3. Of these, 26 had probe set scores below a threshold cutoff, and 30 had no probes picked at all. The 26 were included in the final array design, but the 30 were not. The array design resulted in 223,689 probes.

EXAMPLE 5

Rat CpG island array. Probe selection started using 15832 islands, of which 10 were greater than or equal to 5 kb. The 10 large islands were each divided into 3 regions for probe selection designated 3', Middle and 5' PSRs. In all there were 15,852 PSRs in the first round (15832+10+10).

During probe selection, the sequences were hard pruned versus the repeat database 'Repbase', and soft-pruned versus the islands themselves +/−500 bp of genomic sequence. The intent was to eliminate cross-hybridization to repeats, and to reduce cross-hybridization between islands, such that the signal detected would be specific to a given island, as discussed above.

535 PSRs failed round 1, and were extended by 150 bp at either end, and probe sets were re-selected in a round 2. 269 PSRs failed round 2, and were extended by a further 150 bp at either end, and probe sets were re-selected in a round 3. 189 PSRs failed round 3. Of these, 55 had probe set scores below a threshold cutoff, and 134 had no probes picked at all. The 55 were included in the final array design, but the 134 were not. The rat array design resulted in 218,637 probes.

CONCLUSION

All patents, patent publications, and other published references mentioned herein are hereby incorporated by reference in their entireties as if each had been individually and specifically incorporated by reference herein. While preferred illustrative embodiments of the present invention are described, one skilled in the art will appreciate that the present invention may be practiced by other than the described embodiments, which are presented for purposes of illustration only and not by way of limitation. The present invention is limited only by the claims that follow.

SEQUENCE LISTING (743256 sequences)

SEQ ID NO: 1 - DNA, 25 bp, Homo sapien
gaggatgaccttagcacactcctgg

SEQ ID NO: 2 - DNA, 25 bp, Homo sapien
catctgttggaaagctcaggtgtcc

SEQ ID NO: 3 - DNA, 25 bp, Homo sapien
cgctgaacatctgttggaaagctca

SEQ ID NO: 4 - DNA, 25 bp, Homo sapien
ccctggcgctgaacatctgttggaa

SEQ ID NO: 5 - DNA, 25 bp, Homo sapien
tccgcctcggattcggctcccagaa

SEQ ID NO: 6 - DNA, 25 bp, Homo sapien
gaccttagcacactcctggattttg

SEQ ID NO: 7 - DNA, 25 bp, Homo sapien
gttcccagaggatgaccttagcaca

SEQ ID NO: 8 - DNA, 25 bp, Homo sapien
ttaggacggcaggagaaacgtgaga

SEQ ID NO: 9 - DNA, 25 bp, Homo sapien
ggcgtgtgcttagtaggaatcagtc

SEQ ID NO: 10 - DNA, 25 bp, Homo sapien
actgaaaccggtggagctgctctac

SEQ ID NO: 11 - DNA, 25 bp, Homo sapien
ggagctgctctaccacttacacaac

SEQ ID NO: 12 - DNA, 25 bp, Homo sapien
ccgcaggagcgggacaagctgttaa

SEQ ID NO: 13 - DNA, 25 bp, Homo sapien
caagctgttaagattccggaagcaa

SEQ ID NO: 14 - DNA, 25 bp, Homo sapien
agcacaccggcacgtgcggagagta

SEQ ID NO: 15 - DNA, 25 bp, Homo sapien
ctgtgaaatgaccaaaataggaccc

SEQ ID NO: 16 - DNA, 25 bp, Homo sapien
tcccaaggtaaggaacagcacaccg

SEQ ID NO: 17 - DNA, 25 bp, Homo sapien
ggcactacgcagcatcccggagccc

SEQ ID NO: 18 - DNA, 25 bp, Homo sapien
acaccgagcagtccctggtttctgc

SEQ ID NO: 19 - DNA, 25 bp, Homo sapien
aggcacacaccgagcagtccctggt

SEQ ID NO: 20 - DNA, 25 bp, Homo sapien
acccgaggaggcacacaccgagcag

SEQ ID NO: 21 - DNA, 25 bp, Homo sapien
gtggccctgttctgccctggaccgc

SEQ ID NO: 22 - DNA, 25 bp, Homo sapien
agggcccacggcactacgcagcatc

SEQ ID NO: 23 - DNA, 25 bp, Homo sapien
tcagcctcactgagcggccaccatc

SEQ ID NO: 24 - DNA, 25 bp, Homo sapien
gaaagtcctgcctccacagacaccc

SEQ ID NO: 25 - DNA, 25 bp, Homo sapien
cagtgcactaactggcagggccgta

SEQ ID NO: 26 - DNA, 25 bp, Homo sapien
cagagcagagcaccaaagcggcaac

SEQ ID NO: 27 - DNA, 25 bp, Homo sapien
gctcagccctccagagcgcgggagt

SEQ ID NO: 28 - DNA, 25 bp, Homo sapien
gcagtaatccgggtccgctgcggaa

SEQ ID NO: 29 - DNA, 25 bp, Homo sapien
ccgctgcggaattggatttactttt

SEQ ID NO: 30 - DNA, 25 bp, Homo sapien
ttgttacaatcctcagcagcgcccg

SEQ ID NO: 31 - DNA, 25 bp, Homo sapien
cgccctgcggctccttgaggaaggc

SEQ ID NO: 32 - DNA, 25 bp, Homo sapien
ttgccgaccagaccgtgatccagac

SEQ ID NO: 33 - DNA, 25 bp, Homo sapien
acgcgctcccaaacaatgctcgttg

SEQ ID NO: 34 - DNA, 25 bp, Homo sapien
atttgagaccaacgggaaacgcgct

SEQ ID NO: 35 - DNA, 25 bp, Homo sapien
agacgcgagcagtggggaaataatt

SEQ ID NO: 36 - DNA, 25 bp, Homo sapien
aagggctcagccctgcagacgcgag

SEQ ID NO: 37 - DNA, 25 bp, Homo sapien
cgccgcgtgcaaagcgagccagaca

SEQ ID NO: 38 - DNA, 25 bp, Homo sapien
gcccgctttacagatcttgtcgctc

SEQ ID NO: 39 - DNA, 25 bp, Homo sapien
agcacgtgcaccgagcctggagcgc

SEQ ID NO: 40 - DNA, 25 bp, Homo sapien
ccatacgccggcagacaatggggcg

SEQ ID NO: 41 - DNA, 25 bp, Homo sapien
gaatgaacgacccaatgcactgacg

SEQ ID NO: 42 - DNA, 25 bp, Homo sapien
gtgaccttggggatgtccccgccca

SEQ ID NO: 43 - DNA, 25 bp, Homo sapien
ccaaggcacaggcgcggtgaccttg

SEQ ID NO: 44 - DNA, 25 bp, Homo sapien
agccttggttctaggccaaggcaca

SEQ ID NO: 45 - DNA, 25 bp, Homo sapien
ccgcggcctgaagccttggttctag

SEQ ID NO: 46 - DNA, 25 bp, Homo sapien
aacgacccaatgcactgacggatga

SEQ ID NO: 47 - DNA, 25 bp, Homo sapien
atggaaggaactcacagattccttg

SEQ ID NO: 48 - DNA, 25 bp, Homo sapien
tgacggatgaatggacaggcggcca

SEQ ID NO: 49 - DNA, 25 bp, Homo sapien
actctgctctgtgcactggccgcag

SEQ ID NO: 50 - DNA, 25 bp, Homo sapien
tgccatgtgggtcactctgctctgt

SEQ ID NO: 51 - DNA, 25 bp, Homo sapien
acatgtgcgtctcggcaggcccaga

SEQ ID NO: 52 - DNA, 25 bp, Homo sapien
acgtgctgtttgacatgtgcgtctc

SEQ ID NO: 53 - DNA, 25 bp, Homo sapien
tgtcctcagtacaacgtgctgtttg

SEQ ID NO: 54 - DNA, 25 bp, Homo sapien
acctgggcgtctgtcctcagtacaa

SEQ ID NO: 55 - DNA, 25 bp, Homo sapien
ccgtggacgagcacgtctggttcta

SEQ ID NO: 56 - DNA, 25 bp, Homo sapien
acgtctggttctatgggcggctgaa

SEQ ID NO: 57 - DNA, 25 bp, Homo sapien
agaccctggtgagtctactgccgcg

SEQ ID NO: 58 - DNA, 25 bp, Homo sapien
tccgccgcggacaagaccctggtga

SEQ ID NO: 59 - DNA, 25 bp, Homo sapien
acaagaccctggtgagtctactgcc

SEQ ID NO: 60 - DNA, 25 bp, Homo sapien
cctggtgagtctactgccgcgggct

SEQ ID NO: 61 - DNA, 25 bp, Homo sapien
ggagcagccccatcatgccgaggga

SEQ ID NO: 62 - DNA, 25 bp, Homo sapien
atgcgaaggagcgggacaccatgaa

SEQ ID NO: 63 - DNA, 25 bp, Homo sapien
aggagcgggacaccatgaaggagga

SEQ ID NO: 64 - DNA, 25 bp, Homo sapien
gccgcggacaagaccctggtgagtc

SEQ ID NO: 65 - DNA, 25 bp, Homo sapien
tctgctactccattgcacaaacggg

SEQ ID NO: 66 - DNA, 25 bp, Homo sapien
aggcggcacctctgctactccattg

SEQ ID NO: 67 - DNA, 25 bp, Homo sapien
ctctggaggcggcacctctgctact

SEQ ID NO: 68 - DNA, 25 bp, Homo sapien
aagctatcgccacgatttggggagg

SEQ ID NO: 69 - DNA, 25 bp, Homo sapien
cccggcggaagctatcgccacgatt

SEQ ID NO: 70 - DNA, 25 bp, Homo sapien
cccggccagttccattctcaccacg

SEQ ID NO: 71 - DNA, 25 bp, Homo sapien
cccgccgagcgtaccaggccaggcc

SEQ ID NO: 72 - DNA, 25 bp, Homo sapien
ctactccattgcacaaacggggaaa

SEQ ID NO: 73 - DNA, 25 bp, Homo sapien
tgtttacccacgtgatgcgctgccc

SEQ ID NO: 74 - DNA, 25 bp, Homo sapien
tgcgctccacgtgcgccgtgtttac

SEQ ID NO: 75 - DNA, 25 bp, Homo sapien
tgagcggcccgcaccgcaaaaggcg

SEQ ID NO: 76 - DNA, 25 bp, Homo sapien
gcctggcaatgcacaggggctctta

SEQ ID NO: 77 - DNA, 25 bp, Homo sapien
tggctgtacgtaggtgctctgagaa

SEQ ID NO: 78 - DNA, 25 bp, Homo sapien
acggggtctgtagttcaactgtgcc

SEQ ID NO: 79 - DNA, 25 bp, Homo sapien
ttcaactgtgccgtggcgtcttctt

SEQ ID NO: 80 - DNA, 25 bp, Homo sapien
cgagatctgagtgcctcgcagcagc

SEQ ID NO: 81 - DNA, 25 bp, Homo sapien
ttttagcttcttgaaggctacgatg

SEQ ID NO: 82 - DNA, 25 bp, Homo sapien
taggcagcctgactccaggccaagg

SEQ ID NO: 83 - DNA, 25 bp, Homo sapien
gccgaggaggtcattctttttagtg

SEQ ID NO: 84 - DNA, 25 bp, Homo sapien
ctttttagtgggctgtacagcgtcc

SEQ ID NO: 85 - DNA, 25 bp, Homo sapien
gcgtccaccgcgaggcactttattt

SEQ ID NO: 86 - DNA, 25 bp, Homo sapien
cgcgaggcactttatttttagcttc

SEQ ID NO: 87 - DNA, 25 bp, Homo sapien
gtgccttcgctgatgagcctgaggc

SEQ ID NO: 88 - DNA, 25 bp, Homo sapien
aaggctacgatggagccgcctcctc

SEQ ID NO: 89 - DNA, 25 bp, Homo sapien
tcggcttctcccagcagaaaccgag

SEQ ID NO: 90 - DNA, 25 bp, Homo sapien
acacagggcagggtcgcgctctgcc

SEQ ID NO: 91 - DNA, 25 bp, Homo sapien
tccaggtcagcatcctcagggctcg

SEQ ID NO: 92 - DNA, 25 bp, Homo sapien
catcctcagggctcgcgtgggtgac

SEQ ID NO: 93 - DNA, 25 bp, Homo sapien
gccaatcagtccttcctgagcagcg

SEQ ID NO: 94 - DNA, 25 bp, Homo sapien
cggccgctcgatcgcaaagcgtctg

SEQ ID NO: 95 - DNA, 25 bp, Homo sapien
gctttgctcggcttctcccagcaga

SEQ ID NO: 96 - DNA, 25 bp, Homo sapien
cgcaaagcgtctgctgccatctggt

SEQ ID NO: 97 - DNA, 25 bp, Homo sapien
acctggagtgcggtggtccaatctc

SEQ ID NO: 98 - DNA, 25 bp, Homo sapien
cccaacctggagtgcggtggtccaa

SEQ ID NO: 99 - DNA, 25 bp, Homo sapien
ccaacctggagtgcggtggtccaat

SEQ ID NO: 100 - DNA, 25 bp, Homo sapien
caacctggagtgcggtggtccaatc

SEQ ID NO: 101 - DNA, 25 bp, Homo sapien
aacctggagtgcggtggtccaatct

SEQ ID NO: 102 - DNA, 25 bp, Homo sapien
agccacgcggttcgcatcaagcgca

SEQ ID NO: 103 - DNA, 25 bp, Homo sapien
acatgcacgtgtgagatgcggcagc

SEQ ID NO: 104 - DNA, 25 bp, Homo sapien
gttcaggactcacacgccgcgctga

SEQ ID NO: 105 - DNA, 25 bp, Homo sapien
agcaggaaaaggtaactagcagccc

SEQ ID NO: 106 - DNA, 25 bp, Homo sapien
gggataaacttttgtcacgtgcttc

SEQ ID NO: 107 - DNA, 25 bp, Homo sapien
gttgtctttgtctgcagccctttga

SEQ ID NO: 108 - DNA, 25 bp, Homo sapien
agccctttgacttcgcagcggagtg

SEQ ID NO: 109 - DNA, 25 bp, Homo sapien
cagcacgctgtcaacggaagcgttc

SEQ ID NO: 110 - DNA, 25 bp, Homo sapien
cggtggaactgtcccgagctactct

SEQ ID NO: 111 - DNA, 25 bp, Homo sapien
cggaagtcccaaaccgcagccttgg

SEQ ID NO: 112 - DNA, 25 bp, Homo sapien
tcagccctttaggagccctgcaggc

SEQ ID NO: 113 - DNA, 25 bp, Homo sapien
tgcgcaggaggattctaggccttcc

SEQ ID NO: 114 - DNA, 25 bp, Homo sapien
ttgtgttaaaatccggcgaactctc

SEQ ID NO: 115 - DNA, 25 bp, Homo sapien
tgcctttgattacgagctctgctcc

SEQ ID NO: 116 - DNA, 25 bp, Homo sapien
aggccgacatcaggcttccacttta

SEQ ID NO: 117 - DNA, 25 bp, Homo sapien
ggccaccctgttctgaagatgtaga

SEQ ID NO: 118 - DNA, 25 bp, Homo sapien
ttggcctccgatgagcgcgctgtct

SEQ ID NO: 119 - DNA, 25 bp, Homo sapien
cctgcccggccgtctgcggggctca

SEQ ID NO: 120 - DNA, 25 bp, Homo sapien
gatgagcgcgctgtctctgcccggt

SEQ ID NO: 121 - DNA, 25 bp, Homo sapien
cccggccacgcaaagccgtggcagc

SEQ ID NO: 122 - DNA, 25 bp, Homo sapien
cctcccgagacgcacgggctccgag

SEQ ID NO: 123 - DNA, 25 bp, Homo sapien
tccgaggccgcagaagccttgggcc

SEQ ID NO: 124 - DNA, 25 bp, Homo sapien
cagaccggccagacaccgccaggga

SEQ ID NO: 125 - DNA, 25 bp, Homo sapien
catgcagagggcgtcggcgccgaca

SEQ ID NO: 126 - DNA, 25 bp, Homo sapien
tgactgattcttcgcgtcccgctgt

SEQ ID NO: 127 - DNA, 25 bp, Homo sapien
atcgcggcgattggcaacataactg

SEQ ID NO: 128 - DNA, 25 bp, Homo sapien
taaatacgccacaaggttacagcgc

SEQ ID NO: 129 - DNA, 25 bp, Homo sapien
ttacagcgcggatcaacgtcatttg

SEQ ID NO: 130 - DNA, 25 bp, Homo sapien
catttgatcgctgatgactccctta

SEQ ID NO: 131 - DNA, 25 bp, Homo sapien
atgactcccttaaacgcccgggctg

SEQ ID NO: 132 - DNA, 25 bp, Homo sapien
cgggctgtgactgattcttcgcgtc

SEQ ID NO: 133 - DNA, 25 bp, Homo sapien
ggacctctccgcgtttgtatcgcgg

SEQ ID NO: 134 - DNA, 25 bp, Homo sapien
agtgaactccggcagggctttcttt

SEQ ID NO: 135 - DNA, 25 bp, Homo sapien
tgttgctcactcttcactctgcgga

SEQ ID NO: 136 - DNA, 25 bp, Homo sapien
acatgtccaccgttcccgagttagg

SEQ ID NO: 137 - DNA, 25 bp, Homo sapien
gccgggttttgtttgccagatattg

SEQ ID NO: 138 - DNA, 25 bp, Homo sapien
tgttatgtctaacgggtgcctcgcc

SEQ ID NO: 139 - DNA, 25 bp, Homo sapien
tcgccggagacgtgatttgtcagcc

SEQ ID NO: 140 - DNA, 25 bp, Homo sapien
agccgccttcgttttcactttagca

SEQ ID NO: 141 - DNA, 25 bp, Homo sapien
cgagactcggggtgtattttaggca

SEQ ID NO: 142 - DNA, 25 bp, Homo sapien
tgcaggcacctacagcggagggaac

SEQ ID NO: 143 - DNA, 25 bp, Homo sapien
ccatcatggtgaatgggcggttccg

SEQ ID NO: 144 - DNA, 25 bp, Homo sapien
tcccgacagcatggaggagtgtgaa

SEQ ID NO: 145 - DNA, 25 bp, Homo sapien
agggccgttcagtgatgctcacctc

SEQ ID NO: 146 - DNA, 25 bp, Homo sapien
ggccttgcttatgggatcttccgtg

SEQ ID NO: 147 - DNA, 25 bp, Homo sapien
tgggactctcatggtacgcagaccg

SEQ ID NO: 148 - DNA, 25 bp, Homo sapien
tggaacagccttttggccgtggtgc

SEQ ID NO: 149 - DNA, 25 bp, Homo sapien
tgggcagcccgcaacatctcaaggg

SEQ ID NO: 150 - DNA, 25 bp, Homo sapien
ctggcagagggttaattgaggatca

SEQ ID NO: 151 - DNA, 25 bp, Homo sapien
aggatcattgttgttggttccagga

SEQ ID NO: 152 - DNA, 25 bp, Homo sapien
tgggagtaacaaaggaatgcgtctc

SEQ ID NO: 153 - DNA, 25 bp, Homo sapien
gagcggccgcacttcaccttacgga

SEQ ID NO: 154 - DNA, 25 bp, Homo sapien
tcaccttacggaggggagataatga

SEQ ID NO: 155 - DNA, 25 bp, Homo sapien
agatcaattagaggcgccgtcaccg

SEQ ID NO: 156 - DNA, 25 bp, Homo sapien
ccggagacagctgccgccgcatagt

SEQ ID NO: 157 - DNA, 25 bp, Homo sapien
cgcatagtaatcacccgcgggctgg

SEQ ID NO: 158 - DNA, 25 bp, Homo sapien
aagactcctttgagcactgctgcca

SEQ ID NO: 159 - DNA, 25 bp, Homo sapien
gcagcgcaaccacgaagacactttg

SEQ ID NO: 160 - DNA, 25 bp, Homo sapien
ccgtgaacagctaccaggcttggca

SEQ ID NO: 161 - DNA, 25 bp, Homo sapien
tcgtgccgccgctgaaatccagctg

SEQ ID NO: 162 - DNA, 25 bp, Homo sapien
tcctgggatgcctcaatctcgtgcc

SEQ ID NO: 163 - DNA, 25 bp, Homo sapien
aaggtccacctcaacaagctgtcgg

SEQ ID NO: 164 - DNA, 25 bp, Homo sapien
tcctcaagggtcacatgcgcaagca

SEQ ID NO: 165 - DNA, 25 bp, Homo sapien
ctcctgcctgcagagtggcttcatg

SEQ ID NO: 166 - DNA, 25 bp, Homo sapien
ctcgtgtgtgccgaagctgtgccca

SEQ ID NO: 167 - DNA, 25 bp, Homo sapien
tggtctgtccacttgggacgccctg

SEQ ID NO: 168 - DNA, 25 bp, Homo sapien
tggccgcccgcctaggcgaataagc

SEQ ID NO: 169 - DNA, 25 bp, Homo sapien
atttacggaggatcggctcgtgtgt

SEQ ID NO: 170 - DNA, 25 bp, Homo sapien
ggccgccgtgtttgcggagatttac

SEQ ID NO: 171 - DNA, 25 bp, Homo sapien
agcccttcggtctctgccgtggaag

SEQ ID NO: 172 - DNA, 25 bp, Homo sapien
cgagcgccatatgcagcccttcggt

SEQ ID NO: 173 - DNA, 25 bp, Homo sapien
cctaggcgaataagccggctggtca

SEQ ID NO: 174 - DNA, 25 bp, Homo sapien
agcccggtggctccaagggatcaaa

SEQ ID NO: 175 - DNA, 25 bp, Homo sapien
ctcgtccctaaggactcgtcttttg

SEQ ID NO: 176 - DNA, 25 bp, Homo sapien
ctgagccagctcgtccctaaggact

SEQ ID NO: 177 - DNA, 25 bp, Homo sapien
ccgcaaagggagaacgccctgagcc

SEQ ID NO: 178 - DNA, 25 bp, Homo sapien
tggccgcaaagggagaacgccctga

SEQ ID NO: 179 - DNA, 25 bp, Homo sapien
agcgaaaaacagctttggccgcaaa

SEQ ID NO: 180 - DNA, 25 bp, Homo sapien
aaggactcgtcttttggcgaggaag

SEQ ID NO: 181 - DNA, 25 bp, Homo sapien
cggtggctccaagggatcaaagcga

SEQ ID NO: 182 - DNA, 25 bp, Homo sapien
ctggactagagggattgattattga

SEQ ID NO: 183 - DNA, 25 bp, Homo sapien
gctgctggactagagggattgatta

SEQ ID NO: 184 - DNA, 25 bp, Homo sapien
attattgattggtgatcggggtcgc

SEQ ID NO: 185 - DNA, 25 bp, Homo sapien
cgcatcgatgcgctgcgggctcgat

SEQ ID NO: 186 - DNA, 25 bp, Homo sapien
ggctcgattgcgtctccctgggcca

SEQ ID NO: 187 - DNA, 25 bp, Homo sapien
tcctctcctgactttgggatgatca

SEQ ID NO: 188 - DNA, 25 bp, Homo sapien
tcaagtttcctctcctgactttggg

SEQ ID NO: 189 - DNA, 25 bp, Homo sapien
ctttgggatgatcagggtccctcca

SEQ ID NO: 190 - DNA, 25 bp, Homo sapien
cgaactgttttcacgctagactaga

SEQ ID NO: 191 - DNA, 25 bp, Homo sapien
tcagagtccactacacaaacgggta

SEQ ID NO: 192 - DNA, 25 bp, Homo sapien
tcgccattcgcgagtaagaagggga

SEQ ID NO: 193 - DNA, 25 bp, Homo sapien
ggagccgcttctaggagagcactga

SEQ ID NO: 194 - DNA, 25 bp, Homo sapien
gcactgaggtatgctcggttcggtt

SEQ ID NO: 195 - DNA, 25 bp, Homo sapien
tcctgcagggagacaccgcgctcta

SEQ ID NO: 196 - DNA, 25 bp, Homo sapien
gcgcggctattcatttcgccattcg

SEQ ID NO: 197 - DNA, 25 bp, Homo sapien
ccacatccagtggtcgaactgtttt

SEQ ID NO: 198 - DNA, 25 bp, Homo sapien
tcctgtctttcctcgacgctcggga

SEQ ID NO: 199 - DNA, 25 bp, Homo sapien
atgttggccgcctcaacttcctgcg

SEQ ID NO: 200 - DNA, 25 bp, Homo sapien
tgggcaacctcacctcaacgtctgg

SEQ ID NO: 201 - DNA, 25 bp, Homo sapien
tcggcagcggctgcactcctacaga

SEQ ID NO: 202 - DNA, 25 bp, Homo sapien
taaactcccggaactcgccgcaaga

SEQ ID NO: 203 - DNA, 25 bp, Homo sapien
cgccgcaagaggagcgttgaaaaca

SEQ ID NO: 204 - DNA, 25 bp, Homo sapien
cggtttcaccgctgcttatcatttc

SEQ ID NO: 205 - DNA, 25 bp, Homo sapien
gcgagaaatgcaaccgcgtgggccc

SEQ ID NO: 206 - DNA, 25 bp, Homo sapien
gcgcggagggcacccacatttgcat

SEQ ID NO: 207 - DNA, 25 bp, Homo sapien
attcaaattaggctgggtggcggta

SEQ ID NO: 208 - DNA, 25 bp, Homo sapien
cggcagccaatgaaatattcaaatt

SEQ ID NO: 209 - DNA, 25 bp, Homo sapien
aattgaccagactggcggcagccaa

SEQ ID NO: 210 - DNA, 25 bp, Homo sapien
tgcatgataaattgaccagactggc

SEQ ID NO: 211 - DNA, 25 bp, Homo sapien
ggagggcacccacatttgcatgata

SEQ ID NO: 212 - DNA, 25 bp, Homo sapien
gctgtctcggccaccaatcgggcgc

SEQ ID NO: 213 - DNA, 25 bp, Homo sapien
gcacccacatttgcatgataaattg

SEQ ID NO: 214 - DNA, 25 bp, Homo sapien
tggcagctggaaaagcgcattcctg

SEQ ID NO: 215 - DNA, 25 bp, Homo sapien
atcacgcagccagatgaagctcata

SEQ ID NO: 216 - DNA, 25 bp, Homo sapien
aaagcgcattcctgctcgcccgagg

SEQ ID NO: 217 - DNA, 25 bp, Homo sapien
tcgcccgaggatgcagaaggcaacc

SEQ ID NO: 218 - DNA, 25 bp, Homo sapien
cattccgctcttgcgatcggtgata

SEQ ID NO: 219 - DNA, 25 bp, Homo sapien
ccctcccatgccactagatattata

SEQ ID NO: 220 - DNA, 25 bp, Homo sapien
gctgcccgccaatgttcgctttgcg

SEQ ID NO: 221 - DNA, 25 bp, Homo sapien
cgctttgcgcccttcgctcaatgtg

SEQ ID NO: 222 - DNA, 25 bp, Homo sapien
ggtcacctgacccacccgcggctca

SEQ ID NO: 223 - DNA, 25 bp, Homo sapien
gctgcccgccattcgggtcacctga

SEQ ID NO: 224 - DNA, 25 bp, Homo sapien
acccgcggctcacgtgatccgtccc

SEQ ID NO: 225 - DNA, 25 bp, Homo sapien
gccattttggagctccggatgagga

SEQ ID NO: 226 - DNA, 25 bp, Homo sapien
ctggccaaacgaggctcgcggaagc

SEQ ID NO: 227 - DNA, 25 bp, Homo sapien
ccgccgccggccatgtgcatcctcc

SEQ ID NO: 228 - DNA, 25 bp, Homo sapien
cccgcccggtgctagccacaagccc

SEQ ID NO: 229 - DNA, 25 bp, Homo sapien
tgcaaggggctaaaccggctgggga

SEQ ID NO: 230 - DNA, 25 bp, Homo sapien
agttccgtaaatcaggccctcaggg

SEQ ID NO: 231 - DNA, 25 bp, Homo sapien
atttccacaaagctccgcggcggtt

SEQ ID NO: 232 - DNA, 25 bp, Homo sapien
ttgacgaacagctcccggggcctat

SEQ ID NO: 233 - DNA, 25 bp, Homo sapien
gaagtgtgccgcttccttccggcca

SEQ ID NO: 234 - DNA, 25 bp, Homo sapien
cagaccggactcaatgcggaccagg

SEQ ID NO: 235 - DNA, 25 bp, Homo sapien
agccgtatctctagctccggcctga

SEQ ID NO: 236 - DNA, 25 bp, Homo sapien
tgcgcatccgccacagagcagggaa

SEQ ID NO: 237 - DNA, 25 bp, Homo sapien
ccgcgctcagagtctccggaacaga

SEQ ID NO: 238 - DNA, 25 bp, Homo sapien
agacgatgctggaggaggtgatcac

SEQ ID NO: 239 - DNA, 25 bp, Homo sapien
tttccgtgagccagacgatgctgga

SEQ ID NO: 240 - DNA, 25 bp, Homo sapien
gcgtggaggacttttccgtgagcca

SEQ ID NO: 241 - DNA, 25 bp, Homo sapien
agcacggcgtggaggacttttccgt

SEQ ID NO: 242 - DNA, 25 bp, Homo sapien
ccctggcgcgcgtctttggagagct

SEQ ID NO: 243 - DNA, 25 bp, Homo sapien
agcggccttcgtggcggccgagttc

SEQ ID NO: 244 - DNA, 25 bp, Homo sapien
gcccgccgcaaggtcccagccggca

SEQ ID NO: 245 - DNA, 25 bp, Homo sapien
attcgcggcgggtcacacactgacc

SEQ ID NO: 246 - DNA, 25 bp, Homo sapien
gcagccggaccgaattcagtttttc

SEQ ID NO: 247 - DNA, 25 bp, Homo sapien
ttatcgttgtccctaataccgaggc

SEQ ID NO: 248 - DNA, 25 bp, Homo sapien
gggcgcagtctttgagttatcgttg

SEQ ID NO: 249 - DNA, 25 bp, Homo sapien
cacgcccggagaggcgtttctgata

SEQ ID NO: 250 - DNA, 25 bp, Homo sapien
ttccggagttcagttgttatgaccc

SEQ ID NO: 251 - DNA, 25 bp, Homo sapien
tctcagcttttggagccagcagccg

SEQ ID NO: 252 - DNA, 25 bp, Homo sapien
ggcctggatccaagcacaatctcag

SEQ ID NO: 253 - DNA, 25 bp, Homo sapien
ttatgacccaagtttagccgacagg

SEQ ID NO: 254 - DNA, 25 bp, Homo sapien
gcatcccagatgctggggcaccatc

SEQ ID NO: 255 - DNA, 25 bp, Homo sapien
tgaggtgagacccaaacccttggca

SEQ ID NO: 256 - DNA, 25 bp, Homo sapien
gacacattcccggtcggtgaggtga

SEQ ID NO: 257 - DNA, 25 bp, Homo sapien
aacccttggcaaaagcagcgtcgga

SEQ ID NO: 258 - DNA, 25 bp, Homo sapien
ggagcccttgagaccgcatcccaga

SEQ ID NO: 259 - DNA, 25 bp, Homo sapien
gggcaccatctgttcccatcggaga

SEQ ID NO: 260 - DNA, 25 bp, Homo sapien
cgtgtgggaagacgcacgccctgct

SEQ ID NO: 261 - DNA, 25 bp, Homo sapien
gcaaaagcagcgtcggagcccttga

SEQ ID NO: 262 - DNA, 25 bp, Homo sapien
tccgggagtcagtatagctgggttc

SEQ ID NO: 263 - DNA, 25 bp, Homo sapien
ttggaagcaccgaccaacgtgagcg

SEQ ID NO: 264 - DNA, 25 bp, Homo sapien
ccagtcactgctcgctttggggcac

SEQ ID NO: 265 - DNA, 25 bp, Homo sapien
cgccgagcgagtcacggaccatgaa

SEQ ID NO: 266 - DNA, 25 bp, Homo sapien
gggttctagtcccatcacaggcaaa

SEQ ID NO: 267 - DNA, 25 bp, Homo sapien
tcacaggcaaaaactccgcgggagc

SEQ ID NO: 268 - DNA, 25 bp, Homo sapien
ttggatctcccgagcgctaacattc

SEQ ID NO: 269 - DNA, 25 bp, Homo sapien
gttagccacatcctgccgcgctgag

SEQ ID NO: 270 - DNA, 25 bp, Homo sapien
aggttcacccaacgccagaggctcg

SEQ ID NO: 271 - DNA, 25 bp, Homo sapien
gttgccgaccaaacgcccaggttca

SEQ ID NO: 272 - DNA, 25 bp, Homo sapien
agaggctcgtcctcaattcccgcga

SEQ ID NO: 273 - DNA, 25 bp, Homo sapien
gccgcgccagaatcggatccgggaa

SEQ ID NO: 274 - DNA, 25 bp, Homo sapien
accaaggcttcatgccgggcgcgca

SEQ ID NO: 275 - DNA, 25 bp, Homo sapien
gatgaccacaagaccgacaacactg

SEQ ID NO: 276 - DNA, 25 bp, Homo sapien
cgacaacactgggacgctgcctgag

SEQ ID NO: 277 - DNA, 25 bp, Homo sapien
ccattgtcccgcgagagtgccctag

SEQ ID NO: 278 - DNA, 25 bp, Homo sapien
ctccgcgcgtcagtcctcctggcca

SEQ ID NO: 279 - DNA, 25 bp, Homo sapien
cgccaagccagacccacgccagacc

SEQ ID NO: 280 - DNA, 25 bp, Homo sapien
gcccaggcgctaaaggtggagggaa

SEQ ID NO: 281 - DNA, 25 bp, Homo sapien
acggagcgcattgcctcgagccgac

SEQ ID NO: 282 - DNA, 25 bp, Homo sapien
gacgcctcaaggcctgctcagcgtg

SEQ ID NO: 283 - DNA, 25 bp, Homo sapien
caccgcgtggcgctgtgccttacgt

SEQ ID NO: 284 - DNA, 25 bp, Homo sapien
tgcaaaagagagaatcacgcgaccc

SEQ ID NO: 285 - DNA, 25 bp, Homo sapien
tgtgccttacgttgttgggccgttg

SEQ ID NO: 286 - DNA, 25 bp, Homo sapien
ccctggtatccagcgccgaaagtgc

SEQ ID NO: 287 - DNA, 25 bp, Homo sapien
cgcggacagagaggaccgtgccctc

SEQ ID NO: 288 - DNA, 25 bp, Homo sapien
ggaccgtgccctctttcgcatgtta

SEQ ID NO: 289 - DNA, 25 bp, Homo sapien
agcgccctgggaggaacttcgtagc

SEQ ID NO: 290 - DNA, 25 bp, Homo sapien
aacttcgtagcggattcgagagaca

SEQ ID NO: 291 - DNA, 25 bp, Homo sapien
ttcgagagacagagggaattcagca

SEQ ID NO: 292 - DNA, 25 bp, Homo sapien
agggaattcagcaaacttgctgccc

SEQ ID NO: 293 - DNA, 25 bp, Homo sapien
ccctctttcgcatgttacggggcga

SEQ ID NO: 294 - DNA, 25 bp, Homo sapien
atgagcccgggtttcacgggccctg

SEQ ID NO: 295 - DNA, 25 bp, Homo sapien
tttcacgggccctggcgtgctccgg

SEQ ID NO: 296 - DNA, 25 bp, Homo sapien
agcgcggaattggttgctcctccga

SEQ ID NO: 297 - DNA, 25 bp, Homo sapien
ggttgctcctccgaatgctcgatca

SEQ ID NO: 298 - DNA, 25 bp, Homo sapien
cgaatgctcgatcacccgggccaag

SEQ ID NO: 299 - DNA, 25 bp, Homo sapien
gatcacccgggccaagcgacactgg

SEQ ID NO: 300 - DNA, 25 bp, Homo sapien
ccagtctctgttgccctatccgctc

SEQ ID NO: 301 - DNA, 25 bp, Homo sapien
tctgcgtgggcgttgttctagtcct

SEQ ID NO: 302 - DNA, 25 bp, Homo sapien
atgaggatgtagcacgccgtcacca

SEQ ID NO: 303 - DNA, 25 bp, Homo sapien
cggtggcagtcatcacggtgaagta

SEQ ID NO: 304 - DNA, 25 bp, Homo sapien
agaccacagcctcccgcggaagatg

SEQ ID NO: 305 - DNA, 25 bp, Homo sapien
ggcaatgacacggagacccacgttc

SEQ ID NO: 306 - DNA, 25 bp, Homo sapien
ggggatcccgatgataatggccaaa

SEQ ID NO: 307 - DNA, 25 bp, Homo sapien
taggacacgttcatgaggatgtagc

SEQ ID NO: 308 - DNA, 25 bp, Homo sapien
catcacggtgaagtaggacacgttc

SEQ ID NO: 309 - DNA, 25 bp, Homo sapien
aatggccaaaggcaggtttctggga

SEQ ID NO: 310 - DNA, 25 bp, Homo sapien
gcgggcgagcatctacttacgaaat

SEQ ID NO: 311 - DNA, 25 bp, Homo sapien
tggtcaggttagacgtccatttctg

SEQ ID NO: 312 - DNA, 25 bp, Homo sapien
tggcgcggccaccagtaacatgatc

SEQ ID NO: 313 - DNA, 25 bp, Homo sapien
gcaaccagtgggtaccgttcaaatc

SEQ ID NO: 314 - DNA, 25 bp, Homo sapien
caccggtcgttcttggcaaccagtg

SEQ ID NO: 315 - DNA, 25 bp, Homo sapien
tttgcagcaaccacgtcggccattg

SEQ ID NO: 316 - DNA, 25 bp, Homo sapien
cctcacgctttctcttcgcaatgga

SEQ ID NO: 317 - DNA, 25 bp, Homo sapien
gggcctggactcatcagcagatcta

SEQ ID NO: 318 - DNA, 25 bp, Homo sapien
gcaacagcgcgtcggtcatgctagc

SEQ ID NO: 319 - DNA, 25 bp, Homo sapien
aagtagccgtcgttctccttctcca

SEQ ID NO: 320 - DNA, 25 bp, Homo sapien
tgaggcgctcgtcacccggagagct

SEQ ID NO: 321 - DNA, 25 bp, Homo sapien
actcaactttgcgagtgccgcgaga

SEQ ID NO: 322 - DNA, 25 bp, Homo sapien
cgaagccctggctgtggacctgcac

SEQ ID NO: 323 - DNA, 25 bp, Homo sapien
ggggccagactcgacgccacgtcga

SEQ ID NO: 324 - DNA, 25 bp, Homo sapien
gcttttcccaagaggggagcccatg

SEQ ID NO: 325 - DNA, 25 bp, Homo sapien
ccaggcaccagggatcgcaagcgag

SEQ ID NO: 326 - DNA, 25 bp, Homo sapien
ctaccacaggatgggcctgagaatc

SEQ ID NO: 327 - DNA, 25 bp, Homo sapien
acaagtcggtgctggaccattgtta

SEQ ID NO: 328 - DNA, 25 bp, Homo sapien
ctgcagcgacagagagaggtttaca

SEQ ID NO: 329 - DNA, 25 bp, Homo sapien
tcgggccacaaaagcacaagtcggt

SEQ ID NO: 330 - DNA, 25 bp, Homo sapien
tcgtggctgccaaatcctccgaggc

SEQ ID NO: 331 - DNA, 25 bp, Homo sapien
gaacagttgggtggcttccagctta

SEQ ID NO: 332 - DNA, 25 bp, Homo sapien
tccagcttatgccaggagtctcctc

SEQ ID NO: 333 - DNA, 25 bp, Homo sapien
attgttagatcgttcccagcgctgg

SEQ ID NO: 334 - DNA, 25 bp, Homo sapien
gagtgagagtcagcgccctgcagtc

SEQ ID NO: 335 - DNA, 25 bp, Homo sapien
gaggtccgggtctctgcgtgtcatc

SEQ ID NO: 336 - DNA, 25 bp, Homo sapien
tgcgtgtcatcgtgcacgtgtctgt

SEQ ID NO: 337 - DNA, 25 bp, Homo sapien
ggcctgtcacgtgggcctgacagct

SEQ ID NO: 338 - DNA, 25 bp, Homo sapien
tggccggcgacaatgtggtcccgaa

SEQ ID NO: 339 - DNA, 25 bp, Homo sapien
aatgtggtcccgaagcggccagcgc

SEQ ID NO: 340 - DNA, 25 bp, Homo sapien
ctccaggaagaaacgagagctcatg

SEQ ID NO: 341 - DNA, 25 bp, Homo sapien
ttccatctcgaaaaagaaccgcgcg

SEQ ID NO: 342 - DNA, 25 bp, Homo sapien
cgttcccatccaggcttgtcggcgg

SEQ ID NO: 343 - DNA, 25 bp, Homo sapien
cttaggccgcttcaagctgtcgatc

SEQ ID NO: 344 - DNA, 25 bp, Homo sapien
ccagcgagtattgtcccggcaagct

SEQ ID NO: 345 - DNA, 25 bp, Homo sapien
gggaatgcaagttgccgccaccctc

SEQ ID NO: 346 - DNA, 25 bp, Homo sapien
gcggggtggcactagttttcaccca

SEQ ID NO: 347 - DNA, 25 bp, Homo sapien
ggaccgggcttcgagatggcctccc

SEQ ID NO: 348 - DNA, 25 bp, Homo sapien
gcactagttttcacccagcgggcga

SEQ ID NO: 349 - DNA, 25 bp, Homo sapien
cccatgacagggaatgcaagttgcc

SEQ ID NO: 350 - DNA, 25 bp, Homo sapien
ggggtatcatctcatcccctgcatc

SEQ ID NO: 351 - DNA, 25 bp, Homo sapien
cgcatcacctgcaaccggaaggcca

SEQ ID NO: 352 - DNA, 25 bp, Homo sapien
ctagaggcggggtatcatctcatcc

SEQ ID NO: 353 - DNA, 25 bp, Homo sapien
agcccgcgttccagtgtcctcgtgt

SEQ ID NO: 354 - DNA, 25 bp, Homo sapien
ggagcccgcgttccagtgtcctcgt

SEQ ID NO: 355 - DNA, 25 bp, Homo sapien
acgctccctggcaacggagcccgcg

SEQ ID NO: 356 - DNA, 25 bp, Homo sapien
ccgcgcaggtcatgtcccggggact

SEQ ID NO: 357 - DNA, 25 bp, Homo sapien
cctgcaaccggaaggccaccgccgc

SEQ ID NO: 358 - DNA, 25 bp, Homo sapien
acccggctgcccgatactatgaggg

SEQ ID NO: 359 - DNA, 25 bp, Homo sapien
tcgcgctagtcttcctggctccaag

SEQ ID NO: 360 - DNA, 25 bp, Homo sapien
atgcgcgcggcccatatggtaaata

SEQ ID NO: 361 - DNA, 25 bp, Homo sapien
cgtgcgccacaacaggccgaatgtg

SEQ ID NO: 362 - DNA, 25 bp, Homo sapien
ctgcctgtgtgaatcggaagctaca

SEQ ID NO: 363 - DNA, 25 bp, Homo sapien
cgttggaagagacattaccgtgacc

SEQ ID NO: 364 - DNA, 25 bp, Homo sapien
agcgtcctggctccacgttggaaga

SEQ ID NO: 365 - DNA, 25 bp, Homo sapien
acttttgtgctctgtacccggctgc

SEQ ID NO: 366 - DNA, 25 bp, Homo sapien
accgccaccgcacaaagacgcctcg

SEQ ID NO: 367 - DNA, 25 bp, Homo sapien
gccctacgggcctgcaccgccaccg

SEQ ID NO: 368 - DNA, 25 bp, Homo sapien
gcacaaagacgcctcgggagccgcc

SEQ ID NO: 369 - DNA, 25 bp, Homo sapien
gcgccctgaccgacctcctctccgg

SEQ ID NO: 370 - DNA, 25 bp, Homo sapien
ggccagcaccgcttgcccgcctggc

SEQ ID NO: 371 - DNA, 25 bp, Homo sapien
aggcccttcgtgcaggcggcagcct

SEQ ID NO: 372 - DNA, 25 bp, Homo sapien
gtgcaggcggcagccttcaacccgg

SEQ ID NO: 373 - DNA, 25 bp, Homo sapien
gacagacccacggacgctctaccgg

SEQ ID NO: 374 - DNA, 25 bp, Homo sapien
tgtccctcagagctttccgtgaccg

SEQ ID NO: 375 - DNA, 25 bp, Homo sapien
gagctcgtcagccagcacgtattta

SEQ ID NO: 376 - DNA, 25 bp, Homo sapien
ttgagacacgctcccaggaatcgcg

SEQ ID NO: 377 - DNA, 25 bp, Homo sapien
tgtggtgctcagatcagacttatcc

SEQ ID NO: 378 - DNA, 25 bp, Homo sapien
agctgctccctagagccgttcctga

SEQ ID NO: 379 - DNA, 25 bp, Homo sapien
tgctaggccttgcacgcaacccttt

SEQ ID NO: 380 - DNA, 25 bp, Homo sapien
cgagggtgacccaacactagtcgga

SEQ ID NO: 381 - DNA, 25 bp, Homo sapien
ctcctgtggcttagctcagcgatca

SEQ ID NO: 382 - DNA, 25 bp, Homo sapien
accttcactgcacgtggctggtgga

SEQ ID NO: 383 - DNA, 25 bp, Homo sapien
tgccgaccgctgcaacaaccagaaa

SEQ ID NO: 384 - DNA, 25 bp, Homo sapien
ggcgccgacgagaagaactgcttct

SEQ ID NO: 385 - DNA, 25 bp, Homo sapien
aacctgtgcatcttcgagacgtggc

SEQ ID NO: 386 - DNA, 25 bp, Homo sapien
acggctctgatgagggcaactgctc

SEQ ID NO: 387 - DNA, 25 bp, Homo sapien
cggcttcaatgccacctaccaggtg

SEQ ID NO: 388 - DNA, 25 bp, Homo sapien
gcttctcagagccacagcgctgtga

SEQ ID NO: 389 - DNA, 25 bp, Homo sapien
ctaccaggtgaagggctattgcctc

SEQ ID NO: 390 - DNA, 25 bp, Homo sapien
acagccatgcggagacagatgcgtc

SEQ ID NO: 391 - DNA, 25 bp, Homo sapien
catgcggagacagatgcgtcggcac

SEQ ID NO: 392 - DNA, 25 bp, Homo sapien
gagacagatgcgtcggcacgcctcc

SEQ ID NO: 393 - DNA, 25 bp, Homo sapien
tggaaccggctctttcaccggccgc

SEQ ID NO: 394 - DNA, 25 bp, Homo sapien
ccgaggccagatcccactgctgacc

SEQ ID NO: 395 - DNA, 25 bp, Homo sapien
ggcgatggcttcctccagcctgctc

SEQ ID NO: 396 - DNA, 25 bp, Homo sapien
cagcaccgctcatggacacaggcag

SEQ ID NO: 397 - DNA, 25 bp, Homo sapien
cgctcatggacacaggcagcaccag

SEQ ID NO: 398 - DNA, 25 bp, Homo sapien
tgtggccggccatgtcgctgtcccg

SEQ ID NO: 399 - DNA, 25 bp, Homo sapien
tcggtccgtcggtccgtgagctcac

SEQ ID NO: 400 - DNA, 25 bp, Homo sapien
tcagcagcccgatctccttcttgag

SEQ ID NO: 401 - DNA, 25 bp, Homo sapien
cccgctcaccgatgatgatggtgca

SEQ ID NO: 402 - DNA, 25 bp, Homo sapien
ctgggtcccgctcaccgatgatgat

SEQ ID NO: 403 - DNA, 25 bp, Homo sapien
tagcgctctctgaggccagactgca

SEQ ID NO: 404 - DNA, 25 bp, Homo sapien
gcggtcatagcgctctctgaggcca

SEQ ID NO: 405 - DNA, 25 bp, Homo sapien
agctcacggccctcgcagccgggac

SEQ ID NO: 406 - DNA, 25 bp, Homo sapien
cggcggcggaacagcctttgtttct

SEQ ID NO: 407 - DNA, 25 bp, Homo sapien
aactcgggtctctggtgcaggtccc

SEQ ID NO: 408 - DNA, 25 bp, Homo sapien
tctggtgcaggtcccgcgcgatcca

SEQ ID NO: 409 - DNA, 25 bp, Homo sapien
atccagcccggctcaagaaggccag

SEQ ID NO: 410 - DNA, 25 bp, Homo sapien
gctcaagaaggccaggcgacctgga

SEQ ID NO: 411 - DNA, 25 bp, Homo sapien
tcccggaagccgtccggactgtgca

SEQ ID NO: 412 - DNA, 25 bp, Homo sapien
ccctgcatgtggatgaggcctcgcc

SEQ ID NO: 413 - DNA, 25 bp, Homo sapien
gcgacctggaatgcccgggagacac

SEQ ID NO: 414 - DNA, 25 bp, Homo sapien
gatgggcctggcctttctcacagct

SEQ ID NO: 415 - DNA, 25 bp, Homo sapien
tttctcacagctcggtggagccgcc

SEQ ID NO: 416 - DNA, 25 bp, Homo sapien
caggctccaagacacgtcaaaaccg

SEQ ID NO: 417 - DNA, 25 bp, Homo sapien
ggggcaatctacgtgtttacttcta

SEQ ID NO: 418 - DNA, 25 bp, Homo sapien
aacaagactttgcacaccaccgggg

SEQ ID NO: 419 - DNA, 25 bp, Homo sapien
acaccaccggggctgttcggatccg

SEQ ID NO: 420 - DNA, 25 bp, Homo sapien
ttcggatccgagaacgcatgggttc

SEQ ID NO: 421 - DNA, 25 bp, Homo sapien
gaccggcgcttatctgatgggcctg

SEQ ID NO: 422 - DNA, 25 bp, Homo sapien
aggctgccgtgtggataagagtcgg

SEQ ID NO: 423 - DNA, 25 bp, Homo sapien
agagtcgggggccaagtctcccgct

SEQ ID NO: 424 - DNA, 25 bp, Homo sapien
ccaagtctcccgctggagcagcatg

SEQ ID NO: 425 - DNA, 25 bp, Homo sapien
aagtctcccgctggagcagcatgga

SEQ ID NO: 426 - DNA, 25 bp, Homo sapien
gtctcccgctggagcagcatggaag

SEQ ID NO: 427 - DNA, 25 bp, Homo sapien
cctggctctggcgttggcttagcgt

SEQ ID NO: 428 - DNA, 25 bp, Homo sapien
tctggcgttggcttagcgtgcagcc

SEQ ID NO: 429 - DNA, 25 bp, Homo sapien
tgggcacgtccctgtgctgccgccc

SEQ ID NO: 430 - DNA, 25 bp, Homo sapien
ctgcctcctggacactgggccggag

SEQ ID NO: 431 - DNA, 25 bp, Homo sapien
ccttgagaaacttaaggagtgtgtg

SEQ ID NO: 432 - DNA, 25 bp, Homo sapien
ccgcttcgctgagggccttgagaaa

SEQ ID NO: 433 - DNA, 25 bp, Homo sapien
catctcccatctgctggcggacgtg

SEQ ID NO: 434 - DNA, 25 bp, Homo sapien
gcccggacgtcgtcgaggacatctc

SEQ ID NO: 435 - DNA, 25 bp, Homo sapien
cacagggaccctcaagcggcccacc

SEQ ID NO: 436 - DNA, 25 bp, Homo sapien
tcctccggcgtcaaggccacaggga

SEQ ID NO: 437 - DNA, 25 bp, Homo sapien
cgtcgtcgaggacatctcccatctg

SEQ ID NO: 438 - DNA, 25 bp, Homo sapien
tttcaaagccagaaccaggcctgtc

SEQ ID NO: 439 - DNA, 25 bp, Homo sapien
ggggcgcggattctctttcaaagcc

SEQ ID NO: 440 - DNA, 25 bp, Homo sapien
cgatggacgtctcgtgctcgcagat

SEQ ID NO: 441 - DNA, 25 bp, Homo sapien
gcccaggagtatcccgaggctgcac

SEQ ID NO: 442 - DNA, 25 bp, Homo sapien
taggcgctgatgtcgatggacgtct

SEQ ID NO: 443 - DNA, 25 bp, Homo sapien
agttagagttctcccggcatggcga

SEQ ID NO: 444 - DNA, 25 bp, Homo sapien
cggcccagcttttatacccggcagg

SEQ ID NO: 445 - DNA, 25 bp, Homo sapien
ccaggaactcgtcgttgaaggcggc

SEQ ID NO: 446 - DNA, 25 bp, Homo sapien
agcctgcccacgattggtcgactgg

SEQ ID NO: 447 - DNA, 25 bp, Homo sapien
gcgttccgttcgcagaaactctgtg

SEQ ID NO: 448 - DNA, 25 bp, Homo sapien
cgtctgatgcaacctgccggcaaca

SEQ ID NO: 449 - DNA, 25 bp, Homo sapien
gacggcttttcagcctccgactcga

SEQ ID NO: 450 - DNA, 25 bp, Homo sapien
ttgagtcgtccacagcactaggccg

SEQ ID NO: 451 - DNA, 25 bp, Homo sapien
cagtcgccggtggttcacaaaacca

SEQ ID NO: 452 - DNA, 25 bp, Homo sapien
tgcttccaaaggcacgtctggcctc

SEQ ID NO: 453 - DNA, 25 bp, Homo sapien
tggcctccacaaggtgacggctttt

SEQ ID NO: 454 - DNA, 25 bp, Homo sapien
catccaggaggtggtcgatgaagta

SEQ ID NO: 455 - DNA, 25 bp, Homo sapien
gccaaaaccgcgaaagcgctgcagg

SEQ ID NO: 456 - DNA, 25 bp, Homo sapien
gcctcatccaggaggtggtcgatga

SEQ ID NO: 457 - DNA, 25 bp, Homo sapien
tcgatgaagtagatgcccggctcca

SEQ ID NO: 458 - DNA, 25 bp, Homo sapien
ggctccacggtgagcaccatgcctg

SEQ ID NO: 459 - DNA, 25 bp, Homo sapien
tccacggtgagcaccatgcctggct

SEQ ID NO: 460 - DNA, 25 bp, Homo sapien
aggccgggctcgtcgatgcgctcca

SEQ ID NO: 461 - DNA, 25 bp, Homo sapien
caggacctcgcggttaaggaaggag

SEQ ID NO: 462 - DNA, 25 bp, Homo sapien
gcgtcctcataggtcttgacagatg

SEQ ID NO: 463 - DNA, 25 bp, Homo sapien
ctcggatcgccagctctgcttgaga

SEQ ID NO: 464 - DNA, 25 bp, Homo sapien
ccaggcgcgtgcatctttgcttacc

SEQ ID NO: 465 - DNA, 25 bp, Homo sapien
taccctttcctagatcggtctcagc

SEQ ID NO: 466 - DNA, 25 bp, Homo sapien
ctgtgcagacgacttggaaatccgc

SEQ ID NO: 467 - DNA, 25 bp, Homo sapien
tgccttcccgctagcatctggcagg

SEQ ID NO: 468 - DNA, 25 bp, Homo sapien
tggcggctttgacagttcgtcagcc

SEQ ID NO: 469 - DNA, 25 bp, Homo sapien
cccgcaagcagattggcagcttccg

SEQ ID NO: 470 - DNA, 25 bp, Homo sapien
agcagtaatactcaccgcccatgtc

SEQ ID NO: 471 - DNA, 25 bp, Homo sapien
tcatggcacccatgacggcacggga

SEQ ID NO: 472 - DNA, 25 bp, Homo sapien
gacggcacgggagctccgcagcact

SEQ ID NO: 473 - DNA, 25 bp, Homo sapien
gcactgcctcatagacggccttctg

SEQ ID NO: 474 - DNA, 25 bp, Homo sapien
cggccttctggtctgcagtgaactt

SEQ ID NO: 475 - DNA, 25 bp, Homo sapien
cggaagcgaagcagtaatactcacc

SEQ ID NO: 476 - DNA, 25 bp, Homo sapien
atactcaccgcccatgtcgaacagg

SEQ ID NO: 477 - DNA, 25 bp, Homo sapien
tctgcagtgaacttgccgttggcgg

SEQ ID NO: 478 - DNA, 25 bp, Homo sapien
accctgactcggagcgtgcagctcg

SEQ ID NO: 479 - DNA, 25 bp, Homo sapien
aagaggcgcctacccgcggcattca

SEQ ID NO: 480 - DNA, 25 bp, Homo sapien
cgtcacgtgaagtgcggcgtcagct

SEQ ID NO: 481 - DNA, 25 bp, Homo sapien
ccctccgggtgccaatgcatggggc

SEQ ID NO: 482 - DNA, 25 bp, Homo sapien
gggcatggagtccttgacccacctc

SEQ ID NO: 483 - DNA, 25 bp, Homo sapien
cagagccaaattccacgggacggga

SEQ ID NO: 484 - DNA, 25 bp, Homo sapien
ctcggccaggataaatgagcgggct

SEQ ID NO: 485 - DNA, 25 bp, Homo sapien
ttggcagcgaacatgcgtgtcgacc

SEQ ID NO: 486 - DNA, 25 bp, Homo sapien
tgctcgcccacagatcgcactgggt

SEQ ID NO: 487 - DNA, 25 bp, Homo sapien
aggcttcgctctcacttcgctggga

SEQ ID NO: 488 - DNA, 25 bp, Homo sapien
acagatcgcactgggttccgcttgg

SEQ ID NO: 489 - DNA, 25 bp, Homo sapien
cgcggagaaccgctcccggactgga

SEQ ID NO: 490 - DNA, 25 bp, Homo sapien
tccgctgcgccaggtaagtggctgc

SEQ ID NO: 491 - DNA, 25 bp, Homo sapien
caccgcacgcgaatgggagtccgaa

SEQ ID NO: 492 - DNA, 25 bp, Homo sapien
ttggatctcactcgctgccgcgctt

SEQ ID NO: 493 - DNA, 25 bp, Homo sapien
gcttctgggaactgccgtccctcgg

SEQ ID NO: 494 - DNA, 25 bp, Homo sapien
atccgtcaaccttgcagagcattgc

SEQ ID NO: 495 - DNA, 25 bp, Homo sapien
tgtaggctcccaccgatcgatcggc

SEQ ID NO: 496 - DNA, 25 bp, Homo sapien
tctcagaagtaagcgagagccgcgc

SEQ ID NO: 497 - DNA, 25 bp, Homo sapien
cgccgctgccattagagcggtttta

SEQ ID NO: 498 - DNA, 25 bp, Homo sapien
agggactcgtcccagagtttgctgc

SEQ ID NO: 499 - DNA, 25 bp, Homo sapien
cgcataaaaactggagggactcgtc

SEQ ID NO: 500 - DNA, 25 bp, Homo sapien
atcggcgacgagcagatgagttccc

SEQ ID NO: 501 - DNA, 25 bp, Homo sapien
ttggagtctgagcactcgcgcccat

SEQ ID NO: 502 - DNA, 25 bp, Homo sapien
cgtccactatggcagcgctctcaag

SEQ ID NO: 503 - DNA, 25 bp, Homo sapien
aaggccggctgctccaattggaagc

SEQ ID NO: 504 - DNA, 25 bp, Homo sapien
cgccagggtatcttgcaccgtctca

SEQ ID NO: 505 - DNA, 25 bp, Homo sapien
ccgccttccgcgacaagtttgagca

SEQ ID NO: 506 - DNA, 25 bp, Homo sapien
tgcgttttcccgagttcgtccagta

SEQ ID NO: 507 - DNA, 25 bp, Homo sapien
catggaggacgatgccaacttcttc

SEQ ID NO: 508 - DNA, 25 bp, Homo sapien
gcgaggatcgcccaccagtacttcg

SEQ ID NO: 509 - DNA, 25 bp, Homo sapien
tcccgtatcttcgtggaggaccgcc

SEQ ID NO: 510 - DNA, 25 bp, Homo sapien
agcggtgctgtccactcatgcctcg

SEQ ID NO: 511 - DNA, 25 bp, Homo sapien
cacgctccatcagggtgatgtcagg

SEQ ID NO: 512 - DNA, 25 bp, Homo sapien
ctaaagcagtgacatccacaacctc

SEQ ID NO: 513 - DNA, 25 bp, Homo sapien
ggacccgcctgtgctaacactaagc

SEQ ID NO: 514 - DNA, 25 bp, Homo sapien
gggcggcctccagaggttactctca

SEQ ID NO: 515 - DNA, 25 bp, Homo sapien
ttcgtacccacaggcgcagagccgt

SEQ ID NO: 516 - DNA, 25 bp, Homo sapien
ctcatgcctcgctctactgtatagg

SEQ ID NO: 517 - DNA, 25 bp, Homo sapien
ctctactgtataggtgagaagactg

SEQ ID NO: 518 - DNA, 25 bp, Homo sapien
ggttttctctccagcaatcgaggga

SEQ ID NO: 519 - DNA, 25 bp, Homo sapien
ataccgagaaagtcgcccggccagg

SEQ ID NO: 520 - DNA, 25 bp, Homo sapien
cccgaagtggctgcgataccgagaa

SEQ ID NO: 521 - DNA, 25 bp, Homo sapien
actccaggacgagaccggagcgacc

SEQ ID NO: 522 - DNA, 25 bp, Homo sapien
atcgctgccctttacgtccgggctg

SEQ ID NO: 523 - DNA, 25 bp, Homo sapien
cgcggagctaattgcgactctaatc

SEQ ID NO: 524 - DNA, 25 bp, Homo sapien
aacggcgcgtttttgtcgccaggcg

SEQ ID NO: 525 - DNA, 25 bp, Homo sapien
agcgacccgcgcagcgagcataggc

SEQ ID NO: 526 - DNA, 25 bp, Homo sapien
ggggacccacatggacggtgccacc

SEQ ID NO: 527 - DNA, 25 bp, Homo sapien
tcccgggcttcaggtctgggcctca

SEQ ID NO: 528 - DNA, 25 bp, Homo sapien
cccacctcgaagctctgcggttaag

SEQ ID NO: 529 - DNA, 25 bp, Homo sapien
tctgcggttaaggaaggacccaggc

SEQ ID NO: 530 - DNA, 25 bp, Homo sapien
acggctgcgccatgtgtatctgcgg

SEQ ID NO: 531 - DNA, 25 bp, Homo sapien
ccagcagcgaagacatgttccggtc

SEQ ID NO: 532 - DNA, 25 bp, Homo sapien
ttcaggcagctaggaggggacccac

SEQ ID NO: 533 - DNA, 25 bp, Homo sapien
tgacattcacctggggtcttcggtg

SEQ ID NO: 534 - DNA, 25 bp, Homo sapien
cacgcccgacttgggcgagcggatc

SEQ ID NO: 535 - DNA, 25 bp, Homo sapien
cgctcaatggctactgccggctcaa

SEQ ID NO: 536 - DNA, 25 bp, Homo sapien
tgtgcaactccgtcaacgccggctg

SEQ ID NO: 537 - DNA, 25 bp, Homo sapien
ccgagaccggagacgtcatgtgcaa

SEQ ID NO: 538 - DNA, 25 bp, Homo sapien
agcggatcgcactcagcggcgagaa

SEQ ID NO: 539 - DNA, 25 bp, Homo sapien
tgccggctcaactcggtacaggtga

SEQ ID NO: 540 - DNA, 25 bp, Homo sapien
gaggcgcgctactatcagctccagc

SEQ ID NO: 541 - DNA, 25 bp, Homo sapien
ggcgcgatccctgaaacggtgaagc

SEQ ID NO: 542 - DNA, 25 bp, Homo sapien
ttctgtgtcctggacccggttcagg

SEQ ID NO: 543 - DNA, 25 bp, Homo sapien
agcctaacgagaacagggcctatcc

SEQ ID NO: 544 - DNA, 25 bp, Homo sapien
ggtcccgactggcagagcctaacga

SEQ ID NO: 545 - DNA, 25 bp, Homo sapien
accttcgggtgacatcgatggcctc

SEQ ID NO: 546 - DNA, 25 bp, Homo sapien
tcgcaacgagggctctctccaagtc

SEQ ID NO: 547 - DNA, 25 bp, Homo sapien
caaggccctggaattctcgcccggt

SEQ ID NO: 548 - DNA, 25 bp, Homo sapien
agcccgtgtctaggatgtcaccaga

SEQ ID NO: 549 - DNA, 25 bp, Homo sapien
gttgccacacactgcacggagcata

SEQ ID NO: 550 - DNA, 25 bp, Homo sapien
gtcccgaaaactacggctgacggca

SEQ ID NO: 551 - DNA, 25 bp, Homo sapien
gatcgccgcccttggactttgagcg

SEQ ID NO: 552 - DNA, 25 bp, Homo sapien
gtgcccagcacgatcacgtcgtact

SEQ ID NO: 553 - DNA, 25 bp, Homo sapien
gcgtcgccattttggcttccggttc

SEQ ID NO: 554 - DNA, 25 bp, Homo sapien
cgtactcctcattcatggcggggca

SEQ ID NO: 555 - DNA, 25 bp, Homo sapien
tccgtgaccaccctacgaggctggg

SEQ ID NO: 556 - DNA, 25 bp, Homo sapien
cgccacctcagacgggaagagaaga

SEQ ID NO: 557 - DNA, 25 bp, Homo sapien
gcgctcccggcactctaattggtta

SEQ ID NO: 558 - DNA, 25 bp, Homo sapien
ctcagaatcacccaagaagcttttc

SEQ ID NO: 559 - DNA, 25 bp, Homo sapien
agcttttccagcatcgcctgccagg

SEQ ID NO: 560 - DNA, 25 bp, Homo sapien
aagactcgtttcagctggagcaggc

SEQ ID NO: 561 - DNA, 25 bp, Homo sapien
ccgcggctctgtgggaaaagccctc

SEQ ID NO: 562 - DNA, 25 bp, Homo sapien
gggccgccgtttcagcctccagatg

SEQ ID NO: 563 - DNA, 25 bp, Homo sapien
caagtctctaaggaagggtctggcc

SEQ ID NO: 564 - DNA, 25 bp, Homo sapien
gcccagatccgagctgctgcgtacg

SEQ ID NO: 565 - DNA, 25 bp, Homo sapien
aggtcgcccagcagagctttctaga

SEQ ID NO: 566 - DNA, 25 bp, Homo sapien
ctcgtggcacggtcctaaatttgca

SEQ ID NO: 567 - DNA, 25 bp, Homo sapien
ggaggatcaacccactcgacactgg

SEQ ID NO: 568 - DNA, 25 bp, Homo sapien
tgcaaactgaaaccagcagccgagc

SEQ ID NO: 569 - DNA, 25 bp, Homo sapien
tcacttgttgcgctgcccgcacgtt

SEQ ID NO: 570 - DNA, 25 bp, Homo sapien
ccgcacgtttgtcgcggctcctgga

SEQ ID NO: 571 - DNA, 25 bp, Homo sapien
gttccggctctcttatctgcccagt

SEQ ID NO: 572 - DNA, 25 bp, Homo sapien
caggtcatcgtccacccggcttgtt

SEQ ID NO: 573 - DNA, 25 bp, Homo sapien
taggcgtcccgctcctgactggact

SEQ ID NO: 574 - DNA, 25 bp, Homo sapien
cggccacggcctgagtcaaaaggaa

SEQ ID NO: 575 - DNA, 25 bp, Homo sapien
gtcttagaaggatgagcagcggctc

SEQ ID NO: 576 - DNA, 25 bp, Homo sapien
cgtagtccaggccaacaagcgctgc

SEQ ID NO: 577 - DNA, 25 bp, Homo sapien
ggagccaccagtagccggccaagtc

SEQ ID NO: 578 - DNA, 25 bp, Homo sapien
cccttacatcggcagcaagatcagc

SEQ ID NO: 579 - DNA, 25 bp, Homo sapien
tccaccgtagcccttgccaaaggta

SEQ ID NO: 580 - DNA, 25 bp, Homo sapien
acgcgtcttccaactccgaaattcg

SEQ ID NO: 581 - DNA, 25 bp, Homo sapien
gaaattcggggcttctgccgtctta

SEQ ID NO: 582 - DNA, 25 bp, Homo sapien
tggccgccagtcctcaacctccgcc

SEQ ID NO: 583 - DNA, 25 bp, Homo sapien
ccctctaatgcgagaggagagtccg

SEQ ID NO: 584 - DNA, 25 bp, Homo sapien
agagtccgctctaggcgcgggatcc

SEQ ID NO: 585 - DNA, 25 bp, Homo sapien
ggagacgtaacttccggtgtacaca

SEQ ID NO: 586 - DNA, 25 bp, Homo sapien
ccggtgtacacagccggtccaaggc

SEQ ID NO: 587 - DNA, 25 bp, Homo sapien
tgtacacagccggtccaaggcggtg

SEQ ID NO: 588 - DNA, 25 bp, Homo sapien
aggctgccgaggaacgcgcttttcc

SEQ ID NO: 589 - DNA, 25 bp, Homo sapien
cagagtcaggggtgtgtctttctgc

SEQ ID NO: 590 - DNA, 25 bp, Homo sapien
cagctgtctaaaatccatgggcgtg

SEQ ID NO: 591 - DNA, 25 bp, Homo sapien
cgacaagactggatcgcgcagggta

SEQ ID NO: 592 - DNA, 25 bp, Homo sapien
tgagtaggtggcctctccaagcacc

SEQ ID NO: 593 - DNA, 25 bp, Homo sapien
accactcccgatgtgcgcatgagcg

SEQ ID NO: 594 - DNA, 25 bp, Homo sapien
tacgcagcgcgtgcgcacgtgcact

SEQ ID NO: 595 - DNA, 25 bp, Homo sapien
gtgtctgcaaggttcagtctccaca

SEQ ID NO: 596 - DNA, 25 bp, Homo sapien
acatgcgcacaagcgcgcgtcctga

SEQ ID NO: 597 - DNA, 25 bp, Homo sapien
tcgccggtcaacatgactcagcatc

SEQ ID NO: 598 - DNA, 25 bp, Homo sapien
agtgtaccttctagtcccgccatgg

SEQ ID NO: 599 - DNA, 25 bp, Homo sapien
ctgcagcaatggtaccgcgagcacc

SEQ ID NO: 600 - DNA, 25 bp, Homo sapien
gccgcctcttcgatgccaacaagga

SEQ ID NO: 601 - DNA, 25 bp, Homo sapien
aggaccgcttcaaccacttcaggtg

SEQ ID NO: 602 - DNA, 25 bp, Homo sapien
gcacttcgtccttggagtctccttg

SEQ ID NO: 603 - DNA, 25 bp, Homo sapien
aggggctcctttcgcagttgtgaag

SEQ ID NO: 604 - DNA, 25 bp, Homo sapien
ccacatgagcttgggagcgtctgca

SEQ ID NO: 605 - DNA, 25 bp, Homo sapien
agacacctgtgcacgaccgggaagt

SEQ ID NO: 606 - DNA, 25 bp, Homo sapien
gaggccgccgtagtttgcgttttca

SEQ ID NO: 607 - DNA, 25 bp, Homo sapien
ttaaagccacgcctccgcatcggat

SEQ ID NO: 608 - DNA, 25 bp, Homo sapien
ccgcatcggatcctagtaagggagc

SEQ ID NO: 609 - DNA, 25 bp, Homo sapien
agcggggttatcattttagcgtagc

SEQ ID NO: 610 - DNA, 25 bp, Homo sapien
gactgctagcaagctgggcggcatt

SEQ ID NO: 611 - DNA, 25 bp, Homo sapien
tcaggatgctctgcccaccgtggct

SEQ ID NO: 612 - DNA, 25 bp, Homo sapien
cgtttcaccgtctgctgcacgtgtt

SEQ ID NO: 613 - DNA, 25 bp, Homo sapien
gggacctgagcgcacgcgccttaaa

SEQ ID NO: 614 - DNA, 25 bp, Homo sapien
atcggctgcgagctcctcaagaatc

SEQ ID NO: 615 - DNA, 25 bp, Homo sapien
tgaggtccctgtcgtaactccgaag

SEQ ID NO: 616 - DNA, 25 bp, Homo sapien
tcacgagcgggtttacacacggaac

SEQ ID NO: 617 - DNA, 25 bp, Homo sapien
tgatagcgaccaacgcgtcccgagc

SEQ ID NO: 618 - DNA, 25 bp, Homo sapien
gtcgccagccctttgcaagagcctg

SEQ ID NO: 619 - DNA, 25 bp, Homo sapien
caagaatctcgtgctcaccggtttc

SEQ ID NO: 620 - DNA, 25 bp, Homo sapien
ggtttctcccacatcgacctggtga

SEQ ID NO: 621 - DNA, 25 bp, Homo sapien
tccctcgcggatgttgtgactttaa

SEQ ID NO: 622 - DNA, 25 bp, Homo sapien
cggcggcttgaacacgagaagcgca

SEQ ID NO: 623 - DNA, 25 bp, Homo sapien
accctgcggcggcttgaacacgaga

SEQ ID NO: 624 - DNA, 25 bp, Homo sapien
ccctgcggcgagctccgcacacgcc

SEQ ID NO: 625 - DNA, 25 bp, Homo sapien
cacgagaagcgcaggaaggagatca

SEQ ID NO: 626 - DNA, 25 bp, Homo sapien
aaggagatcaaggaggcctggcacc

SEQ ID NO: 627 - DNA, 25 bp, Homo sapien
gcctggcaccgtgcccagaggaagc

SEQ ID NO: 628 - DNA, 25 bp, Homo sapien
tgtcaccggggtacccactcacggc

SEQ ID NO: 629 - DNA, 25 bp, Homo sapien
gccaagccgggtcggagatgctcca

SEQ ID NO: 630 - DNA, 25 bp, Homo sapien
tccggcccggatggcgccagctgcc

SEQ ID NO: 631 - DNA, 25 bp, Homo sapien
agcgcccgctccagcgtttccagcc

SEQ ID NO: 632 - DNA, 25 bp, Homo sapien
agcgcccgatccagcggcatcagcc

SEQ ID NO: 633 - DNA, 25 bp, Homo sapien
tgggagcttacattcctccgccgcg

SEQ ID NO: 634 - DNA, 25 bp, Homo sapien
gcagcgccgtctccttcctcgcatt

SEQ ID NO: 635 - DNA, 25 bp, Homo sapien
ggaaatccgagctcttcccagcggc

SEQ ID NO: 636 - DNA, 25 bp, Homo sapien
tccagctcagcctgcggaaatccga

SEQ ID NO: 637 - DNA, 25 bp, Homo sapien
cagcctgcggaaatccgagctcttc

SEQ ID NO: 638 - DNA, 25 bp, Homo sapien
tgcagctcacaagcgacgcctggga

SEQ ID NO: 639 - DNA, 25 bp, Homo sapien
agctcctcgtgtccggatgtcgcgt

SEQ ID NO: 640 - DNA, 25 bp, Homo sapien
cggacagacggggtgcagctcacaa

SEQ ID NO: 641 - DNA, 25 bp, Homo sapien
ttgtcgcagcatgcccactagcttc

SEQ ID NO: 642 - DNA, 25 bp, Homo sapien
gtcctgccaaacttgtcgcagcatg

SEQ ID NO: 643 - DNA, 25 bp, Homo sapien
cgggacgggcacttcgcaccgctgt

SEQ ID NO: 644 - DNA, 25 bp, Homo sapien
ggacgcctcggactcttgttctcac

SEQ ID NO: 645 - DNA, 25 bp, Homo sapien
atggaggaatccttccgcacacgcc

SEQ ID NO: 646 - DNA, 25 bp, Homo sapien
gccgtcctgtggactgtgcggtccc

SEQ ID NO: 647 - DNA, 25 bp, Homo sapien
acttgctgggccgtcctgtggactg

SEQ ID NO: 648 - DNA, 25 bp, Homo sapien
ccctgcagattgtccagtaccgagg

SEQ ID NO: 649 - DNA, 25 bp, Homo sapien
cagtaccgagggcagcaaaaggttg

SEQ ID NO: 650 - DNA, 25 bp, Homo sapien
agcaaaaggttgacgctgagagtga

SEQ ID NO: 651 - DNA, 25 bp, Homo sapien
ctgttggatggggactgatacctcc

SEQ ID NO: 652 - DNA, 25 bp, Homo sapien
gatggggactgatacctccgggacc

SEQ ID NO: 653 - DNA, 25 bp, Homo sapien
ctccctggcctggtgtgcagcggtc

SEQ ID NO: 654 - DNA, 25 bp, Homo sapien
tgagactccgctggctctgtggcct

SEQ ID NO: 655 - DNA, 25 bp, Homo sapien
cgcggtccttaaactccgtgtcctg

SEQ ID NO: 656 - DNA, 25 bp, Homo sapien
tttgtggcactccagcgtagcaggt

SEQ ID NO: 657 - DNA, 25 bp, Homo sapien
cgtagcaggttgcatctgcgggtcc

SEQ ID NO: 658 - DNA, 25 bp, Homo sapien
gctggatccaggcagctgatgtgca

SEQ ID NO: 659 - DNA, 25 bp, Homo sapien
gttcaggcttccatgcgcgctgaga

SEQ ID NO: 660 - DNA, 25 bp, Homo sapien
tccctctggcatctcgggagacgcg

SEQ ID NO: 661 - DNA, 25 bp, Homo sapien
cccgtcgtgtgtgcgtcacgaggct

SEQ ID NO: 662 - DNA, 25 bp, Homo sapien
gccttcctgttgagccgtgtaaacg

SEQ ID NO: 663 - DNA, 25 bp, Homo sapien
atgtaatttcttggtccgggcgcca

SEQ ID NO: 664 - DNA, 25 bp, Homo sapien
ggcgccatggcccttataagtagag

SEQ ID NO: 665 - DNA, 25 bp, Homo sapien
cgagttgtatcgttcaccagaggac

SEQ ID NO: 666 - DNA, 25 bp, Homo sapien
aatttgcgcatggtcctagctggcc

SEQ ID NO: 667 - DNA, 25 bp, Homo sapien
cggcttccgggacatttgtaccgca

SEQ ID NO: 668 - DNA, 25 bp, Homo sapien
cactgggtcagtcccgcgatagctt

SEQ ID NO: 669 - DNA, 25 bp, Homo sapien
accttggcacggctgcagttttctg

SEQ ID NO: 670 - DNA, 25 bp, Homo sapien
actccggccagtatgagtcccgggg

SEQ ID NO: 671 - DNA, 25 bp, Homo sapien
cgcatggtcctaactgccgggctct

SEQ ID NO: 672 - DNA, 25 bp, Homo sapien
gaagtgtggtcttccggtacctgcg

SEQ ID NO: 673 - DNA, 25 bp, Homo sapien
ttcgttgcgcctggaattttgtccc

SEQ ID NO: 674 - DNA, 25 bp, Homo sapien
ccctgcgcggatgattctgggaaat

SEQ ID NO: 675 - DNA, 25 bp, Homo sapien
ttctgggaaatgtcgatcggctgtg

SEQ ID NO: 676 - DNA, 25 bp, Homo sapien
aaaccgagatctgtttgcccgcggc

SEQ ID NO: 677 - DNA, 25 bp, Homo sapien
gtagcctcaggcctgacggcgactc

SEQ ID NO: 678 - DNA, 25 bp, Homo sapien
gtccgtctctactcggtctcgaaaa

SEQ ID NO: 679 - DNA, 25 bp, Homo sapien
cctgtctggcgttctacccagtgta

SEQ ID NO: 680 - DNA, 25 bp, Homo sapien
acccagtgtagcgttggcaaccaca

SEQ ID NO: 681 - DNA, 25 bp, Homo sapien
cgccgtattacagcggatgggtgca

SEQ ID NO: 682 - DNA, 25 bp, Homo sapien
cccgccgtcgtgtaaaatgcacaca

SEQ ID NO: 683 - DNA, 25 bp, Homo sapien
atcgcggctgacataaaagcgtgta

SEQ ID NO: 684 - DNA, 25 bp, Homo sapien
aagcgtgtaagtgggtcctatcctc

SEQ ID NO: 685 - DNA, 25 bp, Homo sapien
ggagcgcactttctgttctcggtga

SEQ ID NO: 686 - DNA, 25 bp, Homo sapien
gttcaccggctgacccagtgctgct

SEQ ID NO: 687 - DNA, 25 bp, Homo sapien
ttgctgggcgtcgttttttcttctc

SEQ ID NO: 688 - DNA, 25 bp, Homo sapien
cagaaggtcacgaggcgctagagac

SEQ ID NO: 689 - DNA, 25 bp, Homo sapien
ggtgccaaacgcctgcaacggagtg

SEQ ID NO: 690 - DNA, 25 bp, Homo sapien
agtgctgctgacaaccagcgtccgc

SEQ ID NO: 691 - DNA, 25 bp, Homo sapien
gaaagagctagagcacccacaggtg

SEQ ID NO: 692 - DNA, 25 bp, Homo sapien
agctgctcctctactccgcgtaggg

SEQ ID NO: 693 - DNA, 25 bp, Homo sapien
cgcgtgggaccatctggtgccaaac

SEQ ID NO: 694 - DNA, 25 bp, Homo sapien
tccaaccgaaaaggcgcgggactgc

SEQ ID NO: 695 - DNA, 25 bp, Homo sapien
gcctcctagcggtgatgtccaaccg

SEQ ID NO: 696 - DNA, 25 bp, Homo sapien
gcctacccggtagcggctgtttaga

SEQ ID NO: 697 - DNA, 25 bp, Homo sapien
gaccgcgaggcgatccagaccagat

SEQ ID NO: 698 - DNA, 25 bp, Homo sapien
ctgttacgcaattgagccgccgttg

SEQ ID NO: 699 - DNA, 25 bp, Homo sapien
ccagggctcgaagaaacgcagcaga

SEQ ID NO: 700 - DNA, 25 bp, Homo sapien
gactctcgagcttcgggattccgcc

SEQ ID NO: 701 - DNA, 25 bp, Homo sapien
gcaccgctcaggactgcagctgttg

SEQ ID NO: 702 - DNA, 25 bp, Homo sapien
aaatctcccgctttcaggccaggtg

SEQ ID NO: 703 - DNA, 25 bp, Homo sapien
gcgcgcctcgacagtcctgaacatt

SEQ ID NO: 704 - DNA, 25 bp, Homo sapien
gagcctaacgcctgcaaccgagtga

SEQ ID NO: 705 - DNA, 25 bp, Homo sapien
tccaaggatccaacagcgcacaagc

SEQ ID NO: 706 - DNA, 25 bp, Homo sapien
acaagctgctcttcacgggcaacta

SEQ ID NO: 707 - DNA, 25 bp, Homo sapien
tccctgtctggtctggatcacctcg

SEQ ID NO: 708 - DNA, 25 bp, Homo sapien
tggcctagctagacaagtgcttctc

SEQ ID NO: 709 - DNA, 25 bp, Homo sapien
tgcttctcacgatccagcgcgttta

SEQ ID NO: 710 - DNA, 25 bp, Homo sapien
tgtgacggctcaggactgcatttcc

SEQ ID NO: 711 - DNA, 25 bp, Homo sapien
ggaacccggactgagacatgcgtga

SEQ ID NO: 712 - DNA, 25 bp, Homo sapien
ccgccgggcaacttgaatttctgca

SEQ ID NO: 713 - DNA, 25 bp, Homo sapien
cccggcagcgagctttggagttcat

SEQ ID NO: 714 - DNA, 25 bp, Homo sapien
ccagttcattgtggtcgttgacccg

SEQ ID NO: 715 - DNA, 25 bp, Homo sapien
aggctgcagctatccggccaatgta

SEQ ID NO: 716 - DNA, 25 bp, Homo sapien
ccagcttcgaggtctatggctccca

SEQ ID NO: 717 - DNA, 25 bp, Homo sapien
agcggccactggaacgacctcaatc

SEQ ID NO: 718 - DNA, 25 bp, Homo sapien
tttctcctcctgtcagcggaactgg

SEQ ID NO: 719 - DNA, 25 bp, Homo sapien
attatcgtcgctattttgtgccggc

SEQ ID NO: 720 - DNA, 25 bp, Homo sapien
tatggccctgatgtgattatattaa

SEQ ID NO: 721 - DNA, 25 bp, Homo sapien
ctcctcctttttattgaagtcattt

SEQ ID NO: 722 - DNA, 25 bp, Homo sapien
gccgcctgtaattatggccctgatg

SEQ ID NO: 723 - DNA, 25 bp, Homo sapien
tctgaggccgcctgtaattatggcc

SEQ ID NO: 724 - DNA, 25 bp, Homo sapien
agcttaatcgaatccggcactgggg

SEQ ID NO: 725 - DNA, 25 bp, Homo sapien
attttgtgccggcttccgcccggcg

SEQ ID NO: 726 - DNA, 25 bp, Homo sapien
tggagaactcgctttgcaaaaaaga

SEQ ID NO: 727 - DNA, 25 bp, Homo sapien
aacatgctgctcactgtcgtgggta

SEQ ID NO: 728 - DNA, 25 bp, Homo sapien
cgctgctgctggacaacatgctgct

SEQ ID NO: 729 - DNA, 25 bp, Homo sapien
ccggactgacggagcccactgcggt

SEQ ID NO: 730 - DNA, 25 bp, Homo sapien
ttctaggttgggtctccagattggg

SEQ ID NO: 731 - DNA, 25 bp, Homo sapien
ccatggccctgagcgagctggcgct

SEQ ID NO: 732 - DNA, 25 bp, Homo sapien
cgctcgcggaagctcatcctgttca

SEQ ID NO: 733 - DNA, 25 bp, Homo sapien
atcctgttcatcgtgttcctggcgc

SEQ ID NO: 734 - DNA, 25 bp, Homo sapien
acagctacgtctacttccagggtgc

SEQ ID NO: 735 - DNA, 25 bp, Homo sapien
taccatgtcgtccacggaggagctg

SEQ ID NO: 736 - DNA, 25 bp, Homo sapien
taagaagttcgagcggacgtcatcc

SEQ ID NO: 737 - DNA, 25 bp, Homo sapien
ggggagtctgaacagtcctgattcc

SEQ ID NO: 738 - DNA, 25 bp, Homo sapien
cagggtttcatcacccaccggggtg

SEQ ID NO: 739 - DNA, 25 bp, Homo sapien
ggccgctctcgatctcagactcgga

SEQ ID NO: 740 - DNA, 25 bp, Homo sapien
ggttcacaagtcatggccgctctcg

SEQ ID NO: 741 - DNA, 25 bp, Homo sapien
tgccctcaggaatgtccggcccaga

SEQ ID NO: 742 - DNA, 25 bp, Homo sapien
ggtctcgcaggctgaggctaccacc

SEQ ID NO: 743 - DNA, 25 bp, Homo sapien
cccagtgctcttcctgcgcgtgtgg

SEQ ID NO: 744 - DNA, 25 bp, Homo sapien
agagcggatctcgtcgggtctccac

SEQ ID NO: 745 - DNA, 25 bp, Homo sapien
gatcgcgagtttctgcccagcctct

SEQ ID NO: 746 - DNA, 25 bp, Homo sapien
agagttgccctctcccgtactgtca

SEQ ID NO: 747 - DNA, 25 bp, Homo sapien
gaagggcctaacgtccaagcactca

SEQ ID NO: 748 - DNA, 25 bp, Homo sapien
tctcaacaccgagaacagaagcgtg

SEQ ID NO: 749 - DNA, 25 bp, Homo sapien
ccgtactgtcattggcctggcgcca

SEQ ID NO: 750 - DNA, 25 bp, Homo sapien
tcccaccgtccttggctgttgcggg

SEQ ID NO: 751 - DNA, 25 bp, Homo sapien
atggagacaggatcgggaccagccc

SEQ ID NO: 752 - DNA, 25 bp, Homo sapien
gggcctctgcacatggctctggccg

SEQ ID NO: 753 - DNA, 25 bp, Homo sapien
accgggcgactagagctcagggacc

SEQ ID NO: 754 - DNA, 25 bp, Homo sapien
catgttcgagtaaggaccgggcgac

SEQ ID NO: 755 - DNA, 25 bp, Homo sapien
ccgcgccgcatccatgttcgagtaa

SEQ ID NO: 756 - DNA, 25 bp, Homo sapien
tccaggaccgcgtgcttgaggtcat

SEQ ID NO: 757 - DNA, 25 bp, Homo sapien
gtcctgtgtgctcggaattgacttc

SEQ ID NO: 758 - DNA, 25 bp, Homo sapien
ccaaggctgagaagctgtctctgga

SEQ ID NO: 759 - DNA, 25 bp, Homo sapien
cagagcgagagctcgccaaggctga

SEQ ID NO: 760 - DNA, 25 bp, Homo sapien
aagctgtctctggaggaaggcggga

SEQ ID NO: 761 - DNA, 25 bp, Homo sapien
atgcccggggcttgctatccggcct

SEQ ID NO: 762 - DNA, 25 bp, Homo sapien
gggccggcattcacacctcgggtac

SEQ ID NO: 763 - DNA, 25 bp, Homo sapien
cggcattcacacctcgggtacgttc

SEQ ID NO: 764 - DNA, 25 bp, Homo sapien
gcattcacacctcgggtacgttccg

SEQ ID NO: 765 - DNA, 25 bp, Homo sapien
cgcagagcgagagctcgccaaggct

SEQ ID NO: 766 - DNA, 25 bp, Homo sapien
gttcccagaagtcgcggtccctgcg

SEQ ID NO: 767 - DNA, 25 bp, Homo sapien
aaacgcggagtcagctgctcccgga

SEQ ID NO: 768 - DNA, 25 bp, Homo sapien
cgaggaaacgcggagtcagctgctc

SEQ ID NO: 769 - DNA, 25 bp, Homo sapien
aagtcagcttcagaagttgtgcgcg

SEQ ID NO: 770 - DNA, 25 bp, Homo sapien
cccgccaagtcagcttcagaagttg

SEQ ID NO: 771 - DNA, 25 bp, Homo sapien
gtgcacctagcggatgtgcccggct

SEQ ID NO: 772 - DNA, 25 bp, Homo sapien
cggggtcggagacacacagaccacc

SEQ ID NO: 773 - DNA, 25 bp, Homo sapien
gggacattctaaccgccgccaggtc

SEQ ID NO: 774 - DNA, 25 bp, Homo sapien
gccgtgtatgggatgaccttcaaaa

SEQ ID NO: 775 - DNA, 25 bp, Homo sapien
tgggatgaccttcaaaattctttgc

SEQ ID NO: 776 - DNA, 25 bp, Homo sapien
accgaggccgtgtatgggatgacct

SEQ ID NO: 777 - DNA, 25 bp, Homo sapien
cttcaaaattctttgcatctcctgc

SEQ ID NO: 778 - DNA, 25 bp, Homo sapien
tgcaagcgccgcagcgagaccaacg

SEQ ID NO: 779 - DNA, 25 bp, Homo sapien
cagcgagaccaacgctgagaccttc

SEQ ID NO: 780 - DNA, 25 bp, Homo sapien
cgctgagaccttcaccgagtggacc

SEQ ID NO: 781 - DNA, 25 bp, Homo sapien
ttcaccgagtggaccttccgccaga

SEQ ID NO: 782 - DNA, 25 bp, Homo sapien
ctggtgtttacctggccctgggtct

SEQ ID NO: 783 - DNA, 25 bp, Homo sapien
tgttatctgcctgcggacgcttccg

SEQ ID NO: 784 - DNA, 25 bp, Homo sapien
tggcgggacagtgtgttatctgcct

SEQ ID NO: 785 - DNA, 25 bp, Homo sapien
cacgtctggtgtttacctggccctg

SEQ ID NO: 786 - DNA, 25 bp, Homo sapien
ccctgcacgtctggtgtttacctgg

SEQ ID NO: 787 - DNA, 25 bp, Homo sapien
agccgaggccgactgtgtccggcgt

SEQ ID NO: 788 - DNA, 25 bp, Homo sapien
cgggtggcctatctggggcaagcag

SEQ ID NO: 789 - DNA, 25 bp, Homo sapien
acagtgtgttatctgcctgcggacg

SEQ ID NO: 790 - DNA, 25 bp, Homo sapien
gacgctcggctcatggtctttgaca

SEQ ID NO: 791 - DNA, 25 bp, Homo sapien
tctttgacaagacggaagggacgtg

SEQ ID NO: 792 - DNA, 25 bp, Homo sapien
tcagctctgcggacgctcggctcat

SEQ ID NO: 793 - DNA, 25 bp, Homo sapien
gctcggctcatggtctttgacaaga

SEQ ID NO: 794 - DNA, 25 bp, Homo sapien
gctccaacgccagggtagccggact

SEQ ID NO: 795 - DNA, 25 bp, Homo sapien
gggcactgacccactccgagctgga

SEQ ID NO: 796 - DNA, 25 bp, Homo sapien
tagccggactcagctgcgaggagat

SEQ ID NO: 797 - DNA, 25 bp, Homo sapien
cagctgcgaggagatgggcttcctc

SEQ ID NO: 798 - DNA, 25 bp, Homo sapien
tgagctcggactcgtcttgtccttg

SEQ ID NO: 799 - DNA, 25 bp, Homo sapien
ctcctccaggaaagcgattggctgc

SEQ ID NO: 800 - DNA, 25 bp, Homo sapien
gttgtcttcgaggttggcgctcctc

SEQ ID NO: 801 - DNA, 25 bp, Homo sapien
acccgcccagtgctgagttgtcttc

SEQ ID NO: 802 - DNA, 25 bp, Homo sapien
cgcacaagcagcagaggggaacccg

SEQ ID NO: 803 - DNA, 25 bp, Homo sapien
cgcaagaggcgcaaaaggcacagct

SEQ ID NO: 804 - DNA, 25 bp, Homo sapien
ggagggtgcacagcgcatttattga

SEQ ID NO: 805 - DNA, 25 bp, Homo sapien
tcgcccatctagaagggcaccaggc

SEQ ID NO: 806 - DNA, 25 bp, Homo sapien
cacgaagcagggttgcccttccagc

SEQ ID NO: 807 - DNA, 25 bp, Homo sapien
ccttggaggcatcggccaccacgaa

SEQ ID NO: 808 - DNA, 25 bp, Homo sapien
tcagcgtccgtgtcccggtgccagg

SEQ ID NO: 809 - DNA, 25 bp, Homo sapien
cggccaccggtccagtggaagagca

SEQ ID NO: 810 - DNA, 25 bp, Homo sapien
tgcgtctctcgaagcggccaccggt

SEQ ID NO: 811 - DNA, 25 bp, Homo sapien
ggatgtctgtgcgtctctcgaagcg

SEQ ID NO: 812 - DNA, 25 bp, Homo sapien
ctcggcgtcattgggccgcagcagc

SEQ ID NO: 813 - DNA, 25 bp, Homo sapien
ttccagccacaggagctcggcgtca

SEQ ID NO: 814 - DNA, 25 bp, Homo sapien
accttgatcttcttggtgacccagc

SEQ ID NO: 815 - DNA, 25 bp, Homo sapien
ccactcattggacgagcagcgcgtg

SEQ ID NO: 816 - DNA, 25 bp, Homo sapien
tccattttgaggacatcgggcggct

SEQ ID NO: 817 - DNA, 25 bp, Homo sapien
cccggcactggcttgatgtagcgga

SEQ ID NO: 818 - DNA, 25 bp, Homo sapien
cgccgccataaaggtactcccttag

SEQ ID NO: 819 - DNA, 25 bp, Homo sapien
gtgtcccgcaactcccggaacagga

SEQ ID NO: 820 - DNA, 25 bp, Homo sapien
tggtcttgatgaagggcaccgtctc

SEQ ID NO: 821 - DNA, 25 bp, Homo sapien
ggaagtagcaagtctcccgcgtcgg

SEQ ID NO: 822 - DNA, 25 bp, Homo sapien
ctacagcgccgcttggcgcccgccg

SEQ ID NO: 823 - DNA, 25 bp, Homo sapien
gatgccggtgcaagttcaaccagca

SEQ ID NO: 824 - DNA, 25 bp, Homo sapien
gaagatgccggtgcaagttcaacca

SEQ ID NO: 825 - DNA, 25 bp, Homo sapien
cagaagatgccggtgcaagttcaac

SEQ ID NO: 826 - DNA, 25 bp, Homo sapien
caggcagaagatgccggtgcaagtt

SEQ ID NO: 827 - DNA, 25 bp, Homo sapien
cccacaggcagaagatgccggtgca

SEQ ID NO: 828 - DNA, 25 bp, Homo sapien
cacgcccacaggcagaagatgccgg

SEQ ID NO: 829 - DNA, 25 bp, Homo sapien
tggagctacagcgccgcttggcgcc

SEQ ID NO: 830 - DNA, 25 bp, Homo sapien
atcaggcccgcgtcatcgagactct

SEQ ID NO: 831 - DNA, 25 bp, Homo sapien
gaacctgggcatcgtgttcgggccc

SEQ ID NO: 832 - DNA, 25 bp, Homo sapien
gtggagcaggacaacaagatgaccc

SEQ ID NO: 833 - DNA, 25 bp, Homo sapien
gctgcgtcacctacgcaggtgagtc

SEQ ID NO: 834 - DNA, 25 bp, Homo sapien
cctctaccacgagctcgtagggctg

SEQ ID NO: 835 - DNA, 25 bp, Homo sapien
tcatcgtccactacggcctggtctt

SEQ ID NO: 836 - DNA, 25 bp, Homo sapien
actgacgccgctctgggtggaaccc

SEQ ID NO: 837 - DNA, 25 bp, Homo sapien
gctgacccttgactctgcgcagctt

SEQ ID NO: 838 - DNA, 25 bp, Homo sapien
agagggctggttccaaggaccgctt

SEQ ID NO: 839 - DNA, 25 bp, Homo sapien
catccgccgtgagtctggggagact

SEQ ID NO: 840 - DNA, 25 bp, Homo sapien
agaatgacccccgatctccgtgttc

SEQ ID NO: 841 - DNA, 25 bp, Homo sapien
tctgtccacccgcaggcggtagaaa

SEQ ID NO: 842 - DNA, 25 bp, Homo sapien
cccgcaggcggtagaaacacctgga

SEQ ID NO: 843 - DNA, 25 bp, Homo sapien
acacctggagcgatggaatccggcc

SEQ ID NO: 844 - DNA, 25 bp, Homo sapien
ccaggtgctgcagctctgacacggc

SEQ ID NO: 845 - DNA, 25 bp, Homo sapien
gctccatccgccgtgagtctgggga

SEQ ID NO: 846 - DNA, 25 bp, Homo sapien
ctccgggatctgagagcctaggaga

SEQ ID NO: 847 - DNA, 25 bp, Homo sapien
tcggacaggtcgctatggcaaccgg

SEQ ID NO: 848 - DNA, 25 bp, Homo sapien
aagggatgctcggacaggtcgctat

SEQ ID NO: 849 - DNA, 25 bp, Homo sapien
cctgtgccagacctgcggttggaga

SEQ ID NO: 850 - DNA, 25 bp, Homo sapien
ggcaggcgtcctgtgccagacctgc

SEQ ID NO: 851 - DNA, 25 bp, Homo sapien
gtgtcgggagattcaagcaatggta

SEQ ID NO: 852 - DNA, 25 bp, Homo sapien
cccacaaagggtgagcgtcgtttgg

SEQ ID NO: 853 - DNA, 25 bp, Homo sapien
caagcaatggtaaggcaagggagtt

SEQ ID NO: 854 - DNA, 25 bp, Homo sapien
tctccacgaggctgccggcttagga

SEQ ID NO: 855 - DNA, 25 bp, Homo sapien
cacaccctccgcctggacgcagcag

SEQ ID NO: 856 - DNA, 25 bp, Homo sapien
agctccgacgtaagtccctctcgtg

SEQ ID NO: 857 - DNA, 25 bp, Homo sapien
tcctctcctgggctacagtgggccg

SEQ ID NO: 858 - DNA, 25 bp, Homo sapien
cctcggaccagtgcctcttaggtct

SEQ ID NO: 859 - DNA, 25 bp, Homo sapien
agtgcctcttaggtctctccagcgc

SEQ ID NO: 860 - DNA, 25 bp, Homo sapien
ctctgagcgcgggaggcgttactca

SEQ ID NO: 861 - DNA, 25 bp, Homo sapien
cgggaggcgttactcactcttcctc

SEQ ID NO: 862 - DNA, 25 bp, Homo sapien
tgcacgaagcacttgtagacggccg

SEQ ID NO: 863 - DNA, 25 bp, Homo sapien
ggggctcgctttatttcaccaccag

SEQ ID NO: 864 - DNA, 25 bp, Homo sapien
ccaggacggtgaccacgagcagcac

SEQ ID NO: 865 - DNA, 25 bp, Homo sapien
gggcatcgttctctctccactgagc

SEQ ID NO: 866 - DNA, 25 bp, Homo sapien
ccagaaaggtggtgaagtcctggcc

SEQ ID NO: 867 - DNA, 25 bp, Homo sapien
ttgaactgggccacgagctcctgct

SEQ ID NO: 868 - DNA, 25 bp, Homo sapien
tagacggccggctggaaaacctgca

SEQ ID NO: 869 - DNA, 25 bp, Homo sapien
tcgttggcacgccagttgacgggcc

SEQ ID NO: 870 - DNA, 25 bp, Homo sapien
ggtcatctaactgggagacacagga

SEQ ID NO: 871 - DNA, 25 bp, Homo sapien
cccagccaggactttgcttagactc

SEQ ID NO: 872 - DNA, 25 bp, Homo sapien
ctcaacaggtgaatcgctccaagtg

SEQ ID NO: 873 - DNA, 25 bp, Homo sapien
cgctccaagtgggtctcggttgcat

SEQ ID NO: 874 - DNA, 25 bp, Homo sapien
tccagaatgcaacaggacggacttg

SEQ ID NO: 875 - DNA, 25 bp, Homo sapien
gtccacgtcgtttacgctcattaaa

SEQ ID NO: 876 - DNA, 25 bp, Homo sapien
gcatgccctttgtccacgtcgttta

SEQ ID NO: 877 - DNA, 25 bp, Homo sapien
ccttgtgtacctgggccgaaccatt

SEQ ID NO: 878 - DNA, 25 bp, Homo sapien
cgggaaagtttagtcgtctgatctg

SEQ ID NO: 879 - DNA, 25 bp, Homo sapien
atgcgtctgtaaagcgccgcgtccc

SEQ ID NO: 880 - DNA, 25 bp, Homo sapien
ggctgctcccgtatgcgtctgtaaa

SEQ ID NO: 881 - DNA, 25 bp, Homo sapien
agaaccatttgttcggccgcgcggg

SEQ ID NO: 882 - DNA, 25 bp, Homo sapien
ggaacactgatgaagccctgccata

SEQ ID NO: 883 - DNA, 25 bp, Homo sapien
actttactgtctccaaactcgggca

SEQ ID NO: 884 - DNA, 25 bp, Homo sapien
cccttgcagaacttggccctgagtc

SEQ ID NO: 885 - DNA, 25 bp, Homo sapien
cgtataatcacaagctctggagaga

SEQ ID NO: 886 - DNA, 25 bp, Homo sapien
ggcgaccacaacatccagtaccagt

SEQ ID NO: 887 - DNA, 25 bp, Homo sapien
gagcagacagcggtggccatcacca

SEQ ID NO: 888 - DNA, 25 bp, Homo sapien
atccagtaccagttccgcacagaga

SEQ ID NO: 889 - DNA, 25 bp, Homo sapien
tccgcacagagacaaatggaggaca

SEQ ID NO: 890 - DNA, 25 bp, Homo sapien
cctgcaggtgacataccgcgtagtc

SEQ ID NO: 891 - DNA, 25 bp, Homo sapien
taccgcgtagtccaggtgactgatg

SEQ ID NO: 892 - DNA, 25 bp, Homo sapien
tgactgatggtcagctggacggcca

SEQ ID NO: 893 - DNA, 25 bp, Homo sapien
cagggcgacacagctggcgccgtca

SEQ ID NO: 894 - DNA, 25 bp, Homo sapien
ctcaggcatgatccgtcagcgaagc

SEQ ID NO: 895 - DNA, 25 bp, Homo sapien
gccagaccaaccagcgcatgcagga

SEQ ID NO: 896 - DNA, 25 bp, Homo sapien
ccaaggcctgcgattacatccggga

SEQ ID NO: 897 - DNA, 25 bp, Homo sapien
ccgacccttgcatgcagaaagtcca

SEQ ID NO: 898 - DNA, 25 bp, Homo sapien
ctggatcgtccagctttcgaaaatc

SEQ ID NO: 899 - DNA, 25 bp, Homo sapien
ctgtgactctgttttccgcagtgga

SEQ ID NO: 900 - DNA, 25 bp, Homo sapien
atgagaacgccctgcttcgagccca

SEQ ID NO: 901 - DNA, 25 bp, Homo sapien
catgcaggagaccttcaaagaggcc

SEQ ID NO: 902 - DNA, 25 bp, Homo sapien
tggggcgatgaatccagaccctgga

SEQ ID NO: 903 - DNA, 25 bp, Homo sapien
ctcacggagggctcttggccgtttc

SEQ ID NO: 904 - DNA, 25 bp, Homo sapien
ctgctcaccagctctagaagacgtg

SEQ ID NO: 905 - DNA, 25 bp, Homo sapien
ctcgtccagcataactgaggtgcca

SEQ ID NO: 906 - DNA, 25 bp, Homo sapien
tgccaggacacaggaccgacatcgc

SEQ ID NO: 907 - DNA, 25 bp, Homo sapien
gcaccctccacttgggtcaaagctt

SEQ ID NO: 908 - DNA, 25 bp, Homo sapien
gtcaaagctttatcactgcaggcga

SEQ ID NO: 909 - DNA, 25 bp, Homo sapien
gtggcacccagaagctgctcaccag

SEQ ID NO: 910 - DNA, 25 bp, Homo sapien
accaccgtctgtgtgtacgtctgtc

SEQ ID NO: 911 - DNA, 25 bp, Homo sapien
gcgcccgaactagagagtgtacttc

SEQ ID NO: 912 - DNA, 25 bp, Homo sapien
atgggcttgagcacacatactttta

SEQ ID NO: 913 - DNA, 25 bp, Homo sapien
cccatgctggtcctctgggaactca

SEQ ID NO: 914 - DNA, 25 bp, Homo sapien
gggcgaggaccagactccaagttaa

SEQ ID NO: 915 - DNA, 25 bp, Homo sapien
ctcctagatggacgctgacaaaccc

SEQ ID NO: 916 - DNA, 25 bp, Homo sapien
gcgtttcagaagtagcataggctcc

SEQ ID NO: 917 - DNA, 25 bp, Homo sapien
gtccttgctcggtcctaggctttca

SEQ ID NO: 918 - DNA, 25 bp, Homo sapien
gtgcatggtgtctggtacttcaata

SEQ ID NO: 919 - DNA, 25 bp, Homo sapien
tgccgctttgacttcccggatgagc

SEQ ID NO: 920 - DNA, 25 bp, Homo sapien
ttcaagtcgcgcacccaagtagtcc

SEQ ID NO: 921 - DNA, 25 bp, Homo sapien
agtagtccacgagagcttccagggc

SEQ ID NO: 922 - DNA, 25 bp, Homo sapien
gagctgggcgggaagtactacttcc

SEQ ID NO: 923 - DNA, 25 bp, Homo sapien
gggcggctacaaccagtacaccttc

SEQ ID NO: 924 - DNA, 25 bp, Homo sapien
acagcgtcctggatatcgtcagtga

SEQ ID NO: 925 - DNA, 25 bp, Homo sapien
ccttcgaaggcacgtgcgtctccat

SEQ ID NO: 926 - DNA, 25 bp, Homo sapien
tgctctgtggggctgacagcaaccc

SEQ ID NO: 927 - DNA, 25 bp, Homo sapien
cgaagacggcgtctatgcctgcctg

SEQ ID NO: 928 - DNA, 25 bp, Homo sapien
aatgcctatggccaggacaaccgca

SEQ ID NO: 929 - DNA, 25 bp, Homo sapien
cccggtgattgtggagatgaactcc

SEQ ID NO: 930 - DNA, 25 bp, Homo sapien
ttgtggagatgaactcctcggtgga

SEQ ID NO: 931 - DNA, 25 bp, Homo sapien
cctgcctggccgagaatgcctatgg

SEQ ID NO: 932 - DNA, 25 bp, Homo sapien
atcgagggctcccacgtgagcctgc

SEQ ID NO: 933 - DNA, 25 bp, Homo sapien
gctcccacgtgagcctgctctgtgg

SEQ ID NO: 934 - DNA, 25 bp, Homo sapien
tagagccatactagggaggcagaca

SEQ ID NO: 935 - DNA, 25 bp, Homo sapien
ccggttggcagacgtgctccgtcac

SEQ ID NO: 936 - DNA, 25 bp, Homo sapien
aaccgctgagggctttagagccata

SEQ ID NO: 937 - DNA, 25 bp, Homo sapien
cggagacttccgcaaagcaggtgct

SEQ ID NO: 938 - DNA, 25 bp, Homo sapien
aagcaggtgctgaaaccgagggtcc

SEQ ID NO: 939 - DNA, 25 bp, Homo sapien
gaaaagaggcccgagcacaagctcg

SEQ ID NO: 940 - DNA, 25 bp, Homo sapien
acaagctcgagggacgagtaccgga

SEQ ID NO: 941 - DNA, 25 bp, Homo sapien
actgattaattctgggcgtggggct

SEQ ID NO: 942 - DNA, 25 bp, Homo sapien
cgggccaccctcagacctgattttg

SEQ ID NO: 943 - DNA, 25 bp, Homo sapien
tctgcaccgcgaggaacctctatgg

SEQ ID NO: 944 - DNA, 25 bp, Homo sapien
aatgtgaccgtgaacgagagcgagc

SEQ ID NO: 945 - DNA, 25 bp, Homo sapien
ctgccatcgcgcaatgtgaccgtga

SEQ ID NO: 946 - DNA, 25 bp, Homo sapien
ccgtccgtggcctttgagctgccat

SEQ ID NO: 947 - DNA, 25 bp, Homo sapien
tactcggagcgcagcggcctcgtgc

SEQ ID NO: 948 - DNA, 25 bp, Homo sapien
tgcctgtgcgtggtgaagtccaacc

SEQ ID NO: 949 - DNA, 25 bp, Homo sapien
cagcccgagacacggtgcagtgcct

SEQ ID NO: 950 - DNA, 25 bp, Homo sapien
tgctgctctgcgtaggaccctacaa

SEQ ID NO: 951 - DNA, 25 bp, Homo sapien
tgggcatcaacacaccggtcaacgg

SEQ ID NO: 952 - DNA, 25 bp, Homo sapien
gcagctctccttcggcctctatgtg

SEQ ID NO: 953 - DNA, 25 bp, Homo sapien
tagcctggtctacgccctgaacctg

SEQ ID NO: 954 - DNA, 25 bp, Homo sapien
gacctgctgctgacagtctctctgc

SEQ ID NO: 955 - DNA, 25 bp, Homo sapien
ttcttcccactctatgccggcgggg

SEQ ID NO: 956 - DNA, 25 bp, Homo sapien
aagccttccggaggccgtgctattc

SEQ ID NO: 957 - DNA, 25 bp, Homo sapien
tcctgtgtcacctgggtctggtctt

SEQ ID NO: 958 - DNA, 25 bp, Homo sapien
tggcgtgtgcaccatctagggacca

SEQ ID NO: 959 - DNA, 25 bp, Homo sapien
tgctgacgtcccatgcctctacggg

SEQ ID NO: 960 - DNA, 25 bp, Homo sapien
tgctgtgacatcagggcaattagcc

SEQ ID NO: 961 - DNA, 25 bp, Homo sapien
tcggtaacatcacagcaggtccagg

SEQ ID NO: 962 - DNA, 25 bp, Homo sapien
ggtccaggccaatgataaccttata

SEQ ID NO: 963 - DNA, 25 bp, Homo sapien
tcgcgccgctatcacgcggtagaaa

SEQ ID NO: 964 - DNA, 25 bp, Homo sapien
agcgcgacatcgtcctcaccaatgt

SEQ ID NO: 965 - DNA, 25 bp, Homo sapien
aatgtcaccgttgtccagttgctgc

SEQ ID NO: 966 - DNA, 25 bp, Homo sapien
ccgatgggtccatggtgaaataaaa

SEQ ID NO: 967 - DNA, 25 bp, Homo sapien
cgaatatggctacagtcaccgggtg

SEQ ID NO: 968 - DNA, 25 bp, Homo sapien
tggtcgacctcctccgctacatgtt

SEQ ID NO: 969 - DNA, 25 bp, Homo sapien
atgtgcctcccgttccagcatctgg

SEQ ID NO: 970 - DNA, 25 bp, Homo sapien
ataaaaaacagtgctcacggctgcg

SEQ ID NO: 971 - DNA, 25 bp, Homo sapien
gtcccgtatctctgcgccggtcagg

SEQ ID NO: 972 - DNA, 25 bp, Homo sapien
ttccacttcaggagaccgggaccgc

SEQ ID NO: 973 - DNA, 25 bp, Homo sapien
gctacatgttcagccgagacaagtg

SEQ ID NO: 974 - DNA, 25 bp, Homo sapien
tgcgtctccaatcacgatgcgctgg

SEQ ID NO: 975 - DNA, 25 bp, Homo sapien
cccttgataaggatggagctgcagc

SEQ ID NO: 976 - DNA, 25 bp, Homo sapien
gggcgcccttcatcaccagcaagtg

SEQ ID NO: 977 - DNA, 25 bp, Homo sapien
tccgagaacttgagcagcgccgtct

SEQ ID NO: 978 - DNA, 25 bp, Homo sapien
tcaccttgggcacaggcactgcatc

SEQ ID NO: 979 - DNA, 25 bp, Homo sapien
gcactgcatcctggccggacttgaa

SEQ ID NO: 980 - DNA, 25 bp, Homo sapien
tctccgaggactggtcaaacgtctg

SEQ ID NO: 981 - DNA, 25 bp, Homo sapien
ctcgcagacttttgggaagcggtcc

SEQ ID NO: 982 - DNA, 25 bp, Homo sapien
cgccacacttgaagaggctgaggga

SEQ ID NO: 983 - DNA, 25 bp, Homo sapien
cgggcgccacacttgaagaggctga

SEQ ID NO: 984 - DNA, 25 bp, Homo sapien
taagattactatgcagcgcccgagc

SEQ ID NO: 985 - DNA, 25 bp, Homo sapien
atgacgtcactgttggcgcgcccgt

SEQ ID NO: 986 - DNA, 25 bp, Homo sapien
cccggcaaccgatgacgtcactgtt

SEQ ID NO: 987 - DNA, 25 bp, Homo sapien
gtctgcccggcaaccgatgacgtca

SEQ ID NO: 988 - DNA, 25 bp, Homo sapien
gattactatgcagcgcccgagcccg

SEQ ID NO: 989 - DNA, 25 bp, Homo sapien
ctgtcatggagctagcgcaggaagc

SEQ ID NO: 990 - DNA, 25 bp, Homo sapien
gagtgataaaagtcgtcccagagcc

SEQ ID NO: 991 - DNA, 25 bp, Homo sapien
tccaggcctcgataggccggagata

SEQ ID NO: 992 - DNA, 25 bp, Homo sapien
cgcgcccgaatgtatgacgtcatgc

SEQ ID NO: 993 - DNA, 25 bp, Homo sapien
gtcgcttttgctggacgtcatcctc

SEQ ID NO: 994 - DNA, 25 bp, Homo sapien
gaatctcggagcctccaggcctcga

SEQ ID NO: 995 - DNA, 25 bp, Homo sapien
taaggcccgcgacagagagtgataa

SEQ ID NO: 996 - DNA, 25 bp, Homo sapien
agagccagagccaccgaatctcgga

SEQ ID NO: 997 - DNA, 25 bp, Homo sapien
agcagagactgtagtagcggcgaca

SEQ ID NO: 998 - DNA, 25 bp, Homo sapien
ccctaatgggatttctgctgtgctc

SEQ ID NO: 999 - DNA, 25 bp, Homo sapien
gtttcgatcccttcgctcgcgtttc

SEQ ID NO: 1000 - DNA, 25 bp, Homo sapien
ctcttctagttctcgggagccggga

SEQ ID NO: 1001 - DNA, 25 bp, Homo sapien
gcgttcccttcgtgagcccttggga

SEQ ID NO: 1002 - DNA, 25 bp, Homo sapien
tgggatcttcctgcgttacagactg

SEQ ID NO: 1003 - DNA, 25 bp, Homo sapien
cccgagagtttccttttgcacaacg

SEQ ID NO: 1004 - DNA, 25 bp, Homo sapien
ctggaacacgcctttgagaagaatc

SEQ ID NO: 1005 - DNA, 25 bp, Homo sapien
ctctatacttttccggaggggcaat

SEQ ID NO: 1006 - DNA, 25 bp, Homo sapien
tctgtcctaccagcttgggcgaggc

SEQ ID NO: 1007 - DNA, 25 bp, Homo sapien
attgtccttggacttagggcgccct

SEQ ID NO: 1008 - DNA, 25 bp, Homo sapien
tcagggcgagtaatagcgaccaatc

SEQ ID NO: 1009 - DNA, 25 bp, Homo sapien
gcgctaggctagaggaatctgtctg

SEQ ID NO: 1010 - DNA, 25 bp, Homo sapien
accgctgggagttttgctaagtgtg

SEQ ID NO: 1011 - DNA, 25 bp, Homo sapien
ctcctggcctaggaaaccgctggga

SEQ ID NO: 1012 - DNA, 25 bp, Homo sapien
agccgggtcaagaatcgcgaacgca

SEQ ID NO: 1013 - DNA, 25 bp, Homo sapien
ccgcactaattaggctcatgaacta

SEQ ID NO: 1014 - DNA, 25 bp, Homo sapien
acctgcttaattggggcgccgagca

SEQ ID NO: 1015 - DNA, 25 bp, Homo sapien
ccagcgcgccctgttgggaaactag

SEQ ID NO: 1016 - DNA, 25 bp, Homo sapien
agtctccgaagctacgactggtttg

SEQ ID NO: 1017 - DNA, 25 bp, Homo sapien
ccaggcttgctttcgactgcgttcg

SEQ ID NO: 1018 - DNA, 25 bp, Homo sapien
agacccgcggcttcttagtcttcca

SEQ ID NO: 1019 - DNA, 25 bp, Homo sapien
gtcttccaccctcttctggaggcga

SEQ ID NO: 1020 - DNA, 25 bp, Homo sapien
caccgctaccgatatctgggtcatc

SEQ ID NO: 1021 - DNA, 25 bp, Homo sapien
tcgcttccaaggtacgtgccacgtc

SEQ ID NO: 1022 - DNA, 25 bp, Homo sapien
gtgatccgtgacaagcgcacaggca

SEQ ID NO: 1023 - DNA, 25 bp, Homo sapien
ttccttaaggccaaggtgatccgtg

SEQ ID NO: 1024 - DNA, 25 bp, Homo sapien
cgatgacatcttggcacgcgccttc

SEQ ID NO: 1025 - DNA, 25 bp, Homo sapien
gctacggcttcgtcagcttcaagga

SEQ ID NO: 1026 - DNA, 25 bp, Homo sapien
cgtgcgcgccatgcgtgagatgaat

SEQ ID NO: 1027 - DNA, 25 bp, Homo sapien
ccctctgtctccacagggaagtatg

SEQ ID NO: 1028 - DNA, 25 bp, Homo sapien
catcaagcttcgcaagagcatgtgg

SEQ ID NO: 1029 - DNA, 25 bp, Homo sapien
caggcaagaccaagggctacggctt

SEQ ID NO: 1030 - DNA, 25 bp, Homo sapien
cccaggctcctggattatataaaac

SEQ ID NO: 1031 - DNA, 25 bp, Homo sapien
ccaaggctgactgttggatctcaga

SEQ ID NO: 1032 - DNA, 25 bp, Homo sapien
agttcaatttagctccgcccaaggg

SEQ ID NO: 1033 - DNA, 25 bp, Homo sapien
cgcgtagcagctgcatccgttggac

SEQ ID NO: 1034 - DNA, 25 bp, Homo sapien
gtggcaccacctctttgaagcggta

SEQ ID NO: 1035 - DNA, 25 bp, Homo sapien
gggccctggacgcttgagtctccaa

SEQ ID NO: 1036 - DNA, 25 bp, Homo sapien
gggaggccaaactcctaaatctctg

SEQ ID NO: 1037 - DNA, 25 bp, Homo sapien
ggacccggacctctagatcattgaa

SEQ ID NO: 1038 - DNA, 25 bp, Homo sapien
catcgtctacatcttcgagtgcgcc

SEQ ID NO: 1039 - DNA, 25 bp, Homo sapien
tgctcatcgtctacatcttcgagtg

SEQ ID NO: 1040 - DNA, 25 bp, Homo sapien
ggtgctcatgctcatcgtctacatc

SEQ ID NO: 1041 - DNA, 25 bp, Homo sapien
gacgggccgtcctccctctgtctcc

SEQ ID NO: 1042 - DNA, 25 bp, Homo sapien
cgggctctgcccgacgggccgtcct

SEQ ID NO: 1043 - DNA, 25 bp, Homo sapien
caccgtgactacgtgagcccggcga

SEQ ID NO: 1044 - DNA, 25 bp, Homo sapien
tgcatcacgtcctacacccaccgtg

SEQ ID NO: 1045 - DNA, 25 bp, Homo sapien
tctacatcttcgagtgcgcctcctg

SEQ ID NO: 1046 - DNA, 25 bp, Homo sapien
cttgcggattttccagagccggtac

SEQ ID NO: 1047 - DNA, 25 bp, Homo sapien
tcccaccttggagcaacagtttaga

SEQ ID NO: 1048 - DNA, 25 bp, Homo sapien
cttcatcgctgctgctccgacgaga

SEQ ID NO: 1049 - DNA, 25 bp, Homo sapien
gcggctcacctgcatgatggtcttg

SEQ ID NO: 1050 - DNA, 25 bp, Homo sapien
tctcgtgtgtctttggccgcacagc

SEQ ID NO: 1051 - DNA, 25 bp, Homo sapien
tctcgcctccgtagttctcgtgtgt

SEQ ID NO: 1052 - DNA, 25 bp, Homo sapien
tgcagcaacgtctcggatcggcagc

SEQ ID NO: 1053 - DNA, 25 bp, Homo sapien
tcggcgaatgcctgaatgcagcaac

SEQ ID NO: 1054 - DNA, 25 bp, Homo sapien
ccacttagaaaggagcggagccagc

SEQ ID NO: 1055 - DNA, 25 bp, Homo sapien
cctggcgtctcattggctatgcttg

SEQ ID NO: 1056 - DNA, 25 bp, Homo sapien
gctatgcttgagaacgaatcccagg

SEQ ID NO: 1057 - DNA, 25 bp, Homo sapien
ttagggccaatcagaagcgacagcg

SEQ ID NO: 1058 - DNA, 25 bp, Homo sapien
cccgctgctctctggtcaatctaaa

SEQ ID NO: 1059 - DNA, 25 bp, Homo sapien
gaactcgcatcgcagcctgaaactg

SEQ ID NO: 1060 - DNA, 25 bp, Homo sapien
tcaggacctacagctccggttgttg

SEQ ID NO: 1061 - DNA, 25 bp, Homo sapien
tttcgctccctatcggggccaggga

SEQ ID NO: 1062 - DNA, 25 bp, Homo sapien
tcagctggcctgagcgggagaatgc

SEQ ID NO: 1063 - DNA, 25 bp, Homo sapien
tgcccagcgtgctcagctggcctga

SEQ ID NO: 1064 - DNA, 25 bp, Homo sapien
gccaatcagcgtccgcctcaggatc

SEQ ID NO: 1065 - DNA, 25 bp, Homo sapien
cctcaggatccaggggtgaccacgt

SEQ ID NO: 1066 - DNA, 25 bp, Homo sapien
aggctgcccagcgtgctcagctggc

SEQ ID NO: 1067 - DNA, 25 bp, Homo sapien
accacgtgcgggagcgttgcgtccc

SEQ ID NO: 1068 - DNA, 25 bp, Homo sapien
ggagcgttgcgtccctggcctcgct

SEQ ID NO: 1069 - DNA, 25 bp, Homo sapien
gctgtcctaggtgcctcccaggctg

SEQ ID NO: 1070 - DNA, 25 bp, Homo sapien
gaagcgaggcgtccggactacattt

SEQ ID NO: 1071 - DNA, 25 bp, Homo sapien
tgtgccctcccttcaggactagaaa

SEQ ID NO: 1072 - DNA, 25 bp, Homo sapien
aagccgagtttagtctgtgcacacc

SEQ ID NO: 1073 - DNA, 25 bp, Homo sapien
tccagcgggatggacacttcttcca

SEQ ID NO: 1074 - DNA, 25 bp, Homo sapien
cctggaacggagactgactatgctt

SEQ ID NO: 1075 - DNA, 25 bp, Homo sapien
gccgccggcctagccaagaacaatg

SEQ ID NO: 1076 - DNA, 25 bp, Homo sapien
gggctaggaccacacctcccggaga

SEQ ID NO: 1077 - DNA, 25 bp, Homo sapien
ggagattgtcgatctcatcaccata

SEQ ID NO: 1078 - DNA, 25 bp, Homo sapien
tcggggtcgcaagcataagacgacc

SEQ ID NO: 1079 - DNA, 25 bp, Homo sapien
cacagaacggatggtgcaggcactg

SEQ ID NO: 1080 - DNA, 25 bp, Homo sapien
acggatggtgcaggcactgactgaa

SEQ ID NO: 1081 - DNA, 25 bp, Homo sapien
actgactgaacttctccggcgggcc

SEQ ID NO: 1082 - DNA, 25 bp, Homo sapien
gactgaacttctccggcgggcccag

SEQ ID NO: 1083 - DNA, 25 bp, Homo sapien
agccgggcatgtgagccctccaccc

SEQ ID NO: 1084 - DNA, 25 bp, Homo sapien
tcgcctagcagatgtggctcctacc

SEQ ID NO: 1085 - DNA, 25 bp, Homo sapien
tcctcgcctagcagatgtggctcct

SEQ ID NO: 1086 - DNA, 25 bp, Homo sapien
gacgctgttgccctgggattccgat

SEQ ID NO: 1087 - DNA, 25 bp, Homo sapien
ttccgatgaatctcctgaggcctcc

SEQ ID NO: 1088 - DNA, 25 bp, Homo sapien
tcagctcggcgctgcgtcaaacagc

SEQ ID NO: 1089 - DNA, 25 bp, Homo sapien
gcgtcaaacagcgaccctcctatga

SEQ ID NO: 1090 - DNA, 25 bp, Homo sapien
cctcctatgatatcttcgaggattc

SEQ ID NO: 1091 - DNA, 25 bp, Homo sapien
tcgaggattcggatgactcggagcc

SEQ ID NO: 1092 - DNA, 25 bp, Homo sapien
gccggacgatagtgaagacgctgtt

SEQ ID NO: 1093 - DNA, 25 bp, Homo sapien
ctgcagcgcaagtcagctcggcgct

SEQ ID NO: 1094 - DNA, 25 bp, Homo sapien
cgaggcctgttctgtaagcgcaaca

SEQ ID NO: 1095 - DNA, 25 bp, Homo sapien
ggcatcgggtgctatatgttccgca

SEQ ID NO: 1096 - DNA, 25 bp, Homo sapien
tcatccacgtggagggccagaaaca

SEQ ID NO: 1097 - DNA, 25 bp, Homo sapien
acattgttatcttcgccctgcgccg

SEQ ID NO: 1098 - DNA, 25 bp, Homo sapien
agctgccctgcaactgtggcgccaa

SEQ ID NO: 1099 - DNA, 25 bp, Homo sapien
gcgctgccgtcggttccttaactga

SEQ ID NO: 1100 - DNA, 25 bp, Homo sapien
catcgagtactctggcattgtcatc

SEQ ID NO: 1101 - DNA, 25 bp, Homo sapien
atccgctcggtgttgactgacaagc

SEQ ID NO: 1102 - DNA, 25 bp, Homo sapien
tgccctgagagggtcaaacggaatc

SEQ ID NO: 1103 - DNA, 25 bp, Homo sapien
gttcagtgctccaagctccctctgg

SEQ ID NO: 1104 - DNA, 25 bp, Homo sapien
gccgtggcgctgaggaatataaata

SEQ ID NO: 1105 - DNA, 25 bp, Homo sapien
ccttcgtgctatatgggtgccagcc

SEQ ID NO: 1106 - DNA, 25 bp, Homo sapien
aacttcctggctctcgttctgggtg

SEQ ID NO: 1107 - DNA, 25 bp, Homo sapien
tccttctgggacacggagaactgta

SEQ ID NO: 1108 - DNA, 25 bp, Homo sapien
cggctacgttctcctgcgaagtaca

SEQ ID NO: 1109 - DNA, 25 bp, Homo sapien
tcaatgggcatcgtgggtcagattc

SEQ ID NO: 1110 - DNA, 25 bp, Homo sapien
tgcactgcccagaagaacactttcg

SEQ ID NO: 1111 - DNA, 25 bp, Homo sapien
ttccagtattcaaggcggccgcagt

SEQ ID NO: 1112 - DNA, 25 bp, Homo sapien
agcacttgttgtctgggttccagta

SEQ ID NO: 1113 - DNA, 25 bp, Homo sapien
aagcaaggctcggtctcggattctc

SEQ ID NO: 1114 - DNA, 25 bp, Homo sapien
tgtctgatctgcataaggcccaccg

SEQ ID NO: 1115 - DNA, 25 bp, Homo sapien
atccattcgctgttgccctacggta

SEQ ID NO: 1116 - DNA, 25 bp, Homo sapien
gcctctgctacactttccggggaaa

SEQ ID NO: 1117 - DNA, 25 bp, Homo sapien
cgtggtcattgagtccgcagttttc

SEQ ID NO: 1118 - DNA, 25 bp, Homo sapien
tccagggaaacctggggcgtctcgc

SEQ ID NO: 1119 - DNA, 25 bp, Homo sapien
ttctcagtcccgaatatcgaagcta

SEQ ID NO: 1120 - DNA, 25 bp, Homo sapien
agcagttaaccctggaaaaggtgca

SEQ ID NO: 1121 - DNA, 25 bp, Homo sapien
acgtcacttccgttgcttaggagca

SEQ ID NO: 1122 - DNA, 25 bp, Homo sapien
cggtaggagttcttttaacagcgca

SEQ ID NO: 1123 - DNA, 25 bp, Homo sapien
gtgcagtgttgcctcgcccaaagaa

SEQ ID NO: 1124 - DNA, 25 bp, Homo sapien
tccaggtctggctgctcttacgtca

SEQ ID NO: 1125 - DNA, 25 bp, Homo sapien
tctcacctggctgaatgtcggcttg

SEQ ID NO: 1126 - DNA, 25 bp, Homo sapien
gctgtatcaggcagcgagcgttgcc

SEQ ID NO: 1127 - DNA, 25 bp, Homo sapien
ggcagcgagcgttgcctgccacctt

SEQ ID NO: 1128 - DNA, 25 bp, Homo sapien
acaccctcccggtgtgcgcttgaag

SEQ ID NO: 1129 - DNA, 25 bp, Homo sapien
tgaagtcgctttgagattgaatggg

SEQ ID NO: 1130 - DNA, 25 bp, Homo sapien
ggactgcacgacttttccctgaagc

SEQ ID NO: 1131 - DNA, 25 bp, Homo sapien
cctgtcgggaccatcgggttgacag

SEQ ID NO: 1132 - DNA, 25 bp, Homo sapien
gcccacctgacaatcgctgtatcag

SEQ ID NO: 1133 - DNA, 25 bp, Homo sapien
tcgcggaaaggggactgcacgactt

SEQ ID NO: 1134 - DNA, 25 bp, Homo sapien
tgtgcgggcctcagattcccattga

SEQ ID NO: 1135 - DNA, 25 bp, Homo sapien
cggatcaccagcctccttcagagta

SEQ ID NO: 1136 - DNA, 25 bp, Homo sapien
tcttctggagatatcgggccaccgc

SEQ ID NO: 1137 - DNA, 25 bp, Homo sapien
cccggtgtcagcgaatccgaagtca

SEQ ID NO: 1138 - DNA, 25 bp, Homo sapien
ccctgtaatatctgggattgccctc

SEQ ID NO: 1139 - DNA, 25 bp, Homo sapien
tgagcagtcagctctcctactggga

SEQ ID NO: 1140 - DNA, 25 bp, Homo sapien
cgtctagcagcaccgaaaagtggcc

SEQ ID NO: 1141 - DNA, 25 bp, Homo sapien
tccggcgagaagtgcttcacgtcta

SEQ ID NO: 1142 - DNA, 25 bp, Homo sapien
gagggctggaaatcccggatcacgc

SEQ ID NO: 1143 - DNA, 25 bp, Homo sapien
gctccatgcacgagttttccgccaa

SEQ ID NO: 1144 - DNA, 25 bp, Homo sapien
tcacagtcgcgcagtcctgactacg

SEQ ID NO: 1145 - DNA, 25 bp, Homo sapien
ttgcgaccggagatccacgaatgtc

SEQ ID NO: 1146 - DNA, 25 bp, Homo sapien
agatccacgaatgtcccaagtccca

SEQ ID NO: 1147 - DNA, 25 bp, Homo sapien
cccacaccggctaatgtggcacatt

SEQ ID NO: 1148 - DNA, 25 bp, Homo sapien
agcgttcaggtcttcagggccgcag

SEQ ID NO: 1149 - DNA, 25 bp, Homo sapien
tgtggcacattttggggttggaacc

SEQ ID NO: 1150 - DNA, 25 bp, Homo sapien
gcaggtgaggccgatcgctcttcca

SEQ ID NO: 1151 - DNA, 25 bp, Homo sapien
ttggcctctccagccgtagccgtta

SEQ ID NO: 1152 - DNA, 25 bp, Homo sapien
agggctccaccgcactggaactaca

SEQ ID NO: 1153 - DNA, 25 bp, Homo sapien
acggtctggagtcgctagggctcca

SEQ ID NO: 1154 - DNA, 25 bp, Homo sapien
agcacagcctaggacgggctggata

SEQ ID NO: 1155 - DNA, 25 bp, Homo sapien
ccaacggcgagagcagcacagccta

SEQ ID NO: 1156 - DNA, 25 bp, Homo sapien
ctcttccagggactacaggaggctg

SEQ ID NO: 1157 - DNA, 25 bp, Homo sapien
gccgatcgctcttccagggactaca

SEQ ID NO: 1158 - DNA, 25 bp, Homo sapien
tggcgctgtcaaacttcgaggggcg

SEQ ID NO: 1159 - DNA, 25 bp, Homo sapien
cggagcccaaggtgaaaccaatgag

SEQ ID NO: 1160 - DNA, 25 bp, Homo sapien
ggtgaaaccaatgagaagcctccgg

SEQ ID NO: 1161 - DNA, 25 bp, Homo sapien
caatgagaagcagcgccgcgttccc

SEQ ID NO: 1162 - DNA, 25 bp, Homo sapien
cctgaggaggctacgcgaccatggt

SEQ ID NO: 1163 - DNA, 25 bp, Homo sapien
cctgtccgtccggatgtcagtctgt

SEQ ID NO: 1164 - DNA, 25 bp, Homo sapien
cgtccggatgtcagtctgtccgtgc

SEQ ID NO: 1165 - DNA, 25 bp, Homo sapien
cgaccatggtggtaagggtcccacg

SEQ ID NO: 1166 - DNA, 25 bp, Homo sapien
gccagaataagggacctggcaggac

SEQ ID NO: 1167 - DNA, 25 bp, Homo sapien
gatagccgcggaaggtccagttgaa

SEQ ID NO: 1168 - DNA, 25 bp, Homo sapien
gccctcagagttctggcagtgcagc

SEQ ID NO: 1169 - DNA, 25 bp, Homo sapien
gtcacattccacagatgcagagccc

SEQ ID NO: 1170 - DNA, 25 bp, Homo sapien
gcgcttccgcggtgccctcagagtt

SEQ ID NO: 1171 - DNA, 25 bp, Homo sapien
ccgcggaaggtccagttgaaggcct

SEQ ID NO: 1172 - DNA, 25 bp, Homo sapien
ggggctcacagtgcacgtccagccg

SEQ ID NO: 1173 - DNA, 25 bp, Homo sapien
gcgcgggtcacattccacagatgca

SEQ ID NO: 1174 - DNA, 25 bp, Homo sapien
ccatgatcgcgggatgacacttgca

SEQ ID NO: 1175 - DNA, 25 bp, Homo sapien
tgacacttgcagaaggacgctcctg

SEQ ID NO: 1176 - DNA, 25 bp, Homo sapien
cccaggacaagttgaccggcggatt

SEQ ID NO: 1177 - DNA, 25 bp, Homo sapien
ttggccaggatcgtcacgttagttg

SEQ ID NO: 1178 - DNA, 25 bp, Homo sapien
ctgtccagccttgcacgtgaacttg

SEQ ID NO: 1179 - DNA, 25 bp, Homo sapien
gaaggtgctcccagatttctccacg

SEQ ID NO: 1180 - DNA, 25 bp, Homo sapien
ggcgatagaaggagctcacggtttc

SEQ ID NO: 1181 - DNA, 25 bp, Homo sapien
gcatgtcaagtttaaggcgtctccc

SEQ ID NO: 1182 - DNA, 25 bp, Homo sapien
ttccactgagcgcagtccctctagg

SEQ ID NO: 1183 - DNA, 25 bp, Homo sapien
cggatgagcagacttggaggactcc

SEQ ID NO: 1184 - DNA, 25 bp, Homo sapien
ttcctgggtcttaggacgtgctgta

SEQ ID NO: 1185 - DNA, 25 bp, Homo sapien
aactggcaggcgtttcagagcgtca

SEQ ID NO: 1186 - DNA, 25 bp, Homo sapien
gaacccaggtgttccggctcccaga

SEQ ID NO: 1187 - DNA, 25 bp, Homo sapien
ggactccaggccagagactaggctg

SEQ ID NO: 1188 - DNA, 25 bp, Homo sapien
acctgggctgagcaagtttcttcca

SEQ ID NO: 1189 - DNA, 25 bp, Homo sapien
cgacggcaaatctcgtgaaccttgg

SEQ ID NO: 1190 - DNA, 25 bp, Homo sapien
ttcattagtcgtggctccgccgcta

SEQ ID NO: 1191 - DNA, 25 bp, Homo sapien
cgcgcatggaggctggactccaagt

SEQ ID NO: 1192 - DNA, 25 bp, Homo sapien
atcacgcccacgtgcggagatgcgc

SEQ ID NO: 1193 - DNA, 25 bp, Homo sapien
cccagcgtctaattggccttttgtt

SEQ ID NO: 1194 - DNA, 25 bp, Homo sapien
tgggagttttgagaaccctctgacc

SEQ ID NO: 1195 - DNA, 25 bp, Homo sapien
tcttcgtgcttcgagttcattagtc

SEQ ID NO: 1196 - DNA, 25 bp, Homo sapien
acccggtgcgccagaaaactctagg

SEQ ID NO: 1197 - DNA, 25 bp, Homo sapien
cgcttggaagcgcaaggtccattca

SEQ ID NO: 1198 - DNA, 25 bp, Homo sapien
ggcttccttacaaatccggcttctg

SEQ ID NO: 1199 - DNA, 25 bp, Homo sapien
ccctaaatctgaggcggtggctgga

SEQ ID NO: 1200 - DNA, 25 bp, Homo sapien
tggcgcgcaggtacagccctaaatc

SEQ ID NO: 1201 - DNA, 25 bp, Homo sapien
aagacgcttccttcagctgcgcctg

SEQ ID NO: 1202 - DNA, 25 bp, Homo sapien
ttgggccgattctgcaggcaaagcc

SEQ ID NO: 1203 - DNA, 25 bp, Homo sapien
ctagtctctttcgtccagttgggcc

SEQ ID NO: 1204 - DNA, 25 bp, Homo sapien
gcagacgcctcgttcctgactgagc

SEQ ID NO: 1205 - DNA, 25 bp, Homo sapien
agccacactgcgtcttccgtcggtg

SEQ ID NO: 1206 - DNA, 25 bp, Homo sapien
cgggacgcctggaatctcgaggggc

SEQ ID NO: 1207 - DNA, 25 bp, Homo sapien
ggagcccatagccggactcctggct

SEQ ID NO: 1208 - DNA, 25 bp, Homo sapien
ccggggttcccgagctgctccactc

SEQ ID NO: 1209 - DNA, 25 bp, Homo sapien
gcgaagccgccacgctattgtcctg

SEQ ID NO: 1210 - DNA, 25 bp, Homo sapien
gccacgctattgtcctgaccaggaa

SEQ ID NO: 1211 - DNA, 25 bp, Homo sapien
ctattgtcctgaccaggaaggcggg

SEQ ID NO: 1212 - DNA, 25 bp, Homo sapien
ctgctcgcggtctaagtcgccgccc

SEQ ID NO: 1213 - DNA, 25 bp, Homo sapien
cgcggacatgtccagggcagaaagc

SEQ ID NO: 1214 - DNA, 25 bp, Homo sapien
gcggagtctgtctccgcggcaacaa

SEQ ID NO: 1215 - DNA, 25 bp, Homo sapien
gggccgcccatagaaagctagactt

SEQ ID NO: 1216 - DNA, 25 bp, Homo sapien
gacccgcagcgcgtgctggagtact

SEQ ID NO: 1217 - DNA, 25 bp, Homo sapien
tgtttcccagggaacggtgcctcca

SEQ ID NO: 1218 - DNA, 25 bp, Homo sapien
cgccctacgggagctgtttcccagg

SEQ ID NO: 1219 - DNA, 25 bp, Homo sapien
ggggacccaggtcgccatagcaacg

SEQ ID NO: 1220 - DNA, 25 bp, Homo sapien
ctagacttgaaaaaggcgtggtcca

SEQ ID NO: 1221 - DNA, 25 bp, Homo sapien
ccgcggcaacaaggcagaaagaatc

SEQ ID NO: 1222 - DNA, 25 bp, Homo sapien
gacagcgcctggtggaaacccacgc

SEQ ID NO: 1223 - DNA, 25 bp, Homo sapien
ctgcaggcagatccgcctcaggtgc

SEQ ID NO: 1224 - DNA, 25 bp, Homo sapien
tgtgtcccttccacaggcggagcgt

SEQ ID NO: 1225 - DNA, 25 bp, Homo sapien
aacagaggcacacgctgcgccacta

SEQ ID NO: 1226 - DNA, 25 bp, Homo sapien
ccgtggatcccgagaaggcacagca

SEQ ID NO: 1227 - DNA, 25 bp, Homo sapien
ggcacagcagatgcgcttccaggtg

SEQ ID NO: 1228 - DNA, 25 bp, Homo sapien
caaatgcgccgctattcctcagacg

SEQ ID NO: 1229 - DNA, 25 bp, Homo sapien
cttatcaacgaccagcgccgggctg

SEQ ID NO: 1230 - DNA, 25 bp, Homo sapien
tcccgcgcggaaaaactggcacata

SEQ ID NO: 1231 - DNA, 25 bp, Homo sapien
cttaagtcacctaaatgccgcgggg

SEQ ID NO: 1232 - DNA, 25 bp, Homo sapien
gcctgactcctccaaagccattaga

SEQ ID NO: 1233 - DNA, 25 bp, Homo sapien
ggaagtcatcaagggtccttaagtc

SEQ ID NO: 1234 - DNA, 25 bp, Homo sapien
ttcttcacggtttgcgttgggcagt

SEQ ID NO: 1235 - DNA, 25 bp, Homo sapien
ttccagaagcttcttcacggtttgc

SEQ ID NO: 1236 - DNA, 25 bp, Homo sapien
caagccgctgagtccctacgggaca

SEQ ID NO: 1237 - DNA, 25 bp, Homo sapien
ctggcacatagatgccgcctgactc

SEQ ID NO: 1238 - DNA, 25 bp, Homo sapien
gcacgcagccctcggggatcttgat

SEQ ID NO: 1239 - DNA, 25 bp, Homo sapien
ttcctgtccttggtcttcagccgca

SEQ ID NO: 1240 - DNA, 25 bp, Homo sapien
acaaagcgtagccactctcccaggg

SEQ ID NO: 1241 - DNA, 25 bp, Homo sapien
tgcagtgcgtcagcgacaaagcgta

SEQ ID NO: 1242 - DNA, 25 bp, Homo sapien
cacagcatgtagtggtgccgcagcc

SEQ ID NO: 1243 - DNA, 25 bp, Homo sapien
ttcagccgcacgatctgcaggtagc

SEQ ID NO: 1244 - DNA, 25 bp, Homo sapien
tcctccgcggtgacctagggacaca

SEQ ID NO: 1245 - DNA, 25 bp, Homo sapien
cgatgttgggcttgtacaccgtgaa

SEQ ID NO: 1246 - DNA, 25 bp, Homo sapien
cgcccattacctcggggattccgtg

SEQ ID NO: 1247 - DNA, 25 bp, Homo sapien
acggcgctcacgcaagggaatcttc

SEQ ID NO: 1248 - DNA, 25 bp, Homo sapien
cgcgcaaggggaattcctgctcagc

SEQ ID NO: 1249 - DNA, 25 bp, Homo sapien
gacccacgccgattttaagcaacca

SEQ ID NO: 1250 - DNA, 25 bp, Homo sapien
gtaggagtctcggttgccagcaacc

SEQ ID NO: 1251 - DNA, 25 bp, Homo sapien
acctagggccctcactctcgggata

SEQ ID NO: 1252 - DNA, 25 bp, Homo sapien
ggagtctttcgatcctcagtccctc

SEQ ID NO: 1253 - DNA, 25 bp, Homo sapien
tctcgggataaaggactgacgcttc

SEQ ID NO: 1254 - DNA, 25 bp, Homo sapien
aaatgtagttcgtctgccaggccgg

SEQ ID NO: 1255 - DNA, 25 bp, Homo sapien
tggcctctgcctccacattggaaca

SEQ ID NO: 1256 - DNA, 25 bp, Homo sapien
ctccacattggaacaaggtgaggca

SEQ ID NO: 1257 - DNA, 25 bp, Homo sapien
gctaagcgatgcgttgctgcctcca

SEQ ID NO: 1258 - DNA, 25 bp, Homo sapien
cgcagcggctaagcgatgcgttgct

SEQ ID NO: 1259 - DNA, 25 bp, Homo sapien
gctcaaccggctcgcgagactatgc

SEQ ID NO: 1260 - DNA, 25 bp, Homo sapien
agttcgtctgccaggccggaaccac

SEQ ID NO: 1261 - DNA, 25 bp, Homo sapien
tctgcctccacattggaacaaggtg

SEQ ID NO: 1262 - DNA, 25 bp, Homo sapien
tgcctacgcctttaagcgcgggtgc

SEQ ID NO: 1263 - DNA, 25 bp, Homo sapien
ggcgggtgcctacgcctttaagcgc

SEQ ID NO: 1264 - DNA, 25 bp, Homo sapien
agcctgcgcctttaagcgccggtgc

SEQ ID NO: 1265 - DNA, 25 bp, Homo sapien
cccatcccgcgtgtcccagtctgtc

SEQ ID NO: 1266 - DNA, 25 bp, Homo sapien
cagtctgtctgaccgtccctccgct

SEQ ID NO: 1267 - DNA, 25 bp, Homo sapien
cccagattgaatcgggaattccgga

SEQ ID NO: 1268 - DNA, 25 bp, Homo sapien
ggaaccctgatctgggaccagcacc

SEQ ID NO: 1269 - DNA, 25 bp, Homo sapien
cgccagtgcgactccatgggaggtg

SEQ ID NO: 1270 - DNA, 25 bp, Homo sapien
ggctgctaggcaactcaagccgtgc

SEQ ID NO: 1271 - DNA, 25 bp, Homo sapien
tgcatctgagcctgtcgcggaacac

SEQ ID NO: 1272 - DNA, 25 bp, Homo sapien
attgtgccgagacactggaggacct

SEQ ID NO: 1273 - DNA, 25 bp, Homo sapien
gccgcctgggcaacgtcaacacgtt

SEQ ID NO: 1274 - DNA, 25 bp, Homo sapien
cgaccacaacctgctggcttctgtg

SEQ ID NO: 1275 - DNA, 25 bp, Homo sapien
gccaacatgacaggcctgctgcatc

SEQ ID NO: 1276 - DNA, 25 bp, Homo sapien
gctttttcccgcctgcacaagctgg

SEQ ID NO: 1277 - DNA, 25 bp, Homo sapien
ggcagacaacttcatcgcctccgtg

SEQ ID NO: 1278 - DNA, 25 bp, Homo sapien
attcgctccgcgagagagccatcgg

SEQ ID NO: 1279 - DNA, 25 bp, Homo sapien
cgctggaaatacaaggccgagttgc

SEQ ID NO: 1280 - DNA, 25 bp, Homo sapien
gtctgtacgctaaagccagggcgca

SEQ ID NO: 1281 - DNA, 25 bp, Homo sapien
ggttaatccggccaacattcgctcc

SEQ ID NO: 1282 - DNA, 25 bp, Homo sapien
gcgcctgggttctcagagcccaaga

SEQ ID NO: 1283 - DNA, 25 bp, Homo sapien
gcagggcgccagttctctttcagaa

SEQ ID NO: 1284 - DNA, 25 bp, Homo sapien
gcggcgcgctttgataacaggttaa

SEQ ID NO: 1285 - DNA, 25 bp, Homo sapien
gcactgcggacactagaggcttatg

SEQ ID NO: 1286 - DNA, 25 bp, Homo sapien
tcgccgtgtatgaggacagcgccac

SEQ ID NO: 1287 - DNA, 25 bp, Homo sapien
ccggacctacgatctgtgcgtgctc

SEQ ID NO: 1288 - DNA, 25 bp, Homo sapien
cgtcatcgtagcctcggtactggtc

SEQ ID NO: 1289 - DNA, 25 bp, Homo sapien
actggtcttcatcttcgtgctgcta

SEQ ID NO: 1290 - DNA, 25 bp, Homo sapien
cgtgctgctaatgcgctacaaggtg

SEQ ID NO: 1291 - DNA, 25 bp, Homo sapien
aaggccaagattcccgcgcctgtta

SEQ ID NO: 1292 - DNA, 25 bp, Homo sapien
agagccgctcgttcctgctgacgga

SEQ ID NO: 1293 - DNA, 25 bp, Homo sapien
cacgatgatcatcgcgctgggcggc

SEQ ID NO: 1294 - DNA, 25 bp, Homo sapien
gctgggcactccctaatcgatggtg

SEQ ID NO: 1295 - DNA, 25 bp, Homo sapien
ggtgcagccaaacttttccaacgtg

SEQ ID NO: 1296 - DNA, 25 bp, Homo sapien
gctgcagcttcgcaagcatggtgca

SEQ ID NO: 1297 - DNA, 25 bp, Homo sapien
tgcactctctggctttgcgctcttc

SEQ ID NO: 1298 - DNA, 25 bp, Homo sapien
tctgcaagcgagaagcaaggcctgt

SEQ ID NO: 1299 - DNA, 25 bp, Homo sapien
gctggcctcagttgtctgcaagcga

SEQ ID NO: 1300 - DNA, 25 bp, Homo sapien
agccgcgtcatgagcagcattctga

SEQ ID NO: 1301 - DNA, 25 bp, Homo sapien
taagcctgttctgctggaccgcgta

SEQ ID NO: 1302 - DNA, 25 bp, Homo sapien
gtgcccgctgcgttcgcgctgagct

SEQ ID NO: 1303 - DNA, 25 bp, Homo sapien
acctggccacatgcgcgggtgacag

SEQ ID NO: 1304 - DNA, 25 bp, Homo sapien
cggctgcttccttgcaggcggacac

SEQ ID NO: 1305 - DNA, 25 bp, Homo sapien
ttgcaggcggacacccaccgctggg

SEQ ID NO: 1306 - DNA, 25 bp, Homo sapien
gcttcccgctgagcggcgcctctga

SEQ ID NO: 1307 - DNA, 25 bp, Homo sapien
tctgagtgcccgcagccgaatgcgg

SEQ ID NO: 1308 - DNA, 25 bp, Homo sapien
agccgaatgcggctgcttccttgca

SEQ ID NO: 1309 - DNA, 25 bp, Homo sapien
gcgctacctggccacatgcgcgggt

SEQ ID NO: 1310 - DNA, 25 bp, Homo sapien
ggcctaccacctaaagctcctggga

SEQ ID NO: 1311 - DNA, 25 bp, Homo sapien
cggggacaacaacggcattgcggcc

SEQ ID NO: 1312 - DNA, 25 bp, Homo sapien
gtaactgacggcaaaagcacgcttg

SEQ ID NO: 1313 - DNA, 25 bp, Homo sapien
agagccatttccctacggggtctcg

SEQ ID NO: 1314 - DNA, 25 bp, Homo sapien
acaacggggttgcagtctagtcgac

SEQ ID NO: 1315 - DNA, 25 bp, Homo sapien
tctagtcgactgttcagggtgtccc

SEQ ID NO: 1316 - DNA, 25 bp, Homo sapien
gagaagcctgtccaaccggccgaga

SEQ ID NO: 1317 - DNA, 25 bp, Homo sapien
cgcacggagcttcccaagatggttt

SEQ ID NO: 1318 - DNA, 25 bp, Homo sapien
cccagccggctgttacgtaactgca

SEQ ID NO: 1319 - DNA, 25 bp, Homo sapien
ctggacagtgtcaagccaagagcta

SEQ ID NO: 1320 - DNA, 25 bp, Homo sapien
ccgccttttccgatgcttggagaca

SEQ ID NO: 1321 - DNA, 25 bp, Homo sapien
agagactcctccttggcgacgcagg

SEQ ID NO: 1322 - DNA, 25 bp, Homo sapien
cccgcctaaggtgagaggtcttaag

SEQ ID NO: 1323 - DNA, 25 bp, Homo sapien
gtgctgcgcatcgagtacctgtacc

SEQ ID NO: 1324 - DNA, 25 bp, Homo sapien
gccaagagctacttgcccgaaggta

SEQ ID NO: 1325 - DNA, 25 bp, Homo sapien
ttctgagcctgtaccgcgatctgct

SEQ ID NO: 1326 - DNA, 25 bp, Homo sapien
cgatgccgtggagaagacgcgtgta

SEQ ID NO: 1327 - DNA, 25 bp, Homo sapien
gtcacttgcccagcaggaggccggc

SEQ ID NO: 1328 - DNA, 25 bp, Homo sapien
acgcggcggatggtcagcgagaccc

SEQ ID NO: 1329 - DNA, 25 bp, Homo sapien
agcgagacccgggtgccgcgcacca

SEQ ID NO: 1330 - DNA, 25 bp, Homo sapien
gcgccgacgggcaggctgccgcatt

SEQ ID NO: 1331 - DNA, 25 bp, Homo sapien
tgcgcggttccagcagtagcgaggt

SEQ ID NO: 1332 - DNA, 25 bp, Homo sapien
cctggcggtcacttgcccagcagga

SEQ ID NO: 1333 - DNA, 25 bp, Homo sapien
tgagggtcagcagggctcaagaagt

SEQ ID NO: 1334 - DNA, 25 bp, Homo sapien
ggtgatcccacgagccctgtgcctg

SEQ ID NO: 1335 - DNA, 25 bp, Homo sapien
agcccacccaggatgcatggcgttc

SEQ ID NO: 1336 - DNA, 25 bp, Homo sapien
gtgcacggtgatcccacgagccctg

SEQ ID NO: 1337 - DNA, 25 bp, Homo sapien
cagtctcacccagtaccctcgctca

SEQ ID NO: 1338 - DNA, 25 bp, Homo sapien
gctcacccaggatgcatggcgcttc

SEQ ID NO: 1339 - DNA, 25 bp, Homo sapien
ccacctaggccctcgccgtgctcac

SEQ ID NO: 1340 - DNA, 25 bp, Homo sapien
gtgctcacccacaatgcacggtgtt

SEQ ID NO: 1341 - DNA, 25 bp, Homo sapien
acaatgcacggtgttcccacgagcc

SEQ ID NO: 1342 - DNA, 25 bp, Homo sapien
ggaactgaacctggccattggcgga

SEQ ID NO: 1343 - DNA, 25 bp, Homo sapien
cttcatgctcgcctaaggataggcc

SEQ ID NO: 1344 - DNA, 25 bp, Homo sapien
aatcggcgctctcactcagtattcg

SEQ ID NO: 1345 - DNA, 25 bp, Homo sapien
gcatcgtcgtctggcactggccact

SEQ ID NO: 1346 - DNA, 25 bp, Homo sapien
tggcactggccactcagaacttagg

SEQ ID NO: 1347 - DNA, 25 bp, Homo sapien
ctggccactcagaacttaggaactg

SEQ ID NO: 1348 - DNA, 25 bp, Homo sapien
acttaggaactgaacctggccattg

SEQ ID NO: 1349 - DNA, 25 bp, Homo sapien
gctcgcctaaggataggccgcgcct

SEQ ID NO: 1350 - DNA, 25 bp, Homo sapien
gtggcctccgcgcaactggatcttg

SEQ ID NO: 1351 - DNA, 25 bp, Homo sapien
agcgctggggaccaaagtggagact

SEQ ID NO: 1352 - DNA, 25 bp, Homo sapien
tcttacctcgggcagacagcgctgg

SEQ ID NO: 1353 - DNA, 25 bp, Homo sapien
cgggattcaggatgcttcgcccctc

SEQ ID NO: 1354 - DNA, 25 bp, Homo sapien
cgggtttgtttatctcgggattcag

SEQ ID NO: 1355 - DNA, 25 bp, Homo sapien
ggatcttgggcaaccatagggaccc

SEQ ID NO: 1356 - DNA, 25 bp, Homo sapien
cgcaactggatcttgggcaaccata

SEQ ID NO: 1357 - DNA, 25 bp, Homo sapien
cgctcgcattgatggaggggccaga

SEQ ID NO: 1358 - DNA, 25 bp, Homo sapien
gacgtccgtggagtctcgtcacgta

SEQ ID NO: 1359 - DNA, 25 bp, Homo sapien
tggggcgcacatagttcctctaggt

SEQ ID NO: 1360 - DNA, 25 bp, Homo sapien
ctcgtcacgtgacgaatgggccata

SEQ ID NO: 1361 - DNA, 25 bp, Homo sapien
aactggctagtcaatctcttacggc

SEQ ID NO: 1362 - DNA, 25 bp, Homo sapien
cgagtactgtgcacctgcgcaaagc

SEQ ID NO: 1363 - DNA, 25 bp, Homo sapien
cagtacttgggcatggctatccagc

SEQ ID NO: 1364 - DNA, 25 bp, Homo sapien
gacgcttaatcaggcatccagtaca

SEQ ID NO: 1365 - DNA, 25 bp, Homo sapien
gagcctgcgccaaccaaatcaactg

SEQ ID NO: 1366 - DNA, 25 bp, Homo sapien
ccgggttggccttctccatgttggt

SEQ ID NO: 1367 - DNA, 25 bp, Homo sapien
gcacgtgaggcctggccacacggac

SEQ ID NO: 1368 - DNA, 25 bp, Homo sapien
tcgtctggagaaacacagaggccca

SEQ ID NO: 1369 - DNA, 25 bp, Homo sapien
ctccatgttggtctcgggaacgtga

SEQ ID NO: 1370 - DNA, 25 bp, Homo sapien
tcaggggtcagcacctccctggttg

SEQ ID NO: 1371 - DNA, 25 bp, Homo sapien
gtcagcacctccctggttgccgtgg

SEQ ID NO: 1372 - DNA, 25 bp, Homo sapien
ccctttcgtctggagaaacacagag

SEQ ID NO: 1373 - DNA, 25 bp, Homo sapien
gcacttccgggttggccttctccat

SEQ ID NO: 1374 - DNA, 25 bp, Homo sapien
cgccgcctcagtttacagaatagta

SEQ ID NO: 1375 - DNA, 25 bp, Homo sapien
cttcgtgcgtgatcttgttgacata

SEQ ID NO: 1376 - DNA, 25 bp, Homo sapien
gctggtaatcacagttccggcacta

SEQ ID NO: 1377 - DNA, 25 bp, Homo sapien
cccggaggatatgacgacaggactc

SEQ ID NO: 1378 - DNA, 25 bp, Homo sapien
ctccttgtcttccttggggtacagc

SEQ ID NO: 1379 - DNA, 25 bp, Homo sapien
tctccgcgcagaggtttcatggctt

SEQ ID NO: 1380 - DNA, 25 bp, Homo sapien
gtgcgcatgcgcgagtttacccttc

SEQ ID NO: 1381 - DNA, 25 bp, Homo sapien
gccaggcctaggtgcttcgccaaaa

SEQ ID NO: 1382 - DNA, 25 bp, Homo sapien
actgacggcccagagtgtttgtgga

SEQ ID NO: 1383 - DNA, 25 bp, Homo sapien
tgacggaaccatctgccgacactga

SEQ ID NO: 1384 - DNA, 25 bp, Homo sapien
cagtccctggaggtgacggaaccat

SEQ ID NO: 1385 - DNA, 25 bp, Homo sapien
actcgaaacgatctcagtccctgga

SEQ ID NO: 1386 - DNA, 25 bp, Homo sapien
ccggggcaccgtcatgtatgtaggt

SEQ ID NO: 1387 - DNA, 25 bp, Homo sapien
agcgcagcaagctcggccggtacaa

SEQ ID NO: 1388 - DNA, 25 bp, Homo sapien
ggtccgctctttcctgaagcgcagc

SEQ ID NO: 1389 - DNA, 25 bp, Homo sapien
gagcgtcatcctgttaggcccggcc

SEQ ID NO: 1390 - DNA, 25 bp, Homo sapien
gcaacctttgcgtgcctagcctcgg

SEQ ID NO: 1391 - DNA, 25 bp, Homo sapien
gtgcattatgggtcgcgtagtctca

SEQ ID NO: 1392 - DNA, 25 bp, Homo sapien
aaaactacgcgacaatctgagcctg

SEQ ID NO: 1393 - DNA, 25 bp, Homo sapien
tctgagcctggtcttgcccagagct

SEQ ID NO: 1394 - DNA, 25 bp, Homo sapien
catcctggaacgcaaacggcatttc

SEQ ID NO: 1395 - DNA, 25 bp, Homo sapien
aagctgactttctggccgcagtgga

SEQ ID NO: 1396 - DNA, 25 bp, Homo sapien
tctcaaaggtggcataagcatcctg

SEQ ID NO: 1397 - DNA, 25 bp, Homo sapien
cgagcttaatctgaggcggggaacc

SEQ ID NO: 1398 - DNA, 25 bp, Homo sapien
ccaggaggtgtttgtcgcgacaaca

SEQ ID NO: 1399 - DNA, 25 bp, Homo sapien
ggcagtggaaccgactcccagaact

SEQ ID NO: 1400 - DNA, 25 bp, Homo sapien
cccagcgtgtgagtcaaaccatact

SEQ ID NO: 1401 - DNA, 25 bp, Homo sapien
caccctggaaggatattggcatgcc

SEQ ID NO: 1402 - DNA, 25 bp, Homo sapien
ttggcatgccctagggtgaaaattc

SEQ ID NO: 1403 - DNA, 25 bp, Homo sapien
gcctaccgagtcagggcgggattaa

SEQ ID NO: 1404 - DNA, 25 bp, Homo sapien
cgggattaagacctccggcgctgga

SEQ ID NO: 1405 - DNA, 25 bp, Homo sapien
cgcaatgtccgcttcggctctagga

SEQ ID NO: 1406 - DNA, 25 bp, Homo sapien
tccctagcgagcgtcccaaaggcga

SEQ ID NO: 1407 - DNA, 25 bp, Homo sapien
ttctcgcgcactcggttctgaaagc

SEQ ID NO: 1408 - DNA, 25 bp, Homo sapien
ttggattctgttacccgcgaactgc

SEQ ID NO: 1409 - DNA, 25 bp, Homo sapien
taagggttcccgagatgtcaagttc

SEQ ID NO: 1410 - DNA, 25 bp, Homo sapien
ccagttgtctccgaagagtggattg

SEQ ID NO: 1411 - DNA, 25 bp, Homo sapien
gtggctcacgttccaaggccctaga

SEQ ID NO: 1412 - DNA, 25 bp, Homo sapien
ttctccgcccaaggacacgcgtagt

SEQ ID NO: 1413 - DNA, 25 bp, Homo sapien
acgcgtagtcctcctctgtccagga

SEQ ID NO: 1414 - DNA, 25 bp, Homo sapien
ggcctggctcgttttgacatttttg

SEQ ID NO: 1415 - DNA, 25 bp, Homo sapien
cgcagcgcaccgagtggacattttg

SEQ ID NO: 1416 - DNA, 25 bp, Homo sapien
tcaagagctccatcgtcacagaagg

SEQ ID NO: 1417 - DNA, 25 bp, Homo sapien
atttttgcgcccacgagtcttcgga

SEQ ID NO: 1418 - DNA, 25 bp, Homo sapien
gcgcacagattcgaggctccggaca

SEQ ID NO: 1419 - DNA, 25 bp, Homo sapien
ccacggacagaatggcgttctctta

SEQ ID NO: 1420 - DNA, 25 bp, Homo sapien
tccagagctagatcggccacggaca

SEQ ID NO: 1421 - DNA, 25 bp, Homo sapien
cgggtccttgcggagctaactagct

SEQ ID NO: 1422 - DNA, 25 bp, Homo sapien
tccgttgacgatgcctcgagctatg

SEQ ID NO: 1423 - DNA, 25 bp, Homo sapien
tgcccttgcgagagccatggattcg

SEQ ID NO: 1424 - DNA, 25 bp, Homo sapien
ccctgggctcctttgaatcgctttg

SEQ ID NO: 1425 - DNA, 25 bp, Homo sapien
tgctgccggacattctagggtctga

SEQ ID NO: 1426 - DNA, 25 bp, Homo sapien
accgcgcatctaggaggttacctgc

SEQ ID NO: 1427 - DNA, 25 bp, Homo sapien
ggtgacttgcgagggaccacctttc

SEQ ID NO: 1428 - DNA, 25 bp, Homo sapien
cgaggctaccacctgcccgaattgg

SEQ ID NO: 1429 - DNA, 25 bp, Homo sapien
cccgaattggtgctttggcagagtc

SEQ ID NO: 1430 - DNA, 25 bp, Homo sapien
gccggactcaccgaactgctggatg

SEQ ID NO: 1431 - DNA, 25 bp, Homo sapien
cactccagaagtgcgcgggtccaca

SEQ ID NO: 1432 - DNA, 25 bp, Homo sapien
tctcgccgctcatgaagcgctgctt

SEQ ID NO: 1433 - DNA, 25 bp, Homo sapien
ttctccctgaggttcacgtggtcga

SEQ ID NO: 1434 - DNA, 25 bp, Homo sapien
tggtcgatggacagaccctgctctg

SEQ ID NO: 1435 - DNA, 25 bp, Homo sapien
tcatctgcagccgagacagggacaa

SEQ ID NO: 1436 - DNA, 25 bp, Homo sapien
cctccgagatgatggccacgagcta

SEQ ID NO: 1437 - DNA, 25 bp, Homo sapien
agctccaaggtcatgtgcacgcggc

SEQ ID NO: 1438 - DNA, 25 bp, Homo sapien
atgaagggcggtttcttgtaccttg

SEQ ID NO: 1439 - DNA, 25 bp, Homo sapien
cttggcctttcttctggtgagtctc

SEQ ID NO: 1440 - DNA, 25 bp, Homo sapien
ctcgcatctctgtctgggtcatgtg

SEQ ID NO: 1441 - DNA, 25 bp, Homo sapien
tcatgtggccgggtgtcattcgttt

SEQ ID NO: 1442 - DNA, 25 bp, Homo sapien
gtcattcgttttccaggcggttaca

SEQ ID NO: 1443 - DNA, 25 bp, Homo sapien
caacgtggggagctacatgagacac

SEQ ID NO: 1444 - DNA, 25 bp, Homo sapien
catgggcaatgaagggcggtttctt

SEQ ID NO: 1445 - DNA, 25 bp, Homo sapien
gtgagtctctcctcgcatctctgtc

SEQ ID NO: 1446 - DNA, 25 bp, Homo sapien
cagactcatcatgccggagcccgaa

SEQ ID NO: 1447 - DNA, 25 bp, Homo sapien
tagggtcgccttagcaaccggcctc

SEQ ID NO: 1448 - DNA, 25 bp, Homo sapien
tctggccctagggtcgccttagcaa

SEQ ID NO: 1449 - DNA, 25 bp, Homo sapien
tggctcctgcgtctcaaccaatggg

SEQ ID NO: 1450 - DNA, 25 bp, Homo sapien
tggtcgcccagcagccatcttagga

SEQ ID NO: 1451 - DNA, 25 bp, Homo sapien
cataagccgtactcacctgtcagga

SEQ ID NO: 1452 - DNA, 25 bp, Homo sapien
ggggcttttctagcctgctccggga

SEQ ID NO: 1453 - DNA, 25 bp, Homo sapien
tcacctgtcaggaagtggtcgccca

SEQ ID NO: 1454 - DNA, 25 bp, Homo sapien
ccttggctgcgatgcacagatactt

SEQ ID NO: 1455 - DNA, 25 bp, Homo sapien
ggccgcctgctggaacacgttcagg

SEQ ID NO: 1456 - DNA, 25 bp, Homo sapien
ccacagggacttgcgcgactccagg

SEQ ID NO: 1457 - DNA, 25 bp, Homo sapien
ctggtgtgccgaccagaactggccc

SEQ ID NO: 1458 - DNA, 25 bp, Homo sapien
acagatacttgaagaagcgctggtg

SEQ ID NO: 1459 - DNA, 25 bp, Homo sapien
agggcctcggcccactgcaatgaca

SEQ ID NO: 1460 - DNA, 25 bp, Homo sapien
tgcaatgacacgtcacaaggcgccc

SEQ ID NO: 1461 - DNA, 25 bp, Homo sapien
tgctggaacacgttcagggcctcgg

SEQ ID NO: 1462 - DNA, 25 bp, Homo sapien
cagggcccgcagttcctgtttccgt

SEQ ID NO: 1463 - DNA, 25 bp, Homo sapien
gcgattatcaaaggactgcatgttc

SEQ ID NO: 1464 - DNA, 25 bp, Homo sapien
cgctttgatttagaggccgggataa

SEQ ID NO: 1465 - DNA, 25 bp, Homo sapien
gttgtcagcatgtttgccgctttga

SEQ ID NO: 1466 - DNA, 25 bp, Homo sapien
cagacctgaaagcatcggttgcgtt

SEQ ID NO: 1467 - DNA, 25 bp, Homo sapien
ggaacgccgttctggataactcgca

SEQ ID NO: 1468 - DNA, 25 bp, Homo sapien
tttccgtcgagcctacagcccagag

SEQ ID NO: 1469 - DNA, 25 bp, Homo sapien
gtctccgtttcagggtcagacctga

SEQ ID NO: 1470 - DNA, 25 bp, Homo sapien
gcccaagactgaggactcacacttc

SEQ ID NO: 1471 - DNA, 25 bp, Homo sapien
caaccttgcgccaggcttccggaaa

SEQ ID NO: 1472 - DNA, 25 bp, Homo sapien
acacttcccactttgcacctggagg

SEQ ID NO: 1473 - DNA, 25 bp, Homo sapien
agcgtcccatgtccggcaggcacgt

SEQ ID NO: 1474 - DNA, 25 bp, Homo sapien
aggcacgtggccgaatagcccaaga

SEQ ID NO: 1475 - DNA, 25 bp, Homo sapien
ggcaatggccaatttcccacccgtg

SEQ ID NO: 1476 - DNA, 25 bp, Homo sapien
ggaggccacctgcagaccaaccttg

SEQ ID NO: 1477 - DNA, 25 bp, Homo sapien
cgtggacgcaaaaggccaggactcc

SEQ ID NO: 1478 - DNA, 25 bp, Homo sapien
ctcgggtaaagctgtgcaatctgca

SEQ ID NO: 1479 - DNA, 25 bp, Homo sapien
ttgcctcggtgcaagcgaccaactc

SEQ ID NO: 1480 - DNA, 25 bp, Homo sapien
ggggttcctgtatctaactcggagc

SEQ ID NO: 1481 - DNA, 25 bp, Homo sapien
gccttcattcactccggggttcctg

SEQ ID NO: 1482 - DNA, 25 bp, Homo sapien
ctgcgcgcaaaacccgatggaaata

SEQ ID NO: 1483 - DNA, 25 bp, Homo sapien
atcagagcgaaaggccaggtacacg

SEQ ID NO: 1484 - DNA, 25 bp, Homo sapien
tgaccctttcccgtatcagagcgaa

SEQ ID NO: 1485 - DNA, 25 bp, Homo sapien
agcctggaataaagctgaccctttc

SEQ ID NO: 1486 - DNA, 25 bp, Homo sapien
gccgcagcgcttttcctacagatta

SEQ ID NO: 1487 - DNA, 25 bp, Homo sapien
gaccgcctctctatagtgccaacta

SEQ ID NO: 1488 - DNA, 25 bp, Homo sapien
aggctgcgcttcgagtcccttagcg

SEQ ID NO: 1489 - DNA, 25 bp, Homo sapien
ggccagtctcaagggtccgctcgct

SEQ ID NO: 1490 - DNA, 25 bp, Homo sapien
atgcccgaacggaggaagccgctgc

SEQ ID NO: 1491 - DNA, 25 bp, Homo sapien
aggactgctcactcggggcgcgaac

SEQ ID NO: 1492 - DNA, 25 bp, Homo sapien
atagtgccaactagggagccctgtg

SEQ ID NO: 1493 - DNA, 25 bp, Homo sapien
ctacagattaccaggaccgacgctc

SEQ ID NO: 1494 - DNA, 25 bp, Homo sapien
ggcagtgaaacgagcgacccacatt

SEQ ID NO: 1495 - DNA, 25 bp, Homo sapien
cacctcttctcgatggcgtgcagga

SEQ ID NO: 1496 - DNA, 25 bp, Homo sapien
tgtagatcatgttccgaggctcaga

SEQ ID NO: 1497 - DNA, 25 bp, Homo sapien
gttctgcaggtctagcacagccttg

SEQ ID NO: 1498 - DNA, 25 bp, Homo sapien
cttggctttgtgacactcgtcgaac

SEQ ID NO: 1499 - DNA, 25 bp, Homo sapien
ggcacacgtgggttaaggagtattc

SEQ ID NO: 1500 - DNA, 25 bp, Homo sapien
tgcgatgtacatgccgctgaccttc

SEQ ID NO: 1501 - DNA, 25 bp, Homo sapien
acccaagcggctcatgtagatcatg

SEQ ID NO: 1502 - DNA, 25 bp, Homo sapien
ccggcggcagcccagaaaataagtc

SEQ ID NO: 1503 - DNA, 25 bp, Homo sapien
agtgttgtcctctcacctctgtaaa

SEQ ID NO: 1504 - DNA, 25 bp, Homo sapien
atttacggtcctcgcagtccacgca

SEQ ID NO: 1505 - DNA, 25 bp, Homo sapien
ccgcgggagctgaacggatccaaat

SEQ ID NO: 1506 - DNA, 25 bp, Homo sapien
cggatccaaatgtttcccagtgggc

SEQ ID NO: 1507 - DNA, 25 bp, Homo sapien
tcccttgggaataaccggccacaga

SEQ ID NO: 1508 - DNA, 25 bp, Homo sapien
cccagtgggctagcagcttcttaga

SEQ ID NO: 1509 - DNA, 25 bp, Homo sapien
ggccatggccacctgttcaaaggta

SEQ ID NO: 1510 - DNA, 25 bp, Homo sapien
gcctggcttcggagccgctggacac

SEQ ID NO: 1511 - DNA, 25 bp, Homo sapien
ttaactggtctaaagtcccaggcgc

SEQ ID NO: 1512 - DNA, 25 bp, Homo sapien
gccctctggacaatcggcgcacttg

SEQ ID NO: 1513 - DNA, 25 bp, Homo sapien
ggtgcgcatcaccatgcgcggcctg

SEQ ID NO: 1514 - DNA, 25 bp, Homo sapien
gagcgcgacttcctcccacaagggg

SEQ ID NO: 1515 - DNA, 25 bp, Homo sapien
ctgggccctggaatccaagaaacct

SEQ ID NO: 1516 - DNA, 25 bp, Homo sapien
ctcccacaaggggtgcggagcgatt

SEQ ID NO: 1517 - DNA, 25 bp, Homo sapien
ctgccgagacaagccggtgcgcatc

SEQ ID NO: 1518 - DNA, 25 bp, Homo sapien
agatggttcccgatcgtcagaattc

SEQ ID NO: 1519 - DNA, 25 bp, Homo sapien
gcagcctgtcacaatcgcgcgatca

SEQ ID NO: 1520 - DNA, 25 bp, Homo sapien
tcaggccttaccagctttcgaagca

SEQ ID NO: 1521 - DNA, 25 bp, Homo sapien
agttgctggtaaagccctgagggtc

SEQ ID NO: 1522 - DNA, 25 bp, Homo sapien
tatcaaggccggacaagatggttcc

SEQ ID NO: 1523 - DNA, 25 bp, Homo sapien
cgtcagaattcctgtccgcgccttg

SEQ ID NO: 1524 - DNA, 25 bp, Homo sapien
ctccgacgtgtttgagatgggctta

SEQ ID NO: 1525 - DNA, 25 bp, Homo sapien
cgcgtgagttggaagctgaattacc

SEQ ID NO: 1526 - DNA, 25 bp, Homo sapien
tcggatcaccgcacatcatagaagg

SEQ ID NO: 1527 - DNA, 25 bp, Homo sapien
cacgctgtgctgactttatgtaaca

SEQ ID NO: 1528 - DNA, 25 bp, Homo sapien
agggtaatccctttggctgggctca

SEQ ID NO: 1529 - DNA, 25 bp, Homo sapien
gccacggtgcgatactaagccagga

SEQ ID NO: 1530 - DNA, 25 bp, Homo sapien
ttgagtcagcttttcgcgcgaactt

SEQ ID NO: 1531 - DNA, 25 bp, Homo sapien
cccagaaggttcagcggtttgagtc

SEQ ID NO: 1532 - DNA, 25 bp, Homo sapien
tcaccggcagacaaagacgaccatg

SEQ ID NO: 1533 - DNA, 25 bp, Homo sapien
gccactcttttgagggtagactaca

SEQ ID NO: 1534 - DNA, 25 bp, Homo sapien
tgcctcacctctggaaagaaccgga

SEQ ID NO: 1535 - DNA, 25 bp, Homo sapien
cacgtcaccgtagaccagggtcaca

SEQ ID NO: 1536 - DNA, 25 bp, Homo sapien
tcaccgtcctgagtccgatcaaaca

SEQ ID NO: 1537 - DNA, 25 bp, Homo sapien
ggtcacctcgactcgccaggcttaa

SEQ ID NO: 1538 - DNA, 25 bp, Homo sapien
caaaggtcgaagttcatccgcggcc

SEQ ID NO: 1539 - DNA, 25 bp, Homo sapien
gtagtccaacaacgaaagagccctg

SEQ ID NO: 1540 - DNA, 25 bp, Homo sapien
tgcgcagacccttgccatcagcaga

SEQ ID NO: 1541 - DNA, 25 bp, Homo sapien
ctgaagcgggtacagcctttaggct

SEQ ID NO: 1542 - DNA, 25 bp, Homo sapien
gaccgcggtatccagacgctccgat

SEQ ID NO: 1543 - DNA, 25 bp, Homo sapien
acgctccgatctgtacgagccgggc

SEQ ID NO: 1544 - DNA, 25 bp, Homo sapien
ggacgcagccacagaacggcacaca

SEQ ID NO: 1545 - DNA, 25 bp, Homo sapien
gccagggaggtaaccaagagtccga

SEQ ID NO: 1546 - DNA, 25 bp, Homo sapien
gctccgttccgggagagctgtctaa

SEQ ID NO: 1547 - DNA, 25 bp, Homo sapien
cagaagcgtagtgccagccgcaata

SEQ ID NO: 1548 - DNA, 25 bp, Homo sapien
gccgtgagctcttctcgcatccaga

SEQ ID NO: 1549 - DNA, 25 bp, Homo sapien
ccaatcggggacagtcagggctgtc

SEQ ID NO: 1550 - DNA, 25 bp, Homo sapien
ctcctaccggaagtagctgtggaca

SEQ ID NO: 1551 - DNA, 25 bp, Homo sapien
cggatttcggaataggcacagtggc

SEQ ID NO: 1552 - DNA, 25 bp, Homo sapien
gattctggacttcgggttccgctga

SEQ ID NO: 1553 - DNA, 25 bp, Homo sapien
ctggagtgacgccaacctgttaatg

SEQ ID NO: 1554 - DNA, 25 bp, Homo sapien
acagcagtgtcctctgggaaatgca

SEQ ID NO: 1555 - DNA, 25 bp, Homo sapien
tacccggagaccattcctgcgaggc

SEQ ID NO: 1556 - DNA, 25 bp, Homo sapien
cgggctgtggctgaagataattttc

SEQ ID NO: 1557 - DNA, 25 bp, Homo sapien
tgcacttgcgcagtttcacccgagg

SEQ ID NO: 1558 - DNA, 25 bp, Homo sapien
caggtgcatacacaggcccgagcta

SEQ ID NO: 1559 - DNA, 25 bp, Homo sapien
agctcggggcttcctcaccgtgagc

SEQ ID NO: 1560 - DNA, 25 bp, Homo sapien
tcccagccacgcactatgagaattt

SEQ ID NO: 1561 - DNA, 25 bp, Homo sapien
ccagagatcaaagttcgaaaaccgc

SEQ ID NO: 1562 - DNA, 25 bp, Homo sapien
ccaaggccggaaacgcccggatgtg

SEQ ID NO: 1563 - DNA, 25 bp, Homo sapien
gccttgtcctggcatcaaacacaca

SEQ ID NO: 1564 - DNA, 25 bp, Homo sapien
ggaacacaatcacgcacctgtcgca

SEQ ID NO: 1565 - DNA, 25 bp, Homo sapien
tccgagcagggacaggaacacaatc

SEQ ID NO: 1566 - DNA, 25 bp, Homo sapien
ttcacatccgcacgcacaacgaggg

SEQ ID NO: 1567 - DNA, 25 bp, Homo sapien
tgcgggcttccctatgcctctcatt

SEQ ID NO: 1568 - DNA, 25 bp, Homo sapien
gcctctcatttccaagcctggcttg

SEQ ID NO: 1569 - DNA, 25 bp, Homo sapien
gcccgctagagtggtcaggcctgat

SEQ ID NO: 1570 - DNA, 25 bp, Homo sapien
cctggcagctctgttatctggggta

SEQ ID NO: 1571 - DNA, 25 bp, Homo sapien
aagcggtcaacccagccacgatgcg

SEQ ID NO: 1572 - DNA, 25 bp, Homo sapien
tcagcattctctggttccgctcggg

SEQ ID NO: 1573 - DNA, 25 bp, Homo sapien
cggcggcagctaaatcggcacagca

SEQ ID NO: 1574 - DNA, 25 bp, Homo sapien
gggagcgtgcgtacctccagcccaa

SEQ ID NO: 1575 - DNA, 25 bp, Homo sapien
accaggaatacgagagccaggcggc

SEQ ID NO: 1576 - DNA, 25 bp, Homo sapien
ccgagaaccaggaatacgagagcca

SEQ ID NO: 1577 - DNA, 25 bp, Homo sapien
ccgacgagactaacggctgcggcgc

SEQ ID NO: 1578 - DNA, 25 bp, Homo sapien
gctgaaggagtcacctacccgacga

SEQ ID NO: 1579 - DNA, 25 bp, Homo sapien
ccagataccgttgggagcgcagcca

SEQ ID NO: 1580 - DNA, 25 bp, Homo sapien
ccgtgatttgcagccagataccgtt

SEQ ID NO: 1581 - DNA, 25 bp, Homo sapien
aggagtcacctacccgacgagacta

SEQ ID NO: 1582 - DNA, 25 bp, Homo sapien
aggtgttttcctcgcgtcctccaag

SEQ ID NO: 1583 - DNA, 25 bp, Homo sapien
gtcgtccatcatcgcctcgtagctg

SEQ ID NO: 1584 - DNA, 25 bp, Homo sapien
gcggcgctcctcacgacgttttaca

SEQ ID NO: 1585 - DNA, 25 bp, Homo sapien
tgagtcactcccacgcaacagggca

SEQ ID NO: 1586 - DNA, 25 bp, Homo sapien
cccggcctcacgtgacaaaggtgtg

SEQ ID NO: 1587 - DNA, 25 bp, Homo sapien
acgcgcgttcgcaatctggttacca

SEQ ID NO: 1588 - DNA, 25 bp, Homo sapien
tggttaccatgacgacgaggccctc

SEQ ID NO: 1589 - DNA, 25 bp, Homo sapien
ccgactagcttgaagacgcggctga

SEQ ID NO: 1590 - DNA, 25 bp, Homo sapien
cacggtaacggcacacgcagtcaca

SEQ ID NO: 1591 - DNA, 25 bp, Homo sapien
acatgcggaagcacatggcgacgtg

SEQ ID NO: 1592 - DNA, 25 bp, Homo sapien
cacatggcgacgtgtgtgcacctac

SEQ ID NO: 1593 - DNA, 25 bp, Homo sapien
tgtgtgcacctacctggcacgcaca

SEQ ID NO: 1594 - DNA, 25 bp, Homo sapien
cacccgtgcagcctagcgatgagtg

SEQ ID NO: 1595 - DNA, 25 bp, Homo sapien
ctgaagaggctacaaggcgcccgta

SEQ ID NO: 1596 - DNA, 25 bp, Homo sapien
tacaaggcgcccgtagccctgtcaa

SEQ ID NO: 1597 - DNA, 25 bp, Homo sapien
cgcccaacagatgagcacggtaacg

SEQ ID NO: 1598 - DNA, 25 bp, Homo sapien
cttgaggtcgttggagacgctgaac

SEQ ID NO: 1599 - DNA, 25 bp, Homo sapien
gcgctccgcatcgtacttgaggtcg

SEQ ID NO: 1600 - DNA, 25 bp, Homo sapien
aggcagggcctcaccacaatgcttt

SEQ ID NO: 1601 - DNA, 25 bp, Homo sapien
acaatgctttcttccggccgcgcag

SEQ ID NO: 1602 - DNA, 25 bp, Homo sapien
tggttctccaggatgactccggcca

SEQ ID NO: 1603 - DNA, 25 bp, Homo sapien
tcgccgatgagaaagcccgcgcgct

SEQ ID NO: 1604 - DNA, 25 bp, Homo sapien
agcaggacctcgtgttgctgttgcc

SEQ ID NO: 1605 - DNA, 25 bp, Homo sapien
ctgcttcccgatcttggctggagga

SEQ ID NO: 1606 - DNA, 25 bp, Homo sapien
agatggcgtccaggtacacagtggc

SEQ ID NO: 1607 - DNA, 25 bp, Homo sapien
ggcgcccgcattggtgctgacataa

SEQ ID NO: 1608 - DNA, 25 bp, Homo sapien
ggcccttccacatcggtccaccgca

SEQ ID NO: 1609 - DNA, 25 bp, Homo sapien
catcggcgtggagtcctcgctttca

SEQ ID NO: 1610 - DNA, 25 bp, Homo sapien
catggtacgccgaagggtcatcggc

SEQ ID NO: 1611 - DNA, 25 bp, Homo sapien
gcccgccggacatggtacgccgaag

SEQ ID NO: 1612 - DNA, 25 bp, Homo sapien
gctgacataatttcctgacctctga

SEQ ID NO: 1613 - DNA, 25 bp, Homo sapien
tccaggtacacagtggcgagtgtga

SEQ ID NO: 1614 - DNA, 25 bp, Homo sapien
tggtcacgcacaacgcgacgcagtc

SEQ ID NO: 1615 - DNA, 25 bp, Homo sapien
attagggtcacacacagcgcctgtc

SEQ ID NO: 1616 - DNA, 25 bp, Homo sapien
gccctccggagtcattcggcttctg

SEQ ID NO: 1617 - DNA, 25 bp, Homo sapien
ggcttctgtgtctcggaatcactca

SEQ ID NO: 1618 - DNA, 25 bp, Homo sapien
ggaaggttccgcgatctttctatta

SEQ ID NO: 1619 - DNA, 25 bp, Homo sapien
ggacaccgcggtcaccattaacgga

SEQ ID NO: 1620 - DNA, 25 bp, Homo sapien
ctgctgccgagagcttccagaattc

SEQ ID NO: 1621 - DNA, 25 bp, Homo sapien
tccaggccgcgtttaggaagcttca

SEQ ID NO: 1622 - DNA, 25 bp, Homo sapien
gtcccagacgctcaggtgccacatt

SEQ ID NO: 1623 - DNA, 25 bp, Homo sapien
tccggggcacagttagtctggtcac

SEQ ID NO: 1624 - DNA, 25 bp, Homo sapien
tgcggtccagtatgtctcccgagga

SEQ ID NO: 1625 - DNA, 25 bp, Homo sapien
tggaattccaagcagcctccggggc

SEQ ID NO: 1626 - DNA, 25 bp, Homo sapien
tgcccgcctcaagagcgtctgcgtg

SEQ ID NO: 1627 - DNA, 25 bp, Homo sapien
gtctgcgtgcttccagcgttaagtg

SEQ ID NO: 1628 - DNA, 25 bp, Homo sapien
agcacactttagttgggcccatcta

SEQ ID NO: 1629 - DNA, 25 bp, Homo sapien
cccagagaacgcagcacactttagt

SEQ ID NO: 1630 - DNA, 25 bp, Homo sapien
agcctggcgcgacaggaactcccga

SEQ ID NO: 1631 - DNA, 25 bp, Homo sapien
ctagtagaacggagctgaccctatc

SEQ ID NO: 1632 - DNA, 25 bp, Homo sapien
cgacttgtgtggattctagtagaac

SEQ ID NO: 1633 - DNA, 25 bp, Homo sapien
tgtgagatagctagggtcgacttgt

SEQ ID NO: 1634 - DNA, 25 bp, Homo sapien
ccttggggctttgtgagatagctag

SEQ ID NO: 1635 - DNA, 25 bp, Homo sapien
atcttcccgcggatttgggcaagcg

SEQ ID NO: 1636 - DNA, 25 bp, Homo sapien
gaccctatccgaacaggcgtaagtg

SEQ ID NO: 1637 - DNA, 25 bp, Homo sapien
acaggaactcccgacctgtgtgggc

SEQ ID NO: 1638 - DNA, 25 bp, Homo sapien
ggacacggatcctctaaggcccaga

SEQ ID NO: 1639 - DNA, 25 bp, Homo sapien
gtgttgtcctcggaaacgtcgctgg

SEQ ID NO: 1640 - DNA, 25 bp, Homo sapien
ttcggcgctttaggcgtctgtcaca

SEQ ID NO: 1641 - DNA, 25 bp, Homo sapien
tctgtcacagacctatctgcgggtc

SEQ ID NO: 1642 - DNA, 25 bp, Homo sapien
agcatctcagaaactgcgcgcggga

SEQ ID NO: 1643 - DNA, 25 bp, Homo sapien
cgcgggatgaacattcgggtgtttc

SEQ ID NO: 1644 - DNA, 25 bp, Homo sapien
cgccaggagtgacgaaacgttcgaa

SEQ ID NO: 1645 - DNA, 25 bp, Homo sapien
cgttcgaattcctgcgagaaaagtg

SEQ ID NO: 1646 - DNA, 25 bp, Homo sapien
tctggactaaaagtccgggcagttc

SEQ ID NO: 1647 - DNA, 25 bp, Homo sapien
gccctgcgtcctcttgtctggacta

SEQ ID NO: 1648 - DNA, 25 bp, Homo sapien
atgcccacgcttcaccgctagggga

SEQ ID NO: 1649 - DNA, 25 bp, Homo sapien
gtttaaaagacaggtggctctcgga

SEQ ID NO: 1650 - DNA, 25 bp, Homo sapien
tcagacctgagtgctaggacgccga

SEQ ID NO: 1651 - DNA, 25 bp, Homo sapien
ttgggatggactcgttcagacctga

SEQ ID NO: 1652 - DNA, 25 bp, Homo sapien
tttccggccgaagaaggctagtcac

SEQ ID NO: 1653 - DNA, 25 bp, Homo sapien
agtcacctttccttggcgggtgttg

SEQ ID NO: 1654 - DNA, 25 bp, Homo sapien
gcttcatttccgttagtttgcgaga

SEQ ID NO: 1655 - DNA, 25 bp, Homo sapien
cctctgtcaaggtaggagtgtccgg

SEQ ID NO: 1656 - DNA, 25 bp, Homo sapien
gctggcgaacccgaaattgggcttg

SEQ ID NO: 1657 - DNA, 25 bp, Homo sapien
ccggctagccaagcgctggactaca

SEQ ID NO: 1658 - DNA, 25 bp, Homo sapien
gctcccggagcgtagcttcatttcc

SEQ ID NO: 1659 - DNA, 25 bp, Homo sapien
cgtccggagcgctggactacatttc

SEQ ID NO: 1660 - DNA, 25 bp, Homo sapien
gtagaccctgggaccactcagctcg

SEQ ID NO: 1661 - DNA, 25 bp, Homo sapien
gccagatcttggaccctgaactgca

SEQ ID NO: 1662 - DNA, 25 bp, Homo sapien
cccgagctgtgcagctgcaagaacc

SEQ ID NO: 1663 - DNA, 25 bp, Homo sapien
acggcagtttcactctgagcctgtg

SEQ ID NO: 1664 - DNA, 25 bp, Homo sapien
gtcctactccggactgtatttccca

SEQ ID NO: 1665 - DNA, 25 bp, Homo sapien
gcgcggtcctactccggactgtatt

SEQ ID NO: 1666 - DNA, 25 bp, Homo sapien
tgcaagaacccgaaaaaacaggcgc

SEQ ID NO: 1667 - DNA, 25 bp, Homo sapien
tcactctgagcctgtgtctggatca

SEQ ID NO: 1668 - DNA, 25 bp, Homo sapien
cctgtgtctggatcacggagacgcg

SEQ ID NO: 1669 - DNA, 25 bp, Homo sapien
ggccagcgtcctacggcagtttcac

SEQ ID NO: 1670 - DNA, 25 bp, Homo sapien
gattttcacccggaggggacagcac

SEQ ID NO: 1671 - DNA, 25 bp, Homo sapien
gtctgcccgtccgagctttcctggg

SEQ ID NO: 1672 - DNA, 25 bp, Homo sapien
caggaaggagcgacgttccctaggc

SEQ ID NO: 1673 - DNA, 25 bp, Homo sapien
ggatgcaggccatggacccggccgc

SEQ ID NO: 1674 - DNA, 25 bp, Homo sapien
cccggccgcggcggatctttacgag

SEQ ID NO: 1675 - DNA, 25 bp, Homo sapien
gcggatctttacgaggaggacggca

SEQ ID NO: 1676 - DNA, 25 bp, Homo sapien
ctcagcccccgcgttaggattttca

SEQ ID NO: 1677 - DNA, 25 bp, Homo sapien
cagcccctgcagaagttggtgcgcg

SEQ ID NO: 1678 - DNA, 25 bp, Homo sapien
ctcgtctaggtggtctgtcatcatc

SEQ ID NO: 1679 - DNA, 25 bp, Homo sapien
tcatctgtgttacgccaggaaggcc

SEQ ID NO: 1680 - DNA, 25 bp, Homo sapien
tctagggcctctgtcatcatccatg

SEQ ID NO: 1681 - DNA, 25 bp, Homo sapien
ggcgttcctccaaggtcctcgatca

SEQ ID NO: 1682 - DNA, 25 bp, Homo sapien
gagagggctctctatcttcatcatc

SEQ ID NO: 1683 - DNA, 25 bp, Homo sapien
ggtcatcatcagcattacgccagga

SEQ ID NO: 1684 - DNA, 25 bp, Homo sapien
cccgatcatcgtctggtctaagaga

SEQ ID NO: 1685 - DNA, 25 bp, Homo sapien
ttcatcggcaattcgtctgggaggc

SEQ ID NO: 1686 - DNA, 25 bp, Homo sapien
cgggtatagtggttccgcaaccttg

SEQ ID NO: 1687 - DNA, 25 bp, Homo sapien
ccgcaaccttgggatgttcggctga

SEQ ID NO: 1688 - DNA, 25 bp, Homo sapien
atgttcggctgagcgcctgcctaac

SEQ ID NO: 1689 - DNA, 25 bp, Homo sapien
tgagcgcctgcctaacatgggagcg

SEQ ID NO: 1690 - DNA, 25 bp, Homo sapien
agtcctggccttcaatcggccatcg

SEQ ID NO: 1691 - DNA, 25 bp, Homo sapien
catcgccacggcagaaactggggcc

SEQ ID NO: 1692 - DNA, 25 bp, Homo sapien
gcctaacatgggagcgcctgcctaa

SEQ ID NO: 1693 - DNA, 25 bp, Homo sapien
catccaggcgcacggcgggtatagt

SEQ ID NO: 1694 - DNA, 25 bp, Homo sapien
cccagacaaaaccaacggagaggca

SEQ ID NO: 1695 - DNA, 25 bp, Homo sapien
acggagaggcactctggagaagaca

SEQ ID NO: 1696 - DNA, 25 bp, Homo sapien
gttaccagcatcagcacaacacgcg

SEQ ID NO: 1697 - DNA, 25 bp, Homo sapien
gagggattcctccatccagtcagga

SEQ ID NO: 1698 - DNA, 25 bp, Homo sapien
actgtacatggtgccgtctgaggga

SEQ ID NO: 1699 - DNA, 25 bp, Homo sapien
ggtccacgccgcactgtacatggtg

SEQ ID NO: 1700 - DNA, 25 bp, Homo sapien
cgccaagcggccaaagttaccagca

SEQ ID NO: 1701 - DNA, 25 bp, Homo sapien
cactctggagaagacacaccctgga

SEQ ID NO: 1702 - DNA, 25 bp, Homo sapien
cgggagggagccatgtttcttactc

SEQ ID NO: 1703 - DNA, 25 bp, Homo sapien
gtgagaaggaaacccatgcccaacc

SEQ ID NO: 1704 - DNA, 25 bp, Homo sapien
agctactcaccgttggcgcgtttga

SEQ ID NO: 1705 - DNA, 25 bp, Homo sapien
tggcgtcacgcacgccgacagacgt

SEQ ID NO: 1706 - DNA, 25 bp, Homo sapien
tgagggcattttccggcctctgaaa

SEQ ID NO: 1707 - DNA, 25 bp, Homo sapien
cctctgaaaataggccggcatcttg

SEQ ID NO: 1708 - DNA, 25 bp, Homo sapien
tcctaggcgcgcaaggtccagttcc

SEQ ID NO: 1709 - DNA, 25 bp, Homo sapien
tcagcgaactctctagtggcccggg

SEQ ID NO: 1710 - DNA, 25 bp, Homo sapien
cacacacgggatggggagcaaagcc

SEQ ID NO: 1711 - DNA, 25 bp, Homo sapien
tgggatgagcctcacacacgggatg

SEQ ID NO: 1712 - DNA, 25 bp, Homo sapien
gcccagaggtgtccatgacgtaccc

SEQ ID NO: 1713 - DNA, 25 bp, Homo sapien
gactgtcactgctaacaccttcctg

SEQ ID NO: 1714 - DNA, 25 bp, Homo sapien
gaactcagtcgaccctgcccagagg

SEQ ID NO: 1715 - DNA, 25 bp, Homo sapien
cgtgtgcgaactcagtcgaccctgc

SEQ ID NO: 1716 - DNA, 25 bp, Homo sapien
gtgtccatgacgtacccgaatgtga

SEQ ID NO: 1717 - DNA, 25 bp, Homo sapien
ccgaatgtgacggaacccggaacag

SEQ ID NO: 1718 - DNA, 25 bp, Homo sapien
cgatggcgacgttgctcaggccttc

SEQ ID NO: 1719 - DNA, 25 bp, Homo sapien
atggcgacgttgctcaggccttcac

SEQ ID NO: 1720 - DNA, 25 bp, Homo sapien
ccgatggcgacgttgctcaggcctt

SEQ ID NO: 1721 - DNA, 25 bp, Homo sapien
gccgatggcgacgttgctcaggcct

SEQ ID NO: 1722 - DNA, 25 bp, Homo sapien
acgccgatggcgacgttgctcaggc

SEQ ID NO: 1723 - DNA, 25 bp, Homo sapien
tccgacgccgatggcgacgttgctc

SEQ ID NO: 1724 - DNA, 25 bp, Homo sapien
gtccgacgccgatggcgacgttgct

SEQ ID NO: 1725 - DNA, 25 bp, Homo sapien
tggcgacgttgctcaggccttcaca

SEQ ID NO: 1726 - DNA, 25 bp, Homo sapien
cgtctggcagtaacaggctctgtgc

SEQ ID NO: 1727 - DNA, 25 bp, Homo sapien
tctgagaaaggctctgatctgaccc

SEQ ID NO: 1728 - DNA, 25 bp, Homo sapien
gattagcgcagggatgtaagaaaca

SEQ ID NO: 1729 - DNA, 25 bp, Homo sapien
cgccagttaccgaaagaattgtctg

SEQ ID NO: 1730 - DNA, 25 bp, Homo sapien
gcagacggcacactaggccttcata

SEQ ID NO: 1731 - DNA, 25 bp, Homo sapien
ctgatctgacccgaaaggcccttgg

SEQ ID NO: 1732 - DNA, 25 bp, Homo sapien
ggcaacgcctcagcgtctggcagta

SEQ ID NO: 1733 - DNA, 25 bp, Homo sapien
agactccgcggcagacggcacacta

SEQ ID NO: 1734 - DNA, 25 bp, Homo sapien
cgctgaaatgcgcaagaaagttttt

SEQ ID NO: 1735 - DNA, 25 bp, Homo sapien
gtccgcctactaacatctgatcgcg

SEQ ID NO: 1736 - DNA, 25 bp, Homo sapien
ctggaaacagactgtccgcctacta

SEQ ID NO: 1737 - DNA, 25 bp, Homo sapien
ccgagagcgtcccttccttttgtgt

SEQ ID NO: 1738 - DNA, 25 bp, Homo sapien
ctatttgaggctaaccgagagcgtc

SEQ ID NO: 1739 - DNA, 25 bp, Homo sapien
aaagtttttgctgcgcatgtaggcg

SEQ ID NO: 1740 - DNA, 25 bp, Homo sapien
agcgggtagacgttccagcgctgaa

SEQ ID NO: 1741 - DNA, 25 bp, Homo sapien
ggtcaggcccaagcgcttcttattg

SEQ ID NO: 1742 - DNA, 25 bp, Homo sapien
ggtgtcgcctccaaactggtggttc

SEQ ID NO: 1743 - DNA, 25 bp, Homo sapien
gccttcgcggtcagcagatctcatt

SEQ ID NO: 1744 - DNA, 25 bp, Homo sapien
ctgtgcagatgtcagtcaccctgtg

SEQ ID NO: 1745 - DNA, 25 bp, Homo sapien
cccttcagtgtgtagcgttgacgtc

SEQ ID NO: 1746 - DNA, 25 bp, Homo sapien
tgcaccttgttacctgactttcggc

SEQ ID NO: 1747 - DNA, 25 bp, Homo sapien
gcgttccgtgagtgccctataggca

SEQ ID NO: 1748 - DNA, 25 bp, Homo sapien
gcaccttgaaggtcagcgcacactg

SEQ ID NO: 1749 - DNA, 25 bp, Homo sapien
caccgggaccacattttgcagaatc

SEQ ID NO: 1750 - DNA, 25 bp, Homo sapien
ccgaggtggcggacactcagctgat

SEQ ID NO: 1751 - DNA, 25 bp, Homo sapien
gagccgggacgtcgagcgctcccag

SEQ ID NO: 1752 - DNA, 25 bp, Homo sapien
ggcggacactcagctgatgcttgga

SEQ ID NO: 1753 - DNA, 25 bp, Homo sapien
tgatcggtgaggacgtaggcgccct

SEQ ID NO: 1754 - DNA, 25 bp, Homo sapien
gaagcccgcaccctggttctgcctc

SEQ ID NO: 1755 - DNA, 25 bp, Homo sapien
agcccggcctccttggtgcagggga

SEQ ID NO: 1756 - DNA, 25 bp, Homo sapien
ctcagctgatgcttggagtcgggct

SEQ ID NO: 1757 - DNA, 25 bp, Homo sapien
acctccaagattccggggtggagct

SEQ ID NO: 1758 - DNA, 25 bp, Homo sapien
ccgctcctttcgtcggcaagcataa

SEQ ID NO: 1759 - DNA, 25 bp, Homo sapien
gctggttcagatctcgcagagctca

SEQ ID NO: 1760 - DNA, 25 bp, Homo sapien
tgtagttcaacgatgacggccgtgg

SEQ ID NO: 1761 - DNA, 25 bp, Homo sapien
actggagagcctacgaccgcacaca

SEQ ID NO: 1762 - DNA, 25 bp, Homo sapien
cacagcagctcaaggtcactggaga

SEQ ID NO: 1763 - DNA, 25 bp, Homo sapien
tgcagcaacagtcacacacgaacca

SEQ ID NO: 1764 - DNA, 25 bp, Homo sapien
gctcagagtcctgcatgcctcagtc

SEQ ID NO: 1765 - DNA, 25 bp, Homo sapien
gcaagcataaaggtgtgcagcaaca

SEQ ID NO: 1766 - DNA, 25 bp, Homo sapien
gtgtgtcttctgtctcgtgttgcta

SEQ ID NO: 1767 - DNA, 25 bp, Homo sapien
tgcatgcttcatagaggccagcctg

SEQ ID NO: 1768 - DNA, 25 bp, Homo sapien
gtccgagcctactcacgagagcgtg

SEQ ID NO: 1769 - DNA, 25 bp, Homo sapien
ctgcttatgggtattcgcgtgcgtc

SEQ ID NO: 1770 - DNA, 25 bp, Homo sapien
ccgtgtgactgtgacgccatcatca

SEQ ID NO: 1771 - DNA, 25 bp, Homo sapien
cgcggtttacatcattgggagcaca

SEQ ID NO: 1772 - DNA, 25 bp, Homo sapien
tgttcccagggtgaacgagcacgtg

SEQ ID NO: 1773 - DNA, 25 bp, Homo sapien
cggtggtgcttgtatccgggataac

SEQ ID NO: 1774 - DNA, 25 bp, Homo sapien
cggcgtcctcctccaaagattgggg

SEQ ID NO: 1775 - DNA, 25 bp, Homo sapien
tcagggaaccacaagcacaggcatc

SEQ ID NO: 1776 - DNA, 25 bp, Homo sapien
agctagcggtttcccgaggactcac

SEQ ID NO: 1777 - DNA, 25 bp, Homo sapien
gagcgccacaagtctcggtccgtta

SEQ ID NO: 1778 - DNA, 25 bp, Homo sapien
gcttcactgtttgcgcgtcctgaga

SEQ ID NO: 1779 - DNA, 25 bp, Homo sapien
agaatcgaatcgttccgctgcttcc

SEQ ID NO: 1780 - DNA, 25 bp, Homo sapien
ggagctcagcctaggttttgcacga

SEQ ID NO: 1781 - DNA, 25 bp, Homo sapien
agaccacggtgttccagggctcaca

SEQ ID NO: 1782 - DNA, 25 bp, Homo sapien
ggcgactgttcgctgcaccttgttg

SEQ ID NO: 1783 - DNA, 25 bp, Homo sapien
tgtgcctgtccacgtcctgtgtgac

SEQ ID NO: 1784 - DNA, 25 bp, Homo sapien
accagttctgttctgcaggtcggga

SEQ ID NO: 1785 - DNA, 25 bp, Homo sapien
cttcggggcaggaaggagatcttcc

SEQ ID NO: 1786 - DNA, 25 bp, Homo sapien
tgggttccatccaactaagggtagc

SEQ ID NO: 1787 - DNA, 25 bp, Homo sapien
gtgttacaaaccctgcgcggagctg

SEQ ID NO: 1788 - DNA, 25 bp, Homo sapien
ggaatccggactttcgggctctctg

SEQ ID NO: 1789 - DNA, 25 bp, Homo sapien
tgcggccaacctgcgattctcaact

SEQ ID NO: 1790 - DNA, 25 bp, Homo sapien
ttcatgctgcgggtaatccctgtcc

SEQ ID NO: 1791 - DNA, 25 bp, Homo sapien
tggggcagcattccgcacgacgtga

SEQ ID NO: 1792 - DNA, 25 bp, Homo sapien
acgccgcgtccactggggcagcatt

SEQ ID NO: 1793 - DNA, 25 bp, Homo sapien
tcaggtggagatcacgccgcgtcca

SEQ ID NO: 1794 - DNA, 25 bp, Homo sapien
cccactgcaagcatcgggcggcagg

SEQ ID NO: 1795 - DNA, 25 bp, Homo sapien
ggtaatccctgtccatggcgggccc

SEQ ID NO: 1796 - DNA, 25 bp, Homo sapien
cgtctatctgggcttctcgctccgt

SEQ ID NO: 1797 - DNA, 25 bp, Homo sapien
ggtggcggcagcatcatgatctgca

SEQ ID NO: 1798 - DNA, 25 bp, Homo sapien
cagcataaatgggaaggcacggttt

SEQ ID NO: 1799 - DNA, 25 bp, Homo sapien
tgagaaacggtcaaacctgggacta

SEQ ID NO: 1800 - DNA, 25 bp, Homo sapien
ctgaagggttaagagattcggcgtc

SEQ ID NO: 1801 - DNA, 25 bp, Homo sapien
tgcgcaccggccattcaggatggga

SEQ ID NO: 1802 - DNA, 25 bp, Homo sapien
gctgacagcctcaaagtcgcaattg

SEQ ID NO: 1803 - DNA, 25 bp, Homo sapien
gcgtggcaggacgaccaatttcaga

SEQ ID NO: 1804 - DNA, 25 bp, Homo sapien
atgggacgaccttataccgcggtga

SEQ ID NO: 1805 - DNA, 25 bp, Homo sapien
aatttcagattcagggcgcggatgc

SEQ ID NO: 1806 - DNA, 25 bp, Homo sapien
gcgcggtttctctgtagttcgccta

SEQ ID NO: 1807 - DNA, 25 bp, Homo sapien
ttctgtgcgactgttggatgtttcc

SEQ ID NO: 1808 - DNA, 25 bp, Homo sapien
ggaagcaccacgtgatccctaagga

SEQ ID NO: 1809 - DNA, 25 bp, Homo sapien
gccgaacctgcctgaagaaacctca

SEQ ID NO: 1810 - DNA, 25 bp, Homo sapien
ccatggtcctgcgatcctaggagtc

SEQ ID NO: 1811 - DNA, 25 bp, Homo sapien
tgttttcctattgggctgcagcctg

SEQ ID NO: 1812 - DNA, 25 bp, Homo sapien
aaagtgcacgtaccaggcgcgatca

SEQ ID NO: 1813 - DNA, 25 bp, Homo sapien
ctcttggttcctaaagcctcggtga

SEQ ID NO: 1814 - DNA, 25 bp, Homo sapien
ccgtgcgtcaagacataacagcgta

SEQ ID NO: 1815 - DNA, 25 bp, Homo sapien
taattagccagagcaccgtcccgtt

SEQ ID NO: 1816 - DNA, 25 bp, Homo sapien
agcgcaaggccgacttccataagta

SEQ ID NO: 1817 - DNA, 25 bp, Homo sapien
ttcggtgcggaggaacacaactagc

SEQ ID NO: 1818 - DNA, 25 bp, Homo sapien
gctccaggggcacactcataaattc

SEQ ID NO: 1819 - DNA, 25 bp, Homo sapien
tccagggcggaggaacactactagt

SEQ ID NO: 1820 - DNA, 25 bp, Homo sapien
gggccaagcgctaggagcattaaca

SEQ ID NO: 1821 - DNA, 25 bp, Homo sapien
cgcacgattctcagctggcttaatg

SEQ ID NO: 1822 - DNA, 25 bp, Homo sapien
tgaggctccacaggaaccttttctc

SEQ ID NO: 1823 - DNA, 25 bp, Homo sapien
atcggcttctgcctcgagtgcgcaa

SEQ ID NO: 1824 - DNA, 25 bp, Homo sapien
tcatttggttctcggctcggagaca

SEQ ID NO: 1825 - DNA, 25 bp, Homo sapien
cccgtgactgaccagtgccattaaa

SEQ ID NO: 1826 - DNA, 25 bp, Homo sapien
cgactcagaggatagcccagccctg

SEQ ID NO: 1827 - DNA, 25 bp, Homo sapien
tgcagaagctcagtcccgggaaaaa

SEQ ID NO: 1828 - DNA, 25 bp, Homo sapien
ccacgaacctggtccggcacagtta

SEQ ID NO: 1829 - DNA, 25 bp, Homo sapien
ccagaatacgggagagcgcctgtct

SEQ ID NO: 1830 - DNA, 25 bp, Homo sapien
cctcggatggactcttgcaaacctc

SEQ ID NO: 1831 - DNA, 25 bp, Homo sapien
ggtagcccggaatacatttcccaga

SEQ ID NO: 1832 - DNA, 25 bp, Homo sapien
gcttgtgccagcgactactaggtca

SEQ ID NO: 1833 - DNA, 25 bp, Homo sapien
aactgtgacccgatgagtccgcgca

SEQ ID NO: 1834 - DNA, 25 bp, Homo sapien
gcgtcttctacagccaccacttggg

SEQ ID NO: 1835 - DNA, 25 bp, Homo sapien
tcagatcctccatgcggctttcata

SEQ ID NO: 1836 - DNA, 25 bp, Homo sapien
ctttcattcaggtgacgatccctcg

SEQ ID NO: 1837 - DNA, 25 bp, Homo sapien
gtggctggactcaccgcgtcataaa

SEQ ID NO: 1838 - DNA, 25 bp, Homo sapien
gtacttggcgctcggtgatccagaa

SEQ ID NO: 1839 - DNA, 25 bp, Homo sapien
tcggaacccgtcatcacagtaccta

SEQ ID NO: 1840 - DNA, 25 bp, Homo sapien
tggtcattaccctcgaaaatccctc

SEQ ID NO: 1841 - DNA, 25 bp, Homo sapien
cgttcccggcacaactccgagagga

SEQ ID NO: 1842 - DNA, 25 bp, Homo sapien
cctgttccagggacattttgcgctg

SEQ ID NO: 1843 - DNA, 25 bp, Homo sapien
caggttgcgtttcctcctcctgttc

SEQ ID NO: 1844 - DNA, 25 bp, Homo sapien
ccagaagcgcacgttgggctcaatg

SEQ ID NO: 1845 - DNA, 25 bp, Homo sapien
ctaatgcgaagacccggaaaggttg

SEQ ID NO: 1846 - DNA, 25 bp, Homo sapien
tcaggaccgcaggtaccggtgagaa

SEQ ID NO: 1847 - DNA, 25 bp, Homo sapien
tgtaatatgtagtccaagccagaac

SEQ ID NO: 1848 - DNA, 25 bp, Homo sapien
ttctccgttgcctttgtaatatgta

SEQ ID NO: 1849 - DNA, 25 bp, Homo sapien
acgtcacacaggcaagccggtcctg

SEQ ID NO: 1850 - DNA, 25 bp, Homo sapien
ggtcacacaaggtcgactacgcacc

SEQ ID NO: 1851 - DNA, 25 bp, Homo sapien
acacacggcatgtacaggtcacaca

SEQ ID NO: 1852 - DNA, 25 bp, Homo sapien
cgctttacaaaggacacacacggca

SEQ ID NO: 1853 - DNA, 25 bp, Homo sapien
cgagaaatacggcagcgaccacttg

SEQ ID NO: 1854 - DNA, 25 bp, Homo sapien
aatccgaactcgaggctgcccgaag

SEQ ID NO: 1855 - DNA, 25 bp, Homo sapien
cccagaaggctgagaagtggaatcc

SEQ ID NO: 1856 - DNA, 25 bp, Homo sapien
aaatcccggttagattgcaggcacc

SEQ ID NO: 1857 - DNA, 25 bp, Homo sapien
ttgtcctcggagttctgagggtttc

SEQ ID NO: 1858 - DNA, 25 bp, Homo sapien
aaggcgtgtccgacttgtcctcgga

SEQ ID NO: 1859 - DNA, 25 bp, Homo sapien
cagagacttattgcgctggcgaaga

SEQ ID NO: 1860 - DNA, 25 bp, Homo sapien
cctctaccaggagtgtgaagacaca

SEQ ID NO: 1861 - DNA, 25 bp, Homo sapien
cgaagcctcgggctgtttgagtgta

SEQ ID NO: 1862 - DNA, 25 bp, Homo sapien
ctgttccgtcttggactacatattc

SEQ ID NO: 1863 - DNA, 25 bp, Homo sapien
cggtcctcgtggtcacatccgtatt

SEQ ID NO: 1864 - DNA, 25 bp, Homo sapien
gtcacatccgtatttcctgtaggtt

SEQ ID NO: 1865 - DNA, 25 bp, Homo sapien
cgacggagaaatcttgtacctctgg

SEQ ID NO: 1866 - DNA, 25 bp, Homo sapien
acttctcagggttgcctgcggtcct

SEQ ID NO: 1867 - DNA, 25 bp, Homo sapien
ctacatattccacgggcgacggaga

SEQ ID NO: 1868 - DNA, 25 bp, Homo sapien
ccgtgacctggtcccacctgaggaa

SEQ ID NO: 1869 - DNA, 25 bp, Homo sapien
aggactctggactccacttctcagg

SEQ ID NO: 1870 - DNA, 25 bp, Homo sapien
tcgaccttgcgtaacctggatgtgc

SEQ ID NO: 1871 - DNA, 25 bp, Homo sapien
aaacttggtcctttggctccgcgct

SEQ ID NO: 1872 - DNA, 25 bp, Homo sapien
tcccactgacgacggagaaaacttg

SEQ ID NO: 1873 - DNA, 25 bp, Homo sapien
ggtctggatattccgtcgtggacta

SEQ ID NO: 1874 - DNA, 25 bp, Homo sapien
cctagacttcatttcccgacaggga

SEQ ID NO: 1875 - DNA, 25 bp, Homo sapien
ccttgacctagcgtcagaaacgttc

SEQ ID NO: 1876 - DNA, 25 bp, Homo sapien
cgtgtcctttgcaaagcgtgcgttg

SEQ ID NO: 1877 - DNA, 25 bp, Homo sapien
tggtcaccacggcttttctcagagg

SEQ ID NO: 1878 - DNA, 25 bp, Homo sapien
ggaacccaccgaacgcgcatgcgtg

SEQ ID NO: 1879 - DNA, 25 bp, Homo sapien
cgccagcccggtgtgctatgagaac

SEQ ID NO: 1880 - DNA, 25 bp, Homo sapien
gagaaccttgttgccgcctagctga

SEQ ID NO: 1881 - DNA, 25 bp, Homo sapien
ttggcgagaaagcacgcggaaccca

SEQ ID NO: 1882 - DNA, 25 bp, Homo sapien
gcaaaggaggggctctaccatccgc

SEQ ID NO: 1883 - DNA, 25 bp, Homo sapien
acaattacgagtagtgccttgagcc

SEQ ID NO: 1884 - DNA, 25 bp, Homo sapien
cgcgctcttcagctctctttttctg

SEQ ID NO: 1885 - DNA, 25 bp, Homo sapien
gcagccgccgcactttggcgagaaa

SEQ ID NO: 1886 - DNA, 25 bp, Homo sapien
caggcacttgtgcaatcccgtgggg

SEQ ID NO: 1887 - DNA, 25 bp, Homo sapien
gccacacgcaggcacttgtgcaatc

SEQ ID NO: 1888 - DNA, 25 bp, Homo sapien
acttccagtaattgccgtccagcca

SEQ ID NO: 1889 - DNA, 25 bp, Homo sapien
atctccgggacttccagtaattgcc

SEQ ID NO: 1890 - DNA, 25 bp, Homo sapien
cctggagtgaagaaatctccgggac

SEQ ID NO: 1891 - DNA, 25 bp, Homo sapien
agcatgctcactgccgagggcggca

SEQ ID NO: 1892 - DNA, 25 bp, Homo sapien
ggaaagctttccaggcgtccgccca

SEQ ID NO: 1893 - DNA, 25 bp, Homo sapien
cctacctggcgagtgcagggaccca

SEQ ID NO: 1894 - DNA, 25 bp, Homo sapien
cccgcgcgccattctctttttgagt

SEQ ID NO: 1895 - DNA, 25 bp, Homo sapien
agcggactaccgttcctaggaggca

SEQ ID NO: 1896 - DNA, 25 bp, Homo sapien
ctgcggaagtgctctacagactgga

SEQ ID NO: 1897 - DNA, 25 bp, Homo sapien
cgcggctctcgagctgtagtctgca

SEQ ID NO: 1898 - DNA, 25 bp, Homo sapien
ggcagggcgtctctatctcaaagca

SEQ ID NO: 1899 - DNA, 25 bp, Homo sapien
caaagcattggctgcgcctgttacc

SEQ ID NO: 1900 - DNA, 25 bp, Homo sapien
gcgtgtgcactcaggagctcctaga

SEQ ID NO: 1901 - DNA, 25 bp, Homo sapien
caactaagaagctacctggcggatg

SEQ ID NO: 1902 - DNA, 25 bp, Homo sapien
agagcatgctgttcgacctcaacga

SEQ ID NO: 1903 - DNA, 25 bp, Homo sapien
agcgagatcaccctcagcgagtgtg

SEQ ID NO: 1904 - DNA, 25 bp, Homo sapien
agcttcgcccacttcgacgtgcaga

SEQ ID NO: 1905 - DNA, 25 bp, Homo sapien
ggacctcggcgatgacaacagcaac

SEQ ID NO: 1906 - DNA, 25 bp, Homo sapien
agtgtgagcgcaacgtgagcttctc

SEQ ID NO: 1907 - DNA, 25 bp, Homo sapien
ccggcagtacagcatcgagcatgtg

SEQ ID NO: 1908 - DNA, 25 bp, Homo sapien
ggactcgtccatctttcggaagcta

SEQ ID NO: 1909 - DNA, 25 bp, Homo sapien
cagcatctcggtgttggaagttccc

SEQ ID NO: 1910 - DNA, 25 bp, Homo sapien
tgcccagcgacgtgctcttcaccag

SEQ ID NO: 1911 - DNA, 25 bp, Homo sapien
acgctgcctgcacgccgccagcacc

SEQ ID NO: 1912 - DNA, 25 bp, Homo sapien
agcgacgtgctcttcaccagcacct

SEQ ID NO: 1913 - DNA, 25 bp, Homo sapien
cagcagtcaccgcagaagggcctgc

SEQ ID NO: 1914 - DNA, 25 bp, Homo sapien
gggctgcccagcgacgtgctcttca

SEQ ID NO: 1915 - DNA, 25 bp, Homo sapien
acgctgtcggacgagagcctgtgca

SEQ ID NO: 1916 - DNA, 25 bp, Homo sapien
ctgcagcggacgctgtcggacgaga

SEQ ID NO: 1917 - DNA, 25 bp, Homo sapien
cagcacgctgcctgcacgccgccag

SEQ ID NO: 1918 - DNA, 25 bp, Homo sapien
cccttcgtgtcccagtttccagctt

SEQ ID NO: 1919 - DNA, 25 bp, Homo sapien
gaagcctgggaacaggctgttctca

SEQ ID NO: 1920 - DNA, 25 bp, Homo sapien
cctgggaacaggctgttctcacatc

SEQ ID NO: 1921 - DNA, 25 bp, Homo sapien
gaacaggctgttctcacatcctctc

SEQ ID NO: 1922 - DNA, 25 bp, Homo sapien
aggctgttctcacatcctctcctgg

SEQ ID NO: 1923 - DNA, 25 bp, Homo sapien
tggtcgcgcccaaactgtgctttga

SEQ ID NO: 1924 - DNA, 25 bp, Homo sapien
tcgcgcccaaactgtgctttgaggc

SEQ ID NO: 1925 - DNA, 25 bp, Homo sapien
gcccaaactgtgctttgaggcccgg

SEQ ID NO: 1926 - DNA, 25 bp, Homo sapien
tccaagaagggcgaatggccctcat

SEQ ID NO: 1927 - DNA, 25 bp, Homo sapien
gtcctgtctgagaagcacgttcccg

SEQ ID NO: 1928 - DNA, 25 bp, Homo sapien
gcaggcgcatggaaccttcccggag

SEQ ID NO: 1929 - DNA, 25 bp, Homo sapien
agccgccatcttcagtgcactcggg

SEQ ID NO: 1930 - DNA, 25 bp, Homo sapien
atcttcagtgcactcgggcgccacg

SEQ ID NO: 1931 - DNA, 25 bp, Homo sapien
gacgctcggagcaaccgtcctacag

SEQ ID NO: 1932 - DNA, 25 bp, Homo sapien
agcacgttcccggagccaccagtgt

SEQ ID NO: 1933 - DNA, 25 bp, Homo sapien
gggcgaatggccctcatgcccagaa

SEQ ID NO: 1934 - DNA, 25 bp, Homo sapien
tgtagcagttgttctgggccacgcc

SEQ ID NO: 1935 - DNA, 25 bp, Homo sapien
ccacgccggtctgcgagtcgaggaa

SEQ ID NO: 1936 - DNA, 25 bp, Homo sapien
taactgcggcagtgctcgatggcct

SEQ ID NO: 1937 - DNA, 25 bp, Homo sapien
ggtagaagtcctcgcctaggctaga

SEQ ID NO: 1938 - DNA, 25 bp, Homo sapien
ggctgtcagcaagggcaggcgcaca

SEQ ID NO: 1939 - DNA, 25 bp, Homo sapien
caggcgcacagggtcgcccagcacc

SEQ ID NO: 1940 - DNA, 25 bp, Homo sapien
ctccatccagatgtagcagttgttc

SEQ ID NO: 1941 - DNA, 25 bp, Homo sapien
cgcgcgttgtaactgcggcagtgct

SEQ ID NO: 1942 - DNA, 25 bp, Homo sapien
ctcgtccacatatcctgctctcgcg

SEQ ID NO: 1943 - DNA, 25 bp, Homo sapien
atgacagtggccatcttgctccccg

SEQ ID NO: 1944 - DNA, 25 bp, Homo sapien
acacaggcccgcgtagacccgcccg

SEQ ID NO: 1945 - DNA, 25 bp, Homo sapien
cattcttgtcagagacccacagtca

SEQ ID NO: 1946 - DNA, 25 bp, Homo sapien
ggtgcatccgacaccattcttgtca

SEQ ID NO: 1947 - DNA, 25 bp, Homo sapien
agggagcggtgcatccgacaccatt

SEQ ID NO: 1948 - DNA, 25 bp, Homo sapien
gagcacgagggccacggccaatcgc

SEQ ID NO: 1949 - DNA, 25 bp, Homo sapien
gggcacgcaccgtcactcacccgcc

SEQ ID NO: 1950 - DNA, 25 bp, Homo sapien
ccagcgcgctacgatttcattcatt

SEQ ID NO: 1951 - DNA, 25 bp, Homo sapien
cccaaagggatcagagatgctcccg

SEQ ID NO: 1952 - DNA, 25 bp, Homo sapien
ctcacgacttgagcgggttctgaat

SEQ ID NO: 1953 - DNA, 25 bp, Homo sapien
tcactgacagcgacaaagaagaggc

SEQ ID NO: 1954 - DNA, 25 bp, Homo sapien
ccggacttaggtgttcgagctttca

SEQ ID NO: 1955 - DNA, 25 bp, Homo sapien
cctggagaccgaggtccggacttag

SEQ ID NO: 1956 - DNA, 25 bp, Homo sapien
atgctcccgtttgatgtgtatgcgc

SEQ ID NO: 1957 - DNA, 25 bp, Homo sapien
tttcattcattcttggggctgcggc

SEQ ID NO: 1958 - DNA, 25 bp, Homo sapien
acgcagtcgtgcgaagttgaggtat

SEQ ID NO: 1959 - DNA, 25 bp, Homo sapien
cgctcgtcctcttgtgcagaccagg

SEQ ID NO: 1960 - DNA, 25 bp, Homo sapien
ctggccgtgcaccagcgagtgtgca

SEQ ID NO: 1961 - DNA, 25 bp, Homo sapien
tggagactgcagcttgctcagcacg

SEQ ID NO: 1962 - DNA, 25 bp, Homo sapien
ctgcgtcggcttgaggcacgcagtc

SEQ ID NO: 1963 - DNA, 25 bp, Homo sapien
tgggacagacactcgggacccggcc

SEQ ID NO: 1964 - DNA, 25 bp, Homo sapien
ccgctgtcgctgtagaaggtcgagc

SEQ ID NO: 1965 - DNA, 25 bp, Homo sapien
cccgtctgcagtgcgagagtaggcc

SEQ ID NO: 1966 - DNA, 25 bp, Homo sapien
aggcttccaagaaacgcgtgtctgc

SEQ ID NO: 1967 - DNA, 25 bp, Homo sapien
ttcgggagccgcttccaataggcgt

SEQ ID NO: 1968 - DNA, 25 bp, Homo sapien
ataggcgttcgccattggctctggc

SEQ ID NO: 1969 - DNA, 25 bp, Homo sapien
ccacactgaaggtccggaaaggcga

SEQ ID NO: 1970 - DNA, 25 bp, Homo sapien
gcacctgaacgcgaggcgctccatt

SEQ ID NO: 1971 - DNA, 25 bp, Homo sapien
cgagaacgcagcatccacggtgagg

SEQ ID NO: 1972 - DNA, 25 bp, Homo sapien
cgacgtcgtcaccaagcccaaggga

SEQ ID NO: 1973 - DNA, 25 bp, Homo sapien
accctgaggccagtcctagagcgaa

SEQ ID NO: 1974 - DNA, 25 bp, Homo sapien
ccaatggacgtcaggattgagggaa

SEQ ID NO: 1975 - DNA, 25 bp, Homo sapien
caagcctgccgggtgcatccttcgc

SEQ ID NO: 1976 - DNA, 25 bp, Homo sapien
acctaagccgcggttcggagcgtgc

SEQ ID NO: 1977 - DNA, 25 bp, Homo sapien
cgccggcgaagagacagccaatgga

SEQ ID NO: 1978 - DNA, 25 bp, Homo sapien
gacagccaatggacgtcaggattga

SEQ ID NO: 1979 - DNA, 25 bp, Homo sapien
tcaggattgagggaaggcctcgccc

SEQ ID NO: 1980 - DNA, 25 bp, Homo sapien
acgtacgccacttacgcagccgggg

SEQ ID NO: 1981 - DNA, 25 bp, Homo sapien
acgactgggcggtgccttacgtaag

SEQ ID NO: 1982 - DNA, 25 bp, Homo sapien
tgtggcttccttctgaaatcaggtc

SEQ ID NO: 1983 - DNA, 25 bp, Homo sapien
caaccactgggaaggcagaacctca

SEQ ID NO: 1984 - DNA, 25 bp, Homo sapien
tgagtctgggtaactgcatctgcct

SEQ ID NO: 1985 - DNA, 25 bp, Homo sapien
gcctctttcttctgagcctgctgaa

SEQ ID NO: 1986 - DNA, 25 bp, Homo sapien
ttcagaactggccactgtgcggacc

SEQ ID NO: 1987 - DNA, 25 bp, Homo sapien
ccgcactttcggatgtggacacgga

SEQ ID NO: 1988 - DNA, 25 bp, Homo sapien
agaccctgagaagacactggccgca

SEQ ID NO: 1989 - DNA, 25 bp, Homo sapien
ggcccgcgctttatcagcacgctga

SEQ ID NO: 1990 - DNA, 25 bp, Homo sapien
aacacctggcggttgggcgtgcctc

SEQ ID NO: 1991 - DNA, 25 bp, Homo sapien
tcaccaccgtgggtacgtaagcgcc

SEQ ID NO: 1992 - DNA, 25 bp, Homo sapien
ttgctaacgcttcggggtccgccaa

SEQ ID NO: 1993 - DNA, 25 bp, Homo sapien
gcagctgcttcagcgcagcccgtgt

SEQ ID NO: 1994 - DNA, 25 bp, Homo sapien
actggaactaggtgccagacggtcc

SEQ ID NO: 1995 - DNA, 25 bp, Homo sapien
cgcctgtagcactcccggaactgga

SEQ ID NO: 1996 - DNA, 25 bp, Homo sapien
gtacgtaagcgcctcaccgcaaggc

SEQ ID NO: 1997 - DNA, 25 bp, Homo sapien
ttcctcttggggcatctgctgccgc

SEQ ID NO: 1998 - DNA, 25 bp, Homo sapien
ccaagtgactggtaccacggggccg

SEQ ID NO: 1999 - DNA, 25 bp, Homo sapien
tgccttaggggttgcgcgtcacctt

SEQ ID NO: 2000 - DNA, 25 bp, Homo sapien
gcggccattttgagaccgggcaaga

SEQ ID NO: 2001 - DNA, 25 bp, Homo sapien
cggccgagtgacagttgaccggttt

SEQ ID NO: 2002 - DNA, 25 bp, Homo sapien
gccgagtgacagttgaccggtttta

SEQ ID NO: 2003 - DNA, 25 bp, Homo sapien
ggccggggaaaaagctgtgccatcc

SEQ ID NO: 2004 - DNA, 25 bp, Homo sapien
ctccagccctcggtgccttaggggt

SEQ ID NO: 2005 - DNA, 25 bp, Homo sapien
cggggaaaaagctgtgccatccagg

SEQ ID NO: 2006 - DNA, 25 bp, Homo sapien
agcggcgataccaagagaagtgcga

SEQ ID NO: 2007 - DNA, 25 bp, Homo sapien
tacacgggtgcgatcgcaggcagaa

SEQ ID NO: 2008 - DNA, 25 bp, Homo sapien
ggcacagccgggtggaagtacacgg

SEQ ID NO: 2009 - DNA, 25 bp, Homo sapien
ggagaaagcggcgataccaagagaa

SEQ ID NO: 2010 - DNA, 25 bp, Homo sapien
gcgagaccaggtacagtacccagcc

SEQ ID NO: 2011 - DNA, 25 bp, Homo sapien
agacgggcgagaccaggtacagtac

SEQ ID NO: 2012 - DNA, 25 bp, Homo sapien
cataaagaccaagtggaggagtagg

SEQ ID NO: 2013 - DNA, 25 bp, Homo sapien
aagtacacgggtgcgatcgcaggca

SEQ ID NO: 2014 - DNA, 25 bp, Homo sapien
gcgcgggaagaaccaatcgccgaga

SEQ ID NO: 2015 - DNA, 25 bp, Homo sapien
atcccgaggcgaagagacagttttc

SEQ ID NO: 2016 - DNA, 25 bp, Homo sapien
gtgagactcaagaaggtgccggcta

SEQ ID NO: 2017 - DNA, 25 bp, Homo sapien
actcaagaaggtgccggctaagaag

SEQ ID NO: 2018 - DNA, 25 bp, Homo sapien
ggaaagatcccgaggcgaagagaca

SEQ ID NO: 2019 - DNA, 25 bp, Homo sapien
ccgaggcgaagagacagttttcatc

SEQ ID NO: 2020 - DNA, 25 bp, Homo sapien
acagttttcatcgagaaggggcagg

SEQ ID NO: 2021 - DNA, 25 bp, Homo sapien
caacgaagggcgaggaaagatcccg

SEQ ID NO: 2022 - DNA, 25 bp, Homo sapien
gcgcgtcactgacccgggactcaga

SEQ ID NO: 2023 - DNA, 25 bp, Homo sapien
cctttgagtcgcctgtcggccgggc

SEQ ID NO: 2024 - DNA, 25 bp, Homo sapien
tgcccgccttcgctttcggtgccgt

SEQ ID NO: 2025 - DNA, 25 bp, Homo sapien
ggaggcagaagcatccgaggcatta

SEQ ID NO: 2026 - DNA, 25 bp, Homo sapien
agcatccgaggcattaaagcatccg

SEQ ID NO: 2027 - DNA, 25 bp, Homo sapien
gcattaaagcatccgagggagccgg

SEQ ID NO: 2028 - DNA, 25 bp, Homo sapien
agagcaggaataatgcggtaggcaa

SEQ ID NO: 2029 - DNA, 25 bp, Homo sapien
aaagtgcatctttgtccgcggcccg

SEQ ID NO: 2030 - DNA, 25 bp, Homo sapien
cactgagtacagcttcgccatcttc

SEQ ID NO: 2031 - DNA, 25 bp, Homo sapien
tcgggcttccacaacgagaactcgc

SEQ ID NO: 2032 - DNA, 25 bp, Homo sapien
cctggtctactacctgctgtggctg

SEQ ID NO: 2033 - DNA, 25 bp, Homo sapien
tggctgcactccgtgtacgacaagg

SEQ ID NO: 2034 - DNA, 25 bp, Homo sapien
ggattactacttcttcttggcgagc

SEQ ID NO: 2035 - DNA, 25 bp, Homo sapien
ccggagcgcattttcctggacaagg

SEQ ID NO: 2036 - DNA, 25 bp, Homo sapien
ttccggacgcagtcagaactcggtc

SEQ ID NO: 2037 - DNA, 25 bp, Homo sapien
agatctacaacctcgagtccgcgta

SEQ ID NO: 2038 - DNA, 25 bp, Homo sapien
ttgtaggcggcgctgccgtaaatca

SEQ ID NO: 2039 - DNA, 25 bp, Homo sapien
gctacgaggtgtctggacccaacca

SEQ ID NO: 2040 - DNA, 25 bp, Homo sapien
atcaggcggtctgcttgccgcatca

SEQ ID NO: 2041 - DNA, 25 bp, Homo sapien
gcgaccggcatgtacgagcaactca

SEQ ID NO: 2042 - DNA, 25 bp, Homo sapien
caactcaagggcgagtggaaccgta

SEQ ID NO: 2043 - DNA, 25 bp, Homo sapien
cccaatcttagcaagtgcggggaag

SEQ ID NO: 2044 - DNA, 25 bp, Homo sapien
actcaaggtaaagtcggcaggccca

SEQ ID NO: 2045 - DNA, 25 bp, Homo sapien
acttccgccgggcaagcgtttgtag

SEQ ID NO: 2046 - DNA, 25 bp, Homo sapien
gtggcagtaacacttgcagggacag

SEQ ID NO: 2047 - DNA, 25 bp, Homo sapien
gcggcgatggcgtggctggtggtgg

SEQ ID NO: 2048 - DNA, 25 bp, Homo sapien
ggtggcagtaacacttgcagggaca

SEQ ID NO: 2049 - DNA, 25 bp, Homo sapien
tggtggcagtaacacttgcagggac

SEQ ID NO: 2050 - DNA, 25 bp, Homo sapien
ggtggtggcagtaacacttgcaggg

SEQ ID NO: 2051 - DNA, 25 bp, Homo sapien
tggtggtggcagtaacacttgcagg

SEQ ID NO: 2052 - DNA, 25 bp, Homo sapien
ctggtggtggcagtaacacttgcag

SEQ ID NO: 2053 - DNA, 25 bp, Homo sapien
gctggtggtggcagtaacacttgca

SEQ ID NO: 2054 - DNA, 25 bp, Homo sapien
caggagttaagcacctggaagggca

SEQ ID NO: 2055 - DNA, 25 bp, Homo sapien
caggcacggtagctgtagctcgttc

SEQ ID NO: 2056 - DNA, 25 bp, Homo sapien
gggaacccttgttcctgcgcgtgcg

SEQ ID NO: 2057 - DNA, 25 bp, Homo sapien
ctgtagctcgttcgcgaggaccatc

SEQ ID NO: 2058 - DNA, 25 bp, Homo sapien
tcgcgaggaccatctccatgcaagc

SEQ ID NO: 2059 - DNA, 25 bp, Homo sapien
tccatgcaagccatccttacgggtc

SEQ ID NO: 2060 - DNA, 25 bp, Homo sapien
tgcaagccatccttacgggtcgcgc

SEQ ID NO: 2061 - DNA, 25 bp, Homo sapien
tccaccactgctgtcaggcacggta

SEQ ID NO: 2062 - DNA, 25 bp, Homo sapien
accctacgaggctggctgtacttga

SEQ ID NO: 2063 - DNA, 25 bp, Homo sapien
cgccggctgccgttcagaaggtaat

SEQ ID NO: 2064 - DNA, 25 bp, Homo sapien
cgggacagtgtccttcacggatagt

SEQ ID NO: 2065 - DNA, 25 bp, Homo sapien
ggctggtcatgctgatccctcagtc

SEQ ID NO: 2066 - DNA, 25 bp, Homo sapien
catttctgacggagctcggagacta

SEQ ID NO: 2067 - DNA, 25 bp, Homo sapien
ctgtacttgatctaatgcgtccgca

SEQ ID NO: 2068 - DNA, 25 bp, Homo sapien
ccgatcaggcccaagtccttaggtc

SEQ ID NO: 2069 - DNA, 25 bp, Homo sapien
gcccgcgggcttttgccatttagac

SEQ ID NO: 2070 - DNA, 25 bp, Homo sapien
tcaccgttgaggaacgctgaggacc

SEQ ID NO: 2071 - DNA, 25 bp, Homo sapien
ctgacagactgcctgccccgatgag

SEQ ID NO: 2072 - DNA, 25 bp, Homo sapien
cggcagccattcagggtaccagtct

SEQ ID NO: 2073 - DNA, 25 bp, Homo sapien
gccattcagggtaccagtcttcatt

SEQ ID NO: 2074 - DNA, 25 bp, Homo sapien
taccagtcttcatttgtggggtctg

SEQ ID NO: 2075 - DNA, 25 bp, Homo sapien
tcatttgtggggtctggactttctc

SEQ ID NO: 2076 - DNA, 25 bp, Homo sapien
gtctggactttctccgaggatgccc

SEQ ID NO: 2077 - DNA, 25 bp, Homo sapien
cgtcctggaccctcaccgttgagga

SEQ ID NO: 2078 - DNA, 25 bp, Homo sapien
tggacagcgactcctcctccagtca

SEQ ID NO: 2079 - DNA, 25 bp, Homo sapien
ccgctcaggtgcgacctgggagcct

SEQ ID NO: 2080 - DNA, 25 bp, Homo sapien
agcttcaggcttcgggccgaccacg

SEQ ID NO: 2081 - DNA, 25 bp, Homo sapien
tcagcttcaggcttcgggccgacca

SEQ ID NO: 2082 - DNA, 25 bp, Homo sapien
tcacgatggagtcagcttcaggctt

SEQ ID NO: 2083 - DNA, 25 bp, Homo sapien
agccgccaggagactcctcccagcg

SEQ ID NO: 2084 - DNA, 25 bp, Homo sapien
tccagtcccacgtggacagcgactc

SEQ ID NO: 2085 - DNA, 25 bp, Homo sapien
catcatcacgatggagtcagcttca

SEQ ID NO: 2086 - DNA, 25 bp, Homo sapien
cgcttcgccaagaccggcgcgttga

SEQ ID NO: 2087 - DNA, 25 bp, Homo sapien
gcgcgctcttccgtcgcagagcaga

SEQ ID NO: 2088 - DNA, 25 bp, Homo sapien
cttccgtcgcagagcagacgggcgt

SEQ ID NO: 2089 - DNA, 25 bp, Homo sapien
tcctggtgcgccgtctaagctgcct

SEQ ID NO: 2090 - DNA, 25 bp, Homo sapien
cgccgtctaagctgcctgtggtgcg

SEQ ID NO: 2091 - DNA, 25 bp, Homo sapien
tggtgcgccgagagcttgctctacc

SEQ ID NO: 2092 - DNA, 25 bp, Homo sapien
ttgctctaccactgcctgtcggacg

SEQ ID NO: 2093 - DNA, 25 bp, Homo sapien
gctgcgtgcattgccgcgcgctctt

SEQ ID NO: 2094 - DNA, 25 bp, Homo sapien
ccctcaatttaggatgaggacgagg

SEQ ID NO: 2095 - DNA, 25 bp, Homo sapien
cacgcgactcccgtgagcacgagga

SEQ ID NO: 2096 - DNA, 25 bp, Homo sapien
ctcccgtgagcacgaggactcgggt

SEQ ID NO: 2097 - DNA, 25 bp, Homo sapien
cacgaggctgtctgtggatttccac

SEQ ID NO: 2098 - DNA, 25 bp, Homo sapien
tggatttccacagcatcccaggagg

SEQ ID NO: 2099 - DNA, 25 bp, Homo sapien
tccacagcatcccaggaggcgtctg

SEQ ID NO: 2100 - DNA, 25 bp, Homo sapien
ccgccacgagaagctcgtccaggga

SEQ ID NO: 2101 - DNA, 25 bp, Homo sapien
caggctgccaaccacgggcagaggc

SEQ ID NO: 2102 - DNA, 25 bp, Homo sapien
cggagatcccgaacgcactgcaatt

SEQ ID NO: 2103 - DNA, 25 bp, Homo sapien
gcactgcaatttacagctccagggg

SEQ ID NO: 2104 - DNA, 25 bp, Homo sapien
aagatgccgattggtcagtgccgcc

SEQ ID NO: 2105 - DNA, 25 bp, Homo sapien
cgcggacgaaaagggattcccagtg

SEQ ID NO: 2106 - DNA, 25 bp, Homo sapien
ggggcgcctcatgcccagacttcag

SEQ ID NO: 2107 - DNA, 25 bp, Homo sapien
cagcttgtcttgacagcggagatcc

SEQ ID NO: 2108 - DNA, 25 bp, Homo sapien
cgaagttgtttttatgtcgccgcaa

SEQ ID NO: 2109 - DNA, 25 bp, Homo sapien
cgcgccgagaccacactttcatgga

SEQ ID NO: 2110 - DNA, 25 bp, Homo sapien
ttgtccagcacctgtgcacgctgta

SEQ ID NO: 2111 - DNA, 25 bp, Homo sapien
acgcaatggggagcgatgcacaatc

SEQ ID NO: 2112 - DNA, 25 bp, Homo sapien
tgcacaatcccgaagcgaccgctgg

SEQ ID NO: 2113 - DNA, 25 bp, Homo sapien
ctctcattgacctggggatagaata

SEQ ID NO: 2114 - DNA, 25 bp, Homo sapien
cctgtgccacgtgaatgaacttgtc

SEQ ID NO: 2115 - DNA, 25 bp, Homo sapien
acacgctgttgctgagacctacgga

SEQ ID NO: 2116 - DNA, 25 bp, Homo sapien
gcaaaacgtagctccgcaggtcctg

SEQ ID NO: 2117 - DNA, 25 bp, Homo sapien
ttacggtccttggttggaatgccca

SEQ ID NO: 2118 - DNA, 25 bp, Homo sapien
gctccagtctgggaggtaccaccga

SEQ ID NO: 2119 - DNA, 25 bp, Homo sapien
gctcacggcgcggttgaacatcgcc

SEQ ID NO: 2120 - DNA, 25 bp, Homo sapien
gcctgggataaggtgcactggccca

SEQ ID NO: 2121 - DNA, 25 bp, Homo sapien
ctctcagcgagccttcgcaggtggc

SEQ ID NO: 2122 - DNA, 25 bp, Homo sapien
tcacaggctgggaagcctaggcctc

SEQ ID NO: 2123 - DNA, 25 bp, Homo sapien
ctaggcctcgcggttctgcagagtc

SEQ ID NO: 2124 - DNA, 25 bp, Homo sapien
tcactaaaaagaaaactgcggctgt

SEQ ID NO: 2125 - DNA, 25 bp, Homo sapien
tgcggctgttcctctttcagccaaa

SEQ ID NO: 2126 - DNA, 25 bp, Homo sapien
cccatctctgtccagcatgcgtgta

SEQ ID NO: 2127 - DNA, 25 bp, Homo sapien
acgcagaaggcgaagacgaggtcca

SEQ ID NO: 2128 - DNA, 25 bp, Homo sapien
ggcggggacttcctcccatctctgt

SEQ ID NO: 2129 - DNA, 25 bp, Homo sapien
cctcgacatcatgggtgacgcagaa

SEQ ID NO: 2130 - DNA, 25 bp, Homo sapien
ctgggcttccgacctcgacatcatg

SEQ ID NO: 2131 - DNA, 25 bp, Homo sapien
cgcgggtgcctctggtgtctccaga

SEQ ID NO: 2132 - DNA, 25 bp, Homo sapien
cgcagttccatctacctcgcgggtg

SEQ ID NO: 2133 - DNA, 25 bp, Homo sapien
catgcgtgtactcctcgcagttcca

SEQ ID NO: 2134 - DNA, 25 bp, Homo sapien
gacgttgcggcagttagcgctccca

SEQ ID NO: 2135 - DNA, 25 bp, Homo sapien
gagcaagctgcgaagcctgcgcaac

SEQ ID NO: 2136 - DNA, 25 bp, Homo sapien
tccctccgaggacttgcagcacgag

SEQ ID NO: 2137 - DNA, 25 bp, Homo sapien
tgcaggacctcatcatctacttcga

SEQ ID NO: 2138 - DNA, 25 bp, Homo sapien
atcgagggcgttatcctgagcctgc

SEQ ID NO: 2139 - DNA, 25 bp, Homo sapien
agcctggacagcttcagcgggaagc

SEQ ID NO: 2140 - DNA, 25 bp, Homo sapien
ttagcgctcccagccgtggctgaca

SEQ ID NO: 2141 - DNA, 25 bp, Homo sapien
cgaggtccctgtaggagcctggaca

SEQ ID NO: 2142 - DNA, 25 bp, Homo sapien
agcaaccgggacagcctctgccagg

SEQ ID NO: 2143 - DNA, 25 bp, Homo sapien
tggacctgagccacgtgcggctgac

SEQ ID NO: 2144 - DNA, 25 bp, Homo sapien
tgacgccggcgcagacgacactggt

SEQ ID NO: 2145 - DNA, 25 bp, Homo sapien
cactggtggaccgtctggcagaaaa

SEQ ID NO: 2146 - DNA, 25 bp, Homo sapien
ccgtctggcagaaaatgggcacaac

SEQ ID NO: 2147 - DNA, 25 bp, Homo sapien
gcgcagtgcaggacatcccagcgcg

SEQ ID NO: 2148 - DNA, 25 bp, Homo sapien
tgaagccaccaagcgcagcaaccgg

SEQ ID NO: 2149 - DNA, 25 bp, Homo sapien
gctggtgccctaccgcctgctggat

SEQ ID NO: 2150 - DNA, 25 bp, Homo sapien
gttgtcagccgccatgttccaaagc

SEQ ID NO: 2151 - DNA, 25 bp, Homo sapien
gctgaccatgatggcgctgcacatc

SEQ ID NO: 2152 - DNA, 25 bp, Homo sapien
gccaggagccgctgaccatgatggc

SEQ ID NO: 2153 - DNA, 25 bp, Homo sapien
gcatgcccaaccacttcctgcaggt

SEQ ID NO: 2154 - DNA, 25 bp, Homo sapien
cagtgtcctggagccgcatgcccaa

SEQ ID NO: 2155 - DNA, 25 bp, Homo sapien
tgcagatgctgatgccagtgtcctg

SEQ ID NO: 2156 - DNA, 25 bp, Homo sapien
gccatgttccaaagcgagcgcaaga

SEQ ID NO: 2157 - DNA, 25 bp, Homo sapien
gttccaaagcgagcgcaagaacccg

SEQ ID NO: 2158 - DNA, 25 bp, Homo sapien
ccctgcgggacaaggcactgaggat

SEQ ID NO: 2159 - DNA, 25 bp, Homo sapien
tgtgtgcgccctgggcaacaatcgc

SEQ ID NO: 2160 - DNA, 25 bp, Homo sapien
ggagttggagtcaccacttcgctga

SEQ ID NO: 2161 - DNA, 25 bp, Homo sapien
gccgctccatgctctctgaatacat

SEQ ID NO: 2162 - DNA, 25 bp, Homo sapien
tcagcatccacctcgaaagtgcctg

SEQ ID NO: 2163 - DNA, 25 bp, Homo sapien
gcaggctactatgacctcctcatca

SEQ ID NO: 2164 - DNA, 25 bp, Homo sapien
gcccactgcgcgcaggctactatga

SEQ ID NO: 2165 - DNA, 25 bp, Homo sapien
tgtgcagccacgtagaccaagctca

SEQ ID NO: 2166 - DNA, 25 bp, Homo sapien
cgaagaggccatccgcatctccgag

SEQ ID NO: 2167 - DNA, 25 bp, Homo sapien
tccggaagcctgagtgcttcggacc

SEQ ID NO: 2168 - DNA, 25 bp, Homo sapien
tgagtgcttcggacccgccctgcgg

SEQ ID NO: 2169 - DNA, 25 bp, Homo sapien
tgccatcgaagaggccatccgcatc

SEQ ID NO: 2170 - DNA, 25 bp, Homo sapien
cgcatctccgaggaccctgcgaggg

SEQ ID NO: 2171 - DNA, 25 bp, Homo sapien
ggatggcccaggcatccgcagggac

SEQ ID NO: 2172 - DNA, 25 bp, Homo sapien
ctgctggctgccatcgaagaggcca

SEQ ID NO: 2173 - DNA, 25 bp, Homo sapien
agagcgtggaggagaacgccaatgt

SEQ ID NO: 2174 - DNA, 25 bp, Homo sapien
gctggcgctgaaccgctacctgtgc

SEQ ID NO: 2175 - DNA, 25 bp, Homo sapien
ggtcgttcgctcaccaaggcgcagc

SEQ ID NO: 2176 - DNA, 25 bp, Homo sapien
cgtgacgtcatcgaggactgcctca

SEQ ID NO: 2177 - DNA, 25 bp, Homo sapien
catggtggactctatgctgcatacc

SEQ ID NO: 2178 - DNA, 25 bp, Homo sapien
gggcacagaacaccgcgccatcatg

SEQ ID NO: 2179 - DNA, 25 bp, Homo sapien
gtgctgccgctcatcaccaagtgtg

SEQ ID NO: 2180 - DNA, 25 bp, Homo sapien
gctgcataccgtgtaccgcctgtct

SEQ ID NO: 2181 - DNA, 25 bp, Homo sapien
gcgccgctctttgcgggcacagaac

SEQ ID NO: 2182 - DNA, 25 bp, Homo sapien
tcatcccaactatcgggcggctgcg

SEQ ID NO: 2183 - DNA, 25 bp, Homo sapien
cgggacgagttctctgtgctctgcc

SEQ ID NO: 2184 - DNA, 25 bp, Homo sapien
ctgccgggacctctacgccctgtat

SEQ ID NO: 2185 - DNA, 25 bp, Homo sapien
gtatccgctgctcatccgctacgtg

SEQ ID NO: 2186 - DNA, 25 bp, Homo sapien
ctgctcatccgctacgtggacaaca

SEQ ID NO: 2187 - DNA, 25 bp, Homo sapien
tccgctacgtggacaacaacaggtc

SEQ ID NO: 2188 - DNA, 25 bp, Homo sapien
tggacaacaacaggtcagcggggcc

SEQ ID NO: 2189 - DNA, 25 bp, Homo sapien
cttcatcccaactatcgggcggctg

SEQ ID NO: 2190 - DNA, 25 bp, Homo sapien
ggcagggactttctccgtgaccctc

SEQ ID NO: 2191 - DNA, 25 bp, Homo sapien
atcactttcaaaacgcagcggggcc

SEQ ID NO: 2192 - DNA, 25 bp, Homo sapien
cgggcacgagtcacaaagcaggtca

SEQ ID NO: 2193 - DNA, 25 bp, Homo sapien
agtgagtcagttccagaaacgttta

SEQ ID NO: 2194 - DNA, 25 bp, Homo sapien
gccaaggccgcctctttcggtttca

SEQ ID NO: 2195 - DNA, 25 bp, Homo sapien
gcaggtcactgagacagcggcacca

SEQ ID NO: 2196 - DNA, 25 bp, Homo sapien
ccaggaaacgcgagtgagccgcctt

SEQ ID NO: 2197 - DNA, 25 bp, Homo sapien
cagaaacgtttactgcccgccaggc

SEQ ID NO: 2198 - DNA, 25 bp, Homo sapien
ctccgaagcggatgagaacgaaatg

SEQ ID NO: 2199 - DNA, 25 bp, Homo sapien
agagttcgccaaccgcttccaggag

SEQ ID NO: 2200 - DNA, 25 bp, Homo sapien
gctgaccaacctgtcggagcatgtg

SEQ ID NO: 2201 - DNA, 25 bp, Homo sapien
tcgcctgcacaacttcctggagctg

SEQ ID NO: 2202 - DNA, 25 bp, Homo sapien
ggccgagagcatccttgagtacttc

SEQ ID NO: 2203 - DNA, 25 bp, Homo sapien
ccgcatcgagatcatgggcgcgtca

SEQ ID NO: 2204 - DNA, 25 bp, Homo sapien
cgcatcgagcgcatctacttcgaga

SEQ ID NO: 2205 - DNA, 25 bp, Homo sapien
gtgcgtgcctcgcatatctgccctg

SEQ ID NO: 2206 - DNA, 25 bp, Homo sapien
cctcgtctcgggtactcacagagtc

SEQ ID NO: 2207 - DNA, 25 bp, Homo sapien
gctgcccgtcgtcttccatcatggt

SEQ ID NO: 2208 - DNA, 25 bp, Homo sapien
aggctcttctgttggcccagtctga

SEQ ID NO: 2209 - DNA, 25 bp, Homo sapien
gtccagcccgagagcggtttcttca

SEQ ID NO: 2210 - DNA, 25 bp, Homo sapien
ttcaactgtggctcaggcagcactc

SEQ ID NO: 2211 - DNA, 25 bp, Homo sapien
gtccggccctcctgtgttcatcaga

SEQ ID NO: 2212 - DNA, 25 bp, Homo sapien
tcctcggactgctccaggcattgta

SEQ ID NO: 2213 - DNA, 25 bp, Homo sapien
agaggacttctggaacctgtggtta

SEQ ID NO: 2214 - DNA, 25 bp, Homo sapien
cgagatgcagatcgccgcgcagatc

SEQ ID NO: 2215 - DNA, 25 bp, Homo sapien
ccaagaaggtgacggtgaccgagct

SEQ ID NO: 2216 - DNA, 25 bp, Homo sapien
gaaggagtccaagcgccagttcatc

SEQ ID NO: 2217 - DNA, 25 bp, Homo sapien
gaggacaccatcttcgagatgcaga

SEQ ID NO: 2218 - DNA, 25 bp, Homo sapien
cttcgtgagtttctgcgaggacacc

SEQ ID NO: 2219 - DNA, 25 bp, Homo sapien
cgccagttcatcttcgacgtggtga

SEQ ID NO: 2220 - DNA, 25 bp, Homo sapien
ttgtagctgccactgcgctgtcgct

SEQ ID NO: 2221 - DNA, 25 bp, Homo sapien
tgaccgagctcctggcaggcatgcc

SEQ ID NO: 2222 - DNA, 25 bp, Homo sapien
tgccgtctagaaatgtcaggggata

SEQ ID NO: 2223 - DNA, 25 bp, Homo sapien
tctagaaatgtcaggggataaggcc

SEQ ID NO: 2224 - DNA, 25 bp, Homo sapien
agagcgcgccaaagcgcaccgtgtg

SEQ ID NO: 2225 - DNA, 25 bp, Homo sapien
gcaccgtgtggaagagcaccgactt

SEQ ID NO: 2226 - DNA, 25 bp, Homo sapien
tcacgccgatgcacacagcgggcag

SEQ ID NO: 2227 - DNA, 25 bp, Homo sapien
agcctggcccggtcagcagcgcgaa

SEQ ID NO: 2228 - DNA, 25 bp, Homo sapien
gtcggcagtgggaacagcacctgct

SEQ ID NO: 2229 - DNA, 25 bp, Homo sapien
agctggcctgggacttccgaaccag

SEQ ID NO: 2230 - DNA, 25 bp, Homo sapien
taaggctgctgcgtgcattcccgca

SEQ ID NO: 2231 - DNA, 25 bp, Homo sapien
ctaccggcactggaactgggtctgt

SEQ ID NO: 2232 - DNA, 25 bp, Homo sapien
actgggatccagtaagatttttctc

SEQ ID NO: 2233 - DNA, 25 bp, Homo sapien
tcacgctgtctgtccagcttgagtg

SEQ ID NO: 2234 - DNA, 25 bp, Homo sapien
cacgcgccaattgcgcctgcgagga

SEQ ID NO: 2235 - DNA, 25 bp, Homo sapien
cctgcgaggaagaagtcacgtggca

SEQ ID NO: 2236 - DNA, 25 bp, Homo sapien
gctgctagagcctttccctttaccg

SEQ ID NO: 2237 - DNA, 25 bp, Homo sapien
cccaaggagctggagcgacaacaac

SEQ ID NO: 2238 - DNA, 25 bp, Homo sapien
acgcggcgaaccagtcgtaccagta

SEQ ID NO: 2239 - DNA, 25 bp, Homo sapien
gcgactacatggcccaggaggacga

SEQ ID NO: 2240 - DNA, 25 bp, Homo sapien
gcatgggcgactacatggcccagga

SEQ ID NO: 2241 - DNA, 25 bp, Homo sapien
ggcgaaccagtcgtaccagtacggc

SEQ ID NO: 2242 - DNA, 25 bp, Homo sapien
atggtggactaccacgcggcgaacc

SEQ ID NO: 2243 - DNA, 25 bp, Homo sapien
acgacgcgcgcgttcacgccggaga

SEQ ID NO: 2244 - DNA, 25 bp, Homo sapien
catacgcgaacgacgcgcgcgttca

SEQ ID NO: 2245 - DNA, 25 bp, Homo sapien
gcagcatgggcgactacatggccca

SEQ ID NO: 2246 - DNA, 25 bp, Homo sapien
attgcccgcaccatcaacgaggtgg

SEQ ID NO: 2247 - DNA, 25 bp, Homo sapien
gtctttccgcagcacatccgcgtgg

SEQ ID NO: 2248 - DNA, 25 bp, Homo sapien
catcacagttgctgagcgtcggccg

SEQ ID NO: 2249 - DNA, 25 bp, Homo sapien
ccacttcgacaaggtgagcagcctg

SEQ ID NO: 2250 - DNA, 25 bp, Homo sapien
tgcatctgttcgtccattcccatca

SEQ ID NO: 2251 - DNA, 25 bp, Homo sapien
tcgtccattcccatcacagttgctg

SEQ ID NO: 2252 - DNA, 25 bp, Homo sapien
gtgtgaaccacggtgaggacagttc

SEQ ID NO: 2253 - DNA, 25 bp, Homo sapien
tgaggacagttcacagcacccggcc

SEQ ID NO: 2254 - DNA, 25 bp, Homo sapien
agaagacacgcagagtgaagtcagc

SEQ ID NO: 2255 - DNA, 25 bp, Homo sapien
ccaggtagtggcctggacgcaggca

SEQ ID NO: 2256 - DNA, 25 bp, Homo sapien
gcggtgctcggcaccaccaggtagt

SEQ ID NO: 2257 - DNA, 25 bp, Homo sapien
tgaagtcagcctcgtcgccggcgtg

SEQ ID NO: 2258 - DNA, 25 bp, Homo sapien
cagagtgaagtcagcctcgtcgccg

SEQ ID NO: 2259 - DNA, 25 bp, Homo sapien
agacacgcagagtgaagtcagcctc

SEQ ID NO: 2260 - DNA, 25 bp, Homo sapien
ctcacacggccgtgtggcggcgctc

SEQ ID NO: 2261 - DNA, 25 bp, Homo sapien
cacgcagagtgaagtcagcctcgtc

SEQ ID NO: 2262 - DNA, 25 bp, Homo sapien
gtggccctggggaaatcactcatcc

SEQ ID NO: 2263 - DNA, 25 bp, Homo sapien
ctcacgccttcgcagacagaaagtg

SEQ ID NO: 2264 - DNA, 25 bp, Homo sapien
ccagctggcttgctttgcacaaatg

SEQ ID NO: 2265 - DNA, 25 bp, Homo sapien
acacgctttccacccgtaggattgg

SEQ ID NO: 2266 - DNA, 25 bp, Homo sapien
cagggacccgggatcttataacacg

SEQ ID NO: 2267 - DNA, 25 bp, Homo sapien
ctgctcagaagatcctcacggagtc

SEQ ID NO: 2268 - DNA, 25 bp, Homo sapien
cgcgctgcgggctaacgctttattt

SEQ ID NO: 2269 - DNA, 25 bp, Homo sapien
tggggcccacaaatgaccagaaagg

SEQ ID NO: 2270 - DNA, 25 bp, Homo sapien
gcctgcctgtgcttaggacactttc

SEQ ID NO: 2271 - DNA, 25 bp, Homo sapien
actccgtgaggatcttctgagcaga

SEQ ID NO: 2272 - DNA, 25 bp, Homo sapien
cgtgttataagatcccgggtccctg

SEQ ID NO: 2273 - DNA, 25 bp, Homo sapien
cgcgactgtgtctgtgtcccattca

SEQ ID NO: 2274 - DNA, 25 bp, Homo sapien
cgtgccctgacgcagcatttgtgca

SEQ ID NO: 2275 - DNA, 25 bp, Homo sapien
gggcgaatgagtcccacctttctgg

SEQ ID NO: 2276 - DNA, 25 bp, Homo sapien
tcctacgggtggaaagcgtgttata

SEQ ID NO: 2277 - DNA, 25 bp, Homo sapien
gccttggctggcaaataaagcgtta

SEQ ID NO: 2278 - DNA, 25 bp, Homo sapien
tataacagcacgacagcgcgacgca

SEQ ID NO: 2279 - DNA, 25 bp, Homo sapien
gagggcaccgatgccgcaacctgac

SEQ ID NO: 2280 - DNA, 25 bp, Homo sapien
actgcgttcggacggagtaacgtgc

SEQ ID NO: 2281 - DNA, 25 bp, Homo sapien
gccgccttcgtctactgcgttcgga

SEQ ID NO: 2282 - DNA, 25 bp, Homo sapien
cgccatctttactaagggcagtcga

SEQ ID NO: 2283 - DNA, 25 bp, Homo sapien
cggagtctgcgagaagccactatcc

SEQ ID NO: 2284 - DNA, 25 bp, Homo sapien
tgacaggcaatgacgccgttctttc

SEQ ID NO: 2285 - DNA, 25 bp, Homo sapien
cccataaggcaagaggtgactcacg

SEQ ID NO: 2286 - DNA, 25 bp, Homo sapien
gggtttgaatgcgacccgcactccc

SEQ ID NO: 2287 - DNA, 25 bp, Homo sapien
ccggggtcacctaatatcagcaagc

SEQ ID NO: 2288 - DNA, 25 bp, Homo sapien
tgcagaaaccgaaaaaccatctgcc

SEQ ID NO: 2289 - DNA, 25 bp, Homo sapien
gaaggccaggataccgaggaaaagc

SEQ ID NO: 2290 - DNA, 25 bp, Homo sapien
caagctgcgcggtacagggagtcac

SEQ ID NO: 2291 - DNA, 25 bp, Homo sapien
cacttccgggtttcgggcgccatct

SEQ ID NO: 2292 - DNA, 25 bp, Homo sapien
ctgtccctggaagccgggtttgaat

SEQ ID NO: 2293 - DNA, 25 bp, Homo sapien
ggggacctccatgcagaaaccgaaa

SEQ ID NO: 2294 - DNA, 25 bp, Homo sapien
ctgcagcggcccgtacgtgattcgg

SEQ ID NO: 2295 - DNA, 25 bp, Homo sapien
ccgtacgtgattcgggactgaacac

SEQ ID NO: 2296 - DNA, 25 bp, Homo sapien
tttcgattggcgttagtggccgtcc

SEQ ID NO: 2297 - DNA, 25 bp, Homo sapien
ccaccgattgcgcatttcgattggc

SEQ ID NO: 2298 - DNA, 25 bp, Homo sapien
gactcggggagctcgaaggaactct

SEQ ID NO: 2299 - DNA, 25 bp, Homo sapien
tggggcgcgccgctacaccgcaaag

SEQ ID NO: 2300 - DNA, 25 bp, Homo sapien
gattcgggactgaacacgtaaggga

SEQ ID NO: 2301 - DNA, 25 bp, Homo sapien
ggcgagtgggactttccgcctcttc

SEQ ID NO: 2302 - DNA, 25 bp, Homo sapien
caagtcatcttgtccgtgcgatcta

SEQ ID NO: 2303 - DNA, 25 bp, Homo sapien
aggcgctctttggtgcagtatacga

SEQ ID NO: 2304 - DNA, 25 bp, Homo sapien
cgccggaaggctagaccaagattga

SEQ ID NO: 2305 - DNA, 25 bp, Homo sapien
gggtatctctgtcgccatcactata

SEQ ID NO: 2306 - DNA, 25 bp, Homo sapien
tcgggccagtggttttcacctgaca

SEQ ID NO: 2307 - DNA, 25 bp, Homo sapien
ggactgttgatacgctctgattgga

SEQ ID NO: 2308 - DNA, 25 bp, Homo sapien
tcggaccctgtccagttctaaattc

SEQ ID NO: 2309 - DNA, 25 bp, Homo sapien
accgtgttcatttctacctctagga

SEQ ID NO: 2310 - DNA, 25 bp, Homo sapien
gtgagcacaggaccgccaagttgtc

SEQ ID NO: 2311 - DNA, 25 bp, Homo sapien
cccgcagctcatctggatctaagag

SEQ ID NO: 2312 - DNA, 25 bp, Homo sapien
aagaaactctacgtccagctgcgtg

SEQ ID NO: 2313 - DNA, 25 bp, Homo sapien
caatgtccgggctccagatgagttc

SEQ ID NO: 2314 - DNA, 25 bp, Homo sapien
ggcgcgtagacaccttccatccgat

SEQ ID NO: 2315 - DNA, 25 bp, Homo sapien
ctaccagaatcttcaggaccgcata

SEQ ID NO: 2316 - DNA, 25 bp, Homo sapien
gcatagattcctcccaccagtgcta

SEQ ID NO: 2317 - DNA, 25 bp, Homo sapien
agccaggcccgcatagacatctctg

SEQ ID NO: 2318 - DNA, 25 bp, Homo sapien
gccgcagacgcgctttcgtacaaca

SEQ ID NO: 2319 - DNA, 25 bp, Homo sapien
aagcccttgaggctgtcaccgaccg

SEQ ID NO: 2320 - DNA, 25 bp, Homo sapien
gactgctctgtcctgtcaccgactg

SEQ ID NO: 2321 - DNA, 25 bp, Homo sapien
gtggccgtgatagggcacagaacta

SEQ ID NO: 2322 - DNA, 25 bp, Homo sapien
actctcagcagacattgcggccgca

SEQ ID NO: 2323 - DNA, 25 bp, Homo sapien
gtagtcctcccgaatactctgattg

SEQ ID NO: 2324 - DNA, 25 bp, Homo sapien
acacgtgagtgaaccttaggctgcc

SEQ ID NO: 2325 - DNA, 25 bp, Homo sapien
ggaagctccagaactcccggcaaag

SEQ ID NO: 2326 - DNA, 25 bp, Homo sapien
agggtcgtcaccagggaaggactca

SEQ ID NO: 2327 - DNA, 25 bp, Homo sapien
catggacctgcagaatgacctaggc

SEQ ID NO: 2328 - DNA, 25 bp, Homo sapien
ccagggttcccagtgtgactcccta

SEQ ID NO: 2329 - DNA, 25 bp, Homo sapien
actacgagggtgagggtcgtcacca

SEQ ID NO: 2330 - DNA, 25 bp, Homo sapien
tgcagctggaggctgaaaactacga

SEQ ID NO: 2331 - DNA, 25 bp, Homo sapien
ccgattccgacttggagaaggaaga

SEQ ID NO: 2332 - DNA, 25 bp, Homo sapien
agacatccacggtggagaagctgta

SEQ ID NO: 2333 - DNA, 25 bp, Homo sapien
aggactcagctcctgggctaggcga

SEQ ID NO: 2334 - DNA, 25 bp, Homo sapien
tccgagatgctggagctgaccttga

SEQ ID NO: 2335 - DNA, 25 bp, Homo sapien
ctgaccttgacaaaccggtgagccc

SEQ ID NO: 2336 - DNA, 25 bp, Homo sapien
cccaacctcggggaagatgccgtcg

SEQ ID NO: 2337 - DNA, 25 bp, Homo sapien
gggccctctgacctttctgttgcac

SEQ ID NO: 2338 - DNA, 25 bp, Homo sapien
cccttcatttggcagtggaggccca

SEQ ID NO: 2339 - DNA, 25 bp, Homo sapien
gcagccgatgtgctggagcttctcc

SEQ ID NO: 2340 - DNA, 25 bp, Homo sapien
gctgcccgcatgtacggtggccgca

SEQ ID NO: 2341 - DNA, 25 bp, Homo sapien
cgtggccgttatccacaaagatgtg

SEQ ID NO: 2342 - DNA, 25 bp, Homo sapien
gcgcgcatactcgtacaggaggttc

SEQ ID NO: 2343 - DNA, 25 bp, Homo sapien
gtgtcccgcctcttcagtgacgcga

SEQ ID NO: 2344 - DNA, 25 bp, Homo sapien
tagagtccttcgtcgcccaatcgtc

SEQ ID NO: 2345 - DNA, 25 bp, Homo sapien
tgaccgtgacgagccaatcagatcc

SEQ ID NO: 2346 - DNA, 25 bp, Homo sapien
gcccactccgcgtttagaccaattg

SEQ ID NO: 2347 - DNA, 25 bp, Homo sapien
ttccggtttcgtttctctgtagtga

SEQ ID NO: 2348 - DNA, 25 bp, Homo sapien
gcagaaccgctctatgtccagctga

SEQ ID NO: 2349 - DNA, 25 bp, Homo sapien
gcgccatggacgcagccatcttgga

SEQ ID NO: 2350 - DNA, 25 bp, Homo sapien
agcggtctcgcccattggctacatc

SEQ ID NO: 2351 - DNA, 25 bp, Homo sapien
attggctacatctctcagactctgt

SEQ ID NO: 2352 - DNA, 25 bp, Homo sapien
agttgaagatgagattgcggccgaa

SEQ ID NO: 2353 - DNA, 25 bp, Homo sapien
acactgggcggcatcgcgtgaccaa

SEQ ID NO: 2354 - DNA, 25 bp, Homo sapien
cgggaactcctccttgtcttcgttg

SEQ ID NO: 2355 - DNA, 25 bp, Homo sapien
tccttgtcttcgttgctgggcaggc

SEQ ID NO: 2356 - DNA, 25 bp, Homo sapien
aggcagcgttgagccactgcgtaga

SEQ ID NO: 2357 - DNA, 25 bp, Homo sapien
agtgggcccgtccactatgtcgcgc

SEQ ID NO: 2358 - DNA, 25 bp, Homo sapien
cccacgtgttggtttgcagcgtttg

SEQ ID NO: 2359 - DNA, 25 bp, Homo sapien
ccactttgttctgggaggcagtcga

SEQ ID NO: 2360 - DNA, 25 bp, Homo sapien
cagcggcgggctaagcttccctttc

SEQ ID NO: 2361 - DNA, 25 bp, Homo sapien
tgggtttaaaggagcctcaggccga

SEQ ID NO: 2362 - DNA, 25 bp, Homo sapien
acgttcaaagcaaagcccttccaga

SEQ ID NO: 2363 - DNA, 25 bp, Homo sapien
gcccttccagatttagggctttcta

SEQ ID NO: 2364 - DNA, 25 bp, Homo sapien
gggctttctaacgtgcatttgtata

SEQ ID NO: 2365 - DNA, 25 bp, Homo sapien
tgggcgttcgaacacccacgttcaa

SEQ ID NO: 2366 - DNA, 25 bp, Homo sapien
gttgcgaataaggttgcgtccgatg

SEQ ID NO: 2367 - DNA, 25 bp, Homo sapien
gatgccctagctgtgccgcaagctc

SEQ ID NO: 2368 - DNA, 25 bp, Homo sapien
tcctcgccgggatgccctagctgtg

SEQ ID NO: 2369 - DNA, 25 bp, Homo sapien
caaggcgtcagggaccagcagcctc

SEQ ID NO: 2370 - DNA, 25 bp, Homo sapien
aataaggttgcgtccgatgggtctg

SEQ ID NO: 2371 - DNA, 25 bp, Homo sapien
actgtggcccagcatcctggacttc

SEQ ID NO: 2372 - DNA, 25 bp, Homo sapien
ttcctcttccgagatcccaccttgg

SEQ ID NO: 2373 - DNA, 25 bp, Homo sapien
aggtccagcgcctcttcgggttccg

SEQ ID NO: 2374 - DNA, 25 bp, Homo sapien
ggcaagaggcctcggcacccgcgaa

SEQ ID NO: 2375 - DNA, 25 bp, Homo sapien
aactcataaataccggggcggcgct

SEQ ID NO: 2376 - DNA, 25 bp, Homo sapien
ccgcgaactcataaataccggggcg

SEQ ID NO: 2377 - DNA, 25 bp, Homo sapien
taggcggcaagaggcctcggcaccc

SEQ ID NO: 2378 - DNA, 25 bp, Homo sapien
gacgtatcataaccttcctgggtcc

SEQ ID NO: 2379 - DNA, 25 bp, Homo sapien
cgcgccggagacgtatcataacctt

SEQ ID NO: 2380 - DNA, 25 bp, Homo sapien
acccggctccatcctggcagctgga

SEQ ID NO: 2381 - DNA, 25 bp, Homo sapien
ggctctcacctggtggccggctcag

SEQ ID NO: 2382 - DNA, 25 bp, Homo sapien
tggcccttcttcgtggaccacaaca

SEQ ID NO: 2383 - DNA, 25 bp, Homo sapien
ccgcggccaacttctctggactgga

SEQ ID NO: 2384 - DNA, 25 bp, Homo sapien
ccagaagtttctagccggccagttg

SEQ ID NO: 2385 - DNA, 25 bp, Homo sapien
ggccagttgctacctccctttatct

SEQ ID NO: 2386 - DNA, 25 bp, Homo sapien
cagcgaggaggctatttccagacac

SEQ ID NO: 2387 - DNA, 25 bp, Homo sapien
ttaattcataaaggtgcccggcgcc

SEQ ID NO: 2388 - DNA, 25 bp, Homo sapien
agatcaagatcgacccgcagaccgg

SEQ ID NO: 2389 - DNA, 25 bp, Homo sapien
cgccgcgattatagccgatgactca

SEQ ID NO: 2390 - DNA, 25 bp, Homo sapien
gcgcacgcgcactcaacccggacgc

SEQ ID NO: 2391 - DNA, 25 bp, Homo sapien
tgtggcgaggacagttatcggatta

SEQ ID NO: 2392 - DNA, 25 bp, Homo sapien
cagttatcggattatttgcagcgga

SEQ ID NO: 2393 - DNA, 25 bp, Homo sapien
atttgcagcggatcctacacgtccc

SEQ ID NO: 2394 - DNA, 25 bp, Homo sapien
tttctatccgcgaccggatacctgg

SEQ ID NO: 2395 - DNA, 25 bp, Homo sapien
cgaccggatacctggcaggggtcta

SEQ ID NO: 2396 - DNA, 25 bp, Homo sapien
cggattatttgcagcggatcctaca

SEQ ID NO: 2397 - DNA, 25 bp, Homo sapien
tacctggcaggggtctaggaaagac

SEQ ID NO: 2398 - DNA, 25 bp, Homo sapien
tgtagtggaggtcggagatcaaacc

SEQ ID NO: 2399 - DNA, 25 bp, Homo sapien
gagttccaggtcgagcagttaggcc

SEQ ID NO: 2400 - DNA, 25 bp, Homo sapien
ctctgtaccaatcggaggctggagc

SEQ ID NO: 2401 - DNA, 25 bp, Homo sapien
ccggatgttcgttggggattcaaca

SEQ ID NO: 2402 - DNA, 25 bp, Homo sapien
ttcgttggggattcaacatggcggc

SEQ ID NO: 2403 - DNA, 25 bp, Homo sapien
cgaaggggagtgcaaagtttgaaat

SEQ ID NO: 2404 - DNA, 25 bp, Homo sapien
gtctccgattggacgctctgtacca

SEQ ID NO: 2405 - DNA, 25 bp, Homo sapien
aggtcggagatcaaaccagcgaagg

SEQ ID NO: 2406 - DNA, 25 bp, Homo sapien
cagagcctgatcgaggagtcggctc

SEQ ID NO: 2407 - DNA, 25 bp, Homo sapien
acgagcagaagttcacggggctgcc

SEQ ID NO: 2408 - DNA, 25 bp, Homo sapien
gaccagcacgagcagaagttcacgg

SEQ ID NO: 2409 - DNA, 25 bp, Homo sapien
cgggcttcgaccagcacgagcagaa

SEQ ID NO: 2410 - DNA, 25 bp, Homo sapien
gcacacgggcttcgaccagcacgag

SEQ ID NO: 2411 - DNA, 25 bp, Homo sapien
gggtggagatctccgcgccgtccaa

SEQ ID NO: 2412 - DNA, 25 bp, Homo sapien
gtccccggcaccatgtttgggaaga

SEQ ID NO: 2413 - DNA, 25 bp, Homo sapien
cgtccaacttcgagcaccgcgtgca

SEQ ID NO: 2414 - DNA, 25 bp, Homo sapien
aaatgggatgccagaggagccggcc

SEQ ID NO: 2415 - DNA, 25 bp, Homo sapien
cggtgacacgctccaactccctgcg

SEQ ID NO: 2416 - DNA, 25 bp, Homo sapien
ctgctgctggacgagtttgagaaca

SEQ ID NO: 2417 - DNA, 25 bp, Homo sapien
acatgtcggtgacacgctccaactc

SEQ ID NO: 2418 - DNA, 25 bp, Homo sapien
ttgagaacatgtcggtgacacgctc

SEQ ID NO: 2419 - DNA, 25 bp, Homo sapien
cgagtttgagaacatgtcggtgaca

SEQ ID NO: 2420 - DNA, 25 bp, Homo sapien
tgctggacgagtttgagaacatgtc

SEQ ID NO: 2421 - DNA, 25 bp, Homo sapien
agccgaggccggttcgccggtcaca

SEQ ID NO: 2422 - DNA, 25 bp, Homo sapien
cctcgccacggtcgccttcaccgcc

SEQ ID NO: 2423 - DNA, 25 bp, Homo sapien
ggacagtcgcgcagcctcgagggat

SEQ ID NO: 2424 - DNA, 25 bp, Homo sapien
tcgcgcagcctcgagggatggagga

SEQ ID NO: 2425 - DNA, 25 bp, Homo sapien
gctctaccgcaacctgctgcgctcg

SEQ ID NO: 2426 - DNA, 25 bp, Homo sapien
ctcggtggcgggatggaagccgatg

SEQ ID NO: 2427 - DNA, 25 bp, Homo sapien
aagctgctcctgttgcggcggccgc

SEQ ID NO: 2428 - DNA, 25 bp, Homo sapien
tgcgctcgcccaaccccgaaggtgc

SEQ ID NO: 2429 - DNA, 25 bp, Homo sapien
aggaggtgcgtgagggacacgcgct

SEQ ID NO: 2430 - DNA, 25 bp, Homo sapien
ccagacgtgtgttcttgtcccaaga

SEQ ID NO: 2431 - DNA, 25 bp, Homo sapien
tgaccgactcctccgtgtctgtgca

SEQ ID NO: 2432 - DNA, 25 bp, Homo sapien
cctgcacaaggccaagaaccgcatg

SEQ ID NO: 2433 - DNA, 25 bp, Homo sapien
gtgtgcgctttatccacttcctgca

SEQ ID NO: 2434 - DNA, 25 bp, Homo sapien
tccgccattatggtcccggtgtgcg

SEQ ID NO: 2435 - DNA, 25 bp, Homo sapien
aggtgctgtcaccacaggtgtccca

SEQ ID NO: 2436 - DNA, 25 bp, Homo sapien
tgcgtgcgtctatgagctgcatgtc

SEQ ID NO: 2437 - DNA, 25 bp, Homo sapien
aggtgtcccacgtattccgccatta

SEQ ID NO: 2438 - DNA, 25 bp, Homo sapien
tgccggcagagaacttgtgcgtctt

SEQ ID NO: 2439 - DNA, 25 bp, Homo sapien
gcgttggaccagtctcctaagatgc

SEQ ID NO: 2440 - DNA, 25 bp, Homo sapien
cacctgcagtagagcgcggagatag

SEQ ID NO: 2441 - DNA, 25 bp, Homo sapien
ccaccacaagtgaggaggcggtgtt

SEQ ID NO: 2442 - DNA, 25 bp, Homo sapien
cgcagcagttctcatagtaggggtc

SEQ ID NO: 2443 - DNA, 25 bp, Homo sapien
agtaggggtcgctcttgtcatagag

SEQ ID NO: 2444 - DNA, 25 bp, Homo sapien
ttgtcatagagcttggcgcaagtgc

SEQ ID NO: 2445 - DNA, 25 bp, Homo sapien
acaagctgcgagataaggactcatc

SEQ ID NO: 2446 - DNA, 25 bp, Homo sapien
ctccctgcgggctaaccctgtattg

SEQ ID NO: 2447 - DNA, 25 bp, Homo sapien
cccttctgtgattgaccctgagcct

SEQ ID NO: 2448 - DNA, 25 bp, Homo sapien
ggctcccttctgtgattgaccctga

SEQ ID NO: 2449 - DNA, 25 bp, Homo sapien
cagggttgaattgcactccgcgctc

SEQ ID NO: 2450 - DNA, 25 bp, Homo sapien
ctggccgtgccagctcaagctggag

SEQ ID NO: 2451 - DNA, 25 bp, Homo sapien
gtattgcctgttgcactcaccgctc

SEQ ID NO: 2452 - DNA, 25 bp, Homo sapien
cgggctaaccctgtattgcctgttg

SEQ ID NO: 2453 - DNA, 25 bp, Homo sapien
cgctgacataggagaggcgcctgct

SEQ ID NO: 2454 - DNA, 25 bp, Homo sapien
ggcgcctcttgtacgtcagagccca

SEQ ID NO: 2455 - DNA, 25 bp, Homo sapien
ggtcagtcacaaaaggagccctgca

SEQ ID NO: 2456 - DNA, 25 bp, Homo sapien
aaaaggagccctgcagggcggactc

SEQ ID NO: 2457 - DNA, 25 bp, Homo sapien
ggagagcgggatgcaattcaaccct

SEQ ID NO: 2458 - DNA, 25 bp, Homo sapien
gcagcaggcagtacagggttagcct

SEQ ID NO: 2459 - DNA, 25 bp, Homo sapien
agcaggcgcctcttgtacgtcagag

SEQ ID NO: 2460 - DNA, 25 bp, Homo sapien
gcagtacagggttagcctgcacgga

SEQ ID NO: 2461 - DNA, 25 bp, Homo sapien
aggctcagggtcagtcacaaaagga

SEQ ID NO: 2462 - DNA, 25 bp, Homo sapien
taactgtggctctggaatagtgccc

SEQ ID NO: 2463 - DNA, 25 bp, Homo sapien
caccttatagcggatcatgagcaga

SEQ ID NO: 2464 - DNA, 25 bp, Homo sapien
gagccgcccagagaacgtccaagga

SEQ ID NO: 2465 - DNA, 25 bp, Homo sapien
cccgtcgaacgaatagcgctgctgc

SEQ ID NO: 2466 - DNA, 25 bp, Homo sapien
atccactcggtgctggtgaaagcca

SEQ ID NO: 2467 - DNA, 25 bp, Homo sapien
gtccaatgtcttggcgctgcgcttt

SEQ ID NO: 2468 - DNA, 25 bp, Homo sapien
gcgcgtctccactctggtccaatgt

SEQ ID NO: 2469 - DNA, 25 bp, Homo sapien
ccggaagtttcctcggatggcagca

SEQ ID NO: 2470 - DNA, 25 bp, Homo sapien
tgggattctagacacagagcgcctc

SEQ ID NO: 2471 - DNA, 25 bp, Homo sapien
gcctcagcgggattctagatgcaga

SEQ ID NO: 2472 - DNA, 25 bp, Homo sapien
agcgcctcagcggatcctagatgca

SEQ ID NO: 2473 - DNA, 25 bp, Homo sapien
gcgcctcagcgggattctagatgca

SEQ ID NO: 2474 - DNA, 25 bp, Homo sapien
cagtgggttcctagatgcagagtcc

SEQ ID NO: 2475 - DNA, 25 bp, Homo sapien
cgcctcagcggatcctagatgcaga

SEQ ID NO: 2476 - DNA, 25 bp, Homo sapien
gcctcagcgggatcctacacacaga

SEQ ID NO: 2477 - DNA, 25 bp, Homo sapien
tcagtgggttcctagatgcagagtc

SEQ ID NO: 2478 - DNA, 25 bp, Homo sapien
gtgaccacgacaggaaggctggcgc

SEQ ID NO: 2479 - DNA, 25 bp, Homo sapien
ggtcagtccagaccgactcggccga

SEQ ID NO: 2480 - DNA, 25 bp, Homo sapien
gagctgccaccggtgaccacgacag

SEQ ID NO: 2481 - DNA, 25 bp, Homo sapien
ggaggcggtcagtccagaccgactc

SEQ ID NO: 2482 - DNA, 25 bp, Homo sapien
aagcgtgagcgcctccctgcacgga

SEQ ID NO: 2483 - DNA, 25 bp, Homo sapien
aggtctcggcctggcgaagcgtgag

SEQ ID NO: 2484 - DNA, 25 bp, Homo sapien
tggggttggattcaggtctcggcct

SEQ ID NO: 2485 - DNA, 25 bp, Homo sapien
gtctcgcctggtttcggtacgggca

SEQ ID NO: 2486 - DNA, 25 bp, Homo sapien
ccagcgtgagggtgtttaggttcac

SEQ ID NO: 2487 - DNA, 25 bp, Homo sapien
gcaccaggctggtcatgttggcgaa

SEQ ID NO: 2488 - DNA, 25 bp, Homo sapien
ccatcagaggcagaggtaccacgca

SEQ ID NO: 2489 - DNA, 25 bp, Homo sapien
cccagcagcattggaggcgatacaa

SEQ ID NO: 2490 - DNA, 25 bp, Homo sapien
tgatggtcacatccagcgtcccgtc

SEQ ID NO: 2491 - DNA, 25 bp, Homo sapien
tggcgcaggtctctaagtcgtcctc

SEQ ID NO: 2492 - DNA, 25 bp, Homo sapien
gtccagacggaccagcttgtgaagc

SEQ ID NO: 2493 - DNA, 25 bp, Homo sapien
cccggcggatctggttgtttccaag

SEQ ID NO: 2494 - DNA, 25 bp, Homo sapien
accgtagccacagcctatttacaca

SEQ ID NO: 2495 - DNA, 25 bp, Homo sapien
gcctatttacacacgtggcgtcaaa

SEQ ID NO: 2496 - DNA, 25 bp, Homo sapien
ggcgtcaaagccacggccgtcaatc

SEQ ID NO: 2497 - DNA, 25 bp, Homo sapien
acggccgtcaatcactgcgtgtcgc

SEQ ID NO: 2498 - DNA, 25 bp, Homo sapien
tccggcgccacagcagaaatggcca

SEQ ID NO: 2499 - DNA, 25 bp, Homo sapien
aatcactgcgtgtcgctcccagctg

SEQ ID NO: 2500 - DNA, 25 bp, Homo sapien
acggatgggccatagggctgctctc

SEQ ID NO: 2501 - DNA, 25 bp, Homo sapien
agctgcagacgctggacaaaagggc

SEQ ID NO: 2502 - DNA, 25 bp, Homo sapien
cccagcgaagttgggctctccaggt

SEQ ID NO: 2503 - DNA, 25 bp, Homo sapien
tgcgctcggccgtgttcatacttgt

SEQ ID NO: 2504 - DNA, 25 bp, Homo sapien
cgtctcccagttctgaggcccgggt

SEQ ID NO: 2505 - DNA, 25 bp, Homo sapien
ccgaggacgaagttgaccctgaccg

SEQ ID NO: 2506 - DNA, 25 bp, Homo sapien
tcatacttgtccgtgggcctgaggt

SEQ ID NO: 2507 - DNA, 25 bp, Homo sapien
cccggaggatgacctagcactgaaa

SEQ ID NO: 2508 - DNA, 25 bp, Homo sapien
gccgggactgacgtgtagaacaatc

SEQ ID NO: 2509 - DNA, 25 bp, Homo sapien
gtcccactggaactcgcgtctgagc

SEQ ID NO: 2510 - DNA, 25 bp, Homo sapien
cggggatggacatccaacccggaca

SEQ ID NO: 2511 - DNA, 25 bp, Homo sapien
gatggacatccaacccggacacaaa

SEQ ID NO: 2512 - DNA, 25 bp, Homo sapien
aacacccagagcagctagtcgcgca

SEQ ID NO: 2513 - DNA, 25 bp, Homo sapien
agagcagctagtcgcgcacgcacat

SEQ ID NO: 2514 - DNA, 25 bp, Homo sapien
tagtcgcgcacgcacatgggcttgg

SEQ ID NO: 2515 - DNA, 25 bp, Homo sapien
gggggacccacacctgggcacacaa

SEQ ID NO: 2516 - DNA, 25 bp, Homo sapien
agcgcccagacacacagccggaggg

SEQ ID NO: 2517 - DNA, 25 bp, Homo sapien
atgggcgcgcgacagcgcccagaca

SEQ ID NO: 2518 - DNA, 25 bp, Homo sapien
gaggaggcctggaacgcctgaatca

SEQ ID NO: 2519 - DNA, 25 bp, Homo sapien
agtgcagacgcccactgaggacagc

SEQ ID NO: 2520 - DNA, 25 bp, Homo sapien
ctcgccattcccatcggagagagca

SEQ ID NO: 2521 - DNA, 25 bp, Homo sapien
gagcgcccagaagcccgagtgcaga

SEQ ID NO: 2522 - DNA, 25 bp, Homo sapien
atgagaaagccgagcgcccagaagc

SEQ ID NO: 2523 - DNA, 25 bp, Homo sapien
agcaagcggcaaggctgagaacagc

SEQ ID NO: 2524 - DNA, 25 bp, Homo sapien
tgagaacagcgcgatgagaaagccg

SEQ ID NO: 2525 - DNA, 25 bp, Homo sapien
acgcctgaatcaggaactgtgactt

SEQ ID NO: 2526 - DNA, 25 bp, Homo sapien
cgtgtgcgccctgaaaggtccccgc

SEQ ID NO: 2527 - DNA, 25 bp, Homo sapien
gtcccagcagctttcctcgcagacc

SEQ ID NO: 2528 - DNA, 25 bp, Homo sapien
ttcatgggtcccagcagctttcctc

SEQ ID NO: 2529 - DNA, 25 bp, Homo sapien
ccctcccgtggagtcgcctcctcga

SEQ ID NO: 2530 - DNA, 25 bp, Homo sapien
ggagtcgcctcctcgagcccttcat

SEQ ID NO: 2531 - DNA, 25 bp, Homo sapien
ggaaagcctgccgatcccccgtgtg

SEQ ID NO: 2532 - DNA, 25 bp, Homo sapien
tcgagcccttcatgggtcccagcag

SEQ ID NO: 2533 - DNA, 25 bp, Homo sapien
agcccttcatgggtcccagcagctt

SEQ ID NO: 2534 - DNA, 25 bp, Homo sapien
gagagacgcagtcgtaacgcacttc

SEQ ID NO: 2535 - DNA, 25 bp, Homo sapien
ctacgcgaggaagatggctgcatcc

SEQ ID NO: 2536 - DNA, 25 bp, Homo sapien
ctgcaacagaaaagcgtggcgccta

SEQ ID NO: 2537 - DNA, 25 bp, Homo sapien
agagatatctcagtctggacgcaga

SEQ ID NO: 2538 - DNA, 25 bp, Homo sapien
cggctcggaaccacacacggattgg

SEQ ID NO: 2539 - DNA, 25 bp, Homo sapien
cgccaagacgctgaggacccaacgg

SEQ ID NO: 2540 - DNA, 25 bp, Homo sapien
cttcgtcaaaggtgagcgcttcatg

SEQ ID NO: 2541 - DNA, 25 bp, Homo sapien
tgcatcccagcagcaagcttcagcg

SEQ ID NO: 2542 - DNA, 25 bp, Homo sapien
cccaccgtcattccagaggggattc

SEQ ID NO: 2543 - DNA, 25 bp, Homo sapien
cgtcattccagaggggattcccggc

SEQ ID NO: 2544 - DNA, 25 bp, Homo sapien
gggtacacatgacggctagcccagg

SEQ ID NO: 2545 - DNA, 25 bp, Homo sapien
cacgcagtcgcaggccagggtacac

SEQ ID NO: 2546 - DNA, 25 bp, Homo sapien
cccgcttgtttttctggaaactctg

SEQ ID NO: 2547 - DNA, 25 bp, Homo sapien
ccctaggccggaagtgttggctgta

SEQ ID NO: 2548 - DNA, 25 bp, Homo sapien
gccggaagtgttggctgtattttta

SEQ ID NO: 2549 - DNA, 25 bp, Homo sapien
ggctgtatttttagcctctctggtt

SEQ ID NO: 2550 - DNA, 25 bp, Homo sapien
ctcagcaagcgccgcaccagggatt

SEQ ID NO: 2551 - DNA, 25 bp, Homo sapien
cgagcaggaggccacaaccgtgcca

SEQ ID NO: 2552 - DNA, 25 bp, Homo sapien
cccttgcgagtgagtcacgggcgag

SEQ ID NO: 2553 - DNA, 25 bp, Homo sapien
tcctcgtcacggcttccaggaagcc

SEQ ID NO: 2554 - DNA, 25 bp, Homo sapien
gtgtccgggctgaacctcctcgtca

SEQ ID NO: 2555 - DNA, 25 bp, Homo sapien
aggaggccacaaccgtgccagagcc

SEQ ID NO: 2556 - DNA, 25 bp, Homo sapien
gcccgcccagctcacgagaccggcc

SEQ ID NO: 2557 - DNA, 25 bp, Homo sapien
ccgctctcggacgaagcaggtcgac

SEQ ID NO: 2558 - DNA, 25 bp, Homo sapien
tcaggtgccttaaccgacccatttc

SEQ ID NO: 2559 - DNA, 25 bp, Homo sapien
cggctcttcgctcaaacatgggtgg

SEQ ID NO: 2560 - DNA, 25 bp, Homo sapien
atccggacttccaggtcaactttgc

SEQ ID NO: 2561 - DNA, 25 bp, Homo sapien
ctttgcccggtttctccagttgtga

SEQ ID NO: 2562 - DNA, 25 bp, Homo sapien
ctgaccgtagagacagagaacccta

SEQ ID NO: 2563 - DNA, 25 bp, Homo sapien
acttttctcagaccgaggctgcctg

SEQ ID NO: 2564 - DNA, 25 bp, Homo sapien
tccaactctgggttcctggcatccg

SEQ ID NO: 2565 - DNA, 25 bp, Homo sapien
aaccggcctggcaagctctagttcc

SEQ ID NO: 2566 - DNA, 25 bp, Homo sapien
cggcagccactgtctcttaggcatg

SEQ ID NO: 2567 - DNA, 25 bp, Homo sapien
tggtcgccggatacagagaactaga

SEQ ID NO: 2568 - DNA, 25 bp, Homo sapien
gggctaccttagacagactccatcg

SEQ ID NO: 2569 - DNA, 25 bp, Homo sapien
ggtgttcccaacttgcttcgacttg

SEQ ID NO: 2570 - DNA, 25 bp, Homo sapien
tctccgctaagccaagtggtgttcc

SEQ ID NO: 2571 - DNA, 25 bp, Homo sapien
aggcactgtccctgacgaaggcgaa

SEQ ID NO: 2572 - DNA, 25 bp, Homo sapien
ccgactctatcgacagcgggaaaga

SEQ ID NO: 2573 - DNA, 25 bp, Homo sapien
gcctgcccggtccagcagtggtaat

SEQ ID NO: 2574 - DNA, 25 bp, Homo sapien
tagggtctcaagaggctaggatctc

SEQ ID NO: 2575 - DNA, 25 bp, Homo sapien
ttgcagatttctggccacccgggac

SEQ ID NO: 2576 - DNA, 25 bp, Homo sapien
ttcgacaccttctggatgttgggga

SEQ ID NO: 2577 - DNA, 25 bp, Homo sapien
acatttgggagtcacaggttgcatc

SEQ ID NO: 2578 - DNA, 25 bp, Homo sapien
gggagccgcgtcttcagaccataca

SEQ ID NO: 2579 - DNA, 25 bp, Homo sapien
cagaccatacaaggccagcgtcgtc

SEQ ID NO: 2580 - DNA, 25 bp, Homo sapien
gcctggccgttcacctgaaagggtg

SEQ ID NO: 2581 - DNA, 25 bp, Homo sapien
cgggtcttggcatttccgaaccttg

SEQ ID NO: 2582 - DNA, 25 bp, Homo sapien
ccacggccctacctagaagacttag

SEQ ID NO: 2583 - DNA, 25 bp, Homo sapien
gcgccgccatctgagactccagagt

SEQ ID NO: 2584 - DNA, 25 bp, Homo sapien
ccacctggagggagtttcattcctg

SEQ ID NO: 2585 - DNA, 25 bp, Homo sapien
cgcttcaaggggacccaggactttg

SEQ ID NO: 2586 - DNA, 25 bp, Homo sapien
ttgagatccggacttctaagcgccc

SEQ ID NO: 2587 - DNA, 25 bp, Homo sapien
cccgcgttggaggaacttgagatcc

SEQ ID NO: 2588 - DNA, 25 bp, Homo sapien
cgtttcaagaactcaggatccagga

SEQ ID NO: 2589 - DNA, 25 bp, Homo sapien
ggaatttctgcaccgcatcctgaga

SEQ ID NO: 2590 - DNA, 25 bp, Homo sapien
ttacggcttctgttgcggctaacgg

SEQ ID NO: 2591 - DNA, 25 bp, Homo sapien
ctccgagcgtggactagacaacctc

SEQ ID NO: 2592 - DNA, 25 bp, Homo sapien
ggctcaccttgcgtccgaagacctg

SEQ ID NO: 2593 - DNA, 25 bp, Homo sapien
acagctgtcgctgtcttctgtaaga

SEQ ID NO: 2594 - DNA, 25 bp, Homo sapien
ttgatgagaccattgccgcgtttgc

SEQ ID NO: 2595 - DNA, 25 bp, Homo sapien
ggccgcccgttcaccttgatgagac

SEQ ID NO: 2596 - DNA, 25 bp, Homo sapien
tcccagcaccttgtactgtagcgtg

SEQ ID NO: 2597 - DNA, 25 bp, Homo sapien
gcttcgcgtcctctgtagtcgacta

SEQ ID NO: 2598 - DNA, 25 bp, Homo sapien
accgccacaggcactgcacccgttc

SEQ ID NO: 2599 - DNA, 25 bp, Homo sapien
ttcaaggtggacatctggtcggctg

SEQ ID NO: 2600 - DNA, 25 bp, Homo sapien
ctccggcttcaaggtggacatctgg

SEQ ID NO: 2601 - DNA, 25 bp, Homo sapien
cttctccggcttcaaggtggacatc

SEQ ID NO: 2602 - DNA, 25 bp, Homo sapien
attgccaacggcctggacaccttct

SEQ ID NO: 2603 - DNA, 25 bp, Homo sapien
ccgagattgccaacggcctggacac

SEQ ID NO: 2604 - DNA, 25 bp, Homo sapien
gcctctgcgtcttgggcagctgccg

SEQ ID NO: 2605 - DNA, 25 bp, Homo sapien
ttcgcggcggacgacacctgccgga

SEQ ID NO: 2606 - DNA, 25 bp, Homo sapien
ggactaacgaacaaacggctcacta

SEQ ID NO: 2607 - DNA, 25 bp, Homo sapien
acatgagtttcagcctggtcgccga

SEQ ID NO: 2608 - DNA, 25 bp, Homo sapien
cgtcgtgcgaacagcagctggtacc

SEQ ID NO: 2609 - DNA, 25 bp, Homo sapien
cgattgccaaaacgagcctgccgga

SEQ ID NO: 2610 - DNA, 25 bp, Homo sapien
ccagcagcagcggaagatgtcggac

SEQ ID NO: 2611 - DNA, 25 bp, Homo sapien
acagcgaggacagcaacttttccga

SEQ ID NO: 2612 - DNA, 25 bp, Homo sapien
ccgcgctagtgttccggactaacga

SEQ ID NO: 2613 - DNA, 25 bp, Homo sapien
aatctcgtgttaggcgaggtcaacg

SEQ ID NO: 2614 - DNA, 25 bp, Homo sapien
acctcagggtgctgaatgaaacgcc

SEQ ID NO: 2615 - DNA, 25 bp, Homo sapien
tggagttacggacatatcgccgccc

SEQ ID NO: 2616 - DNA, 25 bp, Homo sapien
tcccttccctggagttacggacata

SEQ ID NO: 2617 - DNA, 25 bp, Homo sapien
gccctctgaatgtggggtcccttcc

SEQ ID NO: 2618 - DNA, 25 bp, Homo sapien
cagcggtgttctcgcgcttgcgaag

SEQ ID NO: 2619 - DNA, 25 bp, Homo sapien
ggcaatccgcccgatgcctttggtc

SEQ ID NO: 2620 - DNA, 25 bp, Homo sapien
cccgcgtttccattggctgtagctc

SEQ ID NO: 2621 - DNA, 25 bp, Homo sapien
ccgatgcctttggtctctctcgggc

SEQ ID NO: 2622 - DNA, 25 bp, Homo sapien
gtgcccacgaccacagacggaatct

SEQ ID NO: 2623 - DNA, 25 bp, Homo sapien
acggaatctcgctgttgctcctgca

SEQ ID NO: 2624 - DNA, 25 bp, Homo sapien
ggcggggccattctctcagatataa

SEQ ID NO: 2625 - DNA, 25 bp, Homo sapien
gtgatcctagcgctcattttcctcc

SEQ ID NO: 2626 - DNA, 25 bp, Homo sapien
tggcgtcttcgagctgcagatccac

SEQ ID NO: 2627 - DNA, 25 bp, Homo sapien
gcagatccactctttcgggccgggt

SEQ ID NO: 2628 - DNA, 25 bp, Homo sapien
agtctgcctgaagcctgggctctca

SEQ ID NO: 2629 - DNA, 25 bp, Homo sapien
gacgcctggcctgtaagtgctgccc

SEQ ID NO: 2630 - DNA, 25 bp, Homo sapien
ggcgctccgtatgcatccatgttcg

SEQ ID NO: 2631 - DNA, 25 bp, Homo sapien
tcctttgcctgtcctcgcagggccc

SEQ ID NO: 2632 - DNA, 25 bp, Homo sapien
agctgcgcttctcgtaccgcgcgcg

SEQ ID NO: 2633 - DNA, 25 bp, Homo sapien
ctgcgcaccgctcgaggacgaatgt

SEQ ID NO: 2634 - DNA, 25 bp, Homo sapien
caccgctcgaggacgaatgtgaggc

SEQ ID NO: 2635 - DNA, 25 bp, Homo sapien
gcgccgcgtgagtcctgcgttcgac

SEQ ID NO: 2636 - DNA, 25 bp, Homo sapien
cgtatgcatccatgttcggccgggc

SEQ ID NO: 2637 - DNA, 25 bp, Homo sapien
atgcatccatgttcggccgggccca

SEQ ID NO: 2638 - DNA, 25 bp, Homo sapien
tgcagcgatgacagagctgggaaac

SEQ ID NO: 2639 - DNA, 25 bp, Homo sapien
tcccggatgcactcaacaacctaag

SEQ ID NO: 2640 - DNA, 25 bp, Homo sapien
tgcgctcttgctggtccacgtgcgc

SEQ ID NO: 2641 - DNA, 25 bp, Homo sapien
ctaccttttgcctccggctctggga

SEQ ID NO: 2642 - DNA, 25 bp, Homo sapien
cggggaccctcagcgctaccttttg

SEQ ID NO: 2643 - DNA, 25 bp, Homo sapien
cgcggtgtgagttcccagtgcaccc

SEQ ID NO: 2644 - DNA, 25 bp, Homo sapien
ggctgcgccacagacgaacgccttg

SEQ ID NO: 2645 - DNA, 25 bp, Homo sapien
ctcgctgcgagcacgacctggacga

SEQ ID NO: 2646 - DNA, 25 bp, Homo sapien
gaactcggtgtaacagagcccccag

SEQ ID NO: 2647 - DNA, 25 bp, Homo sapien
ccgcgtctcagaacccggtgcggga

SEQ ID NO: 2648 - DNA, 25 bp, Homo sapien
tctcagaacccggtgcgggagacgc

SEQ ID NO: 2649 - DNA, 25 bp, Homo sapien
tcagaacccggtgcgggagacgctc

SEQ ID NO: 2650 - DNA, 25 bp, Homo sapien
attactcggcgaggtcgggaggtcg

SEQ ID NO: 2651 - DNA, 25 bp, Homo sapien
gccaggtggaactcggtgtaacaga

SEQ ID NO: 2652 - DNA, 25 bp, Homo sapien
aggtggaactcggtgtaacagagcc

SEQ ID NO: 2653 - DNA, 25 bp, Homo sapien
ggtggaactcggtgtaacagagccc

SEQ ID NO: 2654 - DNA, 25 bp, Homo sapien
ccctgaggaaggtgcacatttagag

SEQ ID NO: 2655 - DNA, 25 bp, Homo sapien
cgccatcttggagacgggcaaaagg

SEQ ID NO: 2656 - DNA, 25 bp, Homo sapien
ggcgtgtagcgggaactcccatagt

SEQ ID NO: 2657 - DNA, 25 bp, Homo sapien
gggcaaagcgagtctgcacaacagc

SEQ ID NO: 2658 - DNA, 25 bp, Homo sapien
gtcatctctgggcaaaattagtggg

SEQ ID NO: 2659 - DNA, 25 bp, Homo sapien
cggcccgaaaccctgagtggtgact

SEQ ID NO: 2660 - DNA, 25 bp, Homo sapien
ttttccctcagctgcacaaggtctc

SEQ ID NO: 2661 - DNA, 25 bp, Homo sapien
gccttcacttcgcacaatggcggga

SEQ ID NO: 2662 - DNA, 25 bp, Homo sapien
ggccatctccttacagaattgtacg

SEQ ID NO: 2663 - DNA, 25 bp, Homo sapien
agctcatcccgtcggtctccagcga

SEQ ID NO: 2664 - DNA, 25 bp, Homo sapien
tctccttacagaattgtacggaaac

SEQ ID NO: 2665 - DNA, 25 bp, Homo sapien
gcccatcctggggaccatcccgtcg

SEQ ID NO: 2666 - DNA, 25 bp, Homo sapien
cgtcggccatctccttacagaattg

SEQ ID NO: 2667 - DNA, 25 bp, Homo sapien
agccggcgccgagcctgaagctcat

SEQ ID NO: 2668 - DNA, 25 bp, Homo sapien
accttcagggcagacccgtcggcca

SEQ ID NO: 2669 - DNA, 25 bp, Homo sapien
gggcccaccctggacttcaccttca

SEQ ID NO: 2670 - DNA, 25 bp, Homo sapien
gcggaacaacagctgccggttaatt

SEQ ID NO: 2671 - DNA, 25 bp, Homo sapien
gcccacctgtgggacactgctatct

SEQ ID NO: 2672 - DNA, 25 bp, Homo sapien
tctgaccggaatcatggagctacca

SEQ ID NO: 2673 - DNA, 25 bp, Homo sapien
cggagactggaataacggcactgca

SEQ ID NO: 2674 - DNA, 25 bp, Homo sapien
ctgcggcgttcctcgaaatcccgta

SEQ ID NO: 2675 - DNA, 25 bp, Homo sapien
catagtcccagcgtttctacggaga

SEQ ID NO: 2676 - DNA, 25 bp, Homo sapien
cacggtggccaatcctctagcgttc

SEQ ID NO: 2677 - DNA, 25 bp, Homo sapien
agcggtcctgagtagccattacgtc

SEQ ID NO: 2678 - DNA, 25 bp, Homo sapien
tgatgcctaaaacgctaagtgggtg

SEQ ID NO: 2679 - DNA, 25 bp, Homo sapien
aacgctgcttcccttgctctgcagg

SEQ ID NO: 2680 - DNA, 25 bp, Homo sapien
atcgcctgcggcgttcttcaagctc

SEQ ID NO: 2681 - DNA, 25 bp, Homo sapien
tggcggagaaactgctggtaattga

SEQ ID NO: 2682 - DNA, 25 bp, Homo sapien
gctgatattcggcatcaaacgctgc

SEQ ID NO: 2683 - DNA, 25 bp, Homo sapien
ctgccgggagcaatcgggtaatttt

SEQ ID NO: 2684 - DNA, 25 bp, Homo sapien
ttcaagctcttgtattctgccggga

SEQ ID NO: 2685 - DNA, 25 bp, Homo sapien
tctgcaggcttccacgaatcgcctg

SEQ ID NO: 2686 - DNA, 25 bp, Homo sapien
gaagcgccaacgcatctgaaacatc

SEQ ID NO: 2687 - DNA, 25 bp, Homo sapien
aagcgccaacgcatctgaaacatcc

SEQ ID NO: 2688 - DNA, 25 bp, Homo sapien
caacgcatctgaaacatcccaacga

SEQ ID NO: 2689 - DNA, 25 bp, Homo sapien
acgcatctgaaacatcccaacgacg

SEQ ID NO: 2690 - DNA, 25 bp, Homo sapien
gcatctgaaacatcccaacgacgaa

SEQ ID NO: 2691 - DNA, 25 bp, Homo sapien
tctgaaacatcccaacgacgaaggg

SEQ ID NO: 2692 - DNA, 25 bp, Homo sapien
tgaaacatcccaacgacgaagggcg

SEQ ID NO: 2693 - DNA, 25 bp, Homo sapien
cgccgttctccagatgccccctcga

SEQ ID NO: 2694 - DNA, 25 bp, Homo sapien
gggacgtctctgtcaccattcgccg

SEQ ID NO: 2695 - DNA, 25 bp, Homo sapien
ggcagcttggacatctcagaccgtg

SEQ ID NO: 2696 - DNA, 25 bp, Homo sapien
ggctgctcccagagaaactggaata

SEQ ID NO: 2697 - DNA, 25 bp, Homo sapien
cgctatgcgcgctgtaaatgcagtg

SEQ ID NO: 2698 - DNA, 25 bp, Homo sapien
taaatgcagtgtgcgtaaccgggcg

SEQ ID NO: 2699 - DNA, 25 bp, Homo sapien
cgggcgcgagagcatagattcttac

SEQ ID NO: 2700 - DNA, 25 bp, Homo sapien
gattcttaccgcaaaccctgggagc

SEQ ID NO: 2701 - DNA, 25 bp, Homo sapien
cagtgcgcatgcgtactttcccggc

SEQ ID NO: 2702 - DNA, 25 bp, Homo sapien
agccgtgagcatagcccgcgctagt

SEQ ID NO: 2703 - DNA, 25 bp, Homo sapien
gccagcagcaagatccgccggctgt

SEQ ID NO: 2704 - DNA, 25 bp, Homo sapien
acctctcagagtgggtgcattccga

SEQ ID NO: 2705 - DNA, 25 bp, Homo sapien
ggcgcagctgagcaccaaatccagg

SEQ ID NO: 2706 - DNA, 25 bp, Homo sapien
ctgtcggcctgcaagcagcagtgag

SEQ ID NO: 2707 - DNA, 25 bp, Homo sapien
gggacaacgcctggatgccacagcc

SEQ ID NO: 2708 - DNA, 25 bp, Homo sapien
cgctagtcagtcatggtgaccgtca

SEQ ID NO: 2709 - DNA, 25 bp, Homo sapien
cccaaggccgtgtgtatgaacggca

SEQ ID NO: 2710 - DNA, 25 bp, Homo sapien
tcccttggcctcgtgctaagtctca

SEQ ID NO: 2711 - DNA, 25 bp, Homo sapien
ggcacctgccatggcaacaactgta

SEQ ID NO: 2712 - DNA, 25 bp, Homo sapien
ctggtgccaagagctcagccaatca

SEQ ID NO: 2713 - DNA, 25 bp, Homo sapien
gcagctgttgctaggcgacgaagaa

SEQ ID NO: 2714 - DNA, 25 bp, Homo sapien
ttggccggttccaggaattcaacta

SEQ ID NO: 2715 - DNA, 25 bp, Homo sapien
tatgaatagccaggcagggcccgca

SEQ ID NO: 2716 - DNA, 25 bp, Homo sapien
atggccgcttacctgcacgcatgcg

SEQ ID NO: 2717 - DNA, 25 bp, Homo sapien
actgagcttggcaatcggcacctgc

SEQ ID NO: 2718 - DNA, 25 bp, Homo sapien
gcctggattctcgagcctgtcgaca

SEQ ID NO: 2719 - DNA, 25 bp, Homo sapien
ctgtgcagcggtcgccctaaactcg

SEQ ID NO: 2720 - DNA, 25 bp, Homo sapien
ccagcctttgcctgtgcagcggtcg

SEQ ID NO: 2721 - DNA, 25 bp, Homo sapien
gcacgcgcagtgagcctggattctc

SEQ ID NO: 2722 - DNA, 25 bp, Homo sapien
caactccacgagtccggggctttcg

SEQ ID NO: 2723 - DNA, 25 bp, Homo sapien
ggagtccgcggcgttcacaactcca

SEQ ID NO: 2724 - DNA, 25 bp, Homo sapien
ggcttcatggcgagccctggtttgt

SEQ ID NO: 2725 - DNA, 25 bp, Homo sapien
agcctgacctggcttcatggcgagc

SEQ ID NO: 2726 - DNA, 25 bp, Homo sapien
ccacggacactcacggcagaagctg

SEQ ID NO: 2727 - DNA, 25 bp, Homo sapien
cccttttgcgcgcacaggtcgtata

SEQ ID NO: 2728 - DNA, 25 bp, Homo sapien
ctcgttgctctcatagggtgcagtc

SEQ ID NO: 2729 - DNA, 25 bp, Homo sapien
attgggcaggacaaagtcgtcactc

SEQ ID NO: 2730 - DNA, 25 bp, Homo sapien
gtgggcatcgccatcaaagagaagc

SEQ ID NO: 2731 - DNA, 25 bp, Homo sapien
tgcagaaccatgtttcggccctcgg

SEQ ID NO: 2732 - DNA, 25 bp, Homo sapien
aagctgtctgtcctccagggcttca

SEQ ID NO: 2733 - DNA, 25 bp, Homo sapien
tccagttgccattgaagttcccaca

SEQ ID NO: 2734 - DNA, 25 bp, Homo sapien
agctggaaaggcagagccacgaaca

SEQ ID NO: 2735 - DNA, 25 bp, Homo sapien
cacgaacacgccgtcgacctgcggg

SEQ ID NO: 2736 - DNA, 25 bp, Homo sapien
ggcagagccacgaacacgccgtcga

SEQ ID NO: 2737 - DNA, 25 bp, Homo sapien
cgagtccagctggaaaggcagagcc

SEQ ID NO: 2738 - DNA, 25 bp, Homo sapien
tggaaaggcagagccacgaacacgc

SEQ ID NO: 2739 - DNA, 25 bp, Homo sapien
tccagctggaaaggcagagccacga

SEQ ID NO: 2740 - DNA, 25 bp, Homo sapien
agtccagctggaaaggcagagccac

SEQ ID NO: 2741 - DNA, 25 bp, Homo sapien
aaggcagagccacgaacacgccgtc

SEQ ID NO: 2742 - DNA, 25 bp, Homo sapien
tcgaaagccagcgagagccctgagg

SEQ ID NO: 2743 - DNA, 25 bp, Homo sapien
gtagttcccgcataagccacagaga

SEQ ID NO: 2744 - DNA, 25 bp, Homo sapien
gggtcctggttgtagttcccgcata

SEQ ID NO: 2745 - DNA, 25 bp, Homo sapien
cgggcatggcttggacacacattcc

SEQ ID NO: 2746 - DNA, 25 bp, Homo sapien
ggcgtccagcaagcagccctggaag

SEQ ID NO: 2747 - DNA, 25 bp, Homo sapien
cagcggcctgacaggctgccacgta

SEQ ID NO: 2748 - DNA, 25 bp, Homo sapien
agccctgaggttgtggtcaccacca

SEQ ID NO: 2749 - DNA, 25 bp, Homo sapien
ggcctccaggatggccctgaacttg

SEQ ID NO: 2750 - DNA, 25 bp, Homo sapien
ttctggaagtcatccttggggtcgc

SEQ ID NO: 2751 - DNA, 25 bp, Homo sapien
cgagccattgggcttctggaagtca

SEQ ID NO: 2752 - DNA, 25 bp, Homo sapien
gtacacaaggtcgtaggccacacgc

SEQ ID NO: 2753 - DNA, 25 bp, Homo sapien
ggtgacccgcacatagtacacaagg

SEQ ID NO: 2754 - DNA, 25 bp, Homo sapien
tagtttccagggacggtgacccgca

SEQ ID NO: 2755 - DNA, 25 bp, Homo sapien
acaggccacacatcagctggtagta

SEQ ID NO: 2756 - DNA, 25 bp, Homo sapien
gtcgccgttgtagttcccacacagg

SEQ ID NO: 2757 - DNA, 25 bp, Homo sapien
ttgccgaactcattggcgttgcctg

SEQ ID NO: 2758 - DNA, 25 bp, Homo sapien
cctcggccacggagttcagcttcaa

SEQ ID NO: 2759 - DNA, 25 bp, Homo sapien
cacgtctatccagaacctgcgggga

SEQ ID NO: 2760 - DNA, 25 bp, Homo sapien
cctccgagggtgtcacgtgctagac

SEQ ID NO: 2761 - DNA, 25 bp, Homo sapien
tcctcatcgggcactaacttacttt

SEQ ID NO: 2762 - DNA, 25 bp, Homo sapien
tacccgtaatttcggctcctgtgcg

SEQ ID NO: 2763 - DNA, 25 bp, Homo sapien
ggcggctgactagctacccgtaatt

SEQ ID NO: 2764 - DNA, 25 bp, Homo sapien
catgttgatatctggcgtcgccgtg

SEQ ID NO: 2765 - DNA, 25 bp, Homo sapien
tccctgctcttaccgggaggtaata

SEQ ID NO: 2766 - DNA, 25 bp, Homo sapien
gcacatacacgcaggtgcccatgaa

SEQ ID NO: 2767 - DNA, 25 bp, Homo sapien
ttctcctgcaggacggcaaaccgat

SEQ ID NO: 2768 - DNA, 25 bp, Homo sapien
tctcctgcaggacggcaaaccgatg

SEQ ID NO: 2769 - DNA, 25 bp, Homo sapien
aggtctgagccagcacatacacgca

SEQ ID NO: 2770 - DNA, 25 bp, Homo sapien
ctgagccagcacatacacgcaggtg

SEQ ID NO: 2771 - DNA, 25 bp, Homo sapien
gagccagcacatacacgcaggtgcc

SEQ ID NO: 2772 - DNA, 25 bp, Homo sapien
agcacatacacgcaggtgcccatga

SEQ ID NO: 2773 - DNA, 25 bp, Homo sapien
cgttctcctgcaggacggcaaaccg

SEQ ID NO: 2774 - DNA, 25 bp, Homo sapien
acgccgcagtgaggtaaacggtctc

SEQ ID NO: 2775 - DNA, 25 bp, Homo sapien
cggcgaactcgtctgcgaccgttag

SEQ ID NO: 2776 - DNA, 25 bp, Homo sapien
agcccgaagctgagagccgttcacg

SEQ ID NO: 2777 - DNA, 25 bp, Homo sapien
caccggaaagagcagtgcacacttc

SEQ ID NO: 2778 - DNA, 25 bp, Homo sapien
ttgtccagcaccgacccggatggta

SEQ ID NO: 2779 - DNA, 25 bp, Homo sapien
ccggctcctcctcgatgacggggat

SEQ ID NO: 2780 - DNA, 25 bp, Homo sapien
tctgggttttgttcgcgtctcaacg

SEQ ID NO: 2781 - DNA, 25 bp, Homo sapien
cgagtgatcgttgtcctcaggagcc

SEQ ID NO: 2782 - DNA, 25 bp, Homo sapien
gtctcctgacgcctggcaggtgcta

SEQ ID NO: 2783 - DNA, 25 bp, Homo sapien
gatggctggcaggcctcgtgcggtc

SEQ ID NO: 2784 - DNA, 25 bp, Homo sapien
ggatggctggcaggcctcgtgcggt

SEQ ID NO: 2785 - DNA, 25 bp, Homo sapien
cggatggctggcaggcctcgtgcgg

SEQ ID NO: 2786 - DNA, 25 bp, Homo sapien
ccggatggctggcaggcctcgtgcg

SEQ ID NO: 2787 - DNA, 25 bp, Homo sapien
caccggatggctggcaggcctcgtg

SEQ ID NO: 2788 - DNA, 25 bp, Homo sapien
tggctggcaggcctcgtgcggtccg

SEQ ID NO: 2789 - DNA, 25 bp, Homo sapien
ccaccggatggctggcaggcctcgt

SEQ ID NO: 2790 - DNA, 25 bp, Homo sapien
cgcagagctcatagcggctgttggc

SEQ ID NO: 2791 - DNA, 25 bp, Homo sapien
accagcaggtacgtgcaggtgccca

SEQ ID NO: 2792 - DNA, 25 bp, Homo sapien
ttctggccgcatgagccgaccagca

SEQ ID NO: 2793 - DNA, 25 bp, Homo sapien
tcccgaagcgatcggggtagcagcc

SEQ ID NO: 2794 - DNA, 25 bp, Homo sapien
tgcagcgcctttggcacaactcgtc

SEQ ID NO: 2795 - DNA, 25 bp, Homo sapien
ggccgtcgaagctcacatagtgtgg

SEQ ID NO: 2796 - DNA, 25 bp, Homo sapien
gtgcagccacacgacgaggccggca

SEQ ID NO: 2797 - DNA, 25 bp, Homo sapien
acggcgcgcgtgtagctcacagtct

SEQ ID NO: 2798 - DNA, 25 bp, Homo sapien
acacagagtggctgtaggcgcgcac

SEQ ID NO: 2799 - DNA, 25 bp, Homo sapien
ctcgttcttggcctccacgctgaag

SEQ ID NO: 2800 - DNA, 25 bp, Homo sapien
acttcaccgcgggtcagcgacacag

SEQ ID NO: 2801 - DNA, 25 bp, Homo sapien
tgcacagctccaccatcgtgtacga

SEQ ID NO: 2802 - DNA, 25 bp, Homo sapien
cgtgtacgaacaggtgcccatcatg

SEQ ID NO: 2803 - DNA, 25 bp, Homo sapien
ccatcatgtcgtagcgacggccgtc

SEQ ID NO: 2804 - DNA, 25 bp, Homo sapien
agacagcggtggactccgccacaca

SEQ ID NO: 2805 - DNA, 25 bp, Homo sapien
cgcgcacagtgacgaggcccacgta

SEQ ID NO: 2806 - DNA, 25 bp, Homo sapien
cgcggcgcacaatctttggatcagc

SEQ ID NO: 2807 - DNA, 25 bp, Homo sapien
ggggtaaagcccagtatgaaatgtc

SEQ ID NO: 2808 - DNA, 25 bp, Homo sapien
tgtggaacccagctcaaggaccctc

SEQ ID NO: 2809 - DNA, 25 bp, Homo sapien
atcagcgccacgtggagaccttacc

SEQ ID NO: 2810 - DNA, 25 bp, Homo sapien
gcccgtacgatcaatcccttctgtg

SEQ ID NO: 2811 - DNA, 25 bp, Homo sapien
gccagactgtccgtgccagagctct

SEQ ID NO: 2812 - DNA, 25 bp, Homo sapien
tctactcgattggttgctcactgcg

SEQ ID NO: 2813 - DNA, 25 bp, Homo sapien
gagctctgcgaacttactccgttga

SEQ ID NO: 2814 - DNA, 25 bp, Homo sapien
gctgtactgctaagatgcgtgctcc

SEQ ID NO: 2815 - DNA, 25 bp, Homo sapien
atttctggtcgagaagctgtactgc

SEQ ID NO: 2816 - DNA, 25 bp, Homo sapien
cagttaattgttgcacctgtatttc

SEQ ID NO: 2817 - DNA, 25 bp, Homo sapien
aggccgtcgtgcgttgcagttaatt

SEQ ID NO: 2818 - DNA, 25 bp, Homo sapien
gtctctgagagtacacagccctctg

SEQ ID NO: 2819 - DNA, 25 bp, Homo sapien
gccagcgcccacagtgtctctgaga

SEQ ID NO: 2820 - DNA, 25 bp, Homo sapien
attcggaaggtgcagtgtgaccctg

SEQ ID NO: 2821 - DNA, 25 bp, Homo sapien
ctctccggagtgaccgaagtgaaga

SEQ ID NO: 2822 - DNA, 25 bp, Homo sapien
tcagtttccggctgtggactacatt

SEQ ID NO: 2823 - DNA, 25 bp, Homo sapien
actcttacgagtaggactggggata

SEQ ID NO: 2824 - DNA, 25 bp, Homo sapien
tggcccagaggcgtctgttctcctc

SEQ ID NO: 2825 - DNA, 25 bp, Homo sapien
ccaagggccctttacattgcgttct

SEQ ID NO: 2826 - DNA, 25 bp, Homo sapien
ggggatagaactgccgcccaaagtg

SEQ ID NO: 2827 - DNA, 25 bp, Homo sapien
gcctccgcccaaaaggatcagtttc

SEQ ID NO: 2828 - DNA, 25 bp, Homo sapien
tcctggtaagtgagtcgaacccgcc

SEQ ID NO: 2829 - DNA, 25 bp, Homo sapien
cgttattattcacttgcgggcgaga

SEQ ID NO: 2830 - DNA, 25 bp, Homo sapien
cacacgcacgcctaaggatctggca

SEQ ID NO: 2831 - DNA, 25 bp, Homo sapien
aggatctggcagattccgtctgcgc

SEQ ID NO: 2832 - DNA, 25 bp, Homo sapien
gtcaggttcgagtcccagtccacga

SEQ ID NO: 2833 - DNA, 25 bp, Homo sapien
ttcgagtcccagtccacgaagacct

SEQ ID NO: 2834 - DNA, 25 bp, Homo sapien
ccgatttcttcctaggacgtgaaga

SEQ ID NO: 2835 - DNA, 25 bp, Homo sapien
aagaccttacccagctaggtcgtca

SEQ ID NO: 2836 - DNA, 25 bp, Homo sapien
caggagacaggaagtggaaccgcta

SEQ ID NO: 2837 - DNA, 25 bp, Homo sapien
aagtggaaccgctaattccggtgcg

SEQ ID NO: 2838 - DNA, 25 bp, Homo sapien
ctccgtcactcatgatctcacaatc

SEQ ID NO: 2839 - DNA, 25 bp, Homo sapien
gtgcatagaacctcacgcacacact

SEQ ID NO: 2840 - DNA, 25 bp, Homo sapien
acacacacgcctggggatccggcag

SEQ ID NO: 2841 - DNA, 25 bp, Homo sapien
ggggatccggcagatcccgtctgca

SEQ ID NO: 2842 - DNA, 25 bp, Homo sapien
acccgcactgtcgggtcagtcaggc

SEQ ID NO: 2843 - DNA, 25 bp, Homo sapien
tccgcagagatctcccgcagccaca

SEQ ID NO: 2844 - DNA, 25 bp, Homo sapien
ctcttcctcagacgtgaagacctta

SEQ ID NO: 2845 - DNA, 25 bp, Homo sapien
ccgggcctgtgcatagaacctcacg

SEQ ID NO: 2846 - DNA, 25 bp, Homo sapien
cctcttagccctctgccgtttgggg

SEQ ID NO: 2847 - DNA, 25 bp, Homo sapien
gtcacagtcatgcacgcagctccta

SEQ ID NO: 2848 - DNA, 25 bp, Homo sapien
gccaaatcggaagggacgagcctgc

SEQ ID NO: 2849 - DNA, 25 bp, Homo sapien
gggtgtcatgtccattgcggcccga

SEQ ID NO: 2850 - DNA, 25 bp, Homo sapien
cccacagggtctgtgaggagcgctt

SEQ ID NO: 2851 - DNA, 25 bp, Homo sapien
taatcgcgtccgttgcagtccaacc

SEQ ID NO: 2852 - DNA, 25 bp, Homo sapien
gcagctcctatttttcgcgttgcta

SEQ ID NO: 2853 - DNA, 25 bp, Homo sapien
agggacgagcctgccctttgaaagg

SEQ ID NO: 2854 - DNA, 25 bp, Homo sapien
ccgcctgctcaagctgcgggaaggc

SEQ ID NO: 2855 - DNA, 25 bp, Homo sapien
gggcaacttcaagcgcagccgcctg

SEQ ID NO: 2856 - DNA, 25 bp, Homo sapien
gtccgcaagcgcaagggcaacttca

SEQ ID NO: 2857 - DNA, 25 bp, Homo sapien
tgctcatgtgccagctgagccagga

SEQ ID NO: 2858 - DNA, 25 bp, Homo sapien
acctgctcatgtgccagctgagcca

SEQ ID NO: 2859 - DNA, 25 bp, Homo sapien
gacatcgtggaacgggagctgcacc

SEQ ID NO: 2860 - DNA, 25 bp, Homo sapien
gctggcagaacgtgagatggacatc

SEQ ID NO: 2861 - DNA, 25 bp, Homo sapien
gcagcgcttccaggaggagcagctg

SEQ ID NO: 2862 - DNA, 25 bp, Homo sapien
gcgctggctcgacggcctcttcttt

SEQ ID NO: 2863 - DNA, 25 bp, Homo sapien
cactgctgcgctctgacagtgacga

SEQ ID NO: 2864 - DNA, 25 bp, Homo sapien
acgcgttcactgctgcgctctgaca

SEQ ID NO: 2865 - DNA, 25 bp, Homo sapien
cgctgtcgtccgtgtccgactgcaa

SEQ ID NO: 2866 - DNA, 25 bp, Homo sapien
ctctgacagtgacgaggccgcaccg

SEQ ID NO: 2867 - DNA, 25 bp, Homo sapien
gtcgctcacgcccacccacgtcacg

SEQ ID NO: 2868 - DNA, 25 bp, Homo sapien
cacgtcacggctgcatgcgctgtga

SEQ ID NO: 2869 - DNA, 25 bp, Homo sapien
gtgtccgactgcaactccacgcgtt

SEQ ID NO: 2870 - DNA, 25 bp, Homo sapien
tactgaaaaatacctgccgagagca

SEQ ID NO: 2871 - DNA, 25 bp, Homo sapien
acgggatgtgccgtaagcgtcagcc

SEQ ID NO: 2872 - DNA, 25 bp, Homo sapien
acctgcgcacgggatgtgccgtaag

SEQ ID NO: 2873 - DNA, 25 bp, Homo sapien
atgaagtcctcctggggggcatccc

SEQ ID NO: 2874 - DNA, 25 bp, Homo sapien
ccgcccgggcaatgtactggatgaa

SEQ ID NO: 2875 - DNA, 25 bp, Homo sapien
ccgtaagcgtcagccggcatgtgcc

SEQ ID NO: 2876 - DNA, 25 bp, Homo sapien
cctagcacctccatctactgaaaaa

SEQ ID NO: 2877 - DNA, 25 bp, Homo sapien
cgggcaatgtactggatgaagtcct

SEQ ID NO: 2878 - DNA, 25 bp, Homo sapien
ccaggcctaagggattgctccggca

SEQ ID NO: 2879 - DNA, 25 bp, Homo sapien
ttcttctctcgatagcagcgctggc

SEQ ID NO: 2880 - DNA, 25 bp, Homo sapien
caatccgctcgcctatcgaaacagg

SEQ ID NO: 2881 - DNA, 25 bp, Homo sapien
gccaaaacacggacaggcgccactg

SEQ ID NO: 2882 - DNA, 25 bp, Homo sapien
ggcagacttcctcaccttgggtcca

SEQ ID NO: 2883 - DNA, 25 bp, Homo sapien
tacccgtgagggagtcgtaacactc

SEQ ID NO: 2884 - DNA, 25 bp, Homo sapien
gatggcctcccggaacttcttctct

SEQ ID NO: 2885 - DNA, 25 bp, Homo sapien
aacccacctgactgcgaggagccga

SEQ ID NO: 2886 - DNA, 25 bp, Homo sapien
gccgcgcatacttgaggaagactgc

SEQ ID NO: 2887 - DNA, 25 bp, Homo sapien
ctattcttcctacagggcgcggcta

SEQ ID NO: 2888 - DNA, 25 bp, Homo sapien
caactggagtgactaggcgagcacc

SEQ ID NO: 2889 - DNA, 25 bp, Homo sapien
acgcgtcccgtcttcaactggagtg

SEQ ID NO: 2890 - DNA, 25 bp, Homo sapien
ctctcttgagatcgggcacgcgtcc

SEQ ID NO: 2891 - DNA, 25 bp, Homo sapien
ctgagaagaagcgtcgatgtggttc

SEQ ID NO: 2892 - DNA, 25 bp, Homo sapien
cccatccttggaactggagactgga

SEQ ID NO: 2893 - DNA, 25 bp, Homo sapien
gcaagtggttggagatgacccatcc

SEQ ID NO: 2894 - DNA, 25 bp, Homo sapien
tggcaagtaacatcacctgcaagtg

SEQ ID NO: 2895 - DNA, 25 bp, Homo sapien
gaagtaggtggcaagtaacatcacc

SEQ ID NO: 2896 - DNA, 25 bp, Homo sapien
gcaaagacagctccaggaagtaggt

SEQ ID NO: 2897 - DNA, 25 bp, Homo sapien
ggcctccagcaaagacagctccagg

SEQ ID NO: 2898 - DNA, 25 bp, Homo sapien
gccgcacgacgacccggctcccatc

SEQ ID NO: 2899 - DNA, 25 bp, Homo sapien
cccgcgtattcacaagggctcacct

SEQ ID NO: 2900 - DNA, 25 bp, Homo sapien
ctcaggatgcgacgctcggcgcgca

SEQ ID NO: 2901 - DNA, 25 bp, Homo sapien
cagctccgcccgtgagaaggagtcc

SEQ ID NO: 2902 - DNA, 25 bp, Homo sapien
ttgaggcccacgttggaagtcttta

SEQ ID NO: 2903 - DNA, 25 bp, Homo sapien
cgcaacgtgtcctacgggaccaaga

SEQ ID NO: 2904 - DNA, 25 bp, Homo sapien
ccctgctcttcggagtcttcgtgta

SEQ ID NO: 2905 - DNA, 25 bp, Homo sapien
cttcgtgtaagtagtggcgcaccgc

SEQ ID NO: 2906 - DNA, 25 bp, Homo sapien
ctaacttagtttgcgcagccgcttc

SEQ ID NO: 2907 - DNA, 25 bp, Homo sapien
ctgcacctctaaacagggacgcgca

SEQ ID NO: 2908 - DNA, 25 bp, Homo sapien
ccttctgtgtgatctttgaggccca

SEQ ID NO: 2909 - DNA, 25 bp, Homo sapien
aagcctctctgtgccctaacttagt

SEQ ID NO: 2910 - DNA, 25 bp, Homo sapien
ccagcgctcaggtaggaatcaagca

SEQ ID NO: 2911 - DNA, 25 bp, Homo sapien
gtacctcgggaagcacgcactcttc

SEQ ID NO: 2912 - DNA, 25 bp, Homo sapien
gatacctacgtgcacctggaccagc

SEQ ID NO: 2913 - DNA, 25 bp, Homo sapien
agccagacccaggtactcctgagga

SEQ ID NO: 2914 - DNA, 25 bp, Homo sapien
caggtgaaccgccagataaagtgtg

SEQ ID NO: 2915 - DNA, 25 bp, Homo sapien
cagctgcaggcgatgtagacgcacg

SEQ ID NO: 2916 - DNA, 25 bp, Homo sapien
ttttgcacgccacaaacaggcaagc

SEQ ID NO: 2917 - DNA, 25 bp, Homo sapien
cagataaagtgtgtcaccagccaga

SEQ ID NO: 2918 - DNA, 25 bp, Homo sapien
agcgcctaacgataggcccgagccg

SEQ ID NO: 2919 - DNA, 25 bp, Homo sapien
aagggcattcccagcggtagaaacg

SEQ ID NO: 2920 - DNA, 25 bp, Homo sapien
caagcaccgacccttgcagctaggg

SEQ ID NO: 2921 - DNA, 25 bp, Homo sapien
cggcgctgtgtgaaaacaaaacaaa

SEQ ID NO: 2922 - DNA, 25 bp, Homo sapien
cgagactctgcaaaggagagggcct

SEQ ID NO: 2923 - DNA, 25 bp, Homo sapien
aggctcaccatgacttcggcgaaga

SEQ ID NO: 2924 - DNA, 25 bp, Homo sapien
aaggaacgccggctgccagtgatag

SEQ ID NO: 2925 - DNA, 25 bp, Homo sapien
acaaaagcctggacgttgcagggaa

SEQ ID NO: 2926 - DNA, 25 bp, Homo sapien
ccctagggcctagccgtagtgatta

SEQ ID NO: 2927 - DNA, 25 bp, Homo sapien
ctacgcaggcgcactaggactccga

SEQ ID NO: 2928 - DNA, 25 bp, Homo sapien
cgtagtgattatttcccggcagccc

SEQ ID NO: 2929 - DNA, 25 bp, Homo sapien
gcgcctgcgcacattagacaacttt

SEQ ID NO: 2930 - DNA, 25 bp, Homo sapien
acaggaagtgacgtacaaagagcca

SEQ ID NO: 2931 - DNA, 25 bp, Homo sapien
tggacggaaataccgccctctcgcg

SEQ ID NO: 2932 - DNA, 25 bp, Homo sapien
tgcgctggttccctttccttgtgtt

SEQ ID NO: 2933 - DNA, 25 bp, Homo sapien
gactccgacgtctgctttccctagg

SEQ ID NO: 2934 - DNA, 25 bp, Homo sapien
ggaagcatcctctcaccgccggaag

SEQ ID NO: 2935 - DNA, 25 bp, Homo sapien
gccaccagcgagagtgcggccataa

SEQ ID NO: 2936 - DNA, 25 bp, Homo sapien
tgcggccataaccatcacgtgaccg

SEQ ID NO: 2937 - DNA, 25 bp, Homo sapien
caccagcgagagtgcagtcgtaacc

SEQ ID NO: 2938 - DNA, 25 bp, Homo sapien
cggccaatgagaaaggcgcatgcct

SEQ ID NO: 2939 - DNA, 25 bp, Homo sapien
tgcagtctagccgtagtgcgcctgc

SEQ ID NO: 2940 - DNA, 25 bp, Homo sapien
tcggctaccctcctcgtgttgtctt

SEQ ID NO: 2941 - DNA, 25 bp, Homo sapien
accgccggaagctgaactgactcgt

SEQ ID NO: 2942 - DNA, 25 bp, Homo sapien
cctcgttcagcctgtccagacagaa

SEQ ID NO: 2943 - DNA, 25 bp, Homo sapien
cccggactggggcacgcactgcgca

SEQ ID NO: 2944 - DNA, 25 bp, Homo sapien
tcgttcagcctgtccagacagaagc

SEQ ID NO: 2945 - DNA, 25 bp, Homo sapien
ttcagcctgtccagacagaagctgg

SEQ ID NO: 2946 - DNA, 25 bp, Homo sapien
cctgtccagacagaagctggggccc

SEQ ID NO: 2947 - DNA, 25 bp, Homo sapien
gcccaccggaggtagctgcagacgc

SEQ ID NO: 2948 - DNA, 25 bp, Homo sapien
accggaggtagctgcagacgcctga

SEQ ID NO: 2949 - DNA, 25 bp, Homo sapien
ctgcagacgcctgagagcgaggccg

SEQ ID NO: 2950 - DNA, 25 bp, Homo sapien
cctccacttgcagcgagaggcggta

SEQ ID NO: 2951 - DNA, 25 bp, Homo sapien
tcccaggtcagcatgcgcttgatca

SEQ ID NO: 2952 - DNA, 25 bp, Homo sapien
atgcgttcgtgtgactcccaggtca

SEQ ID NO: 2953 - DNA, 25 bp, Homo sapien
gatcagctccaccatgctcttgagg

SEQ ID NO: 2954 - DNA, 25 bp, Homo sapien
aaggttagccgactggccacactgc

SEQ ID NO: 2955 - DNA, 25 bp, Homo sapien
tcactgtctcaatctggtccaacga

SEQ ID NO: 2956 - DNA, 25 bp, Homo sapien
ggtccaacgacttgagcatatactt

SEQ ID NO: 2957 - DNA, 25 bp, Homo sapien
atacttgcggcgctccaatgggcgc

SEQ ID NO: 2958 - DNA, 25 bp, Homo sapien
tggcggatccgaagtcaatcacctg

SEQ ID NO: 2959 - DNA, 25 bp, Homo sapien
gcagatgtagcgcacctggtcgtac

SEQ ID NO: 2960 - DNA, 25 bp, Homo sapien
cctcgctgaaaatgctggcggatcc

SEQ ID NO: 2961 - DNA, 25 bp, Homo sapien
gtatggctccttcacgtagcgcacc

SEQ ID NO: 2962 - DNA, 25 bp, Homo sapien
cgcgactggatgtatggctccttca

SEQ ID NO: 2963 - DNA, 25 bp, Homo sapien
acacgtccaccttctcgcagaaggg

SEQ ID NO: 2964 - DNA, 25 bp, Homo sapien
aggtgcagctcagccatgacgcagc

SEQ ID NO: 2965 - DNA, 25 bp, Homo sapien
cacctggtcgtactcgttgttgccg

SEQ ID NO: 2966 - DNA, 25 bp, Homo sapien
ttgtcctgcgtcttgcggctctgct

SEQ ID NO: 2967 - DNA, 25 bp, Homo sapien
aaacagagatgagtcggaatcgagc

SEQ ID NO: 2968 - DNA, 25 bp, Homo sapien
acaggaagcgttcggtctccgcatc

SEQ ID NO: 2969 - DNA, 25 bp, Homo sapien
tcggaatcgagctgcgcccagtctg

SEQ ID NO: 2970 - DNA, 25 bp, Homo sapien
agcgccgcctcattgaaggagaccc

SEQ ID NO: 2971 - DNA, 25 bp, Homo sapien
ggcgagggacactcgtccatccgct

SEQ ID NO: 2972 - DNA, 25 bp, Homo sapien
cgcctgggcgttaaggaaacagaga

SEQ ID NO: 2973 - DNA, 25 bp, Homo sapien
tgggcccacctacgcctgggcgtta

SEQ ID NO: 2974 - DNA, 25 bp, Homo sapien
gcggtaggcgtcattcttgaggatc

SEQ ID NO: 2975 - DNA, 25 bp, Homo sapien
gctccagcagctcaaagaccaggta

SEQ ID NO: 2976 - DNA, 25 bp, Homo sapien
acttgagggcgtcatggaagaactc

SEQ ID NO: 2977 - DNA, 25 bp, Homo sapien
ttgaggatcttgatggccaccatct

SEQ ID NO: 2978 - DNA, 25 bp, Homo sapien
cccttgcccaagacctcgatgatgt

SEQ ID NO: 2979 - DNA, 25 bp, Homo sapien
cgatgatgtcgtagcagtcagtctc

SEQ ID NO: 2980 - DNA, 25 bp, Homo sapien
tctaggcctcgcatgcagtgcagca

SEQ ID NO: 2981 - DNA, 25 bp, Homo sapien
tcagctcgttcttgatgatgcggtt

SEQ ID NO: 2982 - DNA, 25 bp, Homo sapien
ctagttctgcccacttgcacggagc

SEQ ID NO: 2983 - DNA, 25 bp, Homo sapien
ccagcgcaggattaagtcgcagtta

SEQ ID NO: 2984 - DNA, 25 bp, Homo sapien
cttgatctcgtagccagacacggtc

SEQ ID NO: 2985 - DNA, 25 bp, Homo sapien
agaacactcgggcactcagcagctg

SEQ ID NO: 2986 - DNA, 25 bp, Homo sapien
tagtgcgtcctcgtacttgaagttc

SEQ ID NO: 2987 - DNA, 25 bp, Homo sapien
actttgtaaggctcggcgcattgca

SEQ ID NO: 2988 - DNA, 25 bp, Homo sapien
tgcgcttcaggcagaaggagacttt

SEQ ID NO: 2989 - DNA, 25 bp, Homo sapien
ccgggctaagcacgcgtaccagctt

SEQ ID NO: 2990 - DNA, 25 bp, Homo sapien
tctagaggaacctgacagcggcgcc

SEQ ID NO: 2991 - DNA, 25 bp, Homo sapien
agattagcacaaccgcctaagcggc

SEQ ID NO: 2992 - DNA, 25 bp, Homo sapien
cgggatgttgccctacacagtgaac

SEQ ID NO: 2993 - DNA, 25 bp, Homo sapien
ccggactctgtttggaacggaagca

SEQ ID NO: 2994 - DNA, 25 bp, Homo sapien
tgaacttcaaggtgtcggcgcgcac

SEQ ID NO: 2995 - DNA, 25 bp, Homo sapien
acccggagcctgtagaacttgaatc

SEQ ID NO: 2996 - DNA, 25 bp, Homo sapien
ggagagtgcggaacctaggatccta

SEQ ID NO: 2997 - DNA, 25 bp, Homo sapien
acggaagcacagtgtccgccgcttc

SEQ ID NO: 2998 - DNA, 25 bp, Homo sapien
tggacccaaggcagattcctaaccc

SEQ ID NO: 2999 - DNA, 25 bp, Homo sapien
cgcccgctacgttgatgccgctgac

SEQ ID NO: 3000 - DNA, 25 bp, Homo sapien
ccggtcagtttcagcctctctttgg

SEQ ID NO: 3001 - DNA, 25 bp, Homo sapien
tttcagcctctctttggacccaagg

SEQ ID NO: 3002 - DNA, 25 bp, Homo sapien
tctttggacccaaggcagattccta

SEQ ID NO: 3003 - DNA, 25 bp, Homo sapien
gtctccacgataatttccaccaact

SEQ ID NO: 3004 - DNA, 25 bp, Homo sapien
tcccgaacgaagattccctctttgc

SEQ ID NO: 3005 - DNA, 25 bp, Homo sapien
agctcccgaacgaagattccctctt

SEQ ID NO: 3006 - DNA, 25 bp, Homo sapien
ataacttgagttgtgattgagaggc

SEQ ID NO: 3007 - DNA, 25 bp, Homo sapien
gctgccctcgcaggacgtcggggca

SEQ ID NO: 3008 - DNA, 25 bp, Homo sapien
tcggggcacacccactccggcgtct

SEQ ID NO: 3009 - DNA, 25 bp, Homo sapien
ccctttaagcaagcctgagggcagc

SEQ ID NO: 3010 - DNA, 25 bp, Homo sapien
aagcctgagggcagctggctttcta

SEQ ID NO: 3011 - DNA, 25 bp, Homo sapien
gcagctggctttctaggacccgcgg

SEQ ID NO: 3012 - DNA, 25 bp, Homo sapien
cgcggaacggttaaacagctccgcg

SEQ ID NO: 3013 - DNA, 25 bp, Homo sapien
ggctggagataacttgagttgtgat

SEQ ID NO: 3014 - DNA, 25 bp, Homo sapien
tgcgcacccgcagttttcacggtga

SEQ ID NO: 3015 - DNA, 25 bp, Homo sapien
tgatccctcgaccactggacagatg

SEQ ID NO: 3016 - DNA, 25 bp, Homo sapien
cagatgtccggggaacccaagacgg

SEQ ID NO: 3017 - DNA, 25 bp, Homo sapien
tctgcggcaaagcagtccgagtccc

SEQ ID NO: 3018 - DNA, 25 bp, Homo sapien
cttctggccagaagcgaggctctgg

SEQ ID NO: 3019 - DNA, 25 bp, Homo sapien
atggcggcgtttccctcactcaagg

SEQ ID NO: 3020 - DNA, 25 bp, Homo sapien
ccaagttttgagtctgcggcaaagc

SEQ ID NO: 3021 - DNA, 25 bp, Homo sapien
gaaatgggcacaacttcctctgctc

SEQ ID NO: 3022 - DNA, 25 bp, Homo sapien
tcacgcagccggagccaagaagccg

SEQ ID NO: 3023 - DNA, 25 bp, Homo sapien
tcggacccagggatcgaactctgtg

SEQ ID NO: 3024 - DNA, 25 bp, Homo sapien
cgctggtagcccttctgttcccagg

SEQ ID NO: 3025 - DNA, 25 bp, Homo sapien
taccttgctcactagcggccaatca

SEQ ID NO: 3026 - DNA, 25 bp, Homo sapien
caatcagaacgaagaggtagccacc

SEQ ID NO: 3027 - DNA, 25 bp, Homo sapien
ggtagccacccacaaccaatcagga

SEQ ID NO: 3028 - DNA, 25 bp, Homo sapien
tcgcttgttggctgtcctctggaaa

SEQ ID NO: 3029 - DNA, 25 bp, Homo sapien
gtcgcgagacgcagttctgactccg

SEQ ID NO: 3030 - DNA, 25 bp, Homo sapien
ggtgctcctcttactggcctcatcg

SEQ ID NO: 3031 - DNA, 25 bp, Homo sapien
aacgtggacactgccctcggggact

SEQ ID NO: 3032 - DNA, 25 bp, Homo sapien
gggtggtcctagagagagattcttc

SEQ ID NO: 3033 - DNA, 25 bp, Homo sapien
tcttcgaggcgttgacattggagct

SEQ ID NO: 3034 - DNA, 25 bp, Homo sapien
gggaaatgaaaccatcggcgaagcc

SEQ ID NO: 3035 - DNA, 25 bp, Homo sapien
agcctttccacttctgtggccagtt

SEQ ID NO: 3036 - DNA, 25 bp, Homo sapien
tgtggccagttctttttaacaagtg

SEQ ID NO: 3037 - DNA, 25 bp, Homo sapien
aaaatggagacggagccaggaattc

SEQ ID NO: 3038 - DNA, 25 bp, Homo sapien
agtccgcgattctccttccaaactg

SEQ ID NO: 3039 - DNA, 25 bp, Homo sapien
aaactgcccttggatccagagaccc

SEQ ID NO: 3040 - DNA, 25 bp, Homo sapien
ttgacgtcgagcacgcactacaatc

SEQ ID NO: 3041 - DNA, 25 bp, Homo sapien
ccctctgttccttgaaagtccgcga

SEQ ID NO: 3042 - DNA, 25 bp, Homo sapien
agactccggctctaaatttgctttc

SEQ ID NO: 3043 - DNA, 25 bp, Homo sapien
agtctgagctccaggcccggaacac

SEQ ID NO: 3044 - DNA, 25 bp, Homo sapien
cagccgccaggtacacgaattgacg

SEQ ID NO: 3045 - DNA, 25 bp, Homo sapien
agacgacaatgctccgatctagttc

SEQ ID NO: 3046 - DNA, 25 bp, Homo sapien
caggacccaccagtgaccggttgga

SEQ ID NO: 3047 - DNA, 25 bp, Homo sapien
ccgggccatttaaagaagtgcaact

SEQ ID NO: 3048 - DNA, 25 bp, Homo sapien
agctacagtcctcgctccaagatcg

SEQ ID NO: 3049 - DNA, 25 bp, Homo sapien
tcctttatggtaggcctggactcca

SEQ ID NO: 3050 - DNA, 25 bp, Homo sapien
tagcggaagaccagccaatagagtg

SEQ ID NO: 3051 - DNA, 25 bp, Homo sapien
gttgcctaggcgatcgtagcctcgc

SEQ ID NO: 3052 - DNA, 25 bp, Homo sapien
ggtaaattcccaagccaggcgacca

SEQ ID NO: 3053 - DNA, 25 bp, Homo sapien
tgctccctgcggttcctttatggta

SEQ ID NO: 3054 - DNA, 25 bp, Homo sapien
ggtgacactgcgtcagcctgtacga

SEQ ID NO: 3055 - DNA, 25 bp, Homo sapien
tttgtgaccttgtggtgacaccgtg

SEQ ID NO: 3056 - DNA, 25 bp, Homo sapien
tgtgtgacaccacatgtctcgtgta

SEQ ID NO: 3057 - DNA, 25 bp, Homo sapien
gatcccgtgttacagtgtgactaca

SEQ ID NO: 3058 - DNA, 25 bp, Homo sapien
gtcacggcgtacctatgcacttata

SEQ ID NO: 3059 - DNA, 25 bp, Homo sapien
tatgaccctgtgtgactcagtgacc

SEQ ID NO: 3060 - DNA, 25 bp, Homo sapien
cggtggttaccctattggatttgtg

SEQ ID NO: 3061 - DNA, 25 bp, Homo sapien
accacgtgtggcaggcattgattct

SEQ ID NO: 3062 - DNA, 25 bp, Homo sapien
gcccgacctcacagggagaaactga

SEQ ID NO: 3063 - DNA, 25 bp, Homo sapien
tatgtaggtcgggaaatgagttcag

SEQ ID NO: 3064 - DNA, 25 bp, Homo sapien
agacgccatcgtcctcgcccgacct

SEQ ID NO: 3065 - DNA, 25 bp, Homo sapien
cggagcaggcggagaatttatgaat

SEQ ID NO: 3066 - DNA, 25 bp, Homo sapien
gccgcatatgtaggtcgggaaatga

SEQ ID NO: 3067 - DNA, 25 bp, Homo sapien
cgcgcctacctcagcgccgggacga

SEQ ID NO: 3068 - DNA, 25 bp, Homo sapien
cccacacgcgacagcgggaaactga

SEQ ID NO: 3069 - DNA, 25 bp, Homo sapien
caggcggagaatttatgaatggaga

SEQ ID NO: 3070 - DNA, 25 bp, Homo sapien
tgcagtttctgaaggagcagcgcgt

SEQ ID NO: 3071 - DNA, 25 bp, Homo sapien
catcgtggatgggaatcaccggctg

SEQ ID NO: 3072 - DNA, 25 bp, Homo sapien
acctggagaacgtgggttcgcatga

SEQ ID NO: 3073 - DNA, 25 bp, Homo sapien
acaaggcgctgcagtttctgaagga

SEQ ID NO: 3074 - DNA, 25 bp, Homo sapien
cactggagaacgtggacaaggcgct

SEQ ID NO: 3075 - DNA, 25 bp, Homo sapien
cggatccactcactggagaacgtgg

SEQ ID NO: 3076 - DNA, 25 bp, Homo sapien
ggcgccatactcctgtctgtccaga

SEQ ID NO: 3077 - DNA, 25 bp, Homo sapien
cgtgggttcgcatgacatcgtggat

SEQ ID NO: 3078 - DNA, 25 bp, Homo sapien
cttccgcatcagttgcgtggggctg

SEQ ID NO: 3079 - DNA, 25 bp, Homo sapien
ccatcgccgcctctacagggaggga

SEQ ID NO: 3080 - DNA, 25 bp, Homo sapien
ctggccacgcgatggcgctgtgcac

SEQ ID NO: 3081 - DNA, 25 bp, Homo sapien
tcgctgcagcccagctaggttaatc

SEQ ID NO: 3082 - DNA, 25 bp, Homo sapien
tgcagcccagctaggttaatcaatc

SEQ ID NO: 3083 - DNA, 25 bp, Homo sapien
gctaggttaatcaatcagcagccgc

SEQ ID NO: 3084 - DNA, 25 bp, Homo sapien
catcccttccgcatcagttgcgtgg

SEQ ID NO: 3085 - DNA, 25 bp, Homo sapien
gcagccgctcagtcacccatccctt

SEQ ID NO: 3086 - DNA, 25 bp, Homo sapien
gcgctcgctgtctaccgcatgtttg

SEQ ID NO: 3087 - DNA, 25 bp, Homo sapien
gcaggtcatctgcaaccgcgtgaac

SEQ ID NO: 3088 - DNA, 25 bp, Homo sapien
tggcccagcacaagatcctgcaggg

SEQ ID NO: 3089 - DNA, 25 bp, Homo sapien
agacaccgtgcacctggtaggcctg

SEQ ID NO: 3090 - DNA, 25 bp, Homo sapien
agagcagttgttcgctgaggtgacc

SEQ ID NO: 3091 - DNA, 25 bp, Homo sapien
aatggctgctctccatgcgtgtgcc

SEQ ID NO: 3092 - DNA, 25 bp, Homo sapien
tgtgccggattcactcgacgacgtc

SEQ ID NO: 3093 - DNA, 25 bp, Homo sapien
cgccggtgacttcggccacgacgaa

SEQ ID NO: 3094 - DNA, 25 bp, Homo sapien
tgcagcgcttcctacatgacctcga

SEQ ID NO: 3095 - DNA, 25 bp, Homo sapien
atgacctcgacgctttcctggactg

SEQ ID NO: 3096 - DNA, 25 bp, Homo sapien
gaccagcgcgaggaagactatgctc

SEQ ID NO: 3097 - DNA, 25 bp, Homo sapien
gagtggctgccacacctcgaacttg

SEQ ID NO: 3098 - DNA, 25 bp, Homo sapien
ctcgaacttggctggcataaactgc

SEQ ID NO: 3099 - DNA, 25 bp, Homo sapien
accagctcttcctgcgggatctacg

SEQ ID NO: 3100 - DNA, 25 bp, Homo sapien
gcccactcggggtgtacatttcgga

SEQ ID NO: 3101 - DNA, 25 bp, Homo sapien
cgcatcgtggagctagtggaacagc

SEQ ID NO: 3102 - DNA, 25 bp, Homo sapien
ggacgcgcgctgatctcacctttct

SEQ ID NO: 3103 - DNA, 25 bp, Homo sapien
ggtcgcggagcgatgctcgctctaa

SEQ ID NO: 3104 - DNA, 25 bp, Homo sapien
agcgatgctcgctctaagccgccag

SEQ ID NO: 3105 - DNA, 25 bp, Homo sapien
gatgctcgctctaagccgccagggg

SEQ ID NO: 3106 - DNA, 25 bp, Homo sapien
agccgggtctcagtgcgcatgctcc

SEQ ID NO: 3107 - DNA, 25 bp, Homo sapien
gcatgctccgcaagtccctgcccgc

SEQ ID NO: 3108 - DNA, 25 bp, Homo sapien
tcacctttctctcctgagatttgtg

SEQ ID NO: 3109 - DNA, 25 bp, Homo sapien
gagatttgtgagaatcgctctaccc

SEQ ID NO: 3110 - DNA, 25 bp, Homo sapien
ctgctcgagccgttgcaggagcgcc

SEQ ID NO: 3111 - DNA, 25 bp, Homo sapien
tgcgcctgctcgagccgttgcagga

SEQ ID NO: 3112 - DNA, 25 bp, Homo sapien
agccgttgcaggagcgccgccgctt

SEQ ID NO: 3113 - DNA, 25 bp, Homo sapien
gccgccgcttgctgctggcttccaa

SEQ ID NO: 3114 - DNA, 25 bp, Homo sapien
cttccaaggagttgcaccaggtggc

SEQ ID NO: 3115 - DNA, 25 bp, Homo sapien
ccaaggagttgcaccaggtggcgca

SEQ ID NO: 3116 - DNA, 25 bp, Homo sapien
gttgcaccaggtggcgcacgacctg

SEQ ID NO: 3117 - DNA, 25 bp, Homo sapien
cacgacctggacgacgagctggtga

SEQ ID NO: 3118 - DNA, 25 bp, Homo sapien
tgccgcctcatcgtgggcgctttgt

SEQ ID NO: 3119 - DNA, 25 bp, Homo sapien
aaagcatcgcgcagctgtcgcgcca

SEQ ID NO: 3120 - DNA, 25 bp, Homo sapien
ctggacgccgccttccaggtggagc

SEQ ID NO: 3121 - DNA, 25 bp, Homo sapien
gagctgctcatgatgagtgaggaca

SEQ ID NO: 3122 - DNA, 25 bp, Homo sapien
actacttcgacgtggctgaggtgga

SEQ ID NO: 3123 - DNA, 25 bp, Homo sapien
agcagtactacttcgacgtggctga

SEQ ID NO: 3124 - DNA, 25 bp, Homo sapien
gagaactacgaggaaagcatcgcgc

SEQ ID NO: 3125 - DNA, 25 bp, Homo sapien
cttccaggtggagcagtactacttc

SEQ ID NO: 3126 - DNA, 25 bp, Homo sapien
taccctgggccgctatgagcagatg

SEQ ID NO: 3127 - DNA, 25 bp, Homo sapien
ggtccctccatcctcagatcgagaa

SEQ ID NO: 3128 - DNA, 25 bp, Homo sapien
ggtatgtgcgccaggagctcaagcc

SEQ ID NO: 3129 - DNA, 25 bp, Homo sapien
agcggcaagagtcagtcgatcaatc

SEQ ID NO: 3130 - DNA, 25 bp, Homo sapien
tcgatcaatccgaggaggctgcgcg

SEQ ID NO: 3131 - DNA, 25 bp, Homo sapien
gaggcggcacacagccttaccctgg

SEQ ID NO: 3132 - DNA, 25 bp, Homo sapien
agccgcgcattgaccggctgccgga

SEQ ID NO: 3133 - DNA, 25 bp, Homo sapien
tcaaagcggaacagagcaagcagcc

SEQ ID NO: 3134 - DNA, 25 bp, Homo sapien
cctcttcatctcttgcgtccgttta

SEQ ID NO: 3135 - DNA, 25 bp, Homo sapien
tctggcccaatgagcagcctatgga

SEQ ID NO: 3136 - DNA, 25 bp, Homo sapien
ctgcagtcttctgagcggacgcatc

SEQ ID NO: 3137 - DNA, 25 bp, Homo sapien
gcggacgcatctcgacgctgaaaga

SEQ ID NO: 3138 - DNA, 25 bp, Homo sapien
ggcgtgggagacctaatatccactc

SEQ ID NO: 3139 - DNA, 25 bp, Homo sapien
tccctgtccatcaagggttgctccg

SEQ ID NO: 3140 - DNA, 25 bp, Homo sapien
cctcccggggaagtcattcatctga

SEQ ID NO: 3141 - DNA, 25 bp, Homo sapien
aggcgctctgtccaatcgctagtga

SEQ ID NO: 3142 - DNA, 25 bp, Homo sapien
agttcgcagcccgtggctggactgt

SEQ ID NO: 3143 - DNA, 25 bp, Homo sapien
ccctagtccggcacctgtccctgct

SEQ ID NO: 3144 - DNA, 25 bp, Homo sapien
gccagtatccgagtcctaatttccc

SEQ ID NO: 3145 - DNA, 25 bp, Homo sapien
gggctagcctgacccgctggacaga

SEQ ID NO: 3146 - DNA, 25 bp, Homo sapien
agcgggactcggcgcccgacacgat

SEQ ID NO: 3147 - DNA, 25 bp, Homo sapien
gacacgatgccgaggcctggcacca

SEQ ID NO: 3148 - DNA, 25 bp, Homo sapien
ttgctgccgctcttcgcagccgcca

SEQ ID NO: 3149 - DNA, 25 bp, Homo sapien
ggttcacggagccagtatccgagtc

SEQ ID NO: 3150 - DNA, 25 bp, Homo sapien
ctgggtctctgcgaatgcgtttagt

SEQ ID NO: 3151 - DNA, 25 bp, Homo sapien
cgcccttcctgtctgcgggtgacgg

SEQ ID NO: 3152 - DNA, 25 bp, Homo sapien
acccacctgagaggggcccacgcgc

SEQ ID NO: 3153 - DNA, 25 bp, Homo sapien
accagatggcctcatcctccactcg

SEQ ID NO: 3154 - DNA, 25 bp, Homo sapien
ggatgacggcaagatcggggatccc

SEQ ID NO: 3155 - DNA, 25 bp, Homo sapien
tgcgtttagtaacccgagccgcggc

SEQ ID NO: 3156 - DNA, 25 bp, Homo sapien
ctctgcgaatgcgtttagtaacccg

SEQ ID NO: 3157 - DNA, 25 bp, Homo sapien
gcggcccagcgctccgttacaaagg

SEQ ID NO: 3158 - DNA, 25 bp, Homo sapien
cgcattttcccggagcctaaggagc

SEQ ID NO: 3159 - DNA, 25 bp, Homo sapien
gcggtgacgtcatagccgcgagcga

SEQ ID NO: 3160 - DNA, 25 bp, Homo sapien
acgcgctcctgcgtcagaggcgcac

SEQ ID NO: 3161 - DNA, 25 bp, Homo sapien
gccaggctcaaggccctttccaggg

SEQ ID NO: 3162 - DNA, 25 bp, Homo sapien
ccctctgccggcgtcgaggagcagc

SEQ ID NO: 3163 - DNA, 25 bp, Homo sapien
cgattccgcattttcccggagccta

SEQ ID NO: 3164 - DNA, 25 bp, Homo sapien
gcgagcgcatctccgggcgcggagc

SEQ ID NO: 3165 - DNA, 25 bp, Homo sapien
cattttcccggagcctaaggagcgg

SEQ ID NO: 3166 - DNA, 25 bp, Homo sapien
tccgaatgttctcaggccctaagcg

SEQ ID NO: 3167 - DNA, 25 bp, Homo sapien
gtcttaccggtctccgaatgttctc

SEQ ID NO: 3168 - DNA, 25 bp, Homo sapien
ctcggcaaagagacgggtcttaccg

SEQ ID NO: 3169 - DNA, 25 bp, Homo sapien
ccatcgacgcgaacctcggcaaaga

SEQ ID NO: 3170 - DNA, 25 bp, Homo sapien
ctcggagtcgatgtcattattcgcc

SEQ ID NO: 3171 - DNA, 25 bp, Homo sapien
cgtggacaggttcagcactctcgga

SEQ ID NO: 3172 - DNA, 25 bp, Homo sapien
acgctttctcgttcacttctcattg

SEQ ID NO: 3173 - DNA, 25 bp, Homo sapien
attgcaactccttccgccgcgtgga

SEQ ID NO: 3174 - DNA, 25 bp, Homo sapien
agcccagacaacaaaagcgattgtg

SEQ ID NO: 3175 - DNA, 25 bp, Homo sapien
cgttagaaagctccgccgaaccagc

SEQ ID NO: 3176 - DNA, 25 bp, Homo sapien
gagcccgggacaggaccagacacag

SEQ ID NO: 3177 - DNA, 25 bp, Homo sapien
gttccgggccagataaagccgtctg

SEQ ID NO: 3178 - DNA, 25 bp, Homo sapien
cgggtaagcacatccgcctttcctc

SEQ ID NO: 3179 - DNA, 25 bp, Homo sapien
aagccgtctggttcccacggtccag

SEQ ID NO: 3180 - DNA, 25 bp, Homo sapien
aacaaaagcgattgtgcgggttggc

SEQ ID NO: 3181 - DNA, 25 bp, Homo sapien
acaggccagaggcactgacccgcgg

SEQ ID NO: 3182 - DNA, 25 bp, Homo sapien
ctgctctgggtgtcgctattggtgc

SEQ ID NO: 3183 - DNA, 25 bp, Homo sapien
ggacccggcttccgcgcctgtgagt

SEQ ID NO: 3184 - DNA, 25 bp, Homo sapien
tgggccgaccggctcccgctgtacc

SEQ ID NO: 3185 - DNA, 25 bp, Homo sapien
cctgcgctgcgtccatgggccgacc

SEQ ID NO: 3186 - DNA, 25 bp, Homo sapien
gcgtgcgcttcaccccggtcgtgtg

SEQ ID NO: 3187 - DNA, 25 bp, Homo sapien
tcggagagcgtctccgcgtgcgctt

SEQ ID NO: 3188 - DNA, 25 bp, Homo sapien
gctggcgcagctagggccgcagcct

SEQ ID NO: 3189 - DNA, 25 bp, Homo sapien
tgtcgctattggtgctgctggcgca

SEQ ID NO: 3190 - DNA, 25 bp, Homo sapien
taaggccgagctagaactctaaagc

SEQ ID NO: 3191 - DNA, 25 bp, Homo sapien
gcacagctgtctccagctgttctct

SEQ ID NO: 3192 - DNA, 25 bp, Homo sapien
cccaagggtccggaatgtggagcct

SEQ ID NO: 3193 - DNA, 25 bp, Homo sapien
ctactggaggctgtaaggccgagct

SEQ ID NO: 3194 - DNA, 25 bp, Homo sapien
cagaaagaagttgggcggagacaca

SEQ ID NO: 3195 - DNA, 25 bp, Homo sapien
cggaactagggcacccggacagcct

SEQ ID NO: 3196 - DNA, 25 bp, Homo sapien
cgtgaacaagtgagccgggcgaatc

SEQ ID NO: 3197 - DNA, 25 bp, Homo sapien
tccggaatgtggagcctccgccctg

SEQ ID NO: 3198 - DNA, 25 bp, Homo sapien
gggaggacggctactcagatgcctc

SEQ ID NO: 3199 - DNA, 25 bp, Homo sapien
ttcacgactgtcagctgtgctccga

SEQ ID NO: 3200 - DNA, 25 bp, Homo sapien
actcagatgcctcgggcttcggtta

SEQ ID NO: 3201 - DNA, 25 bp, Homo sapien
cgctccgtgtacactatgccactgg

SEQ ID NO: 3202 - DNA, 25 bp, Homo sapien
ttcggttactgctttcgggagctgc

SEQ ID NO: 3203 - DNA, 25 bp, Homo sapien
tgtagacatccgtttgcccggccgt

SEQ ID NO: 3204 - DNA, 25 bp, Homo sapien
gcgtggcatctatggtgagcgtcca

SEQ ID NO: 3205 - DNA, 25 bp, Homo sapien
gcgccctacacggtgttggcacaga

SEQ ID NO: 3206 - DNA, 25 bp, Homo sapien
ccctccgtgtcctcagatgtggacg

SEQ ID NO: 3207 - DNA, 25 bp, Homo sapien
atgtggacgaatgtcgccgcgtgcc

SEQ ID NO: 3208 - DNA, 25 bp, Homo sapien
aggacgctgcatttcccggcccagc

SEQ ID NO: 3209 - DNA, 25 bp, Homo sapien
ggcacccgatgcattggtgagcaag

SEQ ID NO: 3210 - DNA, 25 bp, Homo sapien
cccagggcacccgatgcattggtga

SEQ ID NO: 3211 - DNA, 25 bp, Homo sapien
gcgcttgcgactctggcttccggct

SEQ ID NO: 3212 - DNA, 25 bp, Homo sapien
gctacacctgcgcttgcgactctgg

SEQ ID NO: 3213 - DNA, 25 bp, Homo sapien
tcaccaggcagcttccgctgcgtgt

SEQ ID NO: 3214 - DNA, 25 bp, Homo sapien
gcgatttctgcttccctcacggcga

SEQ ID NO: 3215 - DNA, 25 bp, Homo sapien
gacctttgccagagcggcatctgta

SEQ ID NO: 3216 - DNA, 25 bp, Homo sapien
tcccgcagacgttgacgagtgcagc

SEQ ID NO: 3217 - DNA, 25 bp, Homo sapien
tagccggggtattccagcaggatca

SEQ ID NO: 3218 - DNA, 25 bp, Homo sapien
ctcacggcgagtgcctcaacactga

SEQ ID NO: 3219 - DNA, 25 bp, Homo sapien
cgcgtaccctagacgtgaacgagtg

SEQ ID NO: 3220 - DNA, 25 bp, Homo sapien
accgacggctccttcgagtgcatct

SEQ ID NO: 3221 - DNA, 25 bp, Homo sapien
gacggctcctttgcctgtacttgtg

SEQ ID NO: 3222 - DNA, 25 bp, Homo sapien
cactgtgggctcttatcactgtacc

SEQ ID NO: 3223 - DNA, 25 bp, Homo sapien
tgggctcttatcactgtacctgcga

SEQ ID NO: 3224 - DNA, 25 bp, Homo sapien
ccccactggtgctggatggctcgca

SEQ ID NO: 3225 - DNA, 25 bp, Homo sapien
agcgccgctgcgtctccaacgagag

SEQ ID NO: 3226 - DNA, 25 bp, Homo sapien
gtctccaacgagagccagagcctcg

SEQ ID NO: 3227 - DNA, 25 bp, Homo sapien
tccttcccttggctcggcctcacac

SEQ ID NO: 3228 - DNA, 25 bp, Homo sapien
acacctttgcgacggccacgccctc

SEQ ID NO: 3229 - DNA, 25 bp, Homo sapien
gctgtgtcaacactgtgggctctta

SEQ ID NO: 3230 - DNA, 25 bp, Homo sapien
cccgcttcgacatgccagactttga

SEQ ID NO: 3231 - DNA, 25 bp, Homo sapien
cgctggccctatcggtcccgggaca

SEQ ID NO: 3232 - DNA, 25 bp, Homo sapien
cctatggcgaatctgaggctcctgc

SEQ ID NO: 3233 - DNA, 25 bp, Homo sapien
ccctatggcgaatctgaggctcctg

SEQ ID NO: 3234 - DNA, 25 bp, Homo sapien
cagactttgaggacgatggtggccc

SEQ ID NO: 3235 - DNA, 25 bp, Homo sapien
gcttcgacatgccagactttgagga

SEQ ID NO: 3236 - DNA, 25 bp, Homo sapien
gaggctccttatggggcaccccgct

SEQ ID NO: 3237 - DNA, 25 bp, Homo sapien
cgacatgccagactttgaggacgat

SEQ ID NO: 3238 - DNA, 25 bp, Homo sapien
cgctgtgcgtcaacgcgcgttgcct

SEQ ID NO: 3239 - DNA, 25 bp, Homo sapien
acctacggacgcctggaagctgcga

SEQ ID NO: 3240 - DNA, 25 bp, Homo sapien
ctggagaagggacctacggacgcct

SEQ ID NO: 3241 - DNA, 25 bp, Homo sapien
ttatgcgtatgtgcacggggccgcc

SEQ ID NO: 3242 - DNA, 25 bp, Homo sapien
cgcgttgcctcaacacggatggctc

SEQ ID NO: 3243 - DNA, 25 bp, Homo sapien
catcaacgagtgtgatgaggccgag

SEQ ID NO: 3244 - DNA, 25 bp, Homo sapien
agcgcctcccactgatgtcgtggtc

SEQ ID NO: 3245 - DNA, 25 bp, Homo sapien
tcctgcagcccgcttatgcgtatgt

SEQ ID NO: 3246 - DNA, 25 bp, Homo sapien
gcttcaccacgctagaggagcgctc

SEQ ID NO: 3247 - DNA, 25 bp, Homo sapien
gcggagcttcccaaagaacgggaga

SEQ ID NO: 3248 - DNA, 25 bp, Homo sapien
caacggagggcggagcttcccaaag

SEQ ID NO: 3249 - DNA, 25 bp, Homo sapien
tgcatcaaaatagcctgcgcggccg

SEQ ID NO: 3250 - DNA, 25 bp, Homo sapien
gtcacccgtggaatgcatcaaaata

SEQ ID NO: 3251 - DNA, 25 bp, Homo sapien
gccggctcccggagaaactgtggcc

SEQ ID NO: 3252 - DNA, 25 bp, Homo sapien
ggcgctgcttcaccacgctagagga

SEQ ID NO: 3253 - DNA, 25 bp, Homo sapien
caaaatcacccaacaggaagcgggg

SEQ ID NO: 3254 - DNA, 25 bp, Homo sapien
caccagcgggtgtaagggacctcct

SEQ ID NO: 3255 - DNA, 25 bp, Homo sapien
ctgcacgcaggtcagcgagttcgct

SEQ ID NO: 3256 - DNA, 25 bp, Homo sapien
cagctctcttgtgcagctgcacgca

SEQ ID NO: 3257 - DNA, 25 bp, Homo sapien
tcacggcgatcttctcagctctctt

SEQ ID NO: 3258 - DNA, 25 bp, Homo sapien
tctccatcagcatcacggcgatctt

SEQ ID NO: 3259 - DNA, 25 bp, Homo sapien
agaccaaggccacgtggtcgccgtc

SEQ ID NO: 3260 - DNA, 25 bp, Homo sapien
accggcttgccatctctcaggggaa

SEQ ID NO: 3261 - DNA, 25 bp, Homo sapien
agcgagttcgctatcgcaccctgcg

SEQ ID NO: 3262 - DNA, 25 bp, Homo sapien
cgctgttgtctgcaggtgttcttca

SEQ ID NO: 3263 - DNA, 25 bp, Homo sapien
ccgagataagcgtctcctgggtgcc

SEQ ID NO: 3264 - DNA, 25 bp, Homo sapien
ggtgttcttcaacggtgccaacgtc

SEQ ID NO: 3265 - DNA, 25 bp, Homo sapien
cgccggatcgttgcattcccatttc

SEQ ID NO: 3266 - DNA, 25 bp, Homo sapien
tgacccattacttagcaggacaggc

SEQ ID NO: 3267 - DNA, 25 bp, Homo sapien
tcagtgcctcacatcagcgccaggt

SEQ ID NO: 3268 - DNA, 25 bp, Homo sapien
ttgaggaccaaagctgcaacttcgg

SEQ ID NO: 3269 - DNA, 25 bp, Homo sapien
tcccatttcgcggatcagtagaatg

SEQ ID NO: 3270 - DNA, 25 bp, Homo sapien
gtgcccttccgcaccgcgtcctcgt

SEQ ID NO: 3271 - DNA, 25 bp, Homo sapien
caggctctgccgtaacttgttcatg

SEQ ID NO: 3272 - DNA, 25 bp, Homo sapien
gggcacgtaggctggcttcctccgc

SEQ ID NO: 3273 - DNA, 25 bp, Homo sapien
acgcctcgggcacgtaggctggctt

SEQ ID NO: 3274 - DNA, 25 bp, Homo sapien
gtcctcgtctgcctgccactggtgc

SEQ ID NO: 3275 - DNA, 25 bp, Homo sapien
gaccgggaagctgcacgtgcccttc

SEQ ID NO: 3276 - DNA, 25 bp, Homo sapien
caccctgaccgggaagctgcacgtg

SEQ ID NO: 3277 - DNA, 25 bp, Homo sapien
cgtaacttgttcatggtgcccgccc

SEQ ID NO: 3278 - DNA, 25 bp, Homo sapien
tcctgatgcgcgatcggttcggctt

SEQ ID NO: 3279 - DNA, 25 bp, Homo sapien
tccgcgtccgaaagagttgcttcta

SEQ ID NO: 3280 - DNA, 25 bp, Homo sapien
ggtgacgaggcactttttgcaagga

SEQ ID NO: 3281 - DNA, 25 bp, Homo sapien
gcctatgaacatcgccgagtccttt

SEQ ID NO: 3282 - DNA, 25 bp, Homo sapien
gccgtatatgcagaaaggtcccgcc

SEQ ID NO: 3283 - DNA, 25 bp, Homo sapien
agttgcttctagaggcgccttgccg

SEQ ID NO: 3284 - DNA, 25 bp, Homo sapien
gtgtgaacagaccaaggcgtcctga

SEQ ID NO: 3285 - DNA, 25 bp, Homo sapien
cccgagctgagcatgcctatgaaca

SEQ ID NO: 3286 - DNA, 25 bp, Homo sapien
gcttccgggagcctctgtatgcccg

SEQ ID NO: 3287 - DNA, 25 bp, Homo sapien
cgttgctaagcacccactgctctca

SEQ ID NO: 3288 - DNA, 25 bp, Homo sapien
gcagcaactcgctgactggcacgga

SEQ ID NO: 3289 - DNA, 25 bp, Homo sapien
aactcgctgactggcacggagtttc

SEQ ID NO: 3290 - DNA, 25 bp, Homo sapien
ggccctagcgatggagcctggaatt

SEQ ID NO: 3291 - DNA, 25 bp, Homo sapien
agcctggaattaaggtgggcatcgg

SEQ ID NO: 3292 - DNA, 25 bp, Homo sapien
tcagcctccgagtccgcaacctgct

SEQ ID NO: 3293 - DNA, 25 bp, Homo sapien
ctggggccctcctgtgcttccggga

SEQ ID NO: 3294 - DNA, 25 bp, Homo sapien
gagtatcggttaacccttgcgcggc

SEQ ID NO: 3295 - DNA, 25 bp, Homo sapien
aagcccgaaccgaaggagcgggcat

SEQ ID NO: 3296 - DNA, 25 bp, Homo sapien
gaacttgtcattcaaccgtgtaggg

SEQ ID NO: 3297 - DNA, 25 bp, Homo sapien
tgtcattcaaccgtgtagggagggt

SEQ ID NO: 3298 - DNA, 25 bp, Homo sapien
cccggtgccctagatgcatacctgg

SEQ ID NO: 3299 - DNA, 25 bp, Homo sapien
cctagatgcatacctggccgcgctt

SEQ ID NO: 3300 - DNA, 25 bp, Homo sapien
gacaaggctccgtctcgttccgttc

SEQ ID NO: 3301 - DNA, 25 bp, Homo sapien
gccgcgcttcggatgctcagaggca

SEQ ID NO: 3302 - DNA, 25 bp, Homo sapien
gaatcgccatttagggtgctccgcc

SEQ ID NO: 3303 - DNA, 25 bp, Homo sapien
catcctggaagtcgtagtaaatctc

SEQ ID NO: 3304 - DNA, 25 bp, Homo sapien
ggcccgtctgaggaaacttgctgct

SEQ ID NO: 3305 - DNA, 25 bp, Homo sapien
cggttgagagaactacggccctgtc

SEQ ID NO: 3306 - DNA, 25 bp, Homo sapien
ctgattggtcaagctactgcgtttc

SEQ ID NO: 3307 - DNA, 25 bp, Homo sapien
gcccattttgcgatcacgtgacaga

SEQ ID NO: 3308 - DNA, 25 bp, Homo sapien
gggcgccgcgataaccactggaaaa

SEQ ID NO: 3309 - DNA, 25 bp, Homo sapien
gcgggtcctacgcacgctttgttgt

SEQ ID NO: 3310 - DNA, 25 bp, Homo sapien
atattgcggccctcagcggccgcga

SEQ ID NO: 3311 - DNA, 25 bp, Homo sapien
gatccaatccggagactcgactctg

SEQ ID NO: 3312 - DNA, 25 bp, Homo sapien
gtactccagactaaatccgttcctc

SEQ ID NO: 3313 - DNA, 25 bp, Homo sapien
tccgttcctcggctcagctaagcag

SEQ ID NO: 3314 - DNA, 25 bp, Homo sapien
agctaagcagctctgcacgtccctt

SEQ ID NO: 3315 - DNA, 25 bp, Homo sapien
acttgctcagccaatcgctgggctc

SEQ ID NO: 3316 - DNA, 25 bp, Homo sapien
ccttcggaaagcgtcgcctggtatc

SEQ ID NO: 3317 - DNA, 25 bp, Homo sapien
tttgggcttggtccttctcacgcca

SEQ ID NO: 3318 - DNA, 25 bp, Homo sapien
ctctcacaggcgagaacgtggagga

SEQ ID NO: 3319 - DNA, 25 bp, Homo sapien
aggatgggctctggcattcagtacg

SEQ ID NO: 3320 - DNA, 25 bp, Homo sapien
attcagtacggggatgcgtccctcc

SEQ ID NO: 3321 - DNA, 25 bp, Homo sapien
cccacaggcgagctagacccggaga

SEQ ID NO: 3322 - DNA, 25 bp, Homo sapien
gggtctccaggcaaccaatgctgac

SEQ ID NO: 3323 - DNA, 25 bp, Homo sapien
caacaagattgactcaggtgaggcc

SEQ ID NO: 3324 - DNA, 25 bp, Homo sapien
gcccgcactatcctcaacaagattg

SEQ ID NO: 3325 - DNA, 25 bp, Homo sapien
gcgttcctcaagtgtgcccgcacta

SEQ ID NO: 3326 - DNA, 25 bp, Homo sapien
gccgacgccacttgattccaacatg

SEQ ID NO: 3327 - DNA, 25 bp, Homo sapien
ggatgcaaatgaacctcgtgtaggc

SEQ ID NO: 3328 - DNA, 25 bp, Homo sapien
gcctccgttataaaagatacttatg

SEQ ID NO: 3329 - DNA, 25 bp, Homo sapien
cgggtaggcctgtccatgtaaatca

SEQ ID NO: 3330 - DNA, 25 bp, Homo sapien
tgtaaatgaagtcacgcgcaccgcg

SEQ ID NO: 3331 - DNA, 25 bp, Homo sapien
tgcgtagccatttctccgtctctca

SEQ ID NO: 3332 - DNA, 25 bp, Homo sapien
ttgcacatcccttctagtccgcgtt

SEQ ID NO: 3333 - DNA, 25 bp, Homo sapien
ccgctgtttcctttctccttggtag

SEQ ID NO: 3334 - DNA, 25 bp, Homo sapien
gcggctgggcagctatgtcatcaac

SEQ ID NO: 3335 - DNA, 25 bp, Homo sapien
cggcatctgcgtcaaggacagcttc

SEQ ID NO: 3336 - DNA, 25 bp, Homo sapien
gccctgcatgcggtactacggcatc

SEQ ID NO: 3337 - DNA, 25 bp, Homo sapien
agctagtgagccagagggcgatccc

SEQ ID NO: 3338 - DNA, 25 bp, Homo sapien
ccatgaaccaggctgtcgaagcatt

SEQ ID NO: 3339 - DNA, 25 bp, Homo sapien
tcgaagcattggtgccctcatggcc

SEQ ID NO: 3340 - DNA, 25 bp, Homo sapien
tcatggcccatgtggacgccgtcat

SEQ ID NO: 3341 - DNA, 25 bp, Homo sapien
cctggactatatcgtgccctgcatg

SEQ ID NO: 3342 - DNA, 25 bp, Homo sapien
acagcccattaaactcctgtcgagg

SEQ ID NO: 3343 - DNA, 25 bp, Homo sapien
gctgggcgtattttacttgagcacg

SEQ ID NO: 3344 - DNA, 25 bp, Homo sapien
gttgctattcacagcacgtcacctc

SEQ ID NO: 3345 - DNA, 25 bp, Homo sapien
cggcgttgctattcacagcacgtca

SEQ ID NO: 3346 - DNA, 25 bp, Homo sapien
ccaagtgtctgccacagcccattaa

SEQ ID NO: 3347 - DNA, 25 bp, Homo sapien
attaaactcctgtcgaggccacctc

SEQ ID NO: 3348 - DNA, 25 bp, Homo sapien
cccggctgggcgtattttacttgag

SEQ ID NO: 3349 - DNA, 25 bp, Homo sapien
gaggccggcgttgctattcacagca

SEQ ID NO: 3350 - DNA, 25 bp, Homo sapien
gccaaaacgggcttctcagaactgc

SEQ ID NO: 3351 - DNA, 25 bp, Homo sapien
ggcagctccacaggacaccgctgga

SEQ ID NO: 3352 - DNA, 25 bp, Homo sapien
tgcgaagagagtgggcaaagtcatc

SEQ ID NO: 3353 - DNA, 25 bp, Homo sapien
ctctgggacctccagtgtgcactcg

SEQ ID NO: 3354 - DNA, 25 bp, Homo sapien
caaagcggtgacagatccgtgactc

SEQ ID NO: 3355 - DNA, 25 bp, Homo sapien
tctgcggctcggatccacttgacct

SEQ ID NO: 3356 - DNA, 25 bp, Homo sapien
tcgcccgtgtctccaaactgctgga

SEQ ID NO: 3357 - DNA, 25 bp, Homo sapien
cgccagtcgcattcgctttcgcttt

SEQ ID NO: 3358 - DNA, 25 bp, Homo sapien
ggggagccggccacgccctatccag

SEQ ID NO: 3359 - DNA, 25 bp, Homo sapien
cgggctttgactcttaggctctttt

SEQ ID NO: 3360 - DNA, 25 bp, Homo sapien
ctcgggctttgactcttaggctctt

SEQ ID NO: 3361 - DNA, 25 bp, Homo sapien
ctctcgggctttgactcttaggctc

SEQ ID NO: 3362 - DNA, 25 bp, Homo sapien
tggctctcgggctttgactcttagg

SEQ ID NO: 3363 - DNA, 25 bp, Homo sapien
tcgttccctttgcttctttaccaga

SEQ ID NO: 3364 - DNA, 25 bp, Homo sapien
acgcgcgcctcgacggtccgcgtac

SEQ ID NO: 3365 - DNA, 25 bp, Homo sapien
ctttgcttctttaccagacctccaa

SEQ ID NO: 3366 - DNA, 25 bp, Homo sapien
agcgttcgaagactgccatggaccc

SEQ ID NO: 3367 - DNA, 25 bp, Homo sapien
aggctcttttctcctgttggctgca

SEQ ID NO: 3368 - DNA, 25 bp, Homo sapien
gcaatggtggcttgaaattcgtcta

SEQ ID NO: 3369 - DNA, 25 bp, Homo sapien
ccagcacggccggttagaaaacaag

SEQ ID NO: 3370 - DNA, 25 bp, Homo sapien
ttggctgcaggatgaacctccattc

SEQ ID NO: 3371 - DNA, 25 bp, Homo sapien
tctcggccgtttgcacctcattagc

SEQ ID NO: 3372 - DNA, 25 bp, Homo sapien
gggcctcactgtttccgcgtgtgaa

SEQ ID NO: 3373 - DNA, 25 bp, Homo sapien
aattgcgcagtgtccaccagcacgg

SEQ ID NO: 3374 - DNA, 25 bp, Homo sapien
ccctggaacgttgatacattataac

SEQ ID NO: 3375 - DNA, 25 bp, Homo sapien
atcgcgaggggtaccagacccgtct

SEQ ID NO: 3376 - DNA, 25 bp, Homo sapien
cactcggattttggatttcggtctc

SEQ ID NO: 3377 - DNA, 25 bp, Homo sapien
cgccctttgaaggagaagcaagtgc

SEQ ID NO: 3378 - DNA, 25 bp, Homo sapien
atttcggtctcgcattccgcggccg

SEQ ID NO: 3379 - DNA, 25 bp, Homo sapien
ctccgggcgcttatgaatggctgcg

SEQ ID NO: 3380 - DNA, 25 bp, Homo sapien
cgctcgcggcttttcccggacgaag

SEQ ID NO: 3381 - DNA, 25 bp, Homo sapien
agcgacctcggagcgccactcggat

SEQ ID NO: 3382 - DNA, 25 bp, Homo sapien
ttcccccattcctgtcgggaatgga

SEQ ID NO: 3383 - DNA, 25 bp, Homo sapien
gaggtagggacccccgcatctgagc

SEQ ID NO: 3384 - DNA, 25 bp, Homo sapien
cccgcatctgagcgcggcacccacc

SEQ ID NO: 3385 - DNA, 25 bp, Homo sapien
ccagcaccagaagccacaacagcag

SEQ ID NO: 3386 - DNA, 25 bp, Homo sapien
aacagcagcgcagcgatacccgcga

SEQ ID NO: 3387 - DNA, 25 bp, Homo sapien
gcctgcaattctccacgcctgcacc

SEQ ID NO: 3388 - DNA, 25 bp, Homo sapien
cacctctatttgatttccaaggggt

SEQ ID NO: 3389 - DNA, 25 bp, Homo sapien
catgcctgcaattctccacgcctgc

SEQ ID NO: 3390 - DNA, 25 bp, Homo sapien
agcgccattgcccagcagagctgca

SEQ ID NO: 3391 - DNA, 25 bp, Homo sapien
tcagcgccattgcccagcagagctg

SEQ ID NO: 3392 - DNA, 25 bp, Homo sapien
ttcagcgccattgcccagcagagct

SEQ ID NO: 3393 - DNA, 25 bp, Homo sapien
attcagcgccattgcccagcagagc

SEQ ID NO: 3394 - DNA, 25 bp, Homo sapien
gattcagcgccattgcccagcagag

SEQ ID NO: 3395 - DNA, 25 bp, Homo sapien
ggattcagcgccattgcccagcaga

SEQ ID NO: 3396 - DNA, 25 bp, Homo sapien
tggattcagcgccattgcccagcag

SEQ ID NO: 3397 - DNA, 25 bp, Homo sapien
cattgcccagcagagctgcaaactc

SEQ ID NO: 3398 - DNA, 25 bp, Homo sapien
gtggcgatggcaaagcgcaggagct

SEQ ID NO: 3399 - DNA, 25 bp, Homo sapien
cactcggggaaccttactcaccgtg

SEQ ID NO: 3400 - DNA, 25 bp, Homo sapien
cggggaaccttactcaccgtgcgtg

SEQ ID NO: 3401 - DNA, 25 bp, Homo sapien
tccggatggcctcgatgaggaagcc

SEQ ID NO: 3402 - DNA, 25 bp, Homo sapien
gcaaagcgcaggagctgcttggcgc

SEQ ID NO: 3403 - DNA, 25 bp, Homo sapien
ctcggggaaccttactcaccgtgcg

SEQ ID NO: 3404 - DNA, 25 bp, Homo sapien
tgcgtgctccggatggcctcgatga

SEQ ID NO: 3405 - DNA, 25 bp, Homo sapien
tcaccgtgcgtgctccggatggcct

SEQ ID NO: 3406 - DNA, 25 bp, Homo sapien
gccttctcctggatacctccttgat

SEQ ID NO: 3407 - DNA, 25 bp, Homo sapien
agacggccttgatgaggaagcccgc

SEQ ID NO: 3408 - DNA, 25 bp, Homo sapien
ccctagacggccttgatgaggaagc

SEQ ID NO: 3409 - DNA, 25 bp, Homo sapien
cgcgcgtgccctagacggccttgat

SEQ ID NO: 3410 - DNA, 25 bp, Homo sapien
gggtgttctgctcaccgcgcgtgcc

SEQ ID NO: 3411 - DNA, 25 bp, Homo sapien
acactcggggtgttctgctcaccgc

SEQ ID NO: 3412 - DNA, 25 bp, Homo sapien
tccacactcggggtgttctgctcac

SEQ ID NO: 3413 - DNA, 25 bp, Homo sapien
ggatacctccttgatgccgcgcttg

SEQ ID NO: 3414 - DNA, 25 bp, Homo sapien
gattcggctcaacagggccctgcct

SEQ ID NO: 3415 - DNA, 25 bp, Homo sapien
ctcctgggcactcgcgctgaatcca

SEQ ID NO: 3416 - DNA, 25 bp, Homo sapien
ctctcgtgctctcgtgtttctctga

SEQ ID NO: 3417 - DNA, 25 bp, Homo sapien
aggggttttggcgtgggcaagcgcg

SEQ ID NO: 3418 - DNA, 25 bp, Homo sapien
cacgcacggtgagtaggggaccccg

SEQ ID NO: 3419 - DNA, 25 bp, Homo sapien
cgggaacccgcgctttctgcctggg

SEQ ID NO: 3420 - DNA, 25 bp, Homo sapien
ctgggattcggctcaacagggccct

SEQ ID NO: 3421 - DNA, 25 bp, Homo sapien
ctctctcgtgctctcgtgtttctct

SEQ ID NO: 3422 - DNA, 25 bp, Homo sapien
ggtgcagcgctttgcagacatcatc

SEQ ID NO: 3423 - DNA, 25 bp, Homo sapien
gcacacacctcttatcagcctggtt

SEQ ID NO: 3424 - DNA, 25 bp, Homo sapien
cttatcagcctggttgccctgtcgc

SEQ ID NO: 3425 - DNA, 25 bp, Homo sapien
cggccatgccttacacagacgcggt

SEQ ID NO: 3426 - DNA, 25 bp, Homo sapien
tacacagacgcggtgatccacgagg

SEQ ID NO: 3427 - DNA, 25 bp, Homo sapien
tgaacttgccgcaccgcgtcactag

SEQ ID NO: 3428 - DNA, 25 bp, Homo sapien
cgctgggagactttgactagacgcc

SEQ ID NO: 3429 - DNA, 25 bp, Homo sapien
cgtcactagggacacggcctttcgc

SEQ ID NO: 3430 - DNA, 25 bp, Homo sapien
gcgcgcatggagctctttctgtacc

SEQ ID NO: 3431 - DNA, 25 bp, Homo sapien
aggcccgcccatgcgggttgctacg

SEQ ID NO: 3432 - DNA, 25 bp, Homo sapien
attcgcctgtgagcgatgaggcccg

SEQ ID NO: 3433 - DNA, 25 bp, Homo sapien
cggcccttccagattcgcctgtgag

SEQ ID NO: 3434 - DNA, 25 bp, Homo sapien
atttgccgcggcctttccagctgtg

SEQ ID NO: 3435 - DNA, 25 bp, Homo sapien
tcaggtcttggcaatttgccgcggc

SEQ ID NO: 3436 - DNA, 25 bp, Homo sapien
tggagctctttctgtacctcaccgc

SEQ ID NO: 3437 - DNA, 25 bp, Homo sapien
gtgcgcccgaggacatcgacctgac

SEQ ID NO: 3438 - DNA, 25 bp, Homo sapien
tccatggaatgagcagccctgagat

SEQ ID NO: 3439 - DNA, 25 bp, Homo sapien
agaattgcaggcatgatgatcgcgg

SEQ ID NO: 3440 - DNA, 25 bp, Homo sapien
aatcaaatagaggtgcaggcgtgga

SEQ ID NO: 3441 - DNA, 25 bp, Homo sapien
atggaatgagcagccctgagatgcc

SEQ ID NO: 3442 - DNA, 25 bp, Homo sapien
ccatggaatgagcagccctgagatg

SEQ ID NO: 3443 - DNA, 25 bp, Homo sapien
aggcatgatgatcgcgggtatcgct

SEQ ID NO: 3444 - DNA, 25 bp, Homo sapien
tgcaggcatgatgatcgcgggtatc

SEQ ID NO: 3445 - DNA, 25 bp, Homo sapien
ttgcaggcatgatgatcgcgggtat

SEQ ID NO: 3446 - DNA, 25 bp, Homo sapien
ggcgtcaacgccagaagcagatgtc

SEQ ID NO: 3447 - DNA, 25 bp, Homo sapien
ccaccaaactttgctcgcgagttgc

SEQ ID NO: 3448 - DNA, 25 bp, Homo sapien
aggcttggcgttgcctccaccaaac

SEQ ID NO: 3449 - DNA, 25 bp, Homo sapien
tccaaacgcagaagagtggtccttg

SEQ ID NO: 3450 - DNA, 25 bp, Homo sapien
cgcggcgattaccttgaatggcaac

SEQ ID NO: 3451 - DNA, 25 bp, Homo sapien
agaacttccagaacgccggccgtca

SEQ ID NO: 3452 - DNA, 25 bp, Homo sapien
aaacgcgcccagtcagcgggaatgc

SEQ ID NO: 3453 - DNA, 25 bp, Homo sapien
cggagcgtcctccacaatgctagtc

SEQ ID NO: 3454 - DNA, 25 bp, Homo sapien
gcctaagattcaaagtcccagagcc

SEQ ID NO: 3455 - DNA, 25 bp, Homo sapien
atacgcggaccatcgaggcgcgtgt

SEQ ID NO: 3456 - DNA, 25 bp, Homo sapien
gcagcaaaacgaacgaagccggccg

SEQ ID NO: 3457 - DNA, 25 bp, Homo sapien
ggtaaggcagcaaaacgaacgaagc

SEQ ID NO: 3458 - DNA, 25 bp, Homo sapien
gtctggtaaggcagcaaaacgaacg

SEQ ID NO: 3459 - DNA, 25 bp, Homo sapien
taagattcaaagtcccagagccagc

SEQ ID NO: 3460 - DNA, 25 bp, Homo sapien
agagcctaagattcaaagtcccaga

SEQ ID NO: 3461 - DNA, 25 bp, Homo sapien
tggaggtctggtaaggcagcaaaac

SEQ ID NO: 3462 - DNA, 25 bp, Homo sapien
tccagctaatgaggtgcaaacggcc

SEQ ID NO: 3463 - DNA, 25 bp, Homo sapien
aggcggcttgtctgctagacgaatt

SEQ ID NO: 3464 - DNA, 25 bp, Homo sapien
gaacgcttcacacgcggaaacagtg

SEQ ID NO: 3465 - DNA, 25 bp, Homo sapien
gtccatggcagtcttcgaacgcttc

SEQ ID NO: 3466 - DNA, 25 bp, Homo sapien
cggggcctaatagagactccagcta

SEQ ID NO: 3467 - DNA, 25 bp, Homo sapien
atggaggttcatcctgcagccaaca

SEQ ID NO: 3468 - DNA, 25 bp, Homo sapien
ctggtggacactgcgcaattttgca

SEQ ID NO: 3469 - DNA, 25 bp, Homo sapien
cttgttttctaaccggccgtgctgg

SEQ ID NO: 3470 - DNA, 25 bp, Homo sapien
aacctgggtgacctcggagacatcc

SEQ ID NO: 3471 - DNA, 25 bp, Homo sapien
ccgacctgccgagatggaggcgacc

SEQ ID NO: 3472 - DNA, 25 bp, Homo sapien
acatccgttggagcatgagttcccg

SEQ ID NO: 3473 - DNA, 25 bp, Homo sapien
ctgtttgcttactccctatccgggg

SEQ ID NO: 3474 - DNA, 25 bp, Homo sapien
tccaggttcttctgtttgcttactc

SEQ ID NO: 3475 - DNA, 25 bp, Homo sapien
ccaggcggccaaagtctctgacttc

SEQ ID NO: 3476 - DNA, 25 bp, Homo sapien
ccacatccgaacaatgagcgaggta

SEQ ID NO: 3477 - DNA, 25 bp, Homo sapien
atgagttcccgacatcaggcggcgg

SEQ ID NO: 3478 - DNA, 25 bp, Homo sapien
attccaaagggttccgcgctcagtc

SEQ ID NO: 3479 - DNA, 25 bp, Homo sapien
gaacagagactccttgcgcctcgtg

SEQ ID NO: 3480 - DNA, 25 bp, Homo sapien
tgtcgggcgtcaacacattgctgta

SEQ ID NO: 3481 - DNA, 25 bp, Homo sapien
gaagccgctccaagaaccacatgtt

SEQ ID NO: 3482 - DNA, 25 bp, Homo sapien
ttccggagagatcccgcttaacttc

SEQ ID NO: 3483 - DNA, 25 bp, Homo sapien
ccactctggttttgagcatctcagc

SEQ ID NO: 3484 - DNA, 25 bp, Homo sapien
gcatctcagcgctcattccaaaggg

SEQ ID NO: 3485 - DNA, 25 bp, Homo sapien
cagtcctcggcactctcgatctgga

SEQ ID NO: 3486 - DNA, 25 bp, Homo sapien
tgtcgggccgttcgccactgacact

SEQ ID NO: 3487 - DNA, 25 bp, Homo sapien
aacaccgccatgtgctggccgctgc

SEQ ID NO: 3488 - DNA, 25 bp, Homo sapien
tggccttgcgtgtgggcgaccacat

SEQ ID NO: 3489 - DNA, 25 bp, Homo sapien
ctcgcccatcacagccggctccttc

SEQ ID NO: 3490 - DNA, 25 bp, Homo sapien
tcagtgacttcctgtcgggccgttc

SEQ ID NO: 3491 - DNA, 25 bp, Homo sapien
gctctccttgcaggtcagtgacttc

SEQ ID NO: 3492 - DNA, 25 bp, Homo sapien
tgacggaccgctctccttgcaggtc

SEQ ID NO: 3493 - DNA, 25 bp, Homo sapien
cgaccacatgatgttcgtgcagctg

SEQ ID NO: 3494 - DNA, 25 bp, Homo sapien
cgggcacctgaccttgtctgggaac

SEQ ID NO: 3495 - DNA, 25 bp, Homo sapien
tctgggaacggccacctaggaagcc

SEQ ID NO: 3496 - DNA, 25 bp, Homo sapien
tctgcagactttgcaccattccact

SEQ ID NO: 3497 - DNA, 25 bp, Homo sapien
ctccgctgacggagaaaaggaaact

SEQ ID NO: 3498 - DNA, 25 bp, Homo sapien
aggaaactttgtgtctgcggatgga

SEQ ID NO: 3499 - DNA, 25 bp, Homo sapien
ctcccttgccaacgcggtgggaaca

SEQ ID NO: 3500 - DNA, 25 bp, Homo sapien
gaggcgtacacgcacggagcaaaca

SEQ ID NO: 3501 - DNA, 25 bp, Homo sapien
gactgtactgtttctcctccgggcg

SEQ ID NO: 3502 - DNA, 25 bp, Homo sapien
cgcgaaggttaatgacggatccgtg

SEQ ID NO: 3503 - DNA, 25 bp, Homo sapien
agagcgcccgttccacgtcaggtac

SEQ ID NO: 3504 - DNA, 25 bp, Homo sapien
aaggctctatggtcgcgtgcagagc

SEQ ID NO: 3505 - DNA, 25 bp, Homo sapien
gtcggtgaacttctggatgtctttc

SEQ ID NO: 3506 - DNA, 25 bp, Homo sapien
acgggaacagccgattagaggattc

SEQ ID NO: 3507 - DNA, 25 bp, Homo sapien
agacgccagacagcccgatttacgg

SEQ ID NO: 3508 - DNA, 25 bp, Homo sapien
caggtacccgaccatagagcaaggc

SEQ ID NO: 3509 - DNA, 25 bp, Homo sapien
tgagcttgtcggtacagacgccaga

SEQ ID NO: 3510 - DNA, 25 bp, Homo sapien
cagtagctcctaggccttctcgtgg

SEQ ID NO: 3511 - DNA, 25 bp, Homo sapien
gaccaattggcactcatgtaacatc

SEQ ID NO: 3512 - DNA, 25 bp, Homo sapien
aacgaacttcgcgaggagctgcagc

SEQ ID NO: 3513 - DNA, 25 bp, Homo sapien
acccgggcacatcaacgaggaggtc

SEQ ID NO: 3514 - DNA, 25 bp, Homo sapien
ctacccgccgccgaaaaggatctgg

SEQ ID NO: 3515 - DNA, 25 bp, Homo sapien
gatcggagaccggaaactgctttct

SEQ ID NO: 3516 - DNA, 25 bp, Homo sapien
tcggcttcgacgtaggccaacgctt

SEQ ID NO: 3517 - DNA, 25 bp, Homo sapien
cgccgtctgaaggtgaacgaacttc

SEQ ID NO: 3518 - DNA, 25 bp, Homo sapien
ctcaggcgaaagtgtctcttgcgtg

SEQ ID NO: 3519 - DNA, 25 bp, Homo sapien
gcggttgaaaagtccgagagaatca

SEQ ID NO: 3520 - DNA, 25 bp, Homo sapien
ccggacccggaacattctcaggcga

SEQ ID NO: 3521 - DNA, 25 bp, Homo sapien
ttgcggtgtctctaggaaatgattc

SEQ ID NO: 3522 - DNA, 25 bp, Homo sapien
gcacgcatgcgcaatgcaacgtctg

SEQ ID NO: 3523 - DNA, 25 bp, Homo sapien
gcaatgcaacgtctgccttaggccc

SEQ ID NO: 3524 - DNA, 25 bp, Homo sapien
cttaggcccggaacttcggtgcctg

SEQ ID NO: 3525 - DNA, 25 bp, Homo sapien
cccgataagggtgagatcttggtca

SEQ ID NO: 3526 - DNA, 25 bp, Homo sapien
cggcccacgtagtacacgatgggca

SEQ ID NO: 3527 - DNA, 25 bp, Homo sapien
cagcctctctcacttcgtctctccc

SEQ ID NO: 3528 - DNA, 25 bp, Homo sapien
taccgcgccagcctctctcacttcg

SEQ ID NO: 3529 - DNA, 25 bp, Homo sapien
tgctggttgtacagggccaggacct

SEQ ID NO: 3530 - DNA, 25 bp, Homo sapien
ttatgctggttgtacagggccagga

SEQ ID NO: 3531 - DNA, 25 bp, Homo sapien
cgcccgggttatgctggttgtacag

SEQ ID NO: 3532 - DNA, 25 bp, Homo sapien
gcgcccgggttatgctggttgtaca

SEQ ID NO: 3533 - DNA, 25 bp, Homo sapien
ccacgtagtacacgatgggcagcgg

SEQ ID NO: 3534 - DNA, 25 bp, Homo sapien
acgcctgggtcctcgcatggatgcc

SEQ ID NO: 3535 - DNA, 25 bp, Homo sapien
ggactttggggtccagactgccagc

SEQ ID NO: 3536 - DNA, 25 bp, Homo sapien
gtccagactgccagcgtttagcgca

SEQ ID NO: 3537 - DNA, 25 bp, Homo sapien
agactgccagcgtttagcgcagcgg

SEQ ID NO: 3538 - DNA, 25 bp, Homo sapien
gcgtttagcgcagcggggtcctcct

SEQ ID NO: 3539 - DNA, 25 bp, Homo sapien
cccttggtggaagcgcaggctcctc

SEQ ID NO: 3540 - DNA, 25 bp, Homo sapien
cctgggtcctcgcatggatgccgac

SEQ ID NO: 3541 - DNA, 25 bp, Homo sapien
tcctcgcatggatgccgacggggcc

SEQ ID NO: 3542 - DNA, 25 bp, Homo sapien
gtgcggctacctcaggctaattctc

SEQ ID NO: 3543 - DNA, 25 bp, Homo sapien
gctaattctccattcgctgcgtgga

SEQ ID NO: 3544 - DNA, 25 bp, Homo sapien
tgcccaagcacagctggacgaaatg

SEQ ID NO: 3545 - DNA, 25 bp, Homo sapien
atcaggagcccaggtgcttgcccaa

SEQ ID NO: 3546 - DNA, 25 bp, Homo sapien
tgtgcagatgatgagcgacccaggt

SEQ ID NO: 3547 - DNA, 25 bp, Homo sapien
gagcccagccctgaagtcgtttcgg

SEQ ID NO: 3548 - DNA, 25 bp, Homo sapien
cgccctttgttctccgggttctgcg

SEQ ID NO: 3549 - DNA, 25 bp, Homo sapien
ctgtggatcaacaaggcggagaacc

SEQ ID NO: 3550 - DNA, 25 bp, Homo sapien
ccagctccatgtcgatagtcttgca

SEQ ID NO: 3551 - DNA, 25 bp, Homo sapien
agagagatccgtctcctggaggaga

SEQ ID NO: 3552 - DNA, 25 bp, Homo sapien
agatgggcgcgatctggtaccagaa

SEQ ID NO: 3553 - DNA, 25 bp, Homo sapien
cacggaaataacctagatgggcgcg

SEQ ID NO: 3554 - DNA, 25 bp, Homo sapien
ggtgtctcagtatcccacggaaata

SEQ ID NO: 3555 - DNA, 25 bp, Homo sapien
ggcgtcagcaccagtagccacagca

SEQ ID NO: 3556 - DNA, 25 bp, Homo sapien
tcccagcggcaacggaaaagtctca

SEQ ID NO: 3557 - DNA, 25 bp, Homo sapien
tagtcttgcaggtggatagtcccgc

SEQ ID NO: 3558 - DNA, 25 bp, Homo sapien
actaattggtgctagccgtctgcgg

SEQ ID NO: 3559 - DNA, 25 bp, Homo sapien
cagcgcatgcgtcattcctacctta

SEQ ID NO: 3560 - DNA, 25 bp, Homo sapien
gcgttatgagttcaggtccgactta

SEQ ID NO: 3561 - DNA, 25 bp, Homo sapien
caagctccataaggcgcatgcgtta

SEQ ID NO: 3562 - DNA, 25 bp, Homo sapien
ccgcctggctgcgagatatgtaagc

SEQ ID NO: 3563 - DNA, 25 bp, Homo sapien
tcgtcttggtttccgtggttgttgc

SEQ ID NO: 3564 - DNA, 25 bp, Homo sapien
ttcatgggcttgactgcttcttttc

SEQ ID NO: 3565 - DNA, 25 bp, Homo sapien
tcgctctgcgcgctactaattggtg

SEQ ID NO: 3566 - DNA, 25 bp, Homo sapien
aagtgtcattgcgagggttcaggaa

SEQ ID NO: 3567 - DNA, 25 bp, Homo sapien
cccttggatcctcggtggcagggtc

SEQ ID NO: 3568 - DNA, 25 bp, Homo sapien
tagagcaaagcgcaaggtcccagcg

SEQ ID NO: 3569 - DNA, 25 bp, Homo sapien
ctgagacccgcgtagagcaaagcgc

SEQ ID NO: 3570 - DNA, 25 bp, Homo sapien
cggctttcagggatccctcgccgga

SEQ ID NO: 3571 - DNA, 25 bp, Homo sapien
cctggacgctgacgtcggctttcag

SEQ ID NO: 3572 - DNA, 25 bp, Homo sapien
aggaacccgttcctggacgctgacg

SEQ ID NO: 3573 - DNA, 25 bp, Homo sapien
gtcattgcgagggttcaggaagccc

SEQ ID NO: 3574 - DNA, 25 bp, Homo sapien
agggctggaccctgttccattttca

SEQ ID NO: 3575 - DNA, 25 bp, Homo sapien
aggctgcgtaaccagtgcgcacgcg

SEQ ID NO: 3576 - DNA, 25 bp, Homo sapien
cgcgcgccgcaaacaggctgcgtaa

SEQ ID NO: 3577 - DNA, 25 bp, Homo sapien
ctgcagttgtcacttccgcctggca

SEQ ID NO: 3578 - DNA, 25 bp, Homo sapien
ccacgtgcggctgcagttgtcactt

SEQ ID NO: 3579 - DNA, 25 bp, Homo sapien
acagcaggttctgttcgcaggcaaa

SEQ ID NO: 3580 - DNA, 25 bp, Homo sapien
tccattttcagcacggattttggcg

SEQ ID NO: 3581 - DNA, 25 bp, Homo sapien
ttttggcgtcagtatgcgtctcctc

SEQ ID NO: 3582 - DNA, 25 bp, Homo sapien
tcaccaggcgcctgcatactgggga

SEQ ID NO: 3583 - DNA, 25 bp, Homo sapien
agatcctgaacgacctcctgagcgc

SEQ ID NO: 3584 - DNA, 25 bp, Homo sapien
atcggcaccatcctgcagatcctga

SEQ ID NO: 3585 - DNA, 25 bp, Homo sapien
cgtcctggacatgcgggactgtgcc

SEQ ID NO: 3586 - DNA, 25 bp, Homo sapien
cgtggacgcccgtcctggacatgcg

SEQ ID NO: 3587 - DNA, 25 bp, Homo sapien
gagctcatgagctcacacccgtgga

SEQ ID NO: 3588 - DNA, 25 bp, Homo sapien
gtccacgccattgcctgagctcatg

SEQ ID NO: 3589 - DNA, 25 bp, Homo sapien
atactggggacgtgtcccgctcccg

SEQ ID NO: 3590 - DNA, 25 bp, Homo sapien
gctcctggttcagcgcgaacttatt

SEQ ID NO: 3591 - DNA, 25 bp, Homo sapien
ggtcttatcccacgctcctggttca

SEQ ID NO: 3592 - DNA, 25 bp, Homo sapien
gccgccatcttgctaaggtttcgta

SEQ ID NO: 3593 - DNA, 25 bp, Homo sapien
ggctctaggaactccggtcacttac

SEQ ID NO: 3594 - DNA, 25 bp, Homo sapien
agcggacttcaaatttggggctcta

SEQ ID NO: 3595 - DNA, 25 bp, Homo sapien
gcgaacttattctcctgtggccacg

SEQ ID NO: 3596 - DNA, 25 bp, Homo sapien
ttctgctctcgtggccgccaacaga

SEQ ID NO: 3597 - DNA, 25 bp, Homo sapien
caacagaggccctgaatgcggaggc

SEQ ID NO: 3598 - DNA, 25 bp, Homo sapien
ggcaaaaatgcgactgcgaccgcga

SEQ ID NO: 3599 - DNA, 25 bp, Homo sapien
cggcaaaaatgcgactgcgaccgcg

SEQ ID NO: 3600 - DNA, 25 bp, Homo sapien
caaaaatgcgactgcgaccgcgacc

SEQ ID NO: 3601 - DNA, 25 bp, Homo sapien
atgcgactgcgaccgcgaccggtct

SEQ ID NO: 3602 - DNA, 25 bp, Homo sapien
gactgcgaccgcgaccggtctcgtg

SEQ ID NO: 3603 - DNA, 25 bp, Homo sapien
accgcgaccggtctcgtgctcgcgc

SEQ ID NO: 3604 - DNA, 25 bp, Homo sapien
cggtctcgtgctcgcgcttccgcgg

SEQ ID NO: 3605 - DNA, 25 bp, Homo sapien
aaatgcgactgcgaccgcgaccggt

SEQ ID NO: 3606 - DNA, 25 bp, Homo sapien
tcttcacagcgctgcagtcaggctc

SEQ ID NO: 3607 - DNA, 25 bp, Homo sapien
acgattcactagaagggccggcctg

SEQ ID NO: 3608 - DNA, 25 bp, Homo sapien
gcgctccgtcggaatgacacagttg

SEQ ID NO: 3609 - DNA, 25 bp, Homo sapien
gatcacttggcgctaacaccctcgg

SEQ ID NO: 3610 - DNA, 25 bp, Homo sapien
acttggatattcagagcgctggaca

SEQ ID NO: 3611 - DNA, 25 bp, Homo sapien
gctcccttgagagagtcacggtttc

SEQ ID NO: 3612 - DNA, 25 bp, Homo sapien
gccgatgcttctttcctgcaggttc

SEQ ID NO: 3613 - DNA, 25 bp, Homo sapien
atccattggcgcgtcactaattaga

SEQ ID NO: 3614 - DNA, 25 bp, Homo sapien
cattggccacctgcctcgaaagggg

SEQ ID NO: 3615 - DNA, 25 bp, Homo sapien
gtggcgcgaggctcaactcgaagcg

SEQ ID NO: 3616 - DNA, 25 bp, Homo sapien
cctgcctcgaaagggggaagacagt

SEQ ID NO: 3617 - DNA, 25 bp, Homo sapien
ccagaaacgaggcaacccgtgcaca

SEQ ID NO: 3618 - DNA, 25 bp, Homo sapien
cccgtgcacagaccgggcttggtca

SEQ ID NO: 3619 - DNA, 25 bp, Homo sapien
cgcgcgaagtcgaggtacaaggcaa

SEQ ID NO: 3620 - DNA, 25 bp, Homo sapien
gcacagaccgggcttggtcaacgcc

SEQ ID NO: 3621 - DNA, 25 bp, Homo sapien
cagcctcggtccaataaggggtact

SEQ ID NO: 3622 - DNA, 25 bp, Homo sapien
tacgcccgacttgtgcgcccgggaa

SEQ ID NO: 3623 - DNA, 25 bp, Homo sapien
ggacggaagatgatagccacatttc

SEQ ID NO: 3624 - DNA, 25 bp, Homo sapien
tgctgaagcaacttccgccctgaga

SEQ ID NO: 3625 - DNA, 25 bp, Homo sapien
ttccagccacgaacgacgcaaacga

SEQ ID NO: 3626 - DNA, 25 bp, Homo sapien
tctctctattacactccgggagaag

SEQ ID NO: 3627 - DNA, 25 bp, Homo sapien
ggggacgaactttcgccctgagaga

SEQ ID NO: 3628 - DNA, 25 bp, Homo sapien
gctctcgcgagctttcggaactctc

SEQ ID NO: 3629 - DNA, 25 bp, Homo sapien
ggtgagctccttcagacccgcagga

SEQ ID NO: 3630 - DNA, 25 bp, Homo sapien
tgaggcccttgtattccaccaccga

SEQ ID NO: 3631 - DNA, 25 bp, Homo sapien
gtcctcgctagggaaatagtccacg

SEQ ID NO: 3632 - DNA, 25 bp, Homo sapien
tggggagaccaccacgatttcgaga

SEQ ID NO: 3633 - DNA, 25 bp, Homo sapien
tgcccgactcgttcttgcagtagcc

SEQ ID NO: 3634 - DNA, 25 bp, Homo sapien
accgagggcagctttccactatttc

SEQ ID NO: 3635 - DNA, 25 bp, Homo sapien
cgggaacactcaccgcaggacgctt

SEQ ID NO: 3636 - DNA, 25 bp, Homo sapien
ggacgctttgccctccttggaatcg

SEQ ID NO: 3637 - DNA, 25 bp, Homo sapien
gcaccggttaggattttcctgcaga

SEQ ID NO: 3638 - DNA, 25 bp, Homo sapien
gaagggcgcaagaccatgagaacca

SEQ ID NO: 3639 - DNA, 25 bp, Homo sapien
agaccatgagaaccacagacgcgga

SEQ ID NO: 3640 - DNA, 25 bp, Homo sapien
tgagaaccacagacgcggaaagccg

SEQ ID NO: 3641 - DNA, 25 bp, Homo sapien
cccagccgggagatgcgagtcccgc

SEQ ID NO: 3642 - DNA, 25 bp, Homo sapien
cgggagcacacccacagaggcgaag

SEQ ID NO: 3643 - DNA, 25 bp, Homo sapien
ccgatggacaaagccggggagagct

SEQ ID NO: 3644 - DNA, 25 bp, Homo sapien
acctccgcgcggacaccaggtactc

SEQ ID NO: 3645 - DNA, 25 bp, Homo sapien
cccgggatcgccgagcccgacctcg

SEQ ID NO: 3646 - DNA, 25 bp, Homo sapien
ggaggagttggacccatctgcacct

SEQ ID NO: 3647 - DNA, 25 bp, Homo sapien
tcgagatacggaaacgctggccctc

SEQ ID NO: 3648 - DNA, 25 bp, Homo sapien
tatctggcctgcgtggcgcagtaca

SEQ ID NO: 3649 - DNA, 25 bp, Homo sapien
ggcgatggcttctctttccacctgg

SEQ ID NO: 3650 - DNA, 25 bp, Homo sapien
agcgggtgtcagaccctgactctgc

SEQ ID NO: 3651 - DNA, 25 bp, Homo sapien
taagacccgccacgtccatgtaaga

SEQ ID NO: 3652 - DNA, 25 bp, Homo sapien
ggtctcgtgtagacccgcctcattc

SEQ ID NO: 3653 - DNA, 25 bp, Homo sapien
tggggtgactaggagatctccgatc

SEQ ID NO: 3654 - DNA, 25 bp, Homo sapien
tgctcgccccgtagaggtgcatgtg

SEQ ID NO: 3655 - DNA, 25 bp, Homo sapien
acctccgccatgacccgcgaggtgg

SEQ ID NO: 3656 - DNA, 25 bp, Homo sapien
atggcaagaccatgctgcggcccgt

SEQ ID NO: 3657 - DNA, 25 bp, Homo sapien
cacgcccgatggcaagaccatgctg

SEQ ID NO: 3658 - DNA, 25 bp, Homo sapien
tcaagtcccatagccggacactgac

SEQ ID NO: 3659 - DNA, 25 bp, Homo sapien
tgctccagcgccaggacgagcggct

SEQ ID NO: 3660 - DNA, 25 bp, Homo sapien
ggcacgccgtgtgagcactgctcgc

SEQ ID NO: 3661 - DNA, 25 bp, Homo sapien
gctgctgctcaagtcccatagccgg

SEQ ID NO: 3662 - DNA, 25 bp, Homo sapien
ctgacgtcggtgatctccagctccg

SEQ ID NO: 3663 - DNA, 25 bp, Homo sapien
atcgccctcgctgtcagagctgcag

SEQ ID NO: 3664 - DNA, 25 bp, Homo sapien
gccctcgctgtcagagctgcagccg

SEQ ID NO: 3665 - DNA, 25 bp, Homo sapien
agccgctgacgtcggtgatctccag

SEQ ID NO: 3666 - DNA, 25 bp, Homo sapien
ccgctgacgtcggtgatctccagct

SEQ ID NO: 3667 - DNA, 25 bp, Homo sapien
gctgacgtcggtgatctccagctcc

SEQ ID NO: 3668 - DNA, 25 bp, Homo sapien
tcagctgccggtcccccctttgccc

SEQ ID NO: 3669 - DNA, 25 bp, Homo sapien
cgctgacgtcggtgatctccagctc

SEQ ID NO: 3670 - DNA, 25 bp, Homo sapien
cacaggtcagccagcggggcgctgc

SEQ ID NO: 3671 - DNA, 25 bp, Homo sapien
catcactaactacgccgctcccagc

SEQ ID NO: 3672 - DNA, 25 bp, Homo sapien
gctacagtccatggcggagccggcc

SEQ ID NO: 3673 - DNA, 25 bp, Homo sapien
cgcagctacagtccatggcggagcc

SEQ ID NO: 3674 - DNA, 25 bp, Homo sapien
agacgcagctacagtccatggcgga

SEQ ID NO: 3675 - DNA, 25 bp, Homo sapien
gtcggagacgcagctacagtccatg

SEQ ID NO: 3676 - DNA, 25 bp, Homo sapien
cactcggtgcctccatcactaacta

SEQ ID NO: 3677 - DNA, 25 bp, Homo sapien
agagaaggtcggagacgcagctaca

SEQ ID NO: 3678 - DNA, 25 bp, Homo sapien
cagagttcgtggtggcttaggatct

SEQ ID NO: 3679 - DNA, 25 bp, Homo sapien
cttctgcagcagaaacggctccgta

SEQ ID NO: 3680 - DNA, 25 bp, Homo sapien
taggatcttcggatcggccaccctc

SEQ ID NO: 3681 - DNA, 25 bp, Homo sapien
ccctgacatcaagtcagagttcgtg

SEQ ID NO: 3682 - DNA, 25 bp, Homo sapien
tgtggaagccagaagtcaaccctga

SEQ ID NO: 3683 - DNA, 25 bp, Homo sapien
ctcgacttcgaggactccgtgtgga

SEQ ID NO: 3684 - DNA, 25 bp, Homo sapien
gcgcggggtccgtaccactggtcac

SEQ ID NO: 3685 - DNA, 25 bp, Homo sapien
gcttcggcagacagaaaaccgcgcc

SEQ ID NO: 3686 - DNA, 25 bp, Homo sapien
gcctcctccggacacgttataacga

SEQ ID NO: 3687 - DNA, 25 bp, Homo sapien
tgcccagccttcgtcctgtgtcagg

SEQ ID NO: 3688 - DNA, 25 bp, Homo sapien
tctgtgcccagccttcgtcctgtgt

SEQ ID NO: 3689 - DNA, 25 bp, Homo sapien
tgccatctcgcagtctctgtgccca

SEQ ID NO: 3690 - DNA, 25 bp, Homo sapien
tctcacacgcgtctctgccatctcg

SEQ ID NO: 3691 - DNA, 25 bp, Homo sapien
ccgccgtgtctcacacgcgtctctg

SEQ ID NO: 3692 - DNA, 25 bp, Homo sapien
tccggacacgttataacgaggagcc

SEQ ID NO: 3693 - DNA, 25 bp, Homo sapien
cgttataacgaggagccgtgggatc

SEQ ID NO: 3694 - DNA, 25 bp, Homo sapien
catccgctccggtccggggagaagt

SEQ ID NO: 3695 - DNA, 25 bp, Homo sapien
ctgccccttacagccggggcggatg

SEQ ID NO: 3696 - DNA, 25 bp, Homo sapien
ggctcggaggcccagcttctcaggc

SEQ ID NO: 3697 - DNA, 25 bp, Homo sapien
tttcgcatccgctccggtccgggga

SEQ ID NO: 3698 - DNA, 25 bp, Homo sapien
gtttaaagttcggatcccgcagcca

SEQ ID NO: 3699 - DNA, 25 bp, Homo sapien
agtgtttaaagttcggatcccgcag

SEQ ID NO: 3700 - DNA, 25 bp, Homo sapien
tgggcttttcgcatccgctccggtc

SEQ ID NO: 3701 - DNA, 25 bp, Homo sapien
taaagttcggatcccgcagccatgg

SEQ ID NO: 3702 - DNA, 25 bp, Homo sapien
atgaaaaatagcaggcatcggagcc

SEQ ID NO: 3703 - DNA, 25 bp, Homo sapien
tgggacatgacaggtgcgatcaata

SEQ ID NO: 3704 - DNA, 25 bp, Homo sapien
tagcaggcatcggagccggccttca

SEQ ID NO: 3705 - DNA, 25 bp, Homo sapien
ggagccggccttcagcttcgattag

SEQ ID NO: 3706 - DNA, 25 bp, Homo sapien
ggctgcggtggaattatgaaaaata

SEQ ID NO: 3707 - DNA, 25 bp, Homo sapien
ccggccttcagcttcgattagggga

SEQ ID NO: 3708 - DNA, 25 bp, Homo sapien
cttcagcttcgattaggggagatgg

SEQ ID NO: 3709 - DNA, 25 bp, Homo sapien
gtcggctgcggtggaattatgaaaa

SEQ ID NO: 3710 - DNA, 25 bp, Homo sapien
taaacaacacgggacgagaagaggc

SEQ ID NO: 3711 - DNA, 25 bp, Homo sapien
gaaagattcatcttctcccaggcag

SEQ ID NO: 3712 - DNA, 25 bp, Homo sapien
gcgacagattgagcgatgagacgca

SEQ ID NO: 3713 - DNA, 25 bp, Homo sapien
tgagacgcattacgcacttaatccg

SEQ ID NO: 3714 - DNA, 25 bp, Homo sapien
taatccgcctgattgaatgttttgc

SEQ ID NO: 3715 - DNA, 25 bp, Homo sapien
ttcgcccaaattgaaacattaaaca

SEQ ID NO: 3716 - DNA, 25 bp, Homo sapien
aggcggccgcaaatcactcatgaaa

SEQ ID NO: 3717 - DNA, 25 bp, Homo sapien
gaatgttttgctttcgcccaaattg

SEQ ID NO: 3718 - DNA, 25 bp, Homo sapien
ggaagttcgcgccagaaactgaaac

SEQ ID NO: 3719 - DNA, 25 bp, Homo sapien
caccgtgcaacttcggaacggcgga

SEQ ID NO: 3720 - DNA, 25 bp, Homo sapien
agacatagcgccaattcaccgtgca

SEQ ID NO: 3721 - DNA, 25 bp, Homo sapien
gccgccttacgttggacggagttga

SEQ ID NO: 3722 - DNA, 25 bp, Homo sapien
tcaacaatttaaggtgcggcgaggg

SEQ ID NO: 3723 - DNA, 25 bp, Homo sapien
agtgggagcactttgtcaacaattt

SEQ ID NO: 3724 - DNA, 25 bp, Homo sapien
gtcgtacggctccagccacaaagtg

SEQ ID NO: 3725 - DNA, 25 bp, Homo sapien
gggcgcaatcaaagcacgcggagtc

SEQ ID NO: 3726 - DNA, 25 bp, Homo sapien
cggattcacagttgggagctccctc

SEQ ID NO: 3727 - DNA, 25 bp, Homo sapien
ctgtctcatcgggtctcggccgaga

SEQ ID NO: 3728 - DNA, 25 bp, Homo sapien
gataaatcttcatcaggcggcggcg

SEQ ID NO: 3729 - DNA, 25 bp, Homo sapien
catttccgcttcaaacctttggagg

SEQ ID NO: 3730 - DNA, 25 bp, Homo sapien
ttcggtcgcagagccagtttagaac

SEQ ID NO: 3731 - DNA, 25 bp, Homo sapien
cgcggagaacgtgaatagaagtccc

SEQ ID NO: 3732 - DNA, 25 bp, Homo sapien
cacagcactagggtcggattcacag

SEQ ID NO: 3733 - DNA, 25 bp, Homo sapien
gttccggggccgataaatcttcatc

SEQ ID NO: 3734 - DNA, 25 bp, Homo sapien
atcagcttcggcagcagggtcctgc

SEQ ID NO: 3735 - DNA, 25 bp, Homo sapien
tcccattagaggagaccggggccaa

SEQ ID NO: 3736 - DNA, 25 bp, Homo sapien
gccaacacttctgcggctcggggct

SEQ ID NO: 3737 - DNA, 25 bp, Homo sapien
ttccgcctcggcatctttctgctgg

SEQ ID NO: 3738 - DNA, 25 bp, Homo sapien
gactgtagttctgccgccgagtatt

SEQ ID NO: 3739 - DNA, 25 bp, Homo sapien
tgctggtccacgaaggtgctccagg

SEQ ID NO: 3740 - DNA, 25 bp, Homo sapien
tataatcccagaaagtgacggcgcg

SEQ ID NO: 3741 - DNA, 25 bp, Homo sapien
ggcggtctgactcgcaaaacacctt

SEQ ID NO: 3742 - DNA, 25 bp, Homo sapien
agacgcgatcgcagactttcagaca

SEQ ID NO: 3743 - DNA, 25 bp, Homo sapien
agactttcagacaccacggggccca

SEQ ID NO: 3744 - DNA, 25 bp, Homo sapien
agccagcagctctcatacgcacatg

SEQ ID NO: 3745 - DNA, 25 bp, Homo sapien
gtgcacatgcaaccgcacaaggtca

SEQ ID NO: 3746 - DNA, 25 bp, Homo sapien
agggctggcccacaacctcgcggat

SEQ ID NO: 3747 - DNA, 25 bp, Homo sapien
aagccatgccaacgtgcgccacaga

SEQ ID NO: 3748 - DNA, 25 bp, Homo sapien
accacatggattggctgggtcagcc

SEQ ID NO: 3749 - DNA, 25 bp, Homo sapien
cacaatgtcacacggaagcggcgcc

SEQ ID NO: 3750 - DNA, 25 bp, Homo sapien
caaccagggtctgagacgcagaagg

SEQ ID NO: 3751 - DNA, 25 bp, Homo sapien
ggcacgcaaccagggtctgagacgc

SEQ ID NO: 3752 - DNA, 25 bp, Homo sapien
cgccgcccaggaacgggcgcagcct

SEQ ID NO: 3753 - DNA, 25 bp, Homo sapien
caggctggccaactgggtgctgaac

SEQ ID NO: 3754 - DNA, 25 bp, Homo sapien
ctcaggctggccaactgggtgctga

SEQ ID NO: 3755 - DNA, 25 bp, Homo sapien
acgcaaccagggtctgagacgcaga

SEQ ID NO: 3756 - DNA, 25 bp, Homo sapien
cgcaaccagggtctgagacgcagaa

SEQ ID NO: 3757 - DNA, 25 bp, Homo sapien
gtctgagacgcagaaggggacgggt

SEQ ID NO: 3758 - DNA, 25 bp, Homo sapien
tggatgcgccggcactcctggcaga

SEQ ID NO: 3759 - DNA, 25 bp, Homo sapien
tggagtcctcggttcctgcgccctt

SEQ ID NO: 3760 - DNA, 25 bp, Homo sapien
caagaaacggcgtggcgcagctcct

SEQ ID NO: 3761 - DNA, 25 bp, Homo sapien
ggaacgcgacgtcttgcggcaagaa

SEQ ID NO: 3762 - DNA, 25 bp, Homo sapien
ttgccgttgctgaggcgcatctcgc

SEQ ID NO: 3763 - DNA, 25 bp, Homo sapien
ccggccgagtagagcttgccgttgc

SEQ ID NO: 3764 - DNA, 25 bp, Homo sapien
accaaaggcaaaatcgcggcgtccg

SEQ ID NO: 3765 - DNA, 25 bp, Homo sapien
actcctggcagacgcgcacgtgggt

SEQ ID NO: 3766 - DNA, 25 bp, Homo sapien
tgctcttgacgaacacgctgggctg

SEQ ID NO: 3767 - DNA, 25 bp, Homo sapien
tgccaatgccgtagcccttggtgtc

SEQ ID NO: 3768 - DNA, 25 bp, Homo sapien
ccggtggtattcgttcatggtggac

SEQ ID NO: 3769 - DNA, 25 bp, Homo sapien
ttcgttcatggtggactcgagcagg

SEQ ID NO: 3770 - DNA, 25 bp, Homo sapien
cgggcaatgccctcttctgtgctct

SEQ ID NO: 3771 - DNA, 25 bp, Homo sapien
gggctgcttcgactgcatgtagttc

SEQ ID NO: 3772 - DNA, 25 bp, Homo sapien
tgtgccgtacccagcggcatgccaa

SEQ ID NO: 3773 - DNA, 25 bp, Homo sapien
tccacatgcgctggtacgtttggta

SEQ ID NO: 3774 - DNA, 25 bp, Homo sapien
gaaggaggatgttgtctgaagcacc

SEQ ID NO: 3775 - DNA, 25 bp, Homo sapien
ctgaagcacctgctgaatcacaggg

SEQ ID NO: 3776 - DNA, 25 bp, Homo sapien
cgaagcctccagaaggcgggacttc

SEQ ID NO: 3777 - DNA, 25 bp, Homo sapien
cagtagcagcgcgacgaagcctcca

SEQ ID NO: 3778 - DNA, 25 bp, Homo sapien
cattggtgatcgcaccgctcgctca

SEQ ID NO: 3779 - DNA, 25 bp, Homo sapien
ccaccagcggggaagcctcattggt

SEQ ID NO: 3780 - DNA, 25 bp, Homo sapien
cgccgcgaaaggagcctgacgtcac

SEQ ID NO: 3781 - DNA, 25 bp, Homo sapien
cccaaccattgaggaaaaagctgaa

SEQ ID NO: 3782 - DNA, 25 bp, Homo sapien
cagaagccctcgaagcgttcgttcc

SEQ ID NO: 3783 - DNA, 25 bp, Homo sapien
aaccatgcccgtccaggagccgttg

SEQ ID NO: 3784 - DNA, 25 bp, Homo sapien
tgatgagctcgccaaccatgcccgt

SEQ ID NO: 3785 - DNA, 25 bp, Homo sapien
catacccggttgatgagctcgccaa

SEQ ID NO: 3786 - DNA, 25 bp, Homo sapien
tcactcgccgggtccatgcatcttt

SEQ ID NO: 3787 - DNA, 25 bp, Homo sapien
tccaccaaccgcaggcggtagcgga

SEQ ID NO: 3788 - DNA, 25 bp, Homo sapien
agcatgtccacgcagaagccctcga

SEQ ID NO: 3789 - DNA, 25 bp, Homo sapien
ccagtccagccatacccggttgatg

SEQ ID NO: 3790 - DNA, 25 bp, Homo sapien
aaggggcgggcactatccacccgag

SEQ ID NO: 3791 - DNA, 25 bp, Homo sapien
catgaacgtcgattggccgaacggc

SEQ ID NO: 3792 - DNA, 25 bp, Homo sapien
gcctcagagacatgaacgtcgattg

SEQ ID NO: 3793 - DNA, 25 bp, Homo sapien
tcactattggcccaagcctcagaga

SEQ ID NO: 3794 - DNA, 25 bp, Homo sapien
ggaatctcgacgctcctcactattg

SEQ ID NO: 3795 - DNA, 25 bp, Homo sapien
ctatccacccgagggctgaccggtg

SEQ ID NO: 3796 - DNA, 25 bp, Homo sapien
gcaatgattggttgcgtccggccgt

SEQ ID NO: 3797 - DNA, 25 bp, Homo sapien
tgaccggtgagggaacgacgctaaa

SEQ ID NO: 3798 - DNA, 25 bp, Homo sapien
gctccttcttgctgcgtcggctgct

SEQ ID NO: 3799 - DNA, 25 bp, Homo sapien
atgcaccgctaccatcacacaggtg

SEQ ID NO: 3800 - DNA, 25 bp, Homo sapien
cgctaccatcacacaggtgaatacc

SEQ ID NO: 3801 - DNA, 25 bp, Homo sapien
ggtgaatacccctacaagtgtcgcg

SEQ ID NO: 3802 - DNA, 25 bp, Homo sapien
tacaagtgtcgcgagtgcccccgct

SEQ ID NO: 3803 - DNA, 25 bp, Homo sapien
aggtgcaccagctcgtggtccatgc

SEQ ID NO: 3804 - DNA, 25 bp, Homo sapien
tcaccgtccttaccgcctgctcatg

SEQ ID NO: 3805 - DNA, 25 bp, Homo sapien
agctcgtggtccatgccgggcgcca

SEQ ID NO: 3806 - DNA, 25 bp, Homo sapien
tgctgcaacttttcccgagcctttc

SEQ ID NO: 3807 - DNA, 25 bp, Homo sapien
ctgcgctggatttcctccgagtttg

SEQ ID NO: 3808 - DNA, 25 bp, Homo sapien
ggcgcgtggactagccataaaactc

SEQ ID NO: 3809 - DNA, 25 bp, Homo sapien
tttcccagctcgtgtggtcctactg

SEQ ID NO: 3810 - DNA, 25 bp, Homo sapien
actggaagtggccaaagctcatttc

SEQ ID NO: 3811 - DNA, 25 bp, Homo sapien
ggaaactttgcgtcccagggccgca

SEQ ID NO: 3812 - DNA, 25 bp, Homo sapien
ccagtcattggccttttgtgctgca

SEQ ID NO: 3813 - DNA, 25 bp, Homo sapien
tttggcagttgcgactccgaacgaa

SEQ ID NO: 3814 - DNA, 25 bp, Homo sapien
tgagcggccatacccatgtccagac

SEQ ID NO: 3815 - DNA, 25 bp, Homo sapien
ctgttcagcacagagacgtcactgc

SEQ ID NO: 3816 - DNA, 25 bp, Homo sapien
gcaaagcgttccgtcagagtaccca

SEQ ID NO: 3817 - DNA, 25 bp, Homo sapien
atgtccagactgtggcaaagcgttc

SEQ ID NO: 3818 - DNA, 25 bp, Homo sapien
ggcaaggcctttgccatctccatgc

SEQ ID NO: 3819 - DNA, 25 bp, Homo sapien
tgcgcctggcagaacatcgccgcat

SEQ ID NO: 3820 - DNA, 25 bp, Homo sapien
agcgagtgcaagaagctgttcagca

SEQ ID NO: 3821 - DNA, 25 bp, Homo sapien
agagtacccacctgaaagaccaccg

SEQ ID NO: 3822 - DNA, 25 bp, Homo sapien
gcatcgttgagccacttctccagga

SEQ ID NO: 3823 - DNA, 25 bp, Homo sapien
tccttctccatgtgcagctgctcgg

SEQ ID NO: 3824 - DNA, 25 bp, Homo sapien
cggcgatcagcaggatctcctctga

SEQ ID NO: 3825 - DNA, 25 bp, Homo sapien
ctcctctgaggtaggcttctggttc

SEQ ID NO: 3826 - DNA, 25 bp, Homo sapien
gggcctcaccgctagaaaactcttc

SEQ ID NO: 3827 - DNA, 25 bp, Homo sapien
gggcaggcttgagtccacagacata

SEQ ID NO: 3828 - DNA, 25 bp, Homo sapien
aagtcgttgccgtagagcttgccca

SEQ ID NO: 3829 - DNA, 25 bp, Homo sapien
cgtttgtctcgatgctggtcctctt

SEQ ID NO: 3830 - DNA, 25 bp, Homo sapien
gccctcttcctcttggtgcccgagg

SEQ ID NO: 3831 - DNA, 25 bp, Homo sapien
gcaccgcagctcagacaaaggcgcg

SEQ ID NO: 3832 - DNA, 25 bp, Homo sapien
agggtcacacaaaggcgcaggactc

SEQ ID NO: 3833 - DNA, 25 bp, Homo sapien
acacctgcgagggtcacacaaaggc

SEQ ID NO: 3834 - DNA, 25 bp, Homo sapien
cgcacacctgcgagggtcacacaaa

SEQ ID NO: 3835 - DNA, 25 bp, Homo sapien
ccaacacctccgctcgcacacctgc

SEQ ID NO: 3836 - DNA, 25 bp, Homo sapien
gctcccatttcagcgcttccctccg

SEQ ID NO: 3837 - DNA, 25 bp, Homo sapien
gcggctccagtggaggggagcacca

SEQ ID NO: 3838 - DNA, 25 bp, Homo sapien
cggtaggcgccgctgtcttcgccat

SEQ ID NO: 3839 - DNA, 25 bp, Homo sapien
taggcgccgctgtcttcgccatgcg

SEQ ID NO: 3840 - DNA, 25 bp, Homo sapien
cgctgtcttcgccatgcgcgtcagc

SEQ ID NO: 3841 - DNA, 25 bp, Homo sapien
atgcgcgtcagctgcacggctccga

SEQ ID NO: 3842 - DNA, 25 bp, Homo sapien
tcagctgcacggctccgaggggatg

SEQ ID NO: 3843 - DNA, 25 bp, Homo sapien
tcctcgcctgagctgccggcgcgag

SEQ ID NO: 3844 - DNA, 25 bp, Homo sapien
tgcgcgtcagctgcacggctccgag

SEQ ID NO: 3845 - DNA, 25 bp, Homo sapien
tgctcccatcggtaggcgccgctgt

SEQ ID NO: 3846 - DNA, 25 bp, Homo sapien
ttcccgccaagtgcactgcgccagc

SEQ ID NO: 3847 - DNA, 25 bp, Homo sapien
ctcaagggagctccacggcgcatgc

SEQ ID NO: 3848 - DNA, 25 bp, Homo sapien
tcttgactagctcaagggagctcca

SEQ ID NO: 3849 - DNA, 25 bp, Homo sapien
gcccgcactcttgactagctcaagg

SEQ ID NO: 3850 - DNA, 25 bp, Homo sapien
ttgtcctccgggctcagatctgacc

SEQ ID NO: 3851 - DNA, 25 bp, Homo sapien
tctacccgatgctcccagggttgtc

SEQ ID NO: 3852 - DNA, 25 bp, Homo sapien
cacgatcctgtttctctacccgatg

SEQ ID NO: 3853 - DNA, 25 bp, Homo sapien
atctcccatgggctccgatctcctg

SEQ ID NO: 3854 - DNA, 25 bp, Homo sapien
tcatagtcagcctcatccacactga

SEQ ID NO: 3855 - DNA, 25 bp, Homo sapien
gcgtccagataggagagctctgaga

SEQ ID NO: 3856 - DNA, 25 bp, Homo sapien
agagctctgagaacttgatgtcaca

SEQ ID NO: 3857 - DNA, 25 bp, Homo sapien
ttgatgtcacaaaccacagagccca

SEQ ID NO: 3858 - DNA, 25 bp, Homo sapien
aaggctggcccatgctcgcagtact

SEQ ID NO: 3859 - DNA, 25 bp, Homo sapien
cgcagtactctgctcgaacccggag

SEQ ID NO: 3860 - DNA, 25 bp, Homo sapien
cccagaaggcgtccagataggagag

SEQ ID NO: 3861 - DNA, 25 bp, Homo sapien
tccacactgaccagcaggcgaacag

SEQ ID NO: 3862 - DNA, 25 bp, Homo sapien
ggtgaagcgacagcatcccgtagta

SEQ ID NO: 3863 - DNA, 25 bp, Homo sapien
agctccagctcgcactcggtcagtt

SEQ ID NO: 3864 - DNA, 25 bp, Homo sapien
accaccgtgctacgttcggagctcg

SEQ ID NO: 3865 - DNA, 25 bp, Homo sapien
cgcaagtggtacctcccgaaagtga

SEQ ID NO: 3866 - DNA, 25 bp, Homo sapien
ccagattctggcgtccgatgactcc

SEQ ID NO: 3867 - DNA, 25 bp, Homo sapien
cggccgcagccacttgttttggatc

SEQ ID NO: 3868 - DNA, 25 bp, Homo sapien
ccaggagcctcatccagcagaaagg

SEQ ID NO: 3869 - DNA, 25 bp, Homo sapien
ctgaccaaacgatgcggcccaaaca

SEQ ID NO: 3870 - DNA, 25 bp, Homo sapien
tcatgaatataagacgcaggcgcgc

SEQ ID NO: 3871 - DNA, 25 bp, Homo sapien
ttcctcgtctgccacgtcgtgcttt

SEQ ID NO: 3872 - DNA, 25 bp, Homo sapien
cccgttctagtgtggttcctcgtct

SEQ ID NO: 3873 - DNA, 25 bp, Homo sapien
ctcgtaaatcttgggtaggcgtggc

SEQ ID NO: 3874 - DNA, 25 bp, Homo sapien
caacgcttttgcttaccgagcctta

SEQ ID NO: 3875 - DNA, 25 bp, Homo sapien
gctgtcttcccgcttgcgtcaggga

SEQ ID NO: 3876 - DNA, 25 bp, Homo sapien
cggactgcaaacgtctcggccaata

SEQ ID NO: 3877 - DNA, 25 bp, Homo sapien
ggaggtatccacacaccaacgcttt

SEQ ID NO: 3878 - DNA, 25 bp, Homo sapien
caagcttgtgtctctgtactctgcc

SEQ ID NO: 3879 - DNA, 25 bp, Homo sapien
gcctctgccaggacggtcctatttc

SEQ ID NO: 3880 - DNA, 25 bp, Homo sapien
tgcactcgcacatagctacacattc

SEQ ID NO: 3881 - DNA, 25 bp, Homo sapien
gtgcacacacctccaagactgcgtg

SEQ ID NO: 3882 - DNA, 25 bp, Homo sapien
acctccttgggttgcacacacagcg

SEQ ID NO: 3883 - DNA, 25 bp, Homo sapien
cacatatgctctgtgggtcccggca

SEQ ID NO: 3884 - DNA, 25 bp, Homo sapien
taagcgcacactttggagtccaagc

SEQ ID NO: 3885 - DNA, 25 bp, Homo sapien
agacgggttcctgtgtctttgcaca

SEQ ID NO: 3886 - DNA, 25 bp, Homo sapien
cggcgcttcgcaaaaccaggaaaag

SEQ ID NO: 3887 - DNA, 25 bp, Homo sapien
ttacgcaattatgcaggggccgctg

SEQ ID NO: 3888 - DNA, 25 bp, Homo sapien
ctctgggtcagagaacgtccaccgc

SEQ ID NO: 3889 - DNA, 25 bp, Homo sapien
cggtgctgatgtctctctcctttaa

SEQ ID NO: 3890 - DNA, 25 bp, Homo sapien
atttccctgggatgagcagcaaagc

SEQ ID NO: 3891 - DNA, 25 bp, Homo sapien
cagcttgtcagcagagggtcatccc

SEQ ID NO: 3892 - DNA, 25 bp, Homo sapien
ggtcatccctccgaagactttctgg

SEQ ID NO: 3893 - DNA, 25 bp, Homo sapien
cgcttaataactaggcactggctga

SEQ ID NO: 3894 - DNA, 25 bp, Homo sapien
tagcccgggagcgacccagagaaat

SEQ ID NO: 3895 - DNA, 25 bp, Homo sapien
gtcccacacgcctggagccgagggt

SEQ ID NO: 3896 - DNA, 25 bp, Homo sapien
tgtgcgtggataactcccagagccc

SEQ ID NO: 3897 - DNA, 25 bp, Homo sapien
cctgtgtggcaacacgcaggcgcaa

SEQ ID NO: 3898 - DNA, 25 bp, Homo sapien
ggctctgattggtcgccacgggtaa

SEQ ID NO: 3899 - DNA, 25 bp, Homo sapien
tgggcccaacgctcaccaaaggttg

SEQ ID NO: 3900 - DNA, 25 bp, Homo sapien
aaggttgcccgagtttctctacaga

SEQ ID NO: 3901 - DNA, 25 bp, Homo sapien
tctctacagaacttgccgacgctta

SEQ ID NO: 3902 - DNA, 25 bp, Homo sapien
gtgcacgtccctaccaatgcctgga

SEQ ID NO: 3903 - DNA, 25 bp, Homo sapien
tgcgactgcatcagcgggtccatgc

SEQ ID NO: 3904 - DNA, 25 bp, Homo sapien
cagccagtgtcagcgcagtttcagc

SEQ ID NO: 3905 - DNA, 25 bp, Homo sapien
gggaagcccgctacctctgtgtaga

SEQ ID NO: 3906 - DNA, 25 bp, Homo sapien
cggctttggcacagaactcacgttg

SEQ ID NO: 3907 - DNA, 25 bp, Homo sapien
ttcaagaagctgatccacgtgcgca

SEQ ID NO: 3908 - DNA, 25 bp, Homo sapien
gtggcaagcgcttcacacagagctc

SEQ ID NO: 3909 - DNA, 25 bp, Homo sapien
tgcatcgctgtcgttgcggcaagac

SEQ ID NO: 3910 - DNA, 25 bp, Homo sapien
gctgctcggcgatgatgacatcatc

SEQ ID NO: 3911 - DNA, 25 bp, Homo sapien
tcatcgtgtcacacacaggagccgg

SEQ ID NO: 3912 - DNA, 25 bp, Homo sapien
gagaagagcctttcggaccacaccg

SEQ ID NO: 3913 - DNA, 25 bp, Homo sapien
tagcttgcacgccagggcacagcga

SEQ ID NO: 3914 - DNA, 25 bp, Homo sapien
acctgaacctggaggcttccgaggc

SEQ ID NO: 3915 - DNA, 25 bp, Homo sapien
tccgaggcaatgtaagtgctccgcc

SEQ ID NO: 3916 - DNA, 25 bp, Homo sapien
tcaaagctacacaatgcgggcggtc

SEQ ID NO: 3917 - DNA, 25 bp, Homo sapien
cccgcgatggagctttgtgaagatg

SEQ ID NO: 3918 - DNA, 25 bp, Homo sapien
cacgccgggaaatgaagtccacaaa

SEQ ID NO: 3919 - DNA, 25 bp, Homo sapien
cctcagagtagaccgcgggaatgat

SEQ ID NO: 3920 - DNA, 25 bp, Homo sapien
acgccctcaccgcattgcaggtgta

SEQ ID NO: 3921 - DNA, 25 bp, Homo sapien
ctattagctgtgtatgcctcccaga

SEQ ID NO: 3922 - DNA, 25 bp, Homo sapien
cggagtccactcactcagtctatta

SEQ ID NO: 3923 - DNA, 25 bp, Homo sapien
cagggtaatctgtcagccgactgta

SEQ ID NO: 3924 - DNA, 25 bp, Homo sapien
cgggtcacgctgtacgtcgggaaat

SEQ ID NO: 3925 - DNA, 25 bp, Homo sapien
gtttacgcgctcctctttccaggta

SEQ ID NO: 3926 - DNA, 25 bp, Homo sapien
gcaggatagcgagggttatttaacc

SEQ ID NO: 3927 - DNA, 25 bp, Homo sapien
ccaagacggctcaaaagggcggcga

SEQ ID NO: 3928 - DNA, 25 bp, Homo sapien
gcctagggattccaacgcgggacca

SEQ ID NO: 3929 - DNA, 25 bp, Homo sapien
ctgccctctgatggcagctctgagt

SEQ ID NO: 3930 - DNA, 25 bp, Homo sapien
gccaaatggtacctgctgccctctg

SEQ ID NO: 3931 - DNA, 25 bp, Homo sapien
ggagttgcagtttcccagccaaatg

SEQ ID NO: 3932 - DNA, 25 bp, Homo sapien
cccagaaggcaaagtgcggaacact

SEQ ID NO: 3933 - DNA, 25 bp, Homo sapien
gccaaagcctgttgagactacatta

SEQ ID NO: 3934 - DNA, 25 bp, Homo sapien
tcccggtagggatacaggaccaaga

SEQ ID NO: 3935 - DNA, 25 bp, Homo sapien
gccgcgcgttctaaggtcggaaaca

SEQ ID NO: 3936 - DNA, 25 bp, Homo sapien
ctttttcgaacgttcgggctgcgct

SEQ ID NO: 3937 - DNA, 25 bp, Homo sapien
gctttggaactttgcgactcggcga

SEQ ID NO: 3938 - DNA, 25 bp, Homo sapien
cccagagtgcaacgtgacaagagcg

SEQ ID NO: 3939 - DNA, 25 bp, Homo sapien
cggagccaccttaaagccgcgcgtt

SEQ ID NO: 3940 - DNA, 25 bp, Homo sapien
aacaagtttgaacagcggcgcccgg

SEQ ID NO: 3941 - DNA, 25 bp, Homo sapien
accgcgcagcgcagaaccagggata

SEQ ID NO: 3942 - DNA, 25 bp, Homo sapien
ccgggtttctttggtgctccaagca

SEQ ID NO: 3943 - DNA, 25 bp, Homo sapien
cgtcaattggtcgtagtcccggcca

SEQ ID NO: 3944 - DNA, 25 bp, Homo sapien
gtctaccggcagcaacaaccacgtg

SEQ ID NO: 3945 - DNA, 25 bp, Homo sapien
tgagactcacgacgaactgcccttt

SEQ ID NO: 3946 - DNA, 25 bp, Homo sapien
tgcgactagccggtcaacaaacgtt

SEQ ID NO: 3947 - DNA, 25 bp, Homo sapien
gacggcctgcaattggacacgactg

SEQ ID NO: 3948 - DNA, 25 bp, Homo sapien
cgcgccagacttttcgagaccgtca

SEQ ID NO: 3949 - DNA, 25 bp, Homo sapien
ctgggtctaagatactcctggcgtc

SEQ ID NO: 3950 - DNA, 25 bp, Homo sapien
ctgtgctcacgagatggctgcatga

SEQ ID NO: 3951 - DNA, 25 bp, Homo sapien
agccgcccagcagaagtacaagaag

SEQ ID NO: 3952 - DNA, 25 bp, Homo sapien
acaagaagggcgatgtggtctgcac

SEQ ID NO: 3953 - DNA, 25 bp, Homo sapien
aagttcaacggcaagcagtggcgcc

SEQ ID NO: 3954 - DNA, 25 bp, Homo sapien
tcacagcggcgaggctactgctcac

SEQ ID NO: 3955 - DNA, 25 bp, Homo sapien
gccacctgtccatgcgaaccaaaga

SEQ ID NO: 3956 - DNA, 25 bp, Homo sapien
tgctgacttgtcacgctttgagttc

SEQ ID NO: 3957 - DNA, 25 bp, Homo sapien
ggtctgcacacccagcggaatacga

SEQ ID NO: 3958 - DNA, 25 bp, Homo sapien
tgtcgggcctccgtccttctcattg

SEQ ID NO: 3959 - DNA, 25 bp, Homo sapien
ccaggcggcgagtggaaaatctcgt

SEQ ID NO: 3960 - DNA, 25 bp, Homo sapien
gtctcgcccgctgaccgctgattgg

SEQ ID NO: 3961 - DNA, 25 bp, Homo sapien
tgtgtagaagcggactggcacccag

SEQ ID NO: 3962 - DNA, 25 bp, Homo sapien
tgagcctgtttcttgcgaagtagtc

SEQ ID NO: 3963 - DNA, 25 bp, Homo sapien
gctgattgtgaagccagatagattt

SEQ ID NO: 3964 - DNA, 25 bp, Homo sapien
cctatttcagcggaaaagctgattg

SEQ ID NO: 3965 - DNA, 25 bp, Homo sapien
acaaagcggctttgtggagcctgcc

SEQ ID NO: 3966 - DNA, 25 bp, Homo sapien
aggtggaatcaggaaccttcgcttc

SEQ ID NO: 3967 - DNA, 25 bp, Homo sapien
tgctgtcagccacgaaccgatggtg

SEQ ID NO: 3968 - DNA, 25 bp, Homo sapien
tcagtttcccaatcaggtagtgaga

SEQ ID NO: 3969 - DNA, 25 bp, Homo sapien
tgagagtggcacgaaccagccgttc

SEQ ID NO: 3970 - DNA, 25 bp, Homo sapien
ggactcctcaatatcccaggtggga

SEQ ID NO: 3971 - DNA, 25 bp, Homo sapien
gtgggaacgctcaccagggacatcc

SEQ ID NO: 3972 - DNA, 25 bp, Homo sapien
ctccagggacggaagccttcactta

SEQ ID NO: 3973 - DNA, 25 bp, Homo sapien
cgggttccttatctttgctgtcagc

SEQ ID NO: 3974 - DNA, 25 bp, Homo sapien
gagccacgaagccaaagggcatgga

SEQ ID NO: 3975 - DNA, 25 bp, Homo sapien
aagccaaagggcatggaaagggcac

SEQ ID NO: 3976 - DNA, 25 bp, Homo sapien
ccggaacagcgccaggtgacttcga

SEQ ID NO: 3977 - DNA, 25 bp, Homo sapien
acagcgccaggtgacttcgagagct

SEQ ID NO: 3978 - DNA, 25 bp, Homo sapien
ggtcaccgcggaaaagaagccattg

SEQ ID NO: 3979 - DNA, 25 bp, Homo sapien
ccgcggaaaagaagccattgcgccc

SEQ ID NO: 3980 - DNA, 25 bp, Homo sapien
cccacagctacgtgaagtgggaagg

SEQ ID NO: 3981 - DNA, 25 bp, Homo sapien
cgctaggtttccgtcctctcagagc

SEQ ID NO: 3982 - DNA, 25 bp, Homo sapien
tgatcccttggagcggttcgacgaa

SEQ ID NO: 3983 - DNA, 25 bp, Homo sapien
gccttggccaattagcgcgcgccta

SEQ ID NO: 3984 - DNA, 25 bp, Homo sapien
ctctacttcctgatccgggcgttta

SEQ ID NO: 3985 - DNA, 25 bp, Homo sapien
gcaagggtcattgtccgagcagtga

SEQ ID NO: 3986 - DNA, 25 bp, Homo sapien
ggttcgacgaagcaagttccgcggc

SEQ ID NO: 3987 - DNA, 25 bp, Homo sapien
cgacgcgttctcagtgtccgtgagg

SEQ ID NO: 3988 - DNA, 25 bp, Homo sapien
gagactccagtctcgcgggatctga

SEQ ID NO: 3989 - DNA, 25 bp, Homo sapien
cgcgctccttctacgtgatcctggg

SEQ ID NO: 3990 - DNA, 25 bp, Homo sapien
gctgaagggacagcacttttcactc

SEQ ID NO: 3991 - DNA, 25 bp, Homo sapien
ggccaagtacgtgcggggcaacctc

SEQ ID NO: 3992 - DNA, 25 bp, Homo sapien
gggacagcacttttcactcagcaga

SEQ ID NO: 3993 - DNA, 25 bp, Homo sapien
ctctcgcctccattgccgggccagt

SEQ ID NO: 3994 - DNA, 25 bp, Homo sapien
ggtgagcatgccgagccctcctctg

SEQ ID NO: 3995 - DNA, 25 bp, Homo sapien
tcagttccaaggaggtgagcatgcc

SEQ ID NO: 3996 - DNA, 25 bp, Homo sapien
tgcggggcaacctcagttccaagga

SEQ ID NO: 3997 - DNA, 25 bp, Homo sapien
agcacttttcactcagcagagagcc

SEQ ID NO: 3998 - DNA, 25 bp, Homo sapien
gcattttggcttcaggacttgccga

SEQ ID NO: 3999 - DNA, 25 bp, Homo sapien
tcaggacttgccgaggccgaagccg

SEQ ID NO: 4000 - DNA, 25 bp, Homo sapien
ttcctggtgtttaatgcattttggc

SEQ ID NO: 4001 - DNA, 25 bp, Homo sapien
attgttttcccgacgtcagccctca

SEQ ID NO: 4002 - DNA, 25 bp, Homo sapien
ttagcttgaagaacgcggccgcgct

SEQ ID NO: 4003 - DNA, 25 bp, Homo sapien
cgaggccgcggtaaagtttagcttg

SEQ ID NO: 4004 - DNA, 25 bp, Homo sapien
tccggaatctcagccgccgtctgag

SEQ ID NO: 4005 - DNA, 25 bp, Homo sapien
gcggtgtccgcgatttacctccgca

SEQ ID NO: 4006 - DNA, 25 bp, Homo sapien
gcccaggttgggtacgctgcgtccc

SEQ ID NO: 4007 - DNA, 25 bp, Homo sapien
ctctgtgccaaacggtcccgcggga

SEQ ID NO: 4008 - DNA, 25 bp, Homo sapien
atacttcagcatgcacacggccggg

SEQ ID NO: 4009 - DNA, 25 bp, Homo sapien
accggcttcaccgaatacttcagca

SEQ ID NO: 4010 - DNA, 25 bp, Homo sapien
ctgacaacgtgcgtccacacctggg

SEQ ID NO: 4011 - DNA, 25 bp, Homo sapien
tccttccctgactgacaacgtgcgt

SEQ ID NO: 4012 - DNA, 25 bp, Homo sapien
ggttctggcgctgttgcgcacaccc

SEQ ID NO: 4013 - DNA, 25 bp, Homo sapien
gcgccggattctgggctcccgctgt

SEQ ID NO: 4014 - DNA, 25 bp, Homo sapien
ctcttcgatctacaaggtcatgtta

SEQ ID NO: 4015 - DNA, 25 bp, Homo sapien
cgtcaatggcaactgcgagtggctc

SEQ ID NO: 4016 - DNA, 25 bp, Homo sapien
agtccgtaatgctgggcactgttca

SEQ ID NO: 4017 - DNA, 25 bp, Homo sapien
tgtctataggggactcctacggtcc

SEQ ID NO: 4018 - DNA, 25 bp, Homo sapien
ggcttccagagcctgtcagcagtgg

SEQ ID NO: 4019 - DNA, 25 bp, Homo sapien
tgaccggccgctctgtaacttctcg

SEQ ID NO: 4020 - DNA, 25 bp, Homo sapien
tgcgggcaactacagcgtcaatggc

SEQ ID NO: 4021 - DNA, 25 bp, Homo sapien
acagggccttccatcgctctatagg

SEQ ID NO: 4022 - DNA, 25 bp, Homo sapien
aatgccgctgcaaccgccacagtga

SEQ ID NO: 4023 - DNA, 25 bp, Homo sapien
tgcaaccgccacagtgaatgcgctg

SEQ ID NO: 4024 - DNA, 25 bp, Homo sapien
tctgccgcaaccacaccaaggtggg

SEQ ID NO: 4025 - DNA, 25 bp, Homo sapien
gggccgcaactgctccacggaatgc

SEQ ID NO: 4026 - DNA, 25 bp, Homo sapien
actttggctttgtgggccgcaactg

SEQ ID NO: 4027 - DNA, 25 bp, Homo sapien
gggacccaggccctcacttgccttc

SEQ ID NO: 4028 - DNA, 25 bp, Homo sapien
gtgtggagcccgaccactgccgctg

SEQ ID NO: 4029 - DNA, 25 bp, Homo sapien
gcccagggctgcgtgaacggctcat

SEQ ID NO: 4030 - DNA, 25 bp, Homo sapien
atgccctcaagtcgagccgcttcta

SEQ ID NO: 4031 - DNA, 25 bp, Homo sapien
gccaagtgccgggaatcatttcacg

SEQ ID NO: 4032 - DNA, 25 bp, Homo sapien
gaccaactgcttccatgagcccaaa

SEQ ID NO: 4033 - DNA, 25 bp, Homo sapien
actgtcctctttggcgtgcagccca

SEQ ID NO: 4034 - DNA, 25 bp, Homo sapien
attcaccaacgtggacatccgcctg

SEQ ID NO: 4035 - DNA, 25 bp, Homo sapien
tcctatgacaccttcgtggtccgtg

SEQ ID NO: 4036 - DNA, 25 bp, Homo sapien
gacactggcgtccatactgtacaca

SEQ ID NO: 4037 - DNA, 25 bp, Homo sapien
ggcctgattacctacgtgacggtga

SEQ ID NO: 4038 - DNA, 25 bp, Homo sapien
ggcgcgcagcagcactcgccaaagt

SEQ ID NO: 4039 - DNA, 25 bp, Homo sapien
cagtcgtgcccgacggagccctaga

SEQ ID NO: 4040 - DNA, 25 bp, Homo sapien
gaggagcaaaagtgccgcacagacc

SEQ ID NO: 4041 - DNA, 25 bp, Homo sapien
tcgccaaagtcgtcggagatgcggc

SEQ ID NO: 4042 - DNA, 25 bp, Homo sapien
cgcacctggatgtggtagcgctccc

SEQ ID NO: 4043 - DNA, 25 bp, Homo sapien
tagcgctcccgcatgccggtgcgga

SEQ ID NO: 4044 - DNA, 25 bp, Homo sapien
cagttcccgcgccatctggcagagg

SEQ ID NO: 4045 - DNA, 25 bp, Homo sapien
caggcaaggcacagaggagcaaaag

SEQ ID NO: 4046 - DNA, 25 bp, Homo sapien
acacgcgaggcgcttctttggagtc

SEQ ID NO: 4047 - DNA, 25 bp, Homo sapien
ggcggcgaaagctatccatgacgtc

SEQ ID NO: 4048 - DNA, 25 bp, Homo sapien
gtcagtcactatcttccagccaatg

SEQ ID NO: 4049 - DNA, 25 bp, Homo sapien
tgggccactcaggaccctttgcctg

SEQ ID NO: 4050 - DNA, 25 bp, Homo sapien
cccaactcgggcagcgataggcttt

SEQ ID NO: 4051 - DNA, 25 bp, Homo sapien
ataggctttcggagacgccagtctc

SEQ ID NO: 4052 - DNA, 25 bp, Homo sapien
gtcggccaatagacccggaacctga

SEQ ID NO: 4053 - DNA, 25 bp, Homo sapien
attctgcgaccgtctacgcccaggg

SEQ ID NO: 4054 - DNA, 25 bp, Homo sapien
acttaagtaaggcacagcccgcgtc

SEQ ID NO: 4055 - DNA, 25 bp, Homo sapien
cgggaaatacggatacagacggagt

SEQ ID NO: 4056 - DNA, 25 bp, Homo sapien
gcgagcatgaccgagtcgtccagca

SEQ ID NO: 4057 - DNA, 25 bp, Homo sapien
cacagcgccgctagggtcaggaagc

SEQ ID NO: 4058 - DNA, 25 bp, Homo sapien
aggcggatgcgctccacgcacagct

SEQ ID NO: 4059 - DNA, 25 bp, Homo sapien
cggcccggaaggcattcatgacgga

SEQ ID NO: 4060 - DNA, 25 bp, Homo sapien
aggtccagccgtctcggtgaccggt

SEQ ID NO: 4061 - DNA, 25 bp, Homo sapien
cgcagatgggaacaacaggctttta

SEQ ID NO: 4062 - DNA, 25 bp, Homo sapien
ggcaaaaacgcctgacagccgctgg

SEQ ID NO: 4063 - DNA, 25 bp, Homo sapien
ttggaggccacatagcgggatttgt

SEQ ID NO: 4064 - DNA, 25 bp, Homo sapien
gacatactcccggaggaagtcggcg

SEQ ID NO: 4065 - DNA, 25 bp, Homo sapien
ccctcgtcgccctcaaagaagagta

SEQ ID NO: 4066 - DNA, 25 bp, Homo sapien
cccggccgattggtaaccagcaggc

SEQ ID NO: 4067 - DNA, 25 bp, Homo sapien
tgtgcactaggctgcggtacccgtt

SEQ ID NO: 4068 - DNA, 25 bp, Homo sapien
ggtgtctctgggtccaggtcaaaga

SEQ ID NO: 4069 - DNA, 25 bp, Homo sapien
tccaggtcaaagaggtgcgccacac

SEQ ID NO: 4070 - DNA, 25 bp, Homo sapien
tgagccctctttggcattcttcgag

SEQ ID NO: 4071 - DNA, 25 bp, Homo sapien
gggaagcctcccatgtgctggctca

SEQ ID NO: 4072 - DNA, 25 bp, Homo sapien
aagtcccgatcttcccacgtgctgg

SEQ ID NO: 4073 - DNA, 25 bp, Homo sapien
cgcattaaagggctcgcggccaaca

SEQ ID NO: 4074 - DNA, 25 bp, Homo sapien
gggtccagctccctaaccaattctg

SEQ ID NO: 4075 - DNA, 25 bp, Homo sapien
gagggccaatcctcgctacacacta

SEQ ID NO: 4076 - DNA, 25 bp, Homo sapien
cgcgctcacctttggccttgtcttt

SEQ ID NO: 4077 - DNA, 25 bp, Homo sapien
gccaggtcctctgccaactcaaaga

SEQ ID NO: 4078 - DNA, 25 bp, Homo sapien
cccacgttgctgcagagtaattggc

SEQ ID NO: 4079 - DNA, 25 bp, Homo sapien
aggggcctgtcagcgagaaatgaaa

SEQ ID NO: 4080 - DNA, 25 bp, Homo sapien
acgcagacacgcagacacgcaggca

SEQ ID NO: 4081 - DNA, 25 bp, Homo sapien
ctctgccatccggagtcggaacatg

SEQ ID NO: 4082 - DNA, 25 bp, Homo sapien
cgcaggcacccacaaaatacagtct

SEQ ID NO: 4083 - DNA, 25 bp, Homo sapien
cacacggtaagcaactcggacagtt

SEQ ID NO: 4084 - DNA, 25 bp, Homo sapien
cagttccatggatgggacgcccgca

SEQ ID NO: 4085 - DNA, 25 bp, Homo sapien
cccaaggttaatgcactgttagcca

SEQ ID NO: 4086 - DNA, 25 bp, Homo sapien
tcggacctgcttctgcgggactggt

SEQ ID NO: 4087 - DNA, 25 bp, Homo sapien
gtcatcgtcctgcagcgcggagcct

SEQ ID NO: 4088 - DNA, 25 bp, Homo sapien
tacgccaacctgtgccagctgcgcg

SEQ ID NO: 4089 - DNA, 25 bp, Homo sapien
agagtcgccatgcagatcccgcgcg

SEQ ID NO: 4090 - DNA, 25 bp, Homo sapien
gtcaccgctgcgaggccaatgggct

SEQ ID NO: 4091 - DNA, 25 bp, Homo sapien
caaggcggctcgtcaccgctgcgag

SEQ ID NO: 4092 - DNA, 25 bp, Homo sapien
aacctgcggaaagcgaatatgtggg

SEQ ID NO: 4093 - DNA, 25 bp, Homo sapien
agagaacctgcggaaagcgaatatg

SEQ ID NO: 4094 - DNA, 25 bp, Homo sapien
agcctcagctgcaaaaaagctcgca

SEQ ID NO: 4095 - DNA, 25 bp, Homo sapien
taaacaagcacagtgcggcggccgc

SEQ ID NO: 4096 - DNA, 25 bp, Homo sapien
agtggcgcctaaacaagcacagtgc

SEQ ID NO: 4097 - DNA, 25 bp, Homo sapien
ccgcacagacaaaaagtggcgccta

SEQ ID NO: 4098 - DNA, 25 bp, Homo sapien
agcggtgcagacaaaaagccgcaca

SEQ ID NO: 4099 - DNA, 25 bp, Homo sapien
tcgcagcgcccaagctgacagggtt

SEQ ID NO: 4100 - DNA, 25 bp, Homo sapien
agggcgaaaggaaagcctcagctgc

SEQ ID NO: 4101 - DNA, 25 bp, Homo sapien
aagctgacagggttcggccaggcca

SEQ ID NO: 4102 - DNA, 25 bp, Homo sapien
tgtgtgcagagccatcaatccttcc

SEQ ID NO: 4103 - DNA, 25 bp, Homo sapien
cccggcctctggtatgggaaccagt

SEQ ID NO: 4104 - DNA, 25 bp, Homo sapien
ggaaccagtgacgtctctcccgtga

SEQ ID NO: 4105 - DNA, 25 bp, Homo sapien
cccgcagcgtcctgtttgggagcca

SEQ ID NO: 4106 - DNA, 25 bp, Homo sapien
tgggagccaggtcttctcctcgttc

SEQ ID NO: 4107 - DNA, 25 bp, Homo sapien
ctcgcctgtggccatctgagccgtg

SEQ ID NO: 4108 - DNA, 25 bp, Homo sapien
ttccgagggctgcaaggaacatgcg

SEQ ID NO: 4109 - DNA, 25 bp, Homo sapien
tgtccgcttcgcagcgtgtgtgcag

SEQ ID NO: 4110 - DNA, 25 bp, Homo sapien
caggaattgacttctctgtggccaa

SEQ ID NO: 4111 - DNA, 25 bp, Homo sapien
accctccgagattgccaggaattga

SEQ ID NO: 4112 - DNA, 25 bp, Homo sapien
tccaggctcatccaatgaacttatc

SEQ ID NO: 4113 - DNA, 25 bp, Homo sapien
tccgatgcttttgcatccaccaatg

SEQ ID NO: 4114 - DNA, 25 bp, Homo sapien
tccaccaatggggtttcgagtgctg

SEQ ID NO: 4115 - DNA, 25 bp, Homo sapien
gcccggccttgcgtcgtaagagaat

SEQ ID NO: 4116 - DNA, 25 bp, Homo sapien
cgtcgtgagattcttgtgaggcgtc

SEQ ID NO: 4117 - DNA, 25 bp, Homo sapien
ccgggcctcaactttggcgtcgtga

SEQ ID NO: 4118 - DNA, 25 bp, Homo sapien
gcataggacgtgacctcgttccaaa

SEQ ID NO: 4119 - DNA, 25 bp, Homo sapien
ccacaggaccgacaggcaggaattg

SEQ ID NO: 4120 - DNA, 25 bp, Homo sapien
ttgttaatagagaaggcctggcctg

SEQ ID NO: 4121 - DNA, 25 bp, Homo sapien
tgaacgccagaagcccgtgaagatc

SEQ ID NO: 4122 - DNA, 25 bp, Homo sapien
acggctccacctctatcttggcagg

SEQ ID NO: 4123 - DNA, 25 bp, Homo sapien
ctcctcgcgcttgtaattgttaata

SEQ ID NO: 4124 - DNA, 25 bp, Homo sapien
gcgtggccagatccagaaaggacta

SEQ ID NO: 4125 - DNA, 25 bp, Homo sapien
cattgctgcagctggatgaacgcca

SEQ ID NO: 4126 - DNA, 25 bp, Homo sapien
tgcaacccagaacgcagcagctcag

SEQ ID NO: 4127 - DNA, 25 bp, Homo sapien
ttcgtaggttttgacgcagaaggtc

SEQ ID NO: 4128 - DNA, 25 bp, Homo sapien
gggctcggagccaccatgtagaaaa

SEQ ID NO: 4129 - DNA, 25 bp, Homo sapien
atccaaatgcgcatggcttcggggc

SEQ ID NO: 4130 - DNA, 25 bp, Homo sapien
ggtcacgatgacgtccatccaaatg

SEQ ID NO: 4131 - DNA, 25 bp, Homo sapien
agcggtgcgtccaagttttccggca

SEQ ID NO: 4132 - DNA, 25 bp, Homo sapien
tcccgggagagttccaaagcggtgc

SEQ ID NO: 4133 - DNA, 25 bp, Homo sapien
ccaccatgtagaaaaggcgttcgta

SEQ ID NO: 4134 - DNA, 25 bp, Homo sapien
tccatctgcggagagaatgccaggg

SEQ ID NO: 4135 - DNA, 25 bp, Homo sapien
gagcggagggcctaaaatctgatcc

SEQ ID NO: 4136 - DNA, 25 bp, Homo sapien
tcagggccacacgagtcaatgcctc

SEQ ID NO: 4137 - DNA, 25 bp, Homo sapien
ggcgctgtagctccttcactcgctg

SEQ ID NO: 4138 - DNA, 25 bp, Homo sapien
ccatagctatcggaggcgtagcctc

SEQ ID NO: 4139 - DNA, 25 bp, Homo sapien
aatctgatcccacccgaggaaaaag

SEQ ID NO: 4140 - DNA, 25 bp, Homo sapien
ctcggacgcctaggtccaaggaaga

SEQ ID NO: 4141 - DNA, 25 bp, Homo sapien
ccagggcctgaactaccggattcga

SEQ ID NO: 4142 - DNA, 25 bp, Homo sapien
ggaggcgtgtcctgaagtttccaga

SEQ ID NO: 4143 - DNA, 25 bp, Homo sapien
ttgatggctccaaggcgacacgcca

SEQ ID NO: 4144 - DNA, 25 bp, Homo sapien
tctctaggtgtcaggccttgtaccc

SEQ ID NO: 4145 - DNA, 25 bp, Homo sapien
ttcgcttagagcgacccatcttctc

SEQ ID NO: 4146 - DNA, 25 bp, Homo sapien
cctcacccagggatccaggagtcgg

SEQ ID NO: 4147 - DNA, 25 bp, Homo sapien
cttctctgaacaagccaggagtcgg

SEQ ID NO: 4148 - DNA, 25 bp, Homo sapien
ggagtccttgagattccgaagtcca

SEQ ID NO: 4149 - DNA, 25 bp, Homo sapien
tggacctccacgtcgcattccggga

SEQ ID NO: 4150 - DNA, 25 bp, Homo sapien
tcagtacagcctccgccatcgcgcc

SEQ ID NO: 4151 - DNA, 25 bp, Homo sapien
ccggatctctccctattaagagacc

SEQ ID NO: 4152 - DNA, 25 bp, Homo sapien
agaccccggagttccgtccttgctg

SEQ ID NO: 4153 - DNA, 25 bp, Homo sapien
cgggcgaccctcagtacagcctccg

SEQ ID NO: 4154 - DNA, 25 bp, Homo sapien
gcccactgcggggtcaggaatgagc

SEQ ID NO: 4155 - DNA, 25 bp, Homo sapien
gcgctacggcactgaccccgggaag

SEQ ID NO: 4156 - DNA, 25 bp, Homo sapien
ggcggagcacgccttaaaggggcca

SEQ ID NO: 4157 - DNA, 25 bp, Homo sapien
ttgctgccgcctagtgcccagcagt

SEQ ID NO: 4158 - DNA, 25 bp, Homo sapien
cgacgcatgccaggttccttccgta

SEQ ID NO: 4159 - DNA, 25 bp, Homo sapien
cggtgcactttctgtcgatacggta

SEQ ID NO: 4160 - DNA, 25 bp, Homo sapien
gatacggtagcttcgcgcttgctca

SEQ ID NO: 4161 - DNA, 25 bp, Homo sapien
ccctgggtctagtttcagaacaaga

SEQ ID NO: 4162 - DNA, 25 bp, Homo sapien
gcttgctcacgaacttgcctgcctg

SEQ ID NO: 4163 - DNA, 25 bp, Homo sapien
gcatcggtgcctgaatgtctgattc

SEQ ID NO: 4164 - DNA, 25 bp, Homo sapien
tccgaggggtgcattgaatccttta

SEQ ID NO: 4165 - DNA, 25 bp, Homo sapien
gaatcctttacgcttgggactctga

SEQ ID NO: 4166 - DNA, 25 bp, Homo sapien
ttctcatttccctccaagctggccg

SEQ ID NO: 4167 - DNA, 25 bp, Homo sapien
aggcgactgcctggcaccgatgctc

SEQ ID NO: 4168 - DNA, 25 bp, Homo sapien
tctgctacccttccaagctggcggc

SEQ ID NO: 4169 - DNA, 25 bp, Homo sapien
gaagtcctttggccaccgctccaag

SEQ ID NO: 4170 - DNA, 25 bp, Homo sapien
cgtgcccacactgcccgaagtcctt

SEQ ID NO: 4171 - DNA, 25 bp, Homo sapien
acgcaccgcttagcacacggaggcg

SEQ ID NO: 4172 - DNA, 25 bp, Homo sapien
ccgactgtgacaaggccttctcgta

SEQ ID NO: 4173 - DNA, 25 bp, Homo sapien
gtgacaaggccttctcgtacccgtc

SEQ ID NO: 4174 - DNA, 25 bp, Homo sapien
gtcctgggtcccatccagctgcaga

SEQ ID NO: 4175 - DNA, 25 bp, Homo sapien
ggatgtgggctcctaccaggaaaag

SEQ ID NO: 4176 - DNA, 25 bp, Homo sapien
ctcggtaggtggtcgctctcagacc

SEQ ID NO: 4177 - DNA, 25 bp, Homo sapien
ccaggaaaaggtggacgtcgtcctg

SEQ ID NO: 4178 - DNA, 25 bp, Homo sapien
cttcccgctgctaccgaggctgtgt

SEQ ID NO: 4179 - DNA, 25 bp, Homo sapien
cctgcgttgtaaaatggtggtgtgc

SEQ ID NO: 4180 - DNA, 25 bp, Homo sapien
cctccgtgtacctgcgttgtaaaat

SEQ ID NO: 4181 - DNA, 25 bp, Homo sapien
tcgaagagggatgtgggctcctacc

SEQ ID NO: 4182 - DNA, 25 bp, Homo sapien
ttgcatgaaggggtctctttgaggc

SEQ ID NO: 4183 - DNA, 25 bp, Homo sapien
tctagcaaacgccaaacacacgagg

SEQ ID NO: 4184 - DNA, 25 bp, Homo sapien
ccagcgtggcctgtcctttgttcta

SEQ ID NO: 4185 - DNA, 25 bp, Homo sapien
gtttcagctgcggaatctcccgtcc

SEQ ID NO: 4186 - DNA, 25 bp, Homo sapien
cggcccaagtttttggtttcagctg

SEQ ID NO: 4187 - DNA, 25 bp, Homo sapien
tgtgggtttgattaaggctgtcgct

SEQ ID NO: 4188 - DNA, 25 bp, Homo sapien
acggctggcccacctcagagcgggt

SEQ ID NO: 4189 - DNA, 25 bp, Homo sapien
ctgtgctggtcacatgtgggtttga

SEQ ID NO: 4190 - DNA, 25 bp, Homo sapien
ttagcaacgagcgtttcctccagcc

SEQ ID NO: 4191 - DNA, 25 bp, Homo sapien
cgctggctaaagtgcgcaagcgcgc

SEQ ID NO: 4192 - DNA, 25 bp, Homo sapien
gccctgcgctggctaaagtgcgcaa

SEQ ID NO: 4193 - DNA, 25 bp, Homo sapien
ttcgcctggccagaaggatgaggta

SEQ ID NO: 4194 - DNA, 25 bp, Homo sapien
catgtcaacgtcgtgggcttcgcct

SEQ ID NO: 4195 - DNA, 25 bp, Homo sapien
atctccggcatgtcaacgtcgtggg

SEQ ID NO: 4196 - DNA, 25 bp, Homo sapien
cggaggcggatctccggcatgtcaa

SEQ ID NO: 4197 - DNA, 25 bp, Homo sapien
tctagcctcgcctcccaatgacgtc

SEQ ID NO: 4198 - DNA, 25 bp, Homo sapien
gttctttaagctctcgcccttggga

SEQ ID NO: 4199 - DNA, 25 bp, Homo sapien
ccttgggattctccatcttgccttc

SEQ ID NO: 4200 - DNA, 25 bp, Homo sapien
tgggtcgccaggatccaatccaagc

SEQ ID NO: 4201 - DNA, 25 bp, Homo sapien
tgagtcgccaccacctgatttcttc

SEQ ID NO: 4202 - DNA, 25 bp, Homo sapien
acaagaggcgcatctggtagcagca

SEQ ID NO: 4203 - DNA, 25 bp, Homo sapien
gctttctgcgatccagcgctacatt

SEQ ID NO: 4204 - DNA, 25 bp, Homo sapien
cgcagccattcgcatagccctggga

SEQ ID NO: 4205 - DNA, 25 bp, Homo sapien
aggcacggtccagagcaccacattc

SEQ ID NO: 4206 - DNA, 25 bp, Homo sapien
gaacaaggcggtcacgtcaccctgc

SEQ ID NO: 4207 - DNA, 25 bp, Homo sapien
gactaacggacccagccagaaagcc

SEQ ID NO: 4208 - DNA, 25 bp, Homo sapien
cagagctgctgtctgatcacgggcc

SEQ ID NO: 4209 - DNA, 25 bp, Homo sapien
ccaggacggaggttccgcacagcca

SEQ ID NO: 4210 - DNA, 25 bp, Homo sapien
agtaccagcacgttggcttccgccg

SEQ ID NO: 4211 - DNA, 25 bp, Homo sapien
ctcagctcgcccagaaaaaggcctg

SEQ ID NO: 4212 - DNA, 25 bp, Homo sapien
tccttgtcgcacagcgctgcgatca

SEQ ID NO: 4213 - DNA, 25 bp, Homo sapien
gttcgccggtagcacaaacagatcc

SEQ ID NO: 4214 - DNA, 25 bp, Homo sapien
tcccggtagctttaacctgacgtca

SEQ ID NO: 4215 - DNA, 25 bp, Homo sapien
gcctcagggcctagaacaatgaatg

SEQ ID NO: 4216 - DNA, 25 bp, Homo sapien
atgaatgagtcaacgcgcctgcgcg

SEQ ID NO: 4217 - DNA, 25 bp, Homo sapien
cacgcatgcgcaaaaggcttagcta

SEQ ID NO: 4218 - DNA, 25 bp, Homo sapien
tgcgactatactactgccggatggc

SEQ ID NO: 4219 - DNA, 25 bp, Homo sapien
catctggcaaaagggcgcggaaacc

SEQ ID NO: 4220 - DNA, 25 bp, Homo sapien
gccctgagactgagtggtccctatc

SEQ ID NO: 4221 - DNA, 25 bp, Homo sapien
tgatttagagatgccgggacccgtc

SEQ ID NO: 4222 - DNA, 25 bp, Homo sapien
aacgcgccttacaaaactgggatgc

SEQ ID NO: 4223 - DNA, 25 bp, Homo sapien
gccttactccagagcgcagtgatta

SEQ ID NO: 4224 - DNA, 25 bp, Homo sapien
cctgcgtcgcaagtagggtaggaca

SEQ ID NO: 4225 - DNA, 25 bp, Homo sapien
cgcggcccaaaggaacaagaagctg

SEQ ID NO: 4226 - DNA, 25 bp, Homo sapien
gcccgaggcctgcttatttgcataa

SEQ ID NO: 4227 - DNA, 25 bp, Homo sapien
tgcataatcctagcgcgggacaatg

SEQ ID NO: 4228 - DNA, 25 bp, Homo sapien
tcccgcactggaaggagtgatttgc

SEQ ID NO: 4229 - DNA, 25 bp, Homo sapien
tcgctgcctgggtttacttggtaca

SEQ ID NO: 4230 - DNA, 25 bp, Homo sapien
ggatctcggtgagcgcgggaaatgg

SEQ ID NO: 4231 - DNA, 25 bp, Homo sapien
atgcagggtgcttgcgctgcgcgga

SEQ ID NO: 4232 - DNA, 25 bp, Homo sapien
gtcgaggcaggtcaaggatctccca

SEQ ID NO: 4233 - DNA, 25 bp, Homo sapien
agtctagcgagaggctgtgagctga

SEQ ID NO: 4234 - DNA, 25 bp, Homo sapien
caggtgggtgtctggagtctagcga

SEQ ID NO: 4235 - DNA, 25 bp, Homo sapien
cgacgtgggaaaggtgagtgtgaga

SEQ ID NO: 4236 - DNA, 25 bp, Homo sapien
gcaggtcaaggatctcccagggcag

SEQ ID NO: 4237 - DNA, 25 bp, Homo sapien
aggcaggtcaaggatctcccagggc

SEQ ID NO: 4238 - DNA, 25 bp, Homo sapien
ggagctgttactcattcccggcctc

SEQ ID NO: 4239 - DNA, 25 bp, Homo sapien
cgttcggagtatcccggagctgtta

SEQ ID NO: 4240 - DNA, 25 bp, Homo sapien
cgtagctcttccttgaggttccagc

SEQ ID NO: 4241 - DNA, 25 bp, Homo sapien
ggtctgtaacctctcccgtagctct

SEQ ID NO: 4242 - DNA, 25 bp, Homo sapien
tcctagctcttcctcggtctgtaac

SEQ ID NO: 4243 - DNA, 25 bp, Homo sapien
ctctggctccgcctcgaggttctag

SEQ ID NO: 4244 - DNA, 25 bp, Homo sapien
ctctggttacgcctcgaggttataa

SEQ ID NO: 4245 - DNA, 25 bp, Homo sapien
tctcgagcgctttccgggttattca

SEQ ID NO: 4246 - DNA, 25 bp, Homo sapien
ctccacctgcttgttcggcacgtcg

SEQ ID NO: 4247 - DNA, 25 bp, Homo sapien
gccgtcctagagtcccactgccgct

SEQ ID NO: 4248 - DNA, 25 bp, Homo sapien
tgcaccctgtctccgtctcggcagg

SEQ ID NO: 4249 - DNA, 25 bp, Homo sapien
acactggctgtcgagccactgcagc

SEQ ID NO: 4250 - DNA, 25 bp, Homo sapien
tggtagtcctggcaaccgcgacgct

SEQ ID NO: 4251 - DNA, 25 bp, Homo sapien
aaccgcgacgctgtgctaaggaatc

SEQ ID NO: 4252 - DNA, 25 bp, Homo sapien
gctgtgctaaggaatcccgcctgga

SEQ ID NO: 4253 - DNA, 25 bp, Homo sapien
ccggaacgtgaacgtacgcggctgc

SEQ ID NO: 4254 - DNA, 25 bp, Homo sapien
tcatggagaccacgatgcaaccgtc

SEQ ID NO: 4255 - DNA, 25 bp, Homo sapien
gctgcccggctgacaagtacctaaa

SEQ ID NO: 4256 - DNA, 25 bp, Homo sapien
agcaggtagacttcagccgctatga

SEQ ID NO: 4257 - DNA, 25 bp, Homo sapien
tgtgccagggcaagaagttctactt

SEQ ID NO: 4258 - DNA, 25 bp, Homo sapien
accgcagctttggtctggacgacga

SEQ ID NO: 4259 - DNA, 25 bp, Homo sapien
ggctctattcccagtcgtccgacgg

SEQ ID NO: 4260 - DNA, 25 bp, Homo sapien
ggcgctgtctacaccatgctccagg

SEQ ID NO: 4261 - DNA, 25 bp, Homo sapien
gcgggcaagtcctccctcatcaatg

SEQ ID NO: 4262 - DNA, 25 bp, Homo sapien
tgagacgtggtctaaagccctttcc

SEQ ID NO: 4263 - DNA, 25 bp, Homo sapien
gaaccgccgtgactgtgtcctccgt

SEQ ID NO: 4264 - DNA, 25 bp, Homo sapien
cctccgtgtgaattgcctggaacaa

SEQ ID NO: 4265 - DNA, 25 bp, Homo sapien
ttagctctgcacgagtccacagttg

SEQ ID NO: 4266 - DNA, 25 bp, Homo sapien
caaatgttccgtggctctgacgtcc

SEQ ID NO: 4267 - DNA, 25 bp, Homo sapien
cgttgaaacgctgccacgagtcgtc

SEQ ID NO: 4268 - DNA, 25 bp, Homo sapien
ggagaacgtgtctctggctgacatc

SEQ ID NO: 4269 - DNA, 25 bp, Homo sapien
cacgccgacggtgccaccaaatgtt

SEQ ID NO: 4270 - DNA, 25 bp, Homo sapien
cacgagaacgcgctggagcgctgca

SEQ ID NO: 4271 - DNA, 25 bp, Homo sapien
cacggtgtgcgacgaccactggaac

SEQ ID NO: 4272 - DNA, 25 bp, Homo sapien
gaacgcccgtgtggtgtgccgcctc

SEQ ID NO: 4273 - DNA, 25 bp, Homo sapien
ccgcggccgctttggccagggcacc

SEQ ID NO: 4274 - DNA, 25 bp, Homo sapien
tgcaccggccacgagaacgcgctgg

SEQ ID NO: 4275 - DNA, 25 bp, Homo sapien
agaacgcgctggagcgctgcaccca

SEQ ID NO: 4276 - DNA, 25 bp, Homo sapien
ggcacaactgccagcaccgcgagga

SEQ ID NO: 4277 - DNA, 25 bp, Homo sapien
gggcccatcctgctggacgacgtgc

SEQ ID NO: 4278 - DNA, 25 bp, Homo sapien
gcggctctgactcaatgcgcgtgcg

SEQ ID NO: 4279 - DNA, 25 bp, Homo sapien
ttcgagttgtgcctcttcggtgatg

SEQ ID NO: 4280 - DNA, 25 bp, Homo sapien
ttcctgccaacccagtatcgaattg

SEQ ID NO: 4281 - DNA, 25 bp, Homo sapien
gtatcgaattgacggtcgccggccc

SEQ ID NO: 4282 - DNA, 25 bp, Homo sapien
ggacgtcccagcgacctttcaatgg

SEQ ID NO: 4283 - DNA, 25 bp, Homo sapien
ggcccgagctgagatcagttccctc

SEQ ID NO: 4284 - DNA, 25 bp, Homo sapien
cttcagcacgcatgcgggttccgga

SEQ ID NO: 4285 - DNA, 25 bp, Homo sapien
agctcgagaactgaatgcgctcgcc

SEQ ID NO: 4286 - DNA, 25 bp, Homo sapien
cgtttctgtggagccggtggtctcc

SEQ ID NO: 4287 - DNA, 25 bp, Homo sapien
ccggtggtctccttgtcatccatga

SEQ ID NO: 4288 - DNA, 25 bp, Homo sapien
ccgtgaacgcagtgggatttgacct

SEQ ID NO: 4289 - DNA, 25 bp, Homo sapien
cggaggcagtgggttgtgcattcat

SEQ ID NO: 4290 - DNA, 25 bp, Homo sapien
tctgcaggggactggccctacgtgg

SEQ ID NO: 4291 - DNA, 25 bp, Homo sapien
tgggctgacgtctccgcaggtctgc

SEQ ID NO: 4292 - DNA, 25 bp, Homo sapien
gaacgcagtgggatttgaccttccc

SEQ ID NO: 4293 - DNA, 25 bp, Homo sapien
tccttgtcatccatgagggtcctgc

SEQ ID NO: 4294 - DNA, 25 bp, Homo sapien
tgtcggtcatgaacagctgccggta

SEQ ID NO: 4295 - DNA, 25 bp, Homo sapien
ttcatgtaaagcttggccacgaacc

SEQ ID NO: 4296 - DNA, 25 bp, Homo sapien
gccagggtgcgtgttcatgtaaagc

SEQ ID NO: 4297 - DNA, 25 bp, Homo sapien
acttgattgagagcgccgatgctgc

SEQ ID NO: 4298 - DNA, 25 bp, Homo sapien
gcaccaggtagagacgcagcagcat

SEQ ID NO: 4299 - DNA, 25 bp, Homo sapien
atggccagggacagcagcgcttccc

SEQ ID NO: 4300 - DNA, 25 bp, Homo sapien
cccgcagcccgttgtcggtcatgaa

SEQ ID NO: 4301 - DNA, 25 bp, Homo sapien
acggacagcacccaggcggtggtca

SEQ ID NO: 4302 - DNA, 25 bp, Homo sapien
tcccgcgcaccttggctcaggttgg

SEQ ID NO: 4303 - DNA, 25 bp, Homo sapien
gggacctgccgatagcgcagtcatc

SEQ ID NO: 4304 - DNA, 25 bp, Homo sapien
atacaggcgtagcactcggcgccgc

SEQ ID NO: 4305 - DNA, 25 bp, Homo sapien
ggcaagagagcgtagatgcacactc

SEQ ID NO: 4306 - DNA, 25 bp, Homo sapien
gttgggatcctagcgcgccaagagc

SEQ ID NO: 4307 - DNA, 25 bp, Homo sapien
ttgcatttgtcagttgtgcagccgc

SEQ ID NO: 4308 - DNA, 25 bp, Homo sapien
cgcaccaccgagtagtctggcggca

SEQ ID NO: 4309 - DNA, 25 bp, Homo sapien
tgcacactcaggcagtggtaccctg

SEQ ID NO: 4310 - DNA, 25 bp, Homo sapien
ttgtaacctgtgctccgagtgcgta

SEQ ID NO: 4311 - DNA, 25 bp, Homo sapien
ccctttagcagggagcgtatattga

SEQ ID NO: 4312 - DNA, 25 bp, Homo sapien
tggcacgtgcactctcatacagacg

SEQ ID NO: 4313 - DNA, 25 bp, Homo sapien
gtcaccattcgcacggtagggcaca

SEQ ID NO: 4314 - DNA, 25 bp, Homo sapien
agggcacatccttggctctatcacg

SEQ ID NO: 4315 - DNA, 25 bp, Homo sapien
ccagggagacgcctgacctcgtttt

SEQ ID NO: 4316 - DNA, 25 bp, Homo sapien
ggcccagtgacctgtgggaattgta

SEQ ID NO: 4317 - DNA, 25 bp, Homo sapien
caggagacgccagaaacccaagttt

SEQ ID NO: 4318 - DNA, 25 bp, Homo sapien
gtagtccacccggaataaccatgtc

SEQ ID NO: 4319 - DNA, 25 bp, Homo sapien
cagcagctcggacaccggaaaaaga

SEQ ID NO: 4320 - DNA, 25 bp, Homo sapien
gtcttctggtcttcagcgcctctca

SEQ ID NO: 4321 - DNA, 25 bp, Homo sapien
ccggttccattccaaccagggactg

SEQ ID NO: 4322 - DNA, 25 bp, Homo sapien
tccgctgatttctgtggagacgatc

SEQ ID NO: 4323 - DNA, 25 bp, Homo sapien
accacgtaggggctacagcagctcg

SEQ ID NO: 4324 - DNA, 25 bp, Homo sapien
gatctagagctcgagggtgacccta

SEQ ID NO: 4325 - DNA, 25 bp, Homo sapien
ggagacgatctactcaccacgtagg

SEQ ID NO: 4326 - DNA, 25 bp, Homo sapien
tctcaacctcttgccgcggaagtgc

SEQ ID NO: 4327 - DNA, 25 bp, Homo sapien
ggcttcgtgttctcgtcctcaaata

SEQ ID NO: 4328 - DNA, 25 bp, Homo sapien
tcctcaaatagtcgaagtaccaccg

SEQ ID NO: 4329 - DNA, 25 bp, Homo sapien
cagcagctccggatacagtaaggca

SEQ ID NO: 4330 - DNA, 25 bp, Homo sapien
ttttcctgctgaccgaagtgcgagc

SEQ ID NO: 4331 - DNA, 25 bp, Homo sapien
aggactcactcacttccacgagagg

SEQ ID NO: 4332 - DNA, 25 bp, Homo sapien
ccacggccgaatcttatttctcaga

SEQ ID NO: 4333 - DNA, 25 bp, Homo sapien
gagccctgctgatcctacgaccaaa

SEQ ID NO: 4334 - DNA, 25 bp, Homo sapien
tctgtgatattttgagctgttctgc

SEQ ID NO: 4335 - DNA, 25 bp, Homo sapien
gggagttaccctttattctgtgata

SEQ ID NO: 4336 - DNA, 25 bp, Homo sapien
cggaaccctcaacgagctagcgata

SEQ ID NO: 4337 - DNA, 25 bp, Homo sapien
agcaccgtcggaaagcaaaggtttg

SEQ ID NO: 4338 - DNA, 25 bp, Homo sapien
ccttcttgcgtttagggctgtccta

SEQ ID NO: 4339 - DNA, 25 bp, Homo sapien
gctgtcctagcatcccgagggactc

SEQ ID NO: 4340 - DNA, 25 bp, Homo sapien
gtcctgtcacgtttcgccctatttg

SEQ ID NO: 4341 - DNA, 25 bp, Homo sapien
cacttccggtcaggcaggcggatcc

SEQ ID NO: 4342 - DNA, 25 bp, Homo sapien
tgagcctgcggttgctacataaccg

SEQ ID NO: 4343 - DNA, 25 bp, Homo sapien
tgatcgatgatccaagcaagggaaa

SEQ ID NO: 4344 - DNA, 25 bp, Homo sapien
tcaccttcgcttggggtcgcaacga

SEQ ID NO: 4345 - DNA, 25 bp, Homo sapien
accgcgtagtttgagccatttctgc

SEQ ID NO: 4346 - DNA, 25 bp, Homo sapien
agacgcgagcacttccggtgtgtga

SEQ ID NO: 4347 - DNA, 25 bp, Homo sapien
tctgaacttgtcaccttcgcttggg

SEQ ID NO: 4348 - DNA, 25 bp, Homo sapien
cgcaacgacccgatgatcgatgatc

SEQ ID NO: 4349 - DNA, 25 bp, Homo sapien
tggcgggtccttctgaacttgtcac

SEQ ID NO: 4350 - DNA, 25 bp, Homo sapien
tgccgttccagtcagctgagccttc

SEQ ID NO: 4351 - DNA, 25 bp, Homo sapien
gtgtgccctactttgacctcgctta

SEQ ID NO: 4352 - DNA, 25 bp, Homo sapien
cctttgtctcacacgggcgagtccg

SEQ ID NO: 4353 - DNA, 25 bp, Homo sapien
cacacgctctgtggaggctcgagca

SEQ ID NO: 4354 - DNA, 25 bp, Homo sapien
gtttgagtcatttccacatcttgcg

SEQ ID NO: 4355 - DNA, 25 bp, Homo sapien
tcttgcgagtccttccgaacgagtc

SEQ ID NO: 4356 - DNA, 25 bp, Homo sapien
gcaaccacccaatgatcgattcagg

SEQ ID NO: 4357 - DNA, 25 bp, Homo sapien
gtctcctttccttggggctcgcaac

SEQ ID NO: 4358 - DNA, 25 bp, Homo sapien
cgctagacgcaagcccgcggcttta

SEQ ID NO: 4359 - DNA, 25 bp, Homo sapien
cgtgcaccgcatcctgacgaaattg

SEQ ID NO: 4360 - DNA, 25 bp, Homo sapien
tcaccagaaccgagtagcccgtagc

SEQ ID NO: 4361 - DNA, 25 bp, Homo sapien
acgttggcgtttctcagactccgga

SEQ ID NO: 4362 - DNA, 25 bp, Homo sapien
ccgggacaggaatgcagccctaacc

SEQ ID NO: 4363 - DNA, 25 bp, Homo sapien
agcggtgtttcagcgctcacgtccg

SEQ ID NO: 4364 - DNA, 25 bp, Homo sapien
ggcagtctttgagcttcgcctcttg

SEQ ID NO: 4365 - DNA, 25 bp, Homo sapien
tttcgaaaatgtgcgccagggcgac

SEQ ID NO: 4366 - DNA, 25 bp, Homo sapien
tcaaggaagtgtagcgcaggagatc

SEQ ID NO: 4367 - DNA, 25 bp, Homo sapien
tgctggctcgcaaccacctggaagt

SEQ ID NO: 4368 - DNA, 25 bp, Homo sapien
tcttgtcggtccttctaaacgtgtc

SEQ ID NO: 4369 - DNA, 25 bp, Homo sapien
tcccgccggaaggtgatactataga

SEQ ID NO: 4370 - DNA, 25 bp, Homo sapien
aaatgtagttcacacgctgcgcggg

SEQ ID NO: 4371 - DNA, 25 bp, Homo sapien
caagtaggctcaggacggcgtatcc

SEQ ID NO: 4372 - DNA, 25 bp, Homo sapien
caggagatctgttgaatgacgagca

SEQ ID NO: 4373 - DNA, 25 bp, Homo sapien
cggcctctcttttcgttcttgtcag

SEQ ID NO: 4374 - DNA, 25 bp, Homo sapien
aagtggagtccaaacattcggtgga

SEQ ID NO: 4375 - DNA, 25 bp, Homo sapien
tcgtccgtggcaccttcttgggctt

SEQ ID NO: 4376 - DNA, 25 bp, Homo sapien
tttagctccggcagttgggtcccag

SEQ ID NO: 4377 - DNA, 25 bp, Homo sapien
acattcggtggagtcgcggacactt

SEQ ID NO: 4378 - DNA, 25 bp, Homo sapien
gacacttccgctcggggactgaggt

SEQ ID NO: 4379 - DNA, 25 bp, Homo sapien
gctgcagtttttccgcgatagtttg

SEQ ID NO: 4380 - DNA, 25 bp, Homo sapien
tccgcgcgttgcaggcccttctgaa

SEQ ID NO: 4381 - DNA, 25 bp, Homo sapien
ctgtttgcgttctcgtccgtggcac

SEQ ID NO: 4382 - DNA, 25 bp, Homo sapien
atctactgcccgcactatggggcgc

SEQ ID NO: 4383 - DNA, 25 bp, Homo sapien
tcaatgactacctggacatctactg

SEQ ID NO: 4384 - DNA, 25 bp, Homo sapien
ccgagcgcatggagcactacgtgct

SEQ ID NO: 4385 - DNA, 25 bp, Homo sapien
cgtgctgtacatggtcaacggcgag

SEQ ID NO: 4386 - DNA, 25 bp, Homo sapien
atggtcaacggcgagggccacgcct

SEQ ID NO: 4387 - DNA, 25 bp, Homo sapien
ggagaagttccagctcttcacgccc

SEQ ID NO: 4388 - DNA, 25 bp, Homo sapien
cttctccctgggcttcgagttccgg

SEQ ID NO: 4389 - DNA, 25 bp, Homo sapien
gtggaggtgagcatcaatgactacc

SEQ ID NO: 4390 - DNA, 25 bp, Homo sapien
ggtcagttccgcgagacccttctga

SEQ ID NO: 4391 - DNA, 25 bp, Homo sapien
cgcggtcagtttgtctcaggaattc

SEQ ID NO: 4392 - DNA, 25 bp, Homo sapien
tggagtccagacactcagtggagta

SEQ ID NO: 4393 - DNA, 25 bp, Homo sapien
actcagtggagtagcgggccacttc

SEQ ID NO: 4394 - DNA, 25 bp, Homo sapien
ggccacttccgctccgttactgtga

SEQ ID NO: 4395 - DNA, 25 bp, Homo sapien
tgtccctggtagtttgggtcagttc

SEQ ID NO: 4396 - DNA, 25 bp, Homo sapien
cgctgttttcgttctcgtcagtgga

SEQ ID NO: 4397 - DNA, 25 bp, Homo sapien
tgctgcagttttgtccctggtagtt

SEQ ID NO: 4398 - DNA, 25 bp, Homo sapien
cgctcagcgatataggattcgttcc

SEQ ID NO: 4399 - DNA, 25 bp, Homo sapien
tcacggcacattccacggtagtttc

SEQ ID NO: 4400 - DNA, 25 bp, Homo sapien
gtttcttccagttccgcgactcgcg

SEQ ID NO: 4401 - DNA, 25 bp, Homo sapien
tcagggacttaagattggggctcgc

SEQ ID NO: 4402 - DNA, 25 bp, Homo sapien
tagtcccgccaatcagtggagtcgc

SEQ ID NO: 4403 - DNA, 25 bp, Homo sapien
cgctcagtggagtcgtggtccattt

SEQ ID NO: 4404 - DNA, 25 bp, Homo sapien
gaacgtttttccctcagcattctga

SEQ ID NO: 4405 - DNA, 25 bp, Homo sapien
gagtcccatcgcttttccctgaagg

SEQ ID NO: 4406 - DNA, 25 bp, Homo sapien
cacctggatggtttttccttctgga

SEQ ID NO: 4407 - DNA, 25 bp, Homo sapien
ccagccatcagtcttgggatggaga

SEQ ID NO: 4408 - DNA, 25 bp, Homo sapien
cctgtgcttgggaataggcgctccc

SEQ ID NO: 4409 - DNA, 25 bp, Homo sapien
ttgaaccttttcagcctgtgcttgg

SEQ ID NO: 4410 - DNA, 25 bp, Homo sapien
ctgggaaacgtattccagaactctg

SEQ ID NO: 4411 - DNA, 25 bp, Homo sapien
ggaagtttgctctcctcccgcactt

SEQ ID NO: 4412 - DNA, 25 bp, Homo sapien
gagctccgagaattttgtcacactc

SEQ ID NO: 4413 - DNA, 25 bp, Homo sapien
ctctgtccggaaacaattgggccgc

SEQ ID NO: 4414 - DNA, 25 bp, Homo sapien
agtcagcgcggaacctctgcatcta

SEQ ID NO: 4415 - DNA, 25 bp, Homo sapien
agcctgtttccgctcgggcattctg

SEQ ID NO: 4416 - DNA, 25 bp, Homo sapien
gcagaagccgttgcaaccttgtgta

SEQ ID NO: 4417 - DNA, 25 bp, Homo sapien
aaccttgtgtacttccgctgcagga

SEQ ID NO: 4418 - DNA, 25 bp, Homo sapien
tgcatctacggcgagctttcctggc

SEQ ID NO: 4419 - DNA, 25 bp, Homo sapien
ctcgctctcagtgaagggaagtcgc

SEQ ID NO: 4420 - DNA, 25 bp, Homo sapien
tccaagttgggaatggctcctggtc

SEQ ID NO: 4421 - DNA, 25 bp, Homo sapien
ctcctggtcgcacgtttggtttgaa

SEQ ID NO: 4422 - DNA, 25 bp, Homo sapien
tgggagatatctcagatccgacctc

SEQ ID NO: 4423 - DNA, 25 bp, Homo sapien
agaagtcttggagacccggagctga

SEQ ID NO: 4424 - DNA, 25 bp, Homo sapien
cccacgcctaggcaaagagggctcg

SEQ ID NO: 4425 - DNA, 25 bp, Homo sapien
cccaagccaaggacgggttcattgc

SEQ ID NO: 4426 - DNA, 25 bp, Homo sapien
ttctgccgaggggacgcaaactccc

SEQ ID NO: 4427 - DNA, 25 bp, Homo sapien
tcccacgcaagaggttctgccgagg

SEQ ID NO: 4428 - DNA, 25 bp, Homo sapien
ggcagcagaccctcaacctcgaagg

SEQ ID NO: 4429 - DNA, 25 bp, Homo sapien
tgcccacggttcgtggactccactt

SEQ ID NO: 4430 - DNA, 25 bp, Homo sapien
cttcccagaattcccgacgggatca

SEQ ID NO: 4431 - DNA, 25 bp, Homo sapien
agagcggaagttacccgactacacg

SEQ ID NO: 4432 - DNA, 25 bp, Homo sapien
ctcagcctcctagagcggaagttac

SEQ ID NO: 4433 - DNA, 25 bp, Homo sapien
cttcgccgcaagtggattatcctcc

SEQ ID NO: 4434 - DNA, 25 bp, Homo sapien
aagtggctctgcctaccgagacctc

SEQ ID NO: 4435 - DNA, 25 bp, Homo sapien
cgctcacctttctgggaggaacgaa

SEQ ID NO: 4436 - DNA, 25 bp, Homo sapien
aacatcagtatggacggaaggagca

SEQ ID NO: 4437 - DNA, 25 bp, Homo sapien
ccctagagctactgcccggttgcta

SEQ ID NO: 4438 - DNA, 25 bp, Homo sapien
gcacaggcgctcagaatgttcgata

SEQ ID NO: 4439 - DNA, 25 bp, Homo sapien
atgttcgatacgtgcgcctccttac

SEQ ID NO: 4440 - DNA, 25 bp, Homo sapien
taagacgcctcaccactgcctaaga

SEQ ID NO: 4441 - DNA, 25 bp, Homo sapien
tggcctgacagtacaaccgcatgga

SEQ ID NO: 4442 - DNA, 25 bp, Homo sapien
gccgatcctaattcccatggcctga

SEQ ID NO: 4443 - DNA, 25 bp, Homo sapien
catggaaatccgtgggcttcgaccc

SEQ ID NO: 4444 - DNA, 25 bp, Homo sapien
gtaaatgcgcgtccacctcgagtca

SEQ ID NO: 4445 - DNA, 25 bp, Homo sapien
cactggtcctatagagccgatccta

SEQ ID NO: 4446 - DNA, 25 bp, Homo sapien
cctgcgcatggtctccaaaggctga

SEQ ID NO: 4447 - DNA, 25 bp, Homo sapien
actggccgacacttaagcactggaa

SEQ ID NO: 4448 - DNA, 25 bp, Homo sapien
tctcaccaaatccagaagcggcggg

SEQ ID NO: 4449 - DNA, 25 bp, Homo sapien
cagttggcttatgcgcatgcgtttc

SEQ ID NO: 4450 - DNA, 25 bp, Homo sapien
ttgaacgcctctcgagtccagttgg

SEQ ID NO: 4451 - DNA, 25 bp, Homo sapien
gagacgacacctacctgaccataga

SEQ ID NO: 4452 - DNA, 25 bp, Homo sapien
ccctctaacgcgagaatgtgtatga

SEQ ID NO: 4453 - DNA, 25 bp, Homo sapien
cggtcctgcacatcgcgtagagcga

SEQ ID NO: 4454 - DNA, 25 bp, Homo sapien
tgcgcatgcgcgcatcggacaccaa

SEQ ID NO: 4455 - DNA, 25 bp, Homo sapien
gattctgcaacacggccgactcggg

SEQ ID NO: 4456 - DNA, 25 bp, Homo sapien
caatggctgctcttgtggccgaacc

SEQ ID NO: 4457 - DNA, 25 bp, Homo sapien
cgaacccggaagtgcacttgggctc

SEQ ID NO: 4458 - DNA, 25 bp, Homo sapien
ggctcggagagccagaactacaatt

SEQ ID NO: 4459 - DNA, 25 bp, Homo sapien
ccacacctgtgcatgtgcaggtcta

SEQ ID NO: 4460 - DNA, 25 bp, Homo sapien
cagtcgcggaatatacagctgtatc

SEQ ID NO: 4461 - DNA, 25 bp, Homo sapien
ggctaaagcgccacccgcacagata

SEQ ID NO: 4462 - DNA, 25 bp, Homo sapien
tcctcttggccacccggagagcggt

SEQ ID NO: 4463 - DNA, 25 bp, Homo sapien
ctcgaaattggcagcaacacgggtc

SEQ ID NO: 4464 - DNA, 25 bp, Homo sapien
cagtcacttgtctggagcttgaaga

SEQ ID NO: 4465 - DNA, 25 bp, Homo sapien
ggagcaactggcatggcccgagcca

SEQ ID NO: 4466 - DNA, 25 bp, Homo sapien
gcgctactggtgctgtcctggccac

SEQ ID NO: 4467 - DNA, 25 bp, Homo sapien
tgcgagggcaggaccctcctcttgg

SEQ ID NO: 4468 - DNA, 25 bp, Homo sapien
tcggagttgggtacagaaattcctc

SEQ ID NO: 4469 - DNA, 25 bp, Homo sapien
gctccgcatccaggccgggtacttg

SEQ ID NO: 4470 - DNA, 25 bp, Homo sapien
accttctcttcggttctccgcaggg

SEQ ID NO: 4471 - DNA, 25 bp, Homo sapien
tgacgcatgtgtcacagctgacttg

SEQ ID NO: 4472 - DNA, 25 bp, Homo sapien
tgaatctggcagcatggccgtcttc

SEQ ID NO: 4473 - DNA, 25 bp, Homo sapien
tggccgtcttccaccaaacgcaggg

SEQ ID NO: 4474 - DNA, 25 bp, Homo sapien
tgcgcgtagaggatgaaggcaacta

SEQ ID NO: 4475 - DNA, 25 bp, Homo sapien
tgcctgttcgtcacgttcccgcagg

SEQ ID NO: 4476 - DNA, 25 bp, Homo sapien
gtgacgctgccctgctacctacagg

SEQ ID NO: 4477 - DNA, 25 bp, Homo sapien
ctacaggtgcccaacatggaggtga

SEQ ID NO: 4478 - DNA, 25 bp, Homo sapien
tggctcagggctcccgtgagaccac

SEQ ID NO: 4479 - DNA, 25 bp, Homo sapien
agagacctcggcatcagctcccggg

SEQ ID NO: 4480 - DNA, 25 bp, Homo sapien
ttcgtccgtacctgcgggacagaga

SEQ ID NO: 4481 - DNA, 25 bp, Homo sapien
tcaaacagcacgtccttcgtccgta

SEQ ID NO: 4482 - DNA, 25 bp, Homo sapien
atcaggtggctgatgctctcaaaca

SEQ ID NO: 4483 - DNA, 25 bp, Homo sapien
ccgttctgcaggtggtggtcgatca

SEQ ID NO: 4484 - DNA, 25 bp, Homo sapien
cctggacccgtggagtaggatattg

SEQ ID NO: 4485 - DNA, 25 bp, Homo sapien
gccacgatgggctgcccgttctgca

SEQ ID NO: 4486 - DNA, 25 bp, Homo sapien
aataactcgtgtagcagcccgggcg

SEQ ID NO: 4487 - DNA, 25 bp, Homo sapien
ccgcctccgagaccaaatagagacg

SEQ ID NO: 4488 - DNA, 25 bp, Homo sapien
acccgcagacgagaccctgtacgag

SEQ ID NO: 4489 - DNA, 25 bp, Homo sapien
aatagagacgctgcttctccctcgc

SEQ ID NO: 4490 - DNA, 25 bp, Homo sapien
gatgcggaccgtggccaggccatct

SEQ ID NO: 4491 - DNA, 25 bp, Homo sapien
tgctctggaccctcctgggttccta

SEQ ID NO: 4492 - DNA, 25 bp, Homo sapien
ccatcttcaccagcaataactcgtg

SEQ ID NO: 4493 - DNA, 25 bp, Homo sapien
agaccctgtacgaggctcctgagcc

SEQ ID NO: 4494 - DNA, 25 bp, Homo sapien
cgccgaggtccgctggttcttcaac

SEQ ID NO: 4495 - DNA, 25 bp, Homo sapien
tgtggaacccggtcagtgtcagccg

SEQ ID NO: 4496 - DNA, 25 bp, Homo sapien
gacaccctgcgccttatgtgcagca

SEQ ID NO: 4497 - DNA, 25 bp, Homo sapien
gtcgagacaccctgcgccttatgtg

SEQ ID NO: 4498 - DNA, 25 bp, Homo sapien
cgctggtggaacgtcgagacaccct

SEQ ID NO: 4499 - DNA, 25 bp, Homo sapien
cctatcagtgtgaggtgtggaaccc

SEQ ID NO: 4500 - DNA, 25 bp, Homo sapien
ctggttcttcaacggtggggccctg

SEQ ID NO: 4501 - DNA, 25 bp, Homo sapien
aggtccgctggttcttcaacggtgg

SEQ ID NO: 4502 - DNA, 25 bp, Homo sapien
ccaaggacctgctggtctacgcctg

SEQ ID NO: 4503 - DNA, 25 bp, Homo sapien
acctgctggtctacgcctggtaccg

SEQ ID NO: 4504 - DNA, 25 bp, Homo sapien
agccagctgccgtcaggaacctgga

SEQ ID NO: 4505 - DNA, 25 bp, Homo sapien
gggccaggacgtaacactgaccgtg

SEQ ID NO: 4506 - DNA, 25 bp, Homo sapien
ccagctgcagcagttgccacgatga

SEQ ID NO: 4507 - DNA, 25 bp, Homo sapien
ccaccaagccaacggagggccagga

SEQ ID NO: 4508 - DNA, 25 bp, Homo sapien
tgccgtcaggaacctggattgcagg

SEQ ID NO: 4509 - DNA, 25 bp, Homo sapien
ttgccacgatgatcgtgcccgtgcc

SEQ ID NO: 4510 - DNA, 25 bp, Homo sapien
gagatcatcggggagccagtaagct

SEQ ID NO: 4511 - DNA, 25 bp, Homo sapien
cccaggttccaaggatatagatatg

SEQ ID NO: 4512 - DNA, 25 bp, Homo sapien
gacaagaggatataagcccaggttc

SEQ ID NO: 4513 - DNA, 25 bp, Homo sapien
agcttgaggcacaaaccggtgtctc

SEQ ID NO: 4514 - DNA, 25 bp, Homo sapien
acacagagcatagggtcaccagagc

SEQ ID NO: 4515 - DNA, 25 bp, Homo sapien
ccgggtgggatccacacagagcata

SEQ ID NO: 4516 - DNA, 25 bp, Homo sapien
agtcccttcagttcagccggctgca

SEQ ID NO: 4517 - DNA, 25 bp, Homo sapien
ggccgacaaaagtcccttcagttca

SEQ ID NO: 4518 - DNA, 25 bp, Homo sapien
ccgcccagcagacctgttactggaa

SEQ ID NO: 4519 - DNA, 25 bp, Homo sapien
tctgaaatcattcgctgcgtctgcc

SEQ ID NO: 4520 - DNA, 25 bp, Homo sapien
tctctgaaatcattcgctgcgtctg

SEQ ID NO: 4521 - DNA, 25 bp, Homo sapien
tatgggaactcaggcctggacggtt

SEQ ID NO: 4522 - DNA, 25 bp, Homo sapien
gcgtttatgggaactcaggcctgga

SEQ ID NO: 4523 - DNA, 25 bp, Homo sapien
gcccgcgcgtttatgggaactcagg

SEQ ID NO: 4524 - DNA, 25 bp, Homo sapien
tgcgtctgccctcacttaaccctgg

SEQ ID NO: 4525 - DNA, 25 bp, Homo sapien
cctgttactggaagtccgagggctg

SEQ ID NO: 4526 - DNA, 25 bp, Homo sapien
gccgtggaaaacaacagccttagca

SEQ ID NO: 4527 - DNA, 25 bp, Homo sapien
cgcgtccagctctgatcctttaagg

SEQ ID NO: 4528 - DNA, 25 bp, Homo sapien
tcggtgtccagctccggttaattca

SEQ ID NO: 4529 - DNA, 25 bp, Homo sapien
cggttaattcatcgccgccaacgca

SEQ ID NO: 4530 - DNA, 25 bp, Homo sapien
gcgccaacgtgaacgcgcaaatgta

SEQ ID NO: 4531 - DNA, 25 bp, Homo sapien
gcgcaaatgtactccggcagctccg

SEQ ID NO: 4532 - DNA, 25 bp, Homo sapien
cgcaggacattaagagcggccgctc

SEQ ID NO: 4533 - DNA, 25 bp, Homo sapien
taggccctgtccacgcattgtcctt

SEQ ID NO: 4534 - DNA, 25 bp, Homo sapien
gtgtagtctcgtcgctctacgctgc

SEQ ID NO: 4535 - DNA, 25 bp, Homo sapien
gcgctgccgattcgggttattttta

SEQ ID NO: 4536 - DNA, 25 bp, Homo sapien
tctacgctgcgtgcaagaccgactc

SEQ ID NO: 4537 - DNA, 25 bp, Homo sapien
cagacccttgctctttcgctggaga

SEQ ID NO: 4538 - DNA, 25 bp, Homo sapien
cgcctgatggggacgttatatgaaa

SEQ ID NO: 4539 - DNA, 25 bp, Homo sapien
agtgcttgaatttccgccggtacag

SEQ ID NO: 4540 - DNA, 25 bp, Homo sapien
ttttctgcttccattccgtcggatc

SEQ ID NO: 4541 - DNA, 25 bp, Homo sapien
tctgtgatcaggtaggtgtagtctc

SEQ ID NO: 4542 - DNA, 25 bp, Homo sapien
gtccttcccggcacacgcgaggctc

SEQ ID NO: 4543 - DNA, 25 bp, Homo sapien
cacacgcgaggctcccatggctctg

SEQ ID NO: 4544 - DNA, 25 bp, Homo sapien
ggcagtcaggatgctgcagcgccta

SEQ ID NO: 4545 - DNA, 25 bp, Homo sapien
tcaggatgctgcagcgcctagaaga

SEQ ID NO: 4546 - DNA, 25 bp, Homo sapien
agcgcctagaagagcaatgcgtcga

SEQ ID NO: 4547 - DNA, 25 bp, Homo sapien
gcctagaagagcaatgcgtcgaccc

SEQ ID NO: 4548 - DNA, 25 bp, Homo sapien
agagcaatgcgtcgacccccggctg

SEQ ID NO: 4549 - DNA, 25 bp, Homo sapien
agccgcaccggtccttcccggcaca

SEQ ID NO: 4550 - DNA, 25 bp, Homo sapien
cagctcgggtcactggctacgctgg

SEQ ID NO: 4551 - DNA, 25 bp, Homo sapien
tgcctggtgagatcccagctcgggt

SEQ ID NO: 4552 - DNA, 25 bp, Homo sapien
gccgtgaacatggagcccccggacg

SEQ ID NO: 4553 - DNA, 25 bp, Homo sapien
actggctacgctggtcgatcaggcc

SEQ ID NO: 4554 - DNA, 25 bp, Homo sapien
aggcgctggtcagtaagcccggaca

SEQ ID NO: 4555 - DNA, 25 bp, Homo sapien
tcagtaagcccggacagctctaggc

SEQ ID NO: 4556 - DNA, 25 bp, Homo sapien
aagcccggacagctctaggcttggg

SEQ ID NO: 4557 - DNA, 25 bp, Homo sapien
tccgcgattgcctggtgagatccca

SEQ ID NO: 4558 - DNA, 25 bp, Homo sapien
cactgcgcggctcaacgtgtttggt

SEQ ID NO: 4559 - DNA, 25 bp, Homo sapien
tctgagctccaggtcacaatgcacg

SEQ ID NO: 4560 - DNA, 25 bp, Homo sapien
tttggtaagtgtcctcgggcatccc

SEQ ID NO: 4561 - DNA, 25 bp, Homo sapien
ataccagctggactcccaggggcgc

SEQ ID NO: 4562 - DNA, 25 bp, Homo sapien
acagaccgaccgctcgggagctcgc

SEQ ID NO: 4563 - DNA, 25 bp, Homo sapien
ctcaacgtgtttggtaagtgtcctc

SEQ ID NO: 4564 - DNA, 25 bp, Homo sapien
agcctcggctgagatgcagggctct

SEQ ID NO: 4565 - DNA, 25 bp, Homo sapien
ggtcacaatgcacgacacccggggc

SEQ ID NO: 4566 - DNA, 25 bp, Homo sapien
gctatggcctggctgactgccacct

SEQ ID NO: 4567 - DNA, 25 bp, Homo sapien
tgcccgtagagatgaacccaggtga

SEQ ID NO: 4568 - DNA, 25 bp, Homo sapien
ccgatctctcccagagggctacatg

SEQ ID NO: 4569 - DNA, 25 bp, Homo sapien
gggctacatgaccagccgcacggtc

SEQ ID NO: 4570 - DNA, 25 bp, Homo sapien
cctgcggctccgcaaggatgaccga

SEQ ID NO: 4571 - DNA, 25 bp, Homo sapien
ggatgaccgagacgccagcttccac

SEQ ID NO: 4572 - DNA, 25 bp, Homo sapien
atcacgtggtatcgcaacgggcagc

SEQ ID NO: 4573 - DNA, 25 bp, Homo sapien
agatcgccacctgcaacagccggaa

SEQ ID NO: 4574 - DNA, 25 bp, Homo sapien
acaaagggcccgagtctgagcgaga

SEQ ID NO: 4575 - DNA, 25 bp, Homo sapien
ctggacgaacttgggcccagactgg

SEQ ID NO: 4576 - DNA, 25 bp, Homo sapien
cctgggcagcccaaagaatgcgaag

SEQ ID NO: 4577 - DNA, 25 bp, Homo sapien
cgagccgctgggagagacaaagggc

SEQ ID NO: 4578 - DNA, 25 bp, Homo sapien
ctcctggccctggacgaacttgggc

SEQ ID NO: 4579 - DNA, 25 bp, Homo sapien
gcccgagtctgagcgagagacacaa

SEQ ID NO: 4580 - DNA, 25 bp, Homo sapien
agagacacaaagacgcgaggaggct

SEQ ID NO: 4581 - DNA, 25 bp, Homo sapien
cccaaagaatgcgaagaggtaggtg

SEQ ID NO: 4582 - DNA, 25 bp, Homo sapien
gactgaggtctttacggctggacga

SEQ ID NO: 4583 - DNA, 25 bp, Homo sapien
atgaggcagcccaggcacaaagacc

SEQ ID NO: 4584 - DNA, 25 bp, Homo sapien
ctcctaatgaggcagcccaggcaca

SEQ ID NO: 4585 - DNA, 25 bp, Homo sapien
attaattcagctgcgctgggcccgg

SEQ ID NO: 4586 - DNA, 25 bp, Homo sapien
gggaacgctcccagctaattaattc

SEQ ID NO: 4587 - DNA, 25 bp, Homo sapien
cacaattagccgagcgggaacgctc

SEQ ID NO: 4588 - DNA, 25 bp, Homo sapien
acgacggcgtctccggcacaattag

SEQ ID NO: 4589 - DNA, 25 bp, Homo sapien
ctggacgatggtcgcctgcatccca

SEQ ID NO: 4590 - DNA, 25 bp, Homo sapien
tttaacgccgggagcgaaggagaca

SEQ ID NO: 4591 - DNA, 25 bp, Homo sapien
ctccaaccttaccttccgagctggg

SEQ ID NO: 4592 - DNA, 25 bp, Homo sapien
ctgctcctggaaaccggtgagacga

SEQ ID NO: 4593 - DNA, 25 bp, Homo sapien
tgacgtcagcgggttcgaaccgccg

SEQ ID NO: 4594 - DNA, 25 bp, Homo sapien
accttagaatcctggggaggagcga

SEQ ID NO: 4595 - DNA, 25 bp, Homo sapien
tggcaggggcgaccttagaatcctg

SEQ ID NO: 4596 - DNA, 25 bp, Homo sapien
acagaattctttggcaggggcgacc

SEQ ID NO: 4597 - DNA, 25 bp, Homo sapien
cgggagcgaaggagacagaattctt

SEQ ID NO: 4598 - DNA, 25 bp, Homo sapien
ggcctcagggcacactaaaccaatg

SEQ ID NO: 4599 - DNA, 25 bp, Homo sapien
ttcgaccctggaacgttagccaatg

SEQ ID NO: 4600 - DNA, 25 bp, Homo sapien
ccggcaccagtacgagtcgaagttc

SEQ ID NO: 4601 - DNA, 25 bp, Homo sapien
gctaccctgcgagtgagaaccaata

SEQ ID NO: 4602 - DNA, 25 bp, Homo sapien
ctcagcacagaccaatggcgggtta

SEQ ID NO: 4603 - DNA, 25 bp, Homo sapien
ggcggaatcaaaagagggcctcctc

SEQ ID NO: 4604 - DNA, 25 bp, Homo sapien
ttatcacagcaacctcgccgcgggg

SEQ ID NO: 4605 - DNA, 25 bp, Homo sapien
gtaccaagctgatacgccaccaagg

SEQ ID NO: 4606 - DNA, 25 bp, Homo sapien
cctgtgcccagcgacaatcactgaa

SEQ ID NO: 4607 - DNA, 25 bp, Homo sapien
cctgcgcaagctgcgtaagcggctc

SEQ ID NO: 4608 - DNA, 25 bp, Homo sapien
gacaatcactgaacgccgaagcctg

SEQ ID NO: 4609 - DNA, 25 bp, Homo sapien
ccctggtggaagacatgcagcgcca

SEQ ID NO: 4610 - DNA, 25 bp, Homo sapien
tccaggcccgcctcaagagctggtt

SEQ ID NO: 4611 - DNA, 25 bp, Homo sapien
tccgcgatgccgatgacctgcagaa

SEQ ID NO: 4612 - DNA, 25 bp, Homo sapien
ttgaaggcctacaaatcggaactgg

SEQ ID NO: 4613 - DNA, 25 bp, Homo sapien
tgcagaagcgcctggcagtgtacca

SEQ ID NO: 4614 - DNA, 25 bp, Homo sapien
acatgctggccgagaaagtcctgga

SEQ ID NO: 4615 - DNA, 25 bp, Homo sapien
cggggctaggaaagcgtgaaatctc

SEQ ID NO: 4616 - DNA, 25 bp, Homo sapien
ggcgtgtcctacctcttgtcacgga

SEQ ID NO: 4617 - DNA, 25 bp, Homo sapien
tccttggccagagggaccttgaata

SEQ ID NO: 4618 - DNA, 25 bp, Homo sapien
gctcattgctcgatccggggagaca

SEQ ID NO: 4619 - DNA, 25 bp, Homo sapien
gcgattccatgctctgaggccgttc

SEQ ID NO: 4620 - DNA, 25 bp, Homo sapien
cgttcctagagtggtctggcgttca

SEQ ID NO: 4621 - DNA, 25 bp, Homo sapien
tggccggtaaagctcaagaaacatg

SEQ ID NO: 4622 - DNA, 25 bp, Homo sapien
cacggaaacccagctaggccagttc

SEQ ID NO: 4623 - DNA, 25 bp, Homo sapien
gaccgccgagaacatcagaggaacc

SEQ ID NO: 4624 - DNA, 25 bp, Homo sapien
ggaaacgaggcctctgcgtcctctg

SEQ ID NO: 4625 - DNA, 25 bp, Homo sapien
cccgcggcaggaaaatcgactttcg

SEQ ID NO: 4626 - DNA, 25 bp, Homo sapien
gaaaatcgactttcgcgcgcgccct

SEQ ID NO: 4627 - DNA, 25 bp, Homo sapien
tgatgacgtcatgcccgacgcgttt

SEQ ID NO: 4628 - DNA, 25 bp, Homo sapien
cgacgcgtttctcgccggggcaaga

SEQ ID NO: 4629 - DNA, 25 bp, Homo sapien
ccatcggtgttgtcgcgtatgatga

SEQ ID NO: 4630 - DNA, 25 bp, Homo sapien
ttcgagcgaggcgtcccgctgtaga

SEQ ID NO: 4631 - DNA, 25 bp, Homo sapien
tgcatgcttcggtctgggccagcct

SEQ ID NO: 4632 - DNA, 25 bp, Homo sapien
agaaggcggagcgaaagctgctctt

SEQ ID NO: 4633 - DNA, 25 bp, Homo sapien
tcctatgggagtctaagggtttcgc

SEQ ID NO: 4634 - DNA, 25 bp, Homo sapien
tgagggttcctgagacactgtatta

SEQ ID NO: 4635 - DNA, 25 bp, Homo sapien
gattctggcggtcccggagtagtct

SEQ ID NO: 4636 - DNA, 25 bp, Homo sapien
cggcccgcgtgcatgcttcggtctg

SEQ ID NO: 4637 - DNA, 25 bp, Homo sapien
gacactgtattagggcgtaggaaga

SEQ ID NO: 4638 - DNA, 25 bp, Homo sapien
atgcgcttccgctacgagtgcgagg

SEQ ID NO: 4639 - DNA, 25 bp, Homo sapien
atcgacgagtacatcaaggagaacg

SEQ ID NO: 4640 - DNA, 25 bp, Homo sapien
ctcccgcagagatcatcgacgagta

SEQ ID NO: 4641 - DNA, 25 bp, Homo sapien
agcagcgcggcatgcgcttccgcta

SEQ ID NO: 4642 - DNA, 25 bp, Homo sapien
gtcatcacggagcagcccaagcagc

SEQ ID NO: 4643 - DNA, 25 bp, Homo sapien
agccgcacctggtcatcacggagca

SEQ ID NO: 4644 - DNA, 25 bp, Homo sapien
caaggagaacggcttcggcctggac

SEQ ID NO: 4645 - DNA, 25 bp, Homo sapien
tacatcaaggagaacggcttcggcc

SEQ ID NO: 4646 - DNA, 25 bp, Homo sapien
actgacactggactcgtaccaggcc

SEQ ID NO: 4647 - DNA, 25 bp, Homo sapien
cctgacctcctggacgatggctttg

SEQ ID NO: 4648 - DNA, 25 bp, Homo sapien
gatggctttgcctacgaccctacgg

SEQ ID NO: 4649 - DNA, 25 bp, Homo sapien
ggccctgaaccactgacactggact

SEQ ID NO: 4650 - DNA, 25 bp, Homo sapien
agccttgtgggcagcaacatgttcc

SEQ ID NO: 4651 - DNA, 25 bp, Homo sapien
aatcattaccgcgaggcggcctttg

SEQ ID NO: 4652 - DNA, 25 bp, Homo sapien
cctgacttcttctctggcaccgtgt

SEQ ID NO: 4653 - DNA, 25 bp, Homo sapien
accgccacacgctagcgctgttgtg

SEQ ID NO: 4654 - DNA, 25 bp, Homo sapien
ttcggcccagcagcttatcacaggc

SEQ ID NO: 4655 - DNA, 25 bp, Homo sapien
cgcctctctcgtcggcggaagtgcg

SEQ ID NO: 4656 - DNA, 25 bp, Homo sapien
tgagtgcaggctgcggctcgacctc

SEQ ID NO: 4657 - DNA, 25 bp, Homo sapien
agttgccgcgtcgaactcggccttc

SEQ ID NO: 4658 - DNA, 25 bp, Homo sapien
tagcgcggcctttcatttccgcttc

SEQ ID NO: 4659 - DNA, 25 bp, Homo sapien
aggccgcgacgcgatccacaagccc

SEQ ID NO: 4660 - DNA, 25 bp, Homo sapien
tgggccagaagttgccgcgtcgaac

SEQ ID NO: 4661 - DNA, 25 bp, Homo sapien
cccattaggcctgacgggcctcagg

SEQ ID NO: 4662 - DNA, 25 bp, Homo sapien
tctgctgtgtgtgctgttcccgaag

SEQ ID NO: 4663 - DNA, 25 bp, Homo sapien
tgctgttcccgaagaggctccggga

SEQ ID NO: 4664 - DNA, 25 bp, Homo sapien
atcaggagtcaccacagggaagccc

SEQ ID NO: 4665 - DNA, 25 bp, Homo sapien
cagcatcaggagtcaccacagggaa

SEQ ID NO: 4666 - DNA, 25 bp, Homo sapien
atcaccagttttgggggcagcgatg

SEQ ID NO: 4667 - DNA, 25 bp, Homo sapien
gagaagatcacgttcatcaccagtt

SEQ ID NO: 4668 - DNA, 25 bp, Homo sapien
ccgcgaggagaagatcacgttcatc

SEQ ID NO: 4669 - DNA, 25 bp, Homo sapien
ccgggacgtaatgccagcgcccggt

SEQ ID NO: 4670 - DNA, 25 bp, Homo sapien
ggtaaaatgcttcccgcagaactca

SEQ ID NO: 4671 - DNA, 25 bp, Homo sapien
tgctgctgttggtaaaatgcttccc

SEQ ID NO: 4672 - DNA, 25 bp, Homo sapien
caccgtcaggttgctgctgttggta

SEQ ID NO: 4673 - DNA, 25 bp, Homo sapien
tagttgcagaactcacaggtgtagg

SEQ ID NO: 4674 - DNA, 25 bp, Homo sapien
cgcaggcgtagttgcagaactcaca

SEQ ID NO: 4675 - DNA, 25 bp, Homo sapien
cggtggcggttgagcttactgctct

SEQ ID NO: 4676 - DNA, 25 bp, Homo sapien
ctcgcaggccgaagggcacatggca

SEQ ID NO: 4677 - DNA, 25 bp, Homo sapien
gcttctgccgcaggtgtttgtccag

SEQ ID NO: 4678 - DNA, 25 bp, Homo sapien
cgcagagtcttttccgcccagagga

SEQ ID NO: 4679 - DNA, 25 bp, Homo sapien
ctggtcccgcgcagagtcttttccg

SEQ ID NO: 4680 - DNA, 25 bp, Homo sapien
aggatcctgagggaagtcatctccc

SEQ ID NO: 4681 - DNA, 25 bp, Homo sapien
gcctgaggcgcccaaaactcttgag

SEQ ID NO: 4682 - DNA, 25 bp, Homo sapien
ccaaaactcttgagtgcggcttggg

SEQ ID NO: 4683 - DNA, 25 bp, Homo sapien
gtcttttccgcccagaggatcctga

SEQ ID NO: 4684 - DNA, 25 bp, Homo sapien
ctgccagccctggacggccattggt

SEQ ID NO: 4685 - DNA, 25 bp, Homo sapien
acggccattggtacgctggtcccgc

SEQ ID NO: 4686 - DNA, 25 bp, Homo sapien
cagctatccctgatcccgttttagg

SEQ ID NO: 4687 - DNA, 25 bp, Homo sapien
actcaatctaggcagtgtcccgtgc

SEQ ID NO: 4688 - DNA, 25 bp, Homo sapien
cccaagcgagaaaaatagtcggtca

SEQ ID NO: 4689 - DNA, 25 bp, Homo sapien
tcccgtgcgtttggcttagtgacca

SEQ ID NO: 4690 - DNA, 25 bp, Homo sapien
acaccgagttcccacaaggcattga

SEQ ID NO: 4691 - DNA, 25 bp, Homo sapien
ggtcctgcatttccatctcgtcgtc

SEQ ID NO: 4692 - DNA, 25 bp, Homo sapien
cgccgcgaactcttacacgtgctgg

SEQ ID NO: 4693 - DNA, 25 bp, Homo sapien
cctgacggcggcctaactcaatcta

SEQ ID NO: 4694 - DNA, 25 bp, Homo sapien
tgcaacgccctgagtgacggaaaga

SEQ ID NO: 4695 - DNA, 25 bp, Homo sapien
gcagtcatcccgctttacctggagc

SEQ ID NO: 4696 - DNA, 25 bp, Homo sapien
gacgctcctatcagggactgtttga

SEQ ID NO: 4697 - DNA, 25 bp, Homo sapien
ctgtttgatcccgatcgccggcagc

SEQ ID NO: 4698 - DNA, 25 bp, Homo sapien
acagaagcatcggtggcagtcatcc

SEQ ID NO: 4699 - DNA, 25 bp, Homo sapien
agcggaatcgctcgctcagtctgag

SEQ ID NO: 4700 - DNA, 25 bp, Homo sapien
ccgcggacctcggtgagtacaaggt

SEQ ID NO: 4701 - DNA, 25 bp, Homo sapien
gaagaaggtccagtccgaacgccca

SEQ ID NO: 4702 - DNA, 25 bp, Homo sapien
gagtgtcgtttcgtctcagtcgcga

SEQ ID NO: 4703 - DNA, 25 bp, Homo sapien
aggcccggacttagctctcgagttg

SEQ ID NO: 4704 - DNA, 25 bp, Homo sapien
tttctctccagccttgcagcgtggc

SEQ ID NO: 4705 - DNA, 25 bp, Homo sapien
gttcaggatgtaagcgaagccttcc

SEQ ID NO: 4706 - DNA, 25 bp, Homo sapien
tcactagtaacctttcagcgcattg

SEQ ID NO: 4707 - DNA, 25 bp, Homo sapien
gtggccgttcacatcacgcgcttca

SEQ ID NO: 4708 - DNA, 25 bp, Homo sapien
tcgcgatcagggtgcaacttcactc

SEQ ID NO: 4709 - DNA, 25 bp, Homo sapien
ctcctctagttagccgggtgcgctt

SEQ ID NO: 4710 - DNA, 25 bp, Homo sapien
ctgaactgagtctccgtccggatca

SEQ ID NO: 4711 - DNA, 25 bp, Homo sapien
tacttacctcctgacaactgcatgg

SEQ ID NO: 4712 - DNA, 25 bp, Homo sapien
tggagtaaaccacaccgccttgtta

SEQ ID NO: 4713 - DNA, 25 bp, Homo sapien
gccttgttaaatgccgtcgccgccg

SEQ ID NO: 4714 - DNA, 25 bp, Homo sapien
ggcctgtttgtctctcttggggttc

SEQ ID NO: 4715 - DNA, 25 bp, Homo sapien
tggcagagccttctaacgggcctcg

SEQ ID NO: 4716 - DNA, 25 bp, Homo sapien
tttacccgcgggcagtctatgaccc

SEQ ID NO: 4717 - DNA, 25 bp, Homo sapien
gagctcctgctcgaaggcaatgaca

SEQ ID NO: 4718 - DNA, 25 bp, Homo sapien
tcccgtccgacgaggatatcgtgtc

SEQ ID NO: 4719 - DNA, 25 bp, Homo sapien
ctcatagtctgcagttccggctctg

SEQ ID NO: 4720 - DNA, 25 bp, Homo sapien
cgcgggacaactctacgtgcaagtc

SEQ ID NO: 4721 - DNA, 25 bp, Homo sapien
cgtgcaagtcgctgaaatcgatttt

SEQ ID NO: 4722 - DNA, 25 bp, Homo sapien
cttcttatagtaagcggcgggctcg

SEQ ID NO: 4723 - DNA, 25 bp, Homo sapien
ctcgccagcctcgagcgaaagtgtg

SEQ ID NO: 4724 - DNA, 25 bp, Homo sapien
aggctgcagccaagcgcgtcacatt

SEQ ID NO: 4725 - DNA, 25 bp, Homo sapien
attcgttatttggactccggcagga

SEQ ID NO: 4726 - DNA, 25 bp, Homo sapien
tccaccaagctcacgtgcgagggta

SEQ ID NO: 4727 - DNA, 25 bp, Homo sapien
atggcactgtcgttggccctcaagg

SEQ ID NO: 4728 - DNA, 25 bp, Homo sapien
ggccctcaaggtgaaccactcactg

SEQ ID NO: 4729 - DNA, 25 bp, Homo sapien
tggacctcgaccgtgaacccaagaa

SEQ ID NO: 4730 - DNA, 25 bp, Homo sapien
gtgaagagcttcatcgagacgcaga

SEQ ID NO: 4731 - DNA, 25 bp, Homo sapien
agctgtcggcctccatgcctgagac

SEQ ID NO: 4732 - DNA, 25 bp, Homo sapien
cctgagactggaccttcgggagaac

SEQ ID NO: 4733 - DNA, 25 bp, Homo sapien
cggcacctcaagaacgggctcatca

SEQ ID NO: 4734 - DNA, 25 bp, Homo sapien
cgctggcttacgaacaggtgcttgc

SEQ ID NO: 4735 - DNA, 25 bp, Homo sapien
tcatctcgcggtacaacaggtcgtc

SEQ ID NO: 4736 - DNA, 25 bp, Homo sapien
gttatcggccgtgcccttcatgttg

SEQ ID NO: 4737 - DNA, 25 bp, Homo sapien
gctggctgccgaacttttcacgcga

SEQ ID NO: 4738 - DNA, 25 bp, Homo sapien
cgctcgatcttcttgcgctggctta

SEQ ID NO: 4739 - DNA, 25 bp, Homo sapien
tggccgcccagtgacaagtagagca

SEQ ID NO: 4740 - DNA, 25 bp, Homo sapien
atgcgccgcatggacaccacgttgt

SEQ ID NO: 4741 - DNA, 25 bp, Homo sapien
ggcttgttgcccagcaccgagtaca

SEQ ID NO: 4742 - DNA, 25 bp, Homo sapien
ggcggttcctccattcatgtgactc

SEQ ID NO: 4743 - DNA, 25 bp, Homo sapien
gactttcctcgtcgcacaacctgga

SEQ ID NO: 4744 - DNA, 25 bp, Homo sapien
ggttacacgtgacatactcggcttt

SEQ ID NO: 4745 - DNA, 25 bp, Homo sapien
agcccttcagctgccacggtgagaa

SEQ ID NO: 4746 - DNA, 25 bp, Homo sapien
tcgtaaagacctcggcttgggactc

SEQ ID NO: 4747 - DNA, 25 bp, Homo sapien
cagatccttgttcgagctggtcttc

SEQ ID NO: 4748 - DNA, 25 bp, Homo sapien
gggaatccaggacctgcgcctttta

SEQ ID NO: 4749 - DNA, 25 bp, Homo sapien
aatccacgtgacttggccgctaatg

SEQ ID NO: 4750 - DNA, 25 bp, Homo sapien
agccgccggaacagcctctgcagtt

SEQ ID NO: 4751 - DNA, 25 bp, Homo sapien
aaacccgaggggtgtgagccatgcc

SEQ ID NO: 4752 - DNA, 25 bp, Homo sapien
tagctcggctaccagcgcctggagg

SEQ ID NO: 4753 - DNA, 25 bp, Homo sapien
agcgcccgccggtgtagctcggcta

SEQ ID NO: 4754 - DNA, 25 bp, Homo sapien
aggggccgcacgtactcgaccagcg

SEQ ID NO: 4755 - DNA, 25 bp, Homo sapien
acggactcccatcccgccagtctga

SEQ ID NO: 4756 - DNA, 25 bp, Homo sapien
cgccggaacagcctctgcagttgcg

SEQ ID NO: 4757 - DNA, 25 bp, Homo sapien
agcaggggccgcacgtactcgacca

SEQ ID NO: 4758 - DNA, 25 bp, Homo sapien
tgtgctcgtccgcacgcgctagttc

SEQ ID NO: 4759 - DNA, 25 bp, Homo sapien
tcggcctctagctccaggatgtgct

SEQ ID NO: 4760 - DNA, 25 bp, Homo sapien
tagctccaggatgtgctcgtccgca

SEQ ID NO: 4761 - DNA, 25 bp, Homo sapien
gctgcagggcctcgtacagcagcgc

SEQ ID NO: 4762 - DNA, 25 bp, Homo sapien
gcaccacggccatatcctccagcag

SEQ ID NO: 4763 - DNA, 25 bp, Homo sapien
tgctggatcaggctcaggatctcca

SEQ ID NO: 4764 - DNA, 25 bp, Homo sapien
ggatctccagcactgcgggagcaaa

SEQ ID NO: 4765 - DNA, 25 bp, Homo sapien
cacgcgctagttcgcgctgctggat

SEQ ID NO: 4766 - DNA, 25 bp, Homo sapien
ccaaaatctgctgagctcctgcgta

SEQ ID NO: 4767 - DNA, 25 bp, Homo sapien
gcccaagaaagagcggggctgccca

SEQ ID NO: 4768 - DNA, 25 bp, Homo sapien
gagctcctgcgtatccctggtacca

SEQ ID NO: 4769 - DNA, 25 bp, Homo sapien
gggccaggaggccaaaatctgctga

SEQ ID NO: 4770 - DNA, 25 bp, Homo sapien
tcgccgtgggctcgggtcccatgca

SEQ ID NO: 4771 - DNA, 25 bp, Homo sapien
tctcaggaaggccagtctccgggcg

SEQ ID NO: 4772 - DNA, 25 bp, Homo sapien
gcacgctggggcttggatccacgcc

SEQ ID NO: 4773 - DNA, 25 bp, Homo sapien
tggtaccagcacacggcccaagaaa

SEQ ID NO: 4774 - DNA, 25 bp, Homo sapien
tccgaggacatgtccagtagctggt

SEQ ID NO: 4775 - DNA, 25 bp, Homo sapien
gtccacgccgcgctgggtgaagttg

SEQ ID NO: 4776 - DNA, 25 bp, Homo sapien
accgtgctacccaccatcgcgggca

SEQ ID NO: 4777 - DNA, 25 bp, Homo sapien
aagcacgtcccgcgggtgcgtcttc

SEQ ID NO: 4778 - DNA, 25 bp, Homo sapien
gccggcgcgcgctgttcagctgcat

SEQ ID NO: 4779 - DNA, 25 bp, Homo sapien
tgttcagctgcatccgctgctccga

SEQ ID NO: 4780 - DNA, 25 bp, Homo sapien
tgctccgaggacatgtccagtagct

SEQ ID NO: 4781 - DNA, 25 bp, Homo sapien
gtcgtagacgcccaccgtgctaccc

SEQ ID NO: 4782 - DNA, 25 bp, Homo sapien
ttctcttgcctgtgctaagccgttt

SEQ ID NO: 4783 - DNA, 25 bp, Homo sapien
ttctcggcgcccagcttttgagctc

SEQ ID NO: 4784 - DNA, 25 bp, Homo sapien
cgggacccggagaagatgtcttcgc

SEQ ID NO: 4785 - DNA, 25 bp, Homo sapien
atgtcttcgcggacggtgctggccc

SEQ ID NO: 4786 - DNA, 25 bp, Homo sapien
ccgggcaacgatcggaactcggaca

SEQ ID NO: 4787 - DNA, 25 bp, Homo sapien
tgcacggggccactaggaccctcgg

SEQ ID NO: 4788 - DNA, 25 bp, Homo sapien
aacgatcggaactcggacacggtga

SEQ ID NO: 4789 - DNA, 25 bp, Homo sapien
ctcgggtctgttccctccaggaagc

SEQ ID NO: 4790 - DNA, 25 bp, Homo sapien
ttctcttccgccgtgtggcgggcac

SEQ ID NO: 4791 - DNA, 25 bp, Homo sapien
tgtgaagctgaccagctcgcgccct

SEQ ID NO: 4792 - DNA, 25 bp, Homo sapien
ctcctgaggccctgatggcagctct

SEQ ID NO: 4793 - DNA, 25 bp, Homo sapien
cctgtcccacttcgaagtggaggtc

SEQ ID NO: 4794 - DNA, 25 bp, Homo sapien
aggcttgcggggagttctcttccgc

SEQ ID NO: 4795 - DNA, 25 bp, Homo sapien
gcatctccaacgacctcgagctctg

SEQ ID NO: 4796 - DNA, 25 bp, Homo sapien
cctggagtgtgaagctgaccagctc

SEQ ID NO: 4797 - DNA, 25 bp, Homo sapien
cacttcgaagtggaggtctgccagc

SEQ ID NO: 4798 - DNA, 25 bp, Homo sapien
ccatctgagtctagcgctggagttg

SEQ ID NO: 4799 - DNA, 25 bp, Homo sapien
gcgctgaatggcgaagctcccaaaa

SEQ ID NO: 4800 - DNA, 25 bp, Homo sapien
ccaagtttgcatgcgtctgcgctga

SEQ ID NO: 4801 - DNA, 25 bp, Homo sapien
ctggagttgtgatcagccacgagtc

SEQ ID NO: 4802 - DNA, 25 bp, Homo sapien
gggcgagacctcaatggcttttaaa

SEQ ID NO: 4803 - DNA, 25 bp, Homo sapien
ttttgttttctaactgcggcggcga

SEQ ID NO: 4804 - DNA, 25 bp, Homo sapien
ccacttcctgtcgtggccaggtaga

SEQ ID NO: 4805 - DNA, 25 bp, Homo sapien
tgcgtcagaactctagccaagtttg

SEQ ID NO: 4806 - DNA, 25 bp, Homo sapien
tccttacaagggcagccacggggcc

SEQ ID NO: 4807 - DNA, 25 bp, Homo sapien
ccctcggtgccactgggagatttcc

SEQ ID NO: 4808 - DNA, 25 bp, Homo sapien
ttttagagggcgctttgctgtctcc

SEQ ID NO: 4809 - DNA, 25 bp, Homo sapien
ttgctgtctcctctgccgcaaaggc

SEQ ID NO: 4810 - DNA, 25 bp, Homo sapien
gggcctcgcctccttacaagggcag

SEQ ID NO: 4811 - DNA, 25 bp, Homo sapien
ccagactcgcgcagatctgggcaga

SEQ ID NO: 4812 - DNA, 25 bp, Homo sapien
atctgggcagagcaagcgctctcgg

SEQ ID NO: 4813 - DNA, 25 bp, Homo sapien
tcgccacgtgtcctggttaattata

SEQ ID NO: 4814 - DNA, 25 bp, Homo sapien
gaagttctgccattcccgcggggct

SEQ ID NO: 4815 - DNA, 25 bp, Homo sapien
cgaggctgaacttcccacgggcggt

SEQ ID NO: 4816 - DNA, 25 bp, Homo sapien
gagccgcccgaggtcccagacgccc

SEQ ID NO: 4817 - DNA, 25 bp, Homo sapien
cgcgactgatcgcagtggggcgaag

SEQ ID NO: 4818 - DNA, 25 bp, Homo sapien
ggactctcggagagccgcgatgatg

SEQ ID NO: 4819 - DNA, 25 bp, Homo sapien
gcccgctcgccctgagacggggaag

SEQ ID NO: 4820 - DNA, 25 bp, Homo sapien
cccagcgcaggtaaacagcgaggac

SEQ ID NO: 4821 - DNA, 25 bp, Homo sapien
cgcgtgcgaagttctgccattcccg

SEQ ID NO: 4822 - DNA, 25 bp, Homo sapien
ctggcccaggagaacgtgtggctgc

SEQ ID NO: 4823 - DNA, 25 bp, Homo sapien
gagaacgtgtggctgcgggaggaac

SEQ ID NO: 4824 - DNA, 25 bp, Homo sapien
aggagaagcgccacctggagttcct

SEQ ID NO: 4825 - DNA, 25 bp, Homo sapien
ggcttcgggccagcgaggagtccgt

SEQ ID NO: 4826 - DNA, 25 bp, Homo sapien
agaagcgccacctggagttcctggg

SEQ ID NO: 4827 - DNA, 25 bp, Homo sapien
ggggcagctgcgacagtacgaccca

SEQ ID NO: 4828 - DNA, 25 bp, Homo sapien
tgcgacagtacgacccaccggcgga

SEQ ID NO: 4829 - DNA, 25 bp, Homo sapien
acagtacgacccaccggcggagagc

SEQ ID NO: 4830 - DNA, 25 bp, Homo sapien
tgcagcacttcgtcgggcagcacgg

SEQ ID NO: 4831 - DNA, 25 bp, Homo sapien
ggctctgcataaccgggacctgccg

SEQ ID NO: 4832 - DNA, 25 bp, Homo sapien
aggacacggctctgcataaccggga

SEQ ID NO: 4833 - DNA, 25 bp, Homo sapien
gggctctcctgcaccacatgctgca

SEQ ID NO: 4834 - DNA, 25 bp, Homo sapien
gcagccgccacttcacgtactccag

SEQ ID NO: 4835 - DNA, 25 bp, Homo sapien
aagcccaggaaatgctcggccgtgc

SEQ ID NO: 4836 - DNA, 25 bp, Homo sapien
ctgcctctgcgaggagacgctatca

SEQ ID NO: 4837 - DNA, 25 bp, Homo sapien
ggcttgcgctggatgcacacgcgct

SEQ ID NO: 4838 - DNA, 25 bp, Homo sapien
tcgtacgggaagtagaccaggagcc

SEQ ID NO: 4839 - DNA, 25 bp, Homo sapien
cggtaaccctcaggtcctcaggagc

SEQ ID NO: 4840 - DNA, 25 bp, Homo sapien
agtgtctcctcgctatcactgctgc

SEQ ID NO: 4841 - DNA, 25 bp, Homo sapien
tgaatattcagcgagaggccgggtc

SEQ ID NO: 4842 - DNA, 25 bp, Homo sapien
agggctcgctccacctatattacga

SEQ ID NO: 4843 - DNA, 25 bp, Homo sapien
ttacgagaccattggctaacctgcc

SEQ ID NO: 4844 - DNA, 25 bp, Homo sapien
ccgtcaatccgctagggcagagcca

SEQ ID NO: 4845 - DNA, 25 bp, Homo sapien
ctcccgcatgtaggagaactgctcg

SEQ ID NO: 4846 - DNA, 25 bp, Homo sapien
accgactcgccctcgcggaaggaca

SEQ ID NO: 4847 - DNA, 25 bp, Homo sapien
tccctccgcagcacggtgaccgact

SEQ ID NO: 4848 - DNA, 25 bp, Homo sapien
ccgaactcggcgctgtagtcccaga

SEQ ID NO: 4849 - DNA, 25 bp, Homo sapien
tagtcccagagagcgtacactgccc

SEQ ID NO: 4850 - DNA, 25 bp, Homo sapien
cccatactctgctcgacgtctgaaa

SEQ ID NO: 4851 - DNA, 25 bp, Homo sapien
tgctcgacgtctgaaacatgccacg

SEQ ID NO: 4852 - DNA, 25 bp, Homo sapien
gcggcccaccaccagtcggtctcct

SEQ ID NO: 4853 - DNA, 25 bp, Homo sapien
aagtagttccgcggcacgtagccct

SEQ ID NO: 4854 - DNA, 25 bp, Homo sapien
gcaaggcagtgatgccctcctcgtt

SEQ ID NO: 4855 - DNA, 25 bp, Homo sapien
tggcacccgcggtgatgaggaaatc

SEQ ID NO: 4856 - DNA, 25 bp, Homo sapien
ctcgggtcgttcatctgagtgcacc

SEQ ID NO: 4857 - DNA, 25 bp, Homo sapien
tgactgtgtcgttgcacgacgccgc

SEQ ID NO: 4858 - DNA, 25 bp, Homo sapien
ccagcgccatgcagatgactgtgtc

SEQ ID NO: 4859 - DNA, 25 bp, Homo sapien
ggtaagggtcgcacttctcgaaggc

SEQ ID NO: 4860 - DNA, 25 bp, Homo sapien
gcagtcagcataaccctcgcggtaa

SEQ ID NO: 4861 - DNA, 25 bp, Homo sapien
ccacgatagagtagttggcgccgca

SEQ ID NO: 4862 - DNA, 25 bp, Homo sapien
tctgcgaaggcttcttctcgtacgc

SEQ ID NO: 4863 - DNA, 25 bp, Homo sapien
gagagaccttgtaattgcgcggcag

SEQ ID NO: 4864 - DNA, 25 bp, Homo sapien
aacgggcgccgagacccagatcgca

SEQ ID NO: 4865 - DNA, 25 bp, Homo sapien
ccaaggcaacagctgcaggctcggc

SEQ ID NO: 4866 - DNA, 25 bp, Homo sapien
gccttgcgaagacgtccaggcctgc

SEQ ID NO: 4867 - DNA, 25 bp, Homo sapien
tcacgttcatagctcgctgtctgcg

SEQ ID NO: 4868 - DNA, 25 bp, Homo sapien
tctcgtacgccacgtccaggtcaga

SEQ ID NO: 4869 - DNA, 25 bp, Homo sapien
caggtcagactcgttccaggctttc

SEQ ID NO: 4870 - DNA, 25 bp, Homo sapien
ctgtgcctttgtccaggaaattcga

SEQ ID NO: 4871 - DNA, 25 bp, Homo sapien
ctctcggaggccaacacgggaaact

SEQ ID NO: 4872 - DNA, 25 bp, Homo sapien
cctaatcccggggttgaggctctca

SEQ ID NO: 4873 - DNA, 25 bp, Homo sapien
gagccgcggcaaatgctgttgaccc

SEQ ID NO: 4874 - DNA, 25 bp, Homo sapien
atacagggttcctctcgtcggctca

SEQ ID NO: 4875 - DNA, 25 bp, Homo sapien
ctgcagcatgggcatacagggttcc

SEQ ID NO: 4876 - DNA, 25 bp, Homo sapien
taaagccatgcagcttctcggccgg

SEQ ID NO: 4877 - DNA, 25 bp, Homo sapien
tcgtcggctcattggctgctgaatg

SEQ ID NO: 4878 - DNA, 25 bp, Homo sapien
cagcttacactggaagttcatgtcc

SEQ ID NO: 4879 - DNA, 25 bp, Homo sapien
tgtccagaaagtcccgcgcgctctg

SEQ ID NO: 4880 - DNA, 25 bp, Homo sapien
aagtcccgcgcgctctggaatgcct

SEQ ID NO: 4881 - DNA, 25 bp, Homo sapien
tggaatgcctcgctgtccatggtgc

SEQ ID NO: 4882 - DNA, 25 bp, Homo sapien
ccctactccagcttacactggaagt

SEQ ID NO: 4883 - DNA, 25 bp, Homo sapien
gccctcagggagtcagacgccgtca

SEQ ID NO: 4884 - DNA, 25 bp, Homo sapien
cagacgccgtcaggagcgggacaac

SEQ ID NO: 4885 - DNA, 25 bp, Homo sapien
actggaagttcatgtccagaaagtc

SEQ ID NO: 4886 - DNA, 25 bp, Homo sapien
tttatggtctgatttccggcctctc

SEQ ID NO: 4887 - DNA, 25 bp, Homo sapien
ttcatcattagcatccggcgccgga

SEQ ID NO: 4888 - DNA, 25 bp, Homo sapien
gttgcgctgcccgttaatccaatcc

SEQ ID NO: 4889 - DNA, 25 bp, Homo sapien
gcaaaccctctgctcggtcagtttt

SEQ ID NO: 4890 - DNA, 25 bp, Homo sapien
cctgaaggtaccgacctctctttga

SEQ ID NO: 4891 - DNA, 25 bp, Homo sapien
cctcgctttgagatcccggcgcaga

SEQ ID NO: 4892 - DNA, 25 bp, Homo sapien
tccaatcccacttggtgagaaaaga

SEQ ID NO: 4893 - DNA, 25 bp, Homo sapien
agaacctgctcaacggagaccacca

SEQ ID NO: 4894 - DNA, 25 bp, Homo sapien
tgaaactcacggatccgggcagatc

SEQ ID NO: 4895 - DNA, 25 bp, Homo sapien
cggagggacaggacgtagcccaaga

SEQ ID NO: 4896 - DNA, 25 bp, Homo sapien
ctcgagcaccttgggacttgtagtc

SEQ ID NO: 4897 - DNA, 25 bp, Homo sapien
aggtcgcctcgagcaccttgggact

SEQ ID NO: 4898 - DNA, 25 bp, Homo sapien
gggagccaaggtcgcctcgagcacc

SEQ ID NO: 4899 - DNA, 25 bp, Homo sapien
ctgggaacaggttagacgacgtgac

SEQ ID NO: 4900 - DNA, 25 bp, Homo sapien
cccaggagggtgaaactcacggatc

SEQ ID NO: 4901 - DNA, 25 bp, Homo sapien
caggttagacgacgtgacttgggct

SEQ ID NO: 4902 - DNA, 25 bp, Homo sapien
tggatccacgtggtctgcaacctgg

SEQ ID NO: 4903 - DNA, 25 bp, Homo sapien
tctgaacttgtgaggcatctgggcc

SEQ ID NO: 4904 - DNA, 25 bp, Homo sapien
gaccgtcctgtctctttaaggctta

SEQ ID NO: 4905 - DNA, 25 bp, Homo sapien
ggaggcgttgcaacaaaccatattg

SEQ ID NO: 4906 - DNA, 25 bp, Homo sapien
acgggcctctgactccagcaataca

SEQ ID NO: 4907 - DNA, 25 bp, Homo sapien
cggttttctgctctgcacacgttga

SEQ ID NO: 4908 - DNA, 25 bp, Homo sapien
tcgaggtttcccacgcatgagacta

SEQ ID NO: 4909 - DNA, 25 bp, Homo sapien
ggtcccttcctgaaagtcatcgagg

SEQ ID NO: 4910 - DNA, 25 bp, Homo sapien
tccgagagctccatagcgtcaggtc

SEQ ID NO: 4911 - DNA, 25 bp, Homo sapien
ttacaggtccacaagtcccatcgct

SEQ ID NO: 4912 - DNA, 25 bp, Homo sapien
ctcagactcggcaatgattggcttc

SEQ ID NO: 4913 - DNA, 25 bp, Homo sapien
gtctacgttctcatcccgcagcagg

SEQ ID NO: 4914 - DNA, 25 bp, Homo sapien
acctgctggtcttggagcctcaagg

SEQ ID NO: 4915 - DNA, 25 bp, Homo sapien
tggccttgtccatctctcagactcg

SEQ ID NO: 4916 - DNA, 25 bp, Homo sapien
tcaagggaaagactgcagagggatc

SEQ ID NO: 4917 - DNA, 25 bp, Homo sapien
aacacccagcgctagaggctctgta

SEQ ID NO: 4918 - DNA, 25 bp, Homo sapien
ctctcaacttcgagccctttgttcg

SEQ ID NO: 4919 - DNA, 25 bp, Homo sapien
ggagactgtaaggacgggaccctca

SEQ ID NO: 4920 - DNA, 25 bp, Homo sapien
cccaagttccagaattcagccgcaa

SEQ ID NO: 4921 - DNA, 25 bp, Homo sapien
tcagccgcaactccagtttgggcca

SEQ ID NO: 4922 - DNA, 25 bp, Homo sapien
cgacaattccgccaaaggggacctg

SEQ ID NO: 4923 - DNA, 25 bp, Homo sapien
cctctaaacttagccgcggtgacgc

SEQ ID NO: 4924 - DNA, 25 bp, Homo sapien
gctcggcgagcctctatttatagcg

SEQ ID NO: 4925 - DNA, 25 bp, Homo sapien
cgcccggagcccgaaatagcgcgga

SEQ ID NO: 4926 - DNA, 25 bp, Homo sapien
ataaggcaggacgactcagcgcttc

SEQ ID NO: 4927 - DNA, 25 bp, Homo sapien
tctgccctggcggtcacactcgccc

SEQ ID NO: 4928 - DNA, 25 bp, Homo sapien
caaaactccgccgtcggctctgaac

SEQ ID NO: 4929 - DNA, 25 bp, Homo sapien
cctggaagattctgcgccctgccgg

SEQ ID NO: 4930 - DNA, 25 bp, Homo sapien
gcgcggcgccgcgtccatttttacc

SEQ ID NO: 4931 - DNA, 25 bp, Homo sapien
cccagctccgctaaaaatagttgcc

SEQ ID NO: 4932 - DNA, 25 bp, Homo sapien
cgagccgagcccgaaatagcggccc

SEQ ID NO: 4933 - DNA, 25 bp, Homo sapien
ccgctaaaaatagttgccgcgctcc

SEQ ID NO: 4934 - DNA, 25 bp, Homo sapien
cagggttacacaacccgtcgtcgcg

SEQ ID NO: 4935 - DNA, 25 bp, Homo sapien
tcgtcgcgtcccgagggaagtcgcc

SEQ ID NO: 4936 - DNA, 25 bp, Homo sapien
gttcgcgccgttggtggactccgcc

SEQ ID NO: 4937 - DNA, 25 bp, Homo sapien
acccaggcgtctcccttgggatggg

SEQ ID NO: 4938 - DNA, 25 bp, Homo sapien
cgacccaggcgtctcccttgggatg

SEQ ID NO: 4939 - DNA, 25 bp, Homo sapien
acttgtgacgtcacgagccgctccc

SEQ ID NO: 4940 - DNA, 25 bp, Homo sapien
tggactccgcccacttgtgacgtca

SEQ ID NO: 4941 - DNA, 25 bp, Homo sapien
cccgagggaagtcgccggatgtcct

SEQ ID NO: 4942 - DNA, 25 bp, Homo sapien
gcagcaaagaggagatacagagatc

SEQ ID NO: 4943 - DNA, 25 bp, Homo sapien
acagatcgaacaaggacggggccca

SEQ ID NO: 4944 - DNA, 25 bp, Homo sapien
taaggaaagaccacgcgacagatcg

SEQ ID NO: 4945 - DNA, 25 bp, Homo sapien
gcgcagagatataaggaaagaccac

SEQ ID NO: 4946 - DNA, 25 bp, Homo sapien
aaattcggagacatgcgtggaggcc

SEQ ID NO: 4947 - DNA, 25 bp, Homo sapien
ctcagggcgcagaaacccggagact

SEQ ID NO: 4948 - DNA, 25 bp, Homo sapien
atgcagttacacacgggcaacaccg

SEQ ID NO: 4949 - DNA, 25 bp, Homo sapien
gaggccgaagcaacagggaactgtc

SEQ ID NO: 4950 - DNA, 25 bp, Homo sapien
ctagcaacgcgagggctgtttgtcc

SEQ ID NO: 4951 - DNA, 25 bp, Homo sapien
gcaacgtcaacaaacgacgcggccg

SEQ ID NO: 4952 - DNA, 25 bp, Homo sapien
tagacagccgccgtctgttgtcgcc

SEQ ID NO: 4953 - DNA, 25 bp, Homo sapien
gttgccgggcaacgtcaacaaacga

SEQ ID NO: 4954 - DNA, 25 bp, Homo sapien
acgcgacggactgtggaacgccgtc

SEQ ID NO: 4955 - DNA, 25 bp, Homo sapien
acggactgtggaacgccgtcgccta

SEQ ID NO: 4956 - DNA, 25 bp, Homo sapien
tttccctttagacagccgccgtctg

SEQ ID NO: 4957 - DNA, 25 bp, Homo sapien
ctccgctcgggtatctgtccgtctg

SEQ ID NO: 4958 - DNA, 25 bp, Homo sapien
cactttcaagaggtacagcggcatc

SEQ ID NO: 4959 - DNA, 25 bp, Homo sapien
ggctcacagcgcactttgcaaactg

SEQ ID NO: 4960 - DNA, 25 bp, Homo sapien
cgcctcccaggtaagtttttgatag

SEQ ID NO: 4961 - DNA, 25 bp, Homo sapien
atctgtcttcggtggactccttcgg

SEQ ID NO: 4962 - DNA, 25 bp, Homo sapien
tggcgggtctgtgcttcattcataa

SEQ ID NO: 4963 - DNA, 25 bp, Homo sapien
cccggacagcgtactttgaggactc

SEQ ID NO: 4964 - DNA, 25 bp, Homo sapien
taagactcagagctacggccacggc

SEQ ID NO: 4965 - DNA, 25 bp, Homo sapien
ctgccgagtctcaatatctgtcttc

SEQ ID NO: 4966 - DNA, 25 bp, Homo sapien
gctcctgggtgctggagttcgatct

SEQ ID NO: 4967 - DNA, 25 bp, Homo sapien
aggaacctatatgggctcctgggtg

SEQ ID NO: 4968 - DNA, 25 bp, Homo sapien
agttcgatctgaaccttcccgctca

SEQ ID NO: 4969 - DNA, 25 bp, Homo sapien
ttcccgctcattctgcgtgaccttg

SEQ ID NO: 4970 - DNA, 25 bp, Homo sapien
agccaccctggctggacctagggtc

SEQ ID NO: 4971 - DNA, 25 bp, Homo sapien
gctggacctagggtcccagcttcac

SEQ ID NO: 4972 - DNA, 25 bp, Homo sapien
cggtggaggaacctatatgggctcc

SEQ ID NO: 4973 - DNA, 25 bp, Homo sapien
gtgctggagttcgatctgaaccttc

SEQ ID NO: 4974 - DNA, 25 bp, Homo sapien
tgaggaacccagagggtgaaaaaga

SEQ ID NO: 4975 - DNA, 25 bp, Homo sapien
gccgagaagcgtagcgctcaccaca

SEQ ID NO: 4976 - DNA, 25 bp, Homo sapien
gcgctcttagtgagcagcctgcgga

SEQ ID NO: 4977 - DNA, 25 bp, Homo sapien
ggggtctgcacgtacaattcctggc

SEQ ID NO: 4978 - DNA, 25 bp, Homo sapien
cacgtacaattcctggcggggcacc

SEQ ID NO: 4979 - DNA, 25 bp, Homo sapien
attccagagagcagccatagggcgc

SEQ ID NO: 4980 - DNA, 25 bp, Homo sapien
tgtcctggcagacgccgagaagcgt

SEQ ID NO: 4981 - DNA, 25 bp, Homo sapien
ggggagcgcctgcacgcctctcttt

SEQ ID NO: 4982 - DNA, 25 bp, Homo sapien
acacttcttcgtttgtcctcacctg

SEQ ID NO: 4983 - DNA, 25 bp, Homo sapien
acacagtgaagttcaagtcctcggc

SEQ ID NO: 4984 - DNA, 25 bp, Homo sapien
cggagatcgccgagctccaaaagga

SEQ ID NO: 4985 - DNA, 25 bp, Homo sapien
caaaaggagaaggaacgtctggagt

SEQ ID NO: 4986 - DNA, 25 bp, Homo sapien
tggtggcccacaaaccgggctgcaa

SEQ ID NO: 4987 - DNA, 25 bp, Homo sapien
gcaccggctaaggaagatggcttca

SEQ ID NO: 4988 - DNA, 25 bp, Homo sapien
ctctctttacacacagtgaagttca

SEQ ID NO: 4989 - DNA, 25 bp, Homo sapien
aaggaagatggcttcagctggctgc

SEQ ID NO: 4990 - DNA, 25 bp, Homo sapien
gctggtctcgtggttccgagactga

SEQ ID NO: 4991 - DNA, 25 bp, Homo sapien
ctgtgtgcagctctcgaaaatcaga

SEQ ID NO: 4992 - DNA, 25 bp, Homo sapien
ggagcccactacaccatcaaaggcg

SEQ ID NO: 4993 - DNA, 25 bp, Homo sapien
gatgctctccaagctgtcgcccagg

SEQ ID NO: 4994 - DNA, 25 bp, Homo sapien
aagcctcaggtcttccagagggcgc

SEQ ID NO: 4995 - DNA, 25 bp, Homo sapien
gatggtccaaccgaagcctcaggtc

SEQ ID NO: 4996 - DNA, 25 bp, Homo sapien
cctcctctgagaattcccgggctgt

SEQ ID NO: 4997 - DNA, 25 bp, Homo sapien
tcaaaggcgatgtaggagaaggtca

SEQ ID NO: 4998 - DNA, 25 bp, Homo sapien
ctctactcactgcagtgggcgaaga

SEQ ID NO: 4999 - DNA, 25 bp, Homo sapien
actcactgcagtgggcgaagaccgg

SEQ ID NO: 5000 - DNA, 25 bp, Homo sapien
agtcttcctctactcactgcagtgg

SEQ ID NO: 5001 - DNA, 25 bp, Homo sapien
cacctgaacctctggggcccacacc

SEQ ID NO: 5002 - DNA, 25 bp, Homo sapien
aggggagagcttcctttgtctccta

SEQ ID NO: 5003 - DNA, 25 bp, Homo sapien
tccgccctgtttcgtccaggtcctc

SEQ ID NO: 5004 - DNA, 25 bp, Homo sapien
tcacctccgccctgtttcgtccagg

SEQ ID NO: 5005 - DNA, 25 bp, Homo sapien
cgggcggtacgtcccagagcgcagc

SEQ ID NO: 5006 - DNA, 25 bp, Homo sapien
actgcacttggctttcgttacctgg

SEQ ID NO: 5007 - DNA, 25 bp, Homo sapien
tacagctcgtttctgcggagccaga

SEQ ID NO: 5008 - DNA, 25 bp, Homo sapien
cacgccaggctgaggacgagttcat

SEQ ID NO: 5009 - DNA, 25 bp, Homo sapien
gagcgttgggcgactttacctacaa

SEQ ID NO: 5010 - DNA, 25 bp, Homo sapien
ccgcggtttctgtacctggcgcact

SEQ ID NO: 5011 - DNA, 25 bp, Homo sapien
atttgccaggccatgtgctccagga

SEQ ID NO: 5012 - DNA, 25 bp, Homo sapien
gcatggaggatgctcactgcacttg

SEQ ID NO: 5013 - DNA, 25 bp, Homo sapien
gcgcagctgttggacacgtgtctgt

SEQ ID NO: 5014 - DNA, 25 bp, Homo sapien
agagtaacactgtagccgccaccgg

SEQ ID NO: 5015 - DNA, 25 bp, Homo sapien
cctccgcaggcgaaactgagtcaga

SEQ ID NO: 5016 - DNA, 25 bp, Homo sapien
gtgggccggaggctttacacaccaa

SEQ ID NO: 5017 - DNA, 25 bp, Homo sapien
cacttgcttaacttgagggtcctcc

SEQ ID NO: 5018 - DNA, 25 bp, Homo sapien
tcccacagtgggagcgaactaggaa

SEQ ID NO: 5019 - DNA, 25 bp, Homo sapien
ccgagggtgcagagttgccctttta

SEQ ID NO: 5020 - DNA, 25 bp, Homo sapien
aggaacctctcatcagaccgcctga

SEQ ID NO: 5021 - DNA, 25 bp, Homo sapien
ccctgggctacaacattggggagag

SEQ ID NO: 5022 - DNA, 25 bp, Homo sapien
gtgatgaagatgatgccctcgccca

SEQ ID NO: 5023 - DNA, 25 bp, Homo sapien
tcctatttctcggacgccggcgcaa

SEQ ID NO: 5024 - DNA, 25 bp, Homo sapien
gtggcgccaatactccagcatcagg

SEQ ID NO: 5025 - DNA, 25 bp, Homo sapien
ggcagcggcattgaaacccatgatg

SEQ ID NO: 5026 - DNA, 25 bp, Homo sapien
tctccagccagtggtacactgcagg

SEQ ID NO: 5027 - DNA, 25 bp, Homo sapien
agacaggagtcaggggtcttttgca

SEQ ID NO: 5028 - DNA, 25 bp, Homo sapien
tgtggtcaccacaatcggacgcgtg

SEQ ID NO: 5029 - DNA, 25 bp, Homo sapien
ctgctgcaactggtggcgccaatac

SEQ ID NO: 5030 - DNA, 25 bp, Homo sapien
gccaggtggcccacctcgtcccgca

SEQ ID NO: 5031 - DNA, 25 bp, Homo sapien
cgcgttccaggcagcacgctgctcc

SEQ ID NO: 5032 - DNA, 25 bp, Homo sapien
tgcgcctggtggcgccagtactcca

SEQ ID NO: 5033 - DNA, 25 bp, Homo sapien
agccgccgcccacgatgaagatggt

SEQ ID NO: 5034 - DNA, 25 bp, Homo sapien
cgcccacgatgaagatggtggcttc

SEQ ID NO: 5035 - DNA, 25 bp, Homo sapien
tgaagatggtggcttcgcccagcag

SEQ ID NO: 5036 - DNA, 25 bp, Homo sapien
ttcagcggcttgatgaccgtgcccc

SEQ ID NO: 5037 - DNA, 25 bp, Homo sapien
cctcttgcagctctgtgcgcagttc

SEQ ID NO: 5038 - DNA, 25 bp, Homo sapien
gggaaacttcagaggcgcatcctga

SEQ ID NO: 5039 - DNA, 25 bp, Homo sapien
tgtacgtacgctcgagggaaacttc

SEQ ID NO: 5040 - DNA, 25 bp, Homo sapien
ccatgcgtgcgtcagtacgtatgta

SEQ ID NO: 5041 - DNA, 25 bp, Homo sapien
accatcttggcggtctcacagggca

SEQ ID NO: 5042 - DNA, 25 bp, Homo sapien
gcccaagtatagcagcttcgccata

SEQ ID NO: 5043 - DNA, 25 bp, Homo sapien
gctgacctgccggatgcccaagtat

SEQ ID NO: 5044 - DNA, 25 bp, Homo sapien
ggcggcctccttaatacggttggca

SEQ ID NO: 5045 - DNA, 25 bp, Homo sapien
gacgtccgttcgctgaatatgcaaa

SEQ ID NO: 5046 - DNA, 25 bp, Homo sapien
gttcatcaggtagacgcccagctcg

SEQ ID NO: 5047 - DNA, 25 bp, Homo sapien
acccgatagaggttcatccaggcca

SEQ ID NO: 5048 - DNA, 25 bp, Homo sapien
tccatggggaacttctcaaagcaga

SEQ ID NO: 5049 - DNA, 25 bp, Homo sapien
tctcggaagagctcgtcatggaaca

SEQ ID NO: 5050 - DNA, 25 bp, Homo sapien
tccagttgtcgtggtgcaggaagta

SEQ ID NO: 5051 - DNA, 25 bp, Homo sapien
aggaagcccacgaacacccgataga

SEQ ID NO: 5052 - DNA, 25 bp, Homo sapien
aggaagtagtccacccacagcggca

SEQ ID NO: 5053 - DNA, 25 bp, Homo sapien
cccacgccgatgacaaagatgtaga

SEQ ID NO: 5054 - DNA, 25 bp, Homo sapien
agcggtctcgccacgagcagggcaa

SEQ ID NO: 5055 - DNA, 25 bp, Homo sapien
caggtccccggtcttgacaacggcg

SEQ ID NO: 5056 - DNA, 25 bp, Homo sapien
acttacctgcgcgcggcgactggac

SEQ ID NO: 5057 - DNA, 25 bp, Homo sapien
tcgccacgagcagggcaacctagtg

SEQ ID NO: 5058 - DNA, 25 bp, Homo sapien
gctgcgtccaggtccccggtcttga

SEQ ID NO: 5059 - DNA, 25 bp, Homo sapien
gtctcgccacgagcagggcaaccta

SEQ ID NO: 5060 - DNA, 25 bp, Homo sapien
cacctctctccgctgcgtccaggtc

SEQ ID NO: 5061 - DNA, 25 bp, Homo sapien
gaggacccggcacttacctgcgcgc

SEQ ID NO: 5062 - DNA, 25 bp, Homo sapien
cctgcaagcggtttgaagaggcatc

SEQ ID NO: 5063 - DNA, 25 bp, Homo sapien
cttccgctagcggtccaaatgtaga

SEQ ID NO: 5064 - DNA, 25 bp, Homo sapien
tccgcaaagaggctaagaagacctg

SEQ ID NO: 5065 - DNA, 25 bp, Homo sapien
cagggtgtaagaaccaggagcctca

SEQ ID NO: 5066 - DNA, 25 bp, Homo sapien
ggagcctcatagaaacctctgcttg

SEQ ID NO: 5067 - DNA, 25 bp, Homo sapien
ctctgcttggggtccaaagcccagc

SEQ ID NO: 5068 - DNA, 25 bp, Homo sapien
gccgggcactcccagaggacaacat

SEQ ID NO: 5069 - DNA, 25 bp, Homo sapien
agtgcgtgcgctcttcttgtgtgag

SEQ ID NO: 5070 - DNA, 25 bp, Homo sapien
ccatgacgcattgtttagacagacg

SEQ ID NO: 5071 - DNA, 25 bp, Homo sapien
gtgactctaatcttcgcccggcctg

SEQ ID NO: 5072 - DNA, 25 bp, Homo sapien
gagtgtgtgtgtaacgccctctccc

SEQ ID NO: 5073 - DNA, 25 bp, Homo sapien
ctggacgcctcgagtttaggaaacg

SEQ ID NO: 5074 - DNA, 25 bp, Homo sapien
cggagccgcccggattgaaattctc

SEQ ID NO: 5075 - DNA, 25 bp, Homo sapien
acgcccggcggagaaatccatgacg

SEQ ID NO: 5076 - DNA, 25 bp, Homo sapien
ctggaacccgcagcgtttgccgatt

SEQ ID NO: 5077 - DNA, 25 bp, Homo sapien
ccgtgccagtttccacagcgggaca

SEQ ID NO: 5078 - DNA, 25 bp, Homo sapien
gggctacacagatgggcttagcacg

SEQ ID NO: 5079 - DNA, 25 bp, Homo sapien
aatcagttgagtgttgaagctgcgc

SEQ ID NO: 5080 - DNA, 25 bp, Homo sapien
ttgctctgatcagggcagaatcagt

SEQ ID NO: 5081 - DNA, 25 bp, Homo sapien
agcacttgcccaggcggctgacctt

SEQ ID NO: 5082 - DNA, 25 bp, Homo sapien
acgtggccaagactccttgctctga

SEQ ID NO: 5083 - DNA, 25 bp, Homo sapien
caaaggggcgggcttagaacacacg

SEQ ID NO: 5084 - DNA, 25 bp, Homo sapien
tacaccaagttgtcgtgggagccca

SEQ ID NO: 5085 - DNA, 25 bp, Homo sapien
tgcgctcccttgaggtagaaaattg

SEQ ID NO: 5086 - DNA, 25 bp, Homo sapien
cgctcgtgcccgacaaattgtcatc

SEQ ID NO: 5087 - DNA, 25 bp, Homo sapien
ctggtgacaagtagcggcggacact

SEQ ID NO: 5088 - DNA, 25 bp, Homo sapien
gtgccgtgagcaagcgagattctcc

SEQ ID NO: 5089 - DNA, 25 bp, Homo sapien
ctctgtctcccacgaggtcttggaa

SEQ ID NO: 5090 - DNA, 25 bp, Homo sapien
tcccgagccattaaggggcgtcctg

SEQ ID NO: 5091 - DNA, 25 bp, Homo sapien
ggaccgccagctcgtcttcctgtaa

SEQ ID NO: 5092 - DNA, 25 bp, Homo sapien
gcctttcaagagctgacacactgga

SEQ ID NO: 5093 - DNA, 25 bp, Homo sapien
cccttcctttttggcgctacagttg

SEQ ID NO: 5094 - DNA, 25 bp, Homo sapien
ggcggagaagcacttggcccactgc

SEQ ID NO: 5095 - DNA, 25 bp, Homo sapien
tagagccgggcttggtgtggccggc

SEQ ID NO: 5096 - DNA, 25 bp, Homo sapien
tagcacttggcccactgcgcagtag

SEQ ID NO: 5097 - DNA, 25 bp, Homo sapien
tgcgcagtaggtccactgggcacct

SEQ ID NO: 5098 - DNA, 25 bp, Homo sapien
gcctcgcctgtaacgggtccttcga

SEQ ID NO: 5099 - DNA, 25 bp, Homo sapien
cctgtaacgggtccttcgatatgta

SEQ ID NO: 5100 - DNA, 25 bp, Homo sapien
tgtaacgggtccttcgatatgtacg

SEQ ID NO: 5101 - DNA, 25 bp, Homo sapien
cgcctgtaacgggtccttcgatatg

SEQ ID NO: 5102 - DNA, 25 bp, Homo sapien
cggcccagatcgtgacccagtactg

SEQ ID NO: 5103 - DNA, 25 bp, Homo sapien
tgccaactacacgtggctgctggtg

SEQ ID NO: 5104 - DNA, 25 bp, Homo sapien
ggcgtctacctgcacagtctcctgg

SEQ ID NO: 5105 - DNA, 25 bp, Homo sapien
aggagggccacttccgctactacct

SEQ ID NO: 5106 - DNA, 25 bp, Homo sapien
ccgacagaggaattccgcgggtctt

SEQ ID NO: 5107 - DNA, 25 bp, Homo sapien
gcgcttttcgtcattccctgggtga

SEQ ID NO: 5108 - DNA, 25 bp, Homo sapien
cctgggtgatcgtcaggtacctgta

SEQ ID NO: 5109 - DNA, 25 bp, Homo sapien
ggtacctgtacgagaacacgcagtg

SEQ ID NO: 5110 - DNA, 25 bp, Homo sapien
acgctgacgctggtgcccctgctgg

SEQ ID NO: 5111 - DNA, 25 bp, Homo sapien
tcccgtgacagaggaacaggcccgg

SEQ ID NO: 5112 - DNA, 25 bp, Homo sapien
gctgcgggatcactgctgccgccct

SEQ ID NO: 5113 - DNA, 25 bp, Homo sapien
tggctcgctccacgctgacgctggt

SEQ ID NO: 5114 - DNA, 25 bp, Homo sapien
ccctgctgggtgtccacgaggtggt

SEQ ID NO: 5115 - DNA, 25 bp, Homo sapien
tccacgaggtggtgtttgctcccgt

SEQ ID NO: 5116 - DNA, 25 bp, Homo sapien
aggtggtgtttgctcccgtgacaga

SEQ ID NO: 5117 - DNA, 25 bp, Homo sapien
gggatcactgctgccgccctctctc

SEQ ID NO: 5118 - DNA, 25 bp, Homo sapien
cgcggaggcggttacagtcctgccc

SEQ ID NO: 5119 - DNA, 25 bp, Homo sapien
tctgagcgccatcgtctcacaggtg

SEQ ID NO: 5120 - DNA, 25 bp, Homo sapien
ccatcgtctcacaggtgcagtcgga

SEQ ID NO: 5121 - DNA, 25 bp, Homo sapien
ctcacaggtgcagtcggagatccgc

SEQ ID NO: 5122 - DNA, 25 bp, Homo sapien
gagatccgccgtggctggcaccact

SEQ ID NO: 5123 - DNA, 25 bp, Homo sapien
gcgtcctctactgcttcatcaacaa

SEQ ID NO: 5124 - DNA, 25 bp, Homo sapien
ggcttcctggtcagcgtcctctact

SEQ ID NO: 5125 - DNA, 25 bp, Homo sapien
caacaaggaggtaggcagagacccg

SEQ ID NO: 5126 - DNA, 25 bp, Homo sapien
tgcgcccgggagatcgaatattttc

SEQ ID NO: 5127 - DNA, 25 bp, Homo sapien
tccgctaaggcggagcctacttctc

SEQ ID NO: 5128 - DNA, 25 bp, Homo sapien
gtcgtgccattctcaggggaaccaa

SEQ ID NO: 5129 - DNA, 25 bp, Homo sapien
gtcctcaggaccgtagttcttattg

SEQ ID NO: 5130 - DNA, 25 bp, Homo sapien
cagctgttgcttattggcccaccga

SEQ ID NO: 5131 - DNA, 25 bp, Homo sapien
tggctgggcctaaactcaatccgtg

SEQ ID NO: 5132 - DNA, 25 bp, Homo sapien
ggctcggcgttctacaccatttgga

SEQ ID NO: 5133 - DNA, 25 bp, Homo sapien
ctctgggacgcgttactgacgtatc

SEQ ID NO: 5134 - DNA, 25 bp, Homo sapien
ctggccagcaggaactccacgttgc

SEQ ID NO: 5135 - DNA, 25 bp, Homo sapien
ccttctcgtatctcttgcggcactg

SEQ ID NO: 5136 - DNA, 25 bp, Homo sapien
tgcggcactgtttgcacggatcatc

SEQ ID NO: 5137 - DNA, 25 bp, Homo sapien
acgcctcgatgatgcccttgaagtg

SEQ ID NO: 5138 - DNA, 25 bp, Homo sapien
agcatgtactgtcgcggctccagca

SEQ ID NO: 5139 - DNA, 25 bp, Homo sapien
ggtgccgtccttgccaaagaagatg

SEQ ID NO: 5140 - DNA, 25 bp, Homo sapien
cctctgcgcttcaaagtgggccacg

SEQ ID NO: 5141 - DNA, 25 bp, Homo sapien
cggatctctaggaagtcgtgcgaca

SEQ ID NO: 5142 - DNA, 25 bp, Homo sapien
caccgcgcgggcagactagcaacta

SEQ ID NO: 5143 - DNA, 25 bp, Homo sapien
cgcgggcagactagcaactagcttc

SEQ ID NO: 5144 - DNA, 25 bp, Homo sapien
ggcagactagcaactagcttccctc

SEQ ID NO: 5145 - DNA, 25 bp, Homo sapien
ttccctccgcccttttgttgacaga

SEQ ID NO: 5146 - DNA, 25 bp, Homo sapien
tccgcccttttgttgacagacgcgc

SEQ ID NO: 5147 - DNA, 25 bp, Homo sapien
ttttgttgacagacgcgcgcgtgac

SEQ ID NO: 5148 - DNA, 25 bp, Homo sapien
gcgcgtgacgctctcagccaatgag

SEQ ID NO: 5149 - DNA, 25 bp, Homo sapien
catgcgcgcgaaaggtaaaagggcc

SEQ ID NO: 5150 - DNA, 25 bp, Homo sapien
agctaccgggatgcccatcgcgatc

SEQ ID NO: 5151 - DNA, 25 bp, Homo sapien
agctgcaggctttggaccacagaga

SEQ ID NO: 5152 - DNA, 25 bp, Homo sapien
cccactcgaggcgagagctaccggg

SEQ ID NO: 5153 - DNA, 25 bp, Homo sapien
gtccacttcacgtgcgtggccaggc

SEQ ID NO: 5154 - DNA, 25 bp, Homo sapien
tggggaagttttcacgtccacttca

SEQ ID NO: 5155 - DNA, 25 bp, Homo sapien
atcgcatctcgtggggaagttttca

SEQ ID NO: 5156 - DNA, 25 bp, Homo sapien
cgcgtttgctcaggaatcgcatctc

SEQ ID NO: 5157 - DNA, 25 bp, Homo sapien
ccggagcaggaagctgcaacgtcca

SEQ ID NO: 5158 - DNA, 25 bp, Homo sapien
tccgacgattctttcgctgaacctc

SEQ ID NO: 5159 - DNA, 25 bp, Homo sapien
ctcaccgcggctaatgatattataa

SEQ ID NO: 5160 - DNA, 25 bp, Homo sapien
tgcgcggccgactcctaatcaatta

SEQ ID NO: 5161 - DNA, 25 bp, Homo sapien
gtaatgtgtctcgaccctgccgctg

SEQ ID NO: 5162 - DNA, 25 bp, Homo sapien
tccttccgggttaatgagctgacac

SEQ ID NO: 5163 - DNA, 25 bp, Homo sapien
cgcagaggagaacgcacaaattgta

SEQ ID NO: 5164 - DNA, 25 bp, Homo sapien
cgcctagctcaggatgtctgcgaga

SEQ ID NO: 5165 - DNA, 25 bp, Homo sapien
caaattgtatttcagcgccaggtcc

SEQ ID NO: 5166 - DNA, 25 bp, Homo sapien
cgcgctgcatctccctcggctacgc

SEQ ID NO: 5167 - DNA, 25 bp, Homo sapien
gcagcgcaagcgcagggtgcttccc

SEQ ID NO: 5168 - DNA, 25 bp, Homo sapien
gaacgactcgaactcccgggagaca

SEQ ID NO: 5169 - DNA, 25 bp, Homo sapien
cccagaaggcagcacggtcaagctt

SEQ ID NO: 5170 - DNA, 25 bp, Homo sapien
tccgggcagccacggactacatccc

SEQ ID NO: 5171 - DNA, 25 bp, Homo sapien
ccgaagcccgctgggaattgaagtc

SEQ ID NO: 5172 - DNA, 25 bp, Homo sapien
tgggctctcaccatcgccgcgcgct

SEQ ID NO: 5173 - DNA, 25 bp, Homo sapien
tgggaattgaagtccgggcagccac

SEQ ID NO: 5174 - DNA, 25 bp, Homo sapien
tggttcacaccagccgggcacggtg

SEQ ID NO: 5175 - DNA, 25 bp, Homo sapien
tggctcaaacccgctgggcacagtg

SEQ ID NO: 5176 - DNA, 25 bp, Homo sapien
cacagtggctcaaacccgctgggca

SEQ ID NO: 5177 - DNA, 25 bp, Homo sapien
acggtggttcacaccagccgggcac

SEQ ID NO: 5178 - DNA, 25 bp, Homo sapien
cggtggttcacaccagccgggcacg

SEQ ID NO: 5179 - DNA, 25 bp, Homo sapien
cagtggctcaaacccgctgggcaca

SEQ ID NO: 5180 - DNA, 25 bp, Homo sapien
gtggttcacaccagccgggcacggt

SEQ ID NO: 5181 - DNA, 25 bp, Homo sapien
ggctcaaacccgctgggcacagtgg

SEQ ID NO: 5182 - DNA, 25 bp, Homo sapien
tcacgccgaccaaggccttgtcaga

SEQ ID NO: 5183 - DNA, 25 bp, Homo sapien
gattggtcacctagcggctcacgcc

SEQ ID NO: 5184 - DNA, 25 bp, Homo sapien
gccgagctcacgctgtgcaagacga

SEQ ID NO: 5185 - DNA, 25 bp, Homo sapien
tgcaagacgacagggcccttcccga

SEQ ID NO: 5186 - DNA, 25 bp, Homo sapien
tcgtctcgtgcccagcacatcttgg

SEQ ID NO: 5187 - DNA, 25 bp, Homo sapien
cacatcttggctggaactggtaggg

SEQ ID NO: 5188 - DNA, 25 bp, Homo sapien
tggcctcaggaacgcactcttgctc

SEQ ID NO: 5189 - DNA, 25 bp, Homo sapien
tcacgccattttgcacgccctgagg

SEQ ID NO: 5190 - DNA, 25 bp, Homo sapien
gggccaggccgttgatgatgacggg

SEQ ID NO: 5191 - DNA, 25 bp, Homo sapien
gccaggccgttgatgatgacggggc

SEQ ID NO: 5192 - DNA, 25 bp, Homo sapien
cggggcccccgttgaggagcactgc

SEQ ID NO: 5193 - DNA, 25 bp, Homo sapien
cgttgatgatgacggggcccccgtt

SEQ ID NO: 5194 - DNA, 25 bp, Homo sapien
ccgttgatgatgacggggcccccgt

SEQ ID NO: 5195 - DNA, 25 bp, Homo sapien
ccaggccgttgatgatgacggggcc

SEQ ID NO: 5196 - DNA, 25 bp, Homo sapien
ttgatgatgacggggcccccgttga

SEQ ID NO: 5197 - DNA, 25 bp, Homo sapien
caggccgttgatgatgacggggccc

SEQ ID NO: 5198 - DNA, 25 bp, Homo sapien
ggactcgtcctcagtcgtgggattc

SEQ ID NO: 5199 - DNA, 25 bp, Homo sapien
caggaagctcccgttcaccaggatg

SEQ ID NO: 5200 - DNA, 25 bp, Homo sapien
ggaagctcccgttcaccaggatgga

SEQ ID NO: 5201 - DNA, 25 bp, Homo sapien
ctcccgttcaccaggatggaggagg

SEQ ID NO: 5202 - DNA, 25 bp, Homo sapien
ctccaggtcctcaggacttcggctg

SEQ ID NO: 5203 - DNA, 25 bp, Homo sapien
acttcggctggactcgtcctcagtc

SEQ ID NO: 5204 - DNA, 25 bp, Homo sapien
gtcctcagtcgtgggattcccatca

SEQ ID NO: 5205 - DNA, 25 bp, Homo sapien
tcctcaggacttcggctggactcgt

SEQ ID NO: 5206 - DNA, 25 bp, Homo sapien
ccgacctggcgaagttctggttgtc

SEQ ID NO: 5207 - DNA, 25 bp, Homo sapien
gagcctctgcctcgcgtagttgact

SEQ ID NO: 5208 - DNA, 25 bp, Homo sapien
cacatgagggactcacctgtggctc

SEQ ID NO: 5209 - DNA, 25 bp, Homo sapien
cccgtgacagctggaaggagaagaa

SEQ ID NO: 5210 - DNA, 25 bp, Homo sapien
gccctatatctggacggggagacca

SEQ ID NO: 5211 - DNA, 25 bp, Homo sapien
tcgcaaagacgtagggtgagcccta

SEQ ID NO: 5212 - DNA, 25 bp, Homo sapien
ctggggctgaataaagggcttctgc

SEQ ID NO: 5213 - DNA, 25 bp, Homo sapien
tgccctctaaagtcgcaaagacgta

SEQ ID NO: 5214 - DNA, 25 bp, Homo sapien
agtcgatacttgtccactgcgccaa

SEQ ID NO: 5215 - DNA, 25 bp, Homo sapien
gaacttcttgcgcagtcgatacttg

SEQ ID NO: 5216 - DNA, 25 bp, Homo sapien
tccttgaagcagtagactgtctcct

SEQ ID NO: 5217 - DNA, 25 bp, Homo sapien
ccagttgctgacctgcgtgagcgac

SEQ ID NO: 5218 - DNA, 25 bp, Homo sapien
tgtcctttttcctcagtccctctag

SEQ ID NO: 5219 - DNA, 25 bp, Homo sapien
gtcccgggagatgtccgaggacctc

SEQ ID NO: 5220 - DNA, 25 bp, Homo sapien
caacaccgatgggatttgggaagga

SEQ ID NO: 5221 - DNA, 25 bp, Homo sapien
cggctctcgagtagccggtagagct

SEQ ID NO: 5222 - DNA, 25 bp, Homo sapien
ttgcactttgcgaaccaacgatagg

SEQ ID NO: 5223 - DNA, 25 bp, Homo sapien
gggcgtcatgcacaagaaagctttg

SEQ ID NO: 5224 - DNA, 25 bp, Homo sapien
cttttctcgagcttgcgtcccagga

SEQ ID NO: 5225 - DNA, 25 bp, Homo sapien
cctaggtggggacagacaataaata

SEQ ID NO: 5226 - DNA, 25 bp, Homo sapien
tcctgtagcctgtcagcgagtcgga

SEQ ID NO: 5227 - DNA, 25 bp, Homo sapien
tcggaggacgaggtcaataaatatc

SEQ ID NO: 5228 - DNA, 25 bp, Homo sapien
tttcccgagtaagcaggcagagatc

SEQ ID NO: 5229 - DNA, 25 bp, Homo sapien
tgcagtttgcccatccacgtcaggg

SEQ ID NO: 5230 - DNA, 25 bp, Homo sapien
aatccgcgtagaagggcgtctgccc

SEQ ID NO: 5231 - DNA, 25 bp, Homo sapien
gatcttgccataggtctccgccgtg

SEQ ID NO: 5232 - DNA, 25 bp, Homo sapien
atgaagtctcgagcctcctcaggga

SEQ ID NO: 5233 - DNA, 25 bp, Homo sapien
cagcaaccgctgaatgaagtctcga

SEQ ID NO: 5234 - DNA, 25 bp, Homo sapien
tgtcccggagaccatcccagtcgag

SEQ ID NO: 5235 - DNA, 25 bp, Homo sapien
tcctccaccaagtcgaagttgcatg

SEQ ID NO: 5236 - DNA, 25 bp, Homo sapien
tgtcggtggcaccttcgaaatccgg

SEQ ID NO: 5237 - DNA, 25 bp, Homo sapien
ctcaccttgtagtggacgatcttgc

SEQ ID NO: 5238 - DNA, 25 bp, Homo sapien
tctgcagtcggacctccttaagcct

SEQ ID NO: 5239 - DNA, 25 bp, Homo sapien
ccggttcggcttacctcgctgaacg

SEQ ID NO: 5240 - DNA, 25 bp, Homo sapien
ggttctaaggctcggtcattcatca

SEQ ID NO: 5241 - DNA, 25 bp, Homo sapien
tccagcccagccctaggttctaagg

SEQ ID NO: 5242 - DNA, 25 bp, Homo sapien
tggcccgtctgcttcatcttcacta

SEQ ID NO: 5243 - DNA, 25 bp, Homo sapien
tcatggcatacacctggcccgtctg

SEQ ID NO: 5244 - DNA, 25 bp, Homo sapien
gtcccacttgttcatgatcttcatg

SEQ ID NO: 5245 - DNA, 25 bp, Homo sapien
ttcactaccgctacctgaggtcgag

SEQ ID NO: 5246 - DNA, 25 bp, Homo sapien
caatgctgaatggtgtgccaggctc

SEQ ID NO: 5247 - DNA, 25 bp, Homo sapien
cttcatgagcccacgcaggagcatg

SEQ ID NO: 5248 - DNA, 25 bp, Homo sapien
gccacagcgttgacccaggacttgt

SEQ ID NO: 5249 - DNA, 25 bp, Homo sapien
ctgcccttgtggtgtaggggtcaaa

SEQ ID NO: 5250 - DNA, 25 bp, Homo sapien
cgccgagccaaagcggtaagtaatg

SEQ ID NO: 5251 - DNA, 25 bp, Homo sapien
agcacgtcttcagtgaggtcccaca

SEQ ID NO: 5252 - DNA, 25 bp, Homo sapien
catcgggcgagaaggcgaactcgtt

SEQ ID NO: 5253 - DNA, 25 bp, Homo sapien
ggtcccacaggcagaactgcgtgtc

SEQ ID NO: 5254 - DNA, 25 bp, Homo sapien
agcttgtagaaaccctcgcgcgtgc

SEQ ID NO: 5255 - DNA, 25 bp, Homo sapien
agtccttagcaaccgcgccctggga

SEQ ID NO: 5256 - DNA, 25 bp, Homo sapien
cgtggccagttagaaagctcaagtc

SEQ ID NO: 5257 - DNA, 25 bp, Homo sapien
gcctttgagcctgtgaccgacttgt

SEQ ID NO: 5258 - DNA, 25 bp, Homo sapien
gcgtgcggaattgcgacttaatctc

SEQ ID NO: 5259 - DNA, 25 bp, Homo sapien
tcgcccgggagtagcttgtagaaac

SEQ ID NO: 5260 - DNA, 25 bp, Homo sapien
aacgcctcttcgattggcacccaga

SEQ ID NO: 5261 - DNA, 25 bp, Homo sapien
cgccctgggaacgtttgcctagcaa

SEQ ID NO: 5262 - DNA, 25 bp, Homo sapien
ccaggtagcctgtgaagaacttctt

SEQ ID NO: 5263 - DNA, 25 bp, Homo sapien
tcctcctcactaaactggtagaagc

SEQ ID NO: 5264 - DNA, 25 bp, Homo sapien
atctttcgggcgttcacgatctggg

SEQ ID NO: 5265 - DNA, 25 bp, Homo sapien
cccggctcgttgcacacaaagtaca

SEQ ID NO: 5266 - DNA, 25 bp, Homo sapien
gatgccctcgaagtccgggttctcc

SEQ ID NO: 5267 - DNA, 25 bp, Homo sapien
tacaggtacttgttggcgcctgagc

SEQ ID NO: 5268 - DNA, 25 bp, Homo sapien
ggcggcttccatacggacttaggga

SEQ ID NO: 5269 - DNA, 25 bp, Homo sapien
tgtgtgtgatgcacccagttggcca

SEQ ID NO: 5270 - DNA, 25 bp, Homo sapien
ctgcgttagtccttagcgtgatttc

SEQ ID NO: 5271 - DNA, 25 bp, Homo sapien
ccctggcccattcataaaggtggga

SEQ ID NO: 5272 - DNA, 25 bp, Homo sapien
tgccaaccgcttggtcccagggaga

SEQ ID NO: 5273 - DNA, 25 bp, Homo sapien
tctgtctgttctcgctcctcaggta

SEQ ID NO: 5274 - DNA, 25 bp, Homo sapien
ctccttcgcactcggactttaaaga

SEQ ID NO: 5275 - DNA, 25 bp, Homo sapien
ctgcagctcacggagacccaggtaa

SEQ ID NO: 5276 - DNA, 25 bp, Homo sapien
gtgatttccaaacaaacggcctgtg

SEQ ID NO: 5277 - DNA, 25 bp, Homo sapien
gcctgtgaaatgatgccaccctata

SEQ ID NO: 5278 - DNA, 25 bp, Homo sapien
cttctccaacaggtgcgagggtctg

SEQ ID NO: 5279 - DNA, 25 bp, Homo sapien
cgccggtttctgagcaccgagagag

SEQ ID NO: 5280 - DNA, 25 bp, Homo sapien
ggctgggagtcttcatagcatcttc

SEQ ID NO: 5281 - DNA, 25 bp, Homo sapien
aaatccatggcttcctcagacgggg

SEQ ID NO: 5282 - DNA, 25 bp, Homo sapien
tccatgctgatgaagatgcccgggg

SEQ ID NO: 5283 - DNA, 25 bp, Homo sapien
agactagagtccaacagcgcggcct

SEQ ID NO: 5284 - DNA, 25 bp, Homo sapien
aggctgctctccctaccttgggtag

SEQ ID NO: 5285 - DNA, 25 bp, Homo sapien
cttcttccttcgcagcggaggctgc

SEQ ID NO: 5286 - DNA, 25 bp, Homo sapien
ggcgagcagacccttcatttccggc

SEQ ID NO: 5287 - DNA, 25 bp, Homo sapien
gaaatgtagtcccttcggaggcacc

SEQ ID NO: 5288 - DNA, 25 bp, Homo sapien
catttccggctctgggtccggctag

SEQ ID NO: 5289 - DNA, 25 bp, Homo sapien
catactacggcgagcagacccttca

SEQ ID NO: 5290 - DNA, 25 bp, Homo sapien
ctcgtcccgtgcgagcggcattctg

SEQ ID NO: 5291 - DNA, 25 bp, Homo sapien
gccatcttccgttcgtcgccgggaa

SEQ ID NO: 5292 - DNA, 25 bp, Homo sapien
ctgcttctttaggagcctcctcctt

SEQ ID NO: 5293 - DNA, 25 bp, Homo sapien
ctctgggtccggctaggccttctgg

SEQ ID NO: 5294 - DNA, 25 bp, Homo sapien
agttcagaagcttatgacgcctttg

SEQ ID NO: 5295 - DNA, 25 bp, Homo sapien
gtgccgtaggacctggaagattctc

SEQ ID NO: 5296 - DNA, 25 bp, Homo sapien
cctcaggcagcactcccgggaaaaa

SEQ ID NO: 5297 - DNA, 25 bp, Homo sapien
ctggaagattctcgaaagttctgga

SEQ ID NO: 5298 - DNA, 25 bp, Homo sapien
aattgggtccgtggcgcgcagctcc

SEQ ID NO: 5299 - DNA, 25 bp, Homo sapien
ttatgacgcctttgcggggatgcct

SEQ ID NO: 5300 - DNA, 25 bp, Homo sapien
aggtgggtcctgctctagttcagaa

SEQ ID NO: 5301 - DNA, 25 bp, Homo sapien
ggaaggttctctcagggatcgccgc

SEQ ID NO: 5302 - DNA, 25 bp, Homo sapien
cctgaggtctgtctcctggcgatcc

SEQ ID NO: 5303 - DNA, 25 bp, Homo sapien
ctgtctcctggcgatcccgcagggg

SEQ ID NO: 5304 - DNA, 25 bp, Homo sapien
ggtgtcccggctataaagcgtggcc

SEQ ID NO: 5305 - DNA, 25 bp, Homo sapien
tcccggctataaagcgtggccgcct

SEQ ID NO: 5306 - DNA, 25 bp, Homo sapien
cgtgcccgctgagagatccagagcg

SEQ ID NO: 5307 - DNA, 25 bp, Homo sapien
tgagagatccagagcgctccgttcc

SEQ ID NO: 5308 - DNA, 25 bp, Homo sapien
ctggccgagtggagctactacccgg

SEQ ID NO: 5309 - DNA, 25 bp, Homo sapien
ccgagtggagctactacccggaggc

SEQ ID NO: 5310 - DNA, 25 bp, Homo sapien
gccgagagaaaggccctcagtctcc

SEQ ID NO: 5311 - DNA, 25 bp, Homo sapien
ccaaatattattccgcgggaggagt

SEQ ID NO: 5312 - DNA, 25 bp, Homo sapien
gcccaaatattattccgcgggagga

SEQ ID NO: 5313 - DNA, 25 bp, Homo sapien
acagcccaaatattattccgcggga

SEQ ID NO: 5314 - DNA, 25 bp, Homo sapien
aagccctgcggtttctggcttctcc

SEQ ID NO: 5315 - DNA, 25 bp, Homo sapien
cgtccgtcccaccagccttgctgtc

SEQ ID NO: 5316 - DNA, 25 bp, Homo sapien
ccgccttgccggctgcgtgtcaccc

SEQ ID NO: 5317 - DNA, 25 bp, Homo sapien
cggccaacagcccaaatattattcc

SEQ ID NO: 5318 - DNA, 25 bp, Homo sapien
taatgatcagccacccggacaggtg

SEQ ID NO: 5319 - DNA, 25 bp, Homo sapien
ttcccggaatctccaccttagcttg

SEQ ID NO: 5320 - DNA, 25 bp, Homo sapien
gtgcgggacaaggccgcgcacatca

SEQ ID NO: 5321 - DNA, 25 bp, Homo sapien
tggttaatgatcagccacccggaca

SEQ ID NO: 5322 - DNA, 25 bp, Homo sapien
gcgagcaggaagtcctggttaatga

SEQ ID NO: 5323 - DNA, 25 bp, Homo sapien
cccgtgacgccagcgagcaggaagt

SEQ ID NO: 5324 - DNA, 25 bp, Homo sapien
atctccaccttagcttggccgggga

SEQ ID NO: 5325 - DNA, 25 bp, Homo sapien
gcacatcagaagcagccgcggagcg

SEQ ID NO: 5326 - DNA, 25 bp, Homo sapien
ccggcgttcatattcgaggtacttg

SEQ ID NO: 5327 - DNA, 25 bp, Homo sapien
agcgccagtagctgttcccgcactg

SEQ ID NO: 5328 - DNA, 25 bp, Homo sapien
tcttgaagcgcacattgaacggggc

SEQ ID NO: 5329 - DNA, 25 bp, Homo sapien
cgggcagtagcatcgaaggcgaaca

SEQ ID NO: 5330 - DNA, 25 bp, Homo sapien
cagttctgccagacagtccgcattc

SEQ ID NO: 5331 - DNA, 25 bp, Homo sapien
cccgcagagcatcgtggaacatctg

SEQ ID NO: 5332 - DNA, 25 bp, Homo sapien
ttctcctgatccatgccggcgttca

SEQ ID NO: 5333 - DNA, 25 bp, Homo sapien
cattgccggaaccacaggggtattc

SEQ ID NO: 5334 - DNA, 25 bp, Homo sapien
cccaaaatgcactgcgggtcggaca

SEQ ID NO: 5335 - DNA, 25 bp, Homo sapien
cgggtcggacatagtgacgcacttc

SEQ ID NO: 5336 - DNA, 25 bp, Homo sapien
gtcggacatagtgacgcacttccgc

SEQ ID NO: 5337 - DNA, 25 bp, Homo sapien
gaggccttccagattcacgctactt

SEQ ID NO: 5338 - DNA, 25 bp, Homo sapien
ggccttccagattcacgctactttc

SEQ ID NO: 5339 - DNA, 25 bp, Homo sapien
ggggctctttacgtgcattcggagc

SEQ ID NO: 5340 - DNA, 25 bp, Homo sapien
ctttacgtgcattcggagcgtggcg

SEQ ID NO: 5341 - DNA, 25 bp, Homo sapien
ctacaattcccaaaatgcactgcgg

SEQ ID NO: 5342 - DNA, 25 bp, Homo sapien
cctaagagtagctgacaccggctga

SEQ ID NO: 5343 - DNA, 25 bp, Homo sapien
tgcccttaccgccagggtttcattc

SEQ ID NO: 5344 - DNA, 25 bp, Homo sapien
cactggaagagctggaacgatcaaa

SEQ ID NO: 5345 - DNA, 25 bp, Homo sapien
tgggagctcctgtatcactggaaga

SEQ ID NO: 5346 - DNA, 25 bp, Homo sapien
gcccttagagggatgtccaggaata

SEQ ID NO: 5347 - DNA, 25 bp, Homo sapien
gaccgatatgagaagggcccttaga

SEQ ID NO: 5348 - DNA, 25 bp, Homo sapien
gcgcgaagtgccacgctgaagagtt

SEQ ID NO: 5349 - DNA, 25 bp, Homo sapien
caacggggcgtctgtaagaccgata

SEQ ID NO: 5350 - DNA, 25 bp, Homo sapien
aggatgggacacaccaccacgccat

SEQ ID NO: 5351 - DNA, 25 bp, Homo sapien
cacgccatccggtgtcttcagctgg

SEQ ID NO: 5352 - DNA, 25 bp, Homo sapien
cacacgggacacacgtagtgcctca

SEQ ID NO: 5353 - DNA, 25 bp, Homo sapien
tacttgagcgtatgggcctggtcac

SEQ ID NO: 5354 - DNA, 25 bp, Homo sapien
taagcgggcagtacttgagcgtatg

SEQ ID NO: 5355 - DNA, 25 bp, Homo sapien
tggccaccgttaagcgggcagtact

SEQ ID NO: 5356 - DNA, 25 bp, Homo sapien
gatgctcagcgcttgaccctgcgtc

SEQ ID NO: 5357 - DNA, 25 bp, Homo sapien
atccggtgtcttcagctggtgtgag

SEQ ID NO: 5358 - DNA, 25 bp, Homo sapien
tgccgcttggacgtcgtcctgtctg

SEQ ID NO: 5359 - DNA, 25 bp, Homo sapien
caaaaccgacagatggctagggacg

SEQ ID NO: 5360 - DNA, 25 bp, Homo sapien
tgcctcctgggcaaaaccgacagat

SEQ ID NO: 5361 - DNA, 25 bp, Homo sapien
agctctggcctgagtcccacctttg

SEQ ID NO: 5362 - DNA, 25 bp, Homo sapien
cgcagatataccagggctccggacc

SEQ ID NO: 5363 - DNA, 25 bp, Homo sapien
ggcgcgatgcccttcaggaaaggta

SEQ ID NO: 5364 - DNA, 25 bp, Homo sapien
acgcgccaggctttgaccaaatatg

SEQ ID NO: 5365 - DNA, 25 bp, Homo sapien
ggcacttgcagcgaattcccgcttc

SEQ ID NO: 5366 - DNA, 25 bp, Homo sapien
tccaggctttcaggacagcgagccc

SEQ ID NO: 5367 - DNA, 25 bp, Homo sapien
catcgtgacatccagtccaggcttt

SEQ ID NO: 5368 - DNA, 25 bp, Homo sapien
cagcttgggtatcgcgatcccgttc

SEQ ID NO: 5369 - DNA, 25 bp, Homo sapien
agtaaaccagtgtccctggctcgcc

SEQ ID NO: 5370 - DNA, 25 bp, Homo sapien
gatagcagggctgggtgttatcacc

SEQ ID NO: 5371 - DNA, 25 bp, Homo sapien
caaacggatcgcgatagcagggctg

SEQ ID NO: 5372 - DNA, 25 bp, Homo sapien
agctgaccacagtgcaaacggatcg

SEQ ID NO: 5373 - DNA, 25 bp, Homo sapien
gaaggcctggctggctgtaccgaca

SEQ ID NO: 5374 - DNA, 25 bp, Homo sapien
ggcttctgggacagctgcacccatg

SEQ ID NO: 5375 - DNA, 25 bp, Homo sapien
catgctcctgactgttccatcacgg

SEQ ID NO: 5376 - DNA, 25 bp, Homo sapien
taacttgccagcgtgttaagcgccg

SEQ ID NO: 5377 - DNA, 25 bp, Homo sapien
ttaagcgccgtgctgatggccagca

SEQ ID NO: 5378 - DNA, 25 bp, Homo sapien
gccacgttggcgtagctgatgttga

SEQ ID NO: 5379 - DNA, 25 bp, Homo sapien
ggggtcttcttgtaccttctgcacg

SEQ ID NO: 5380 - DNA, 25 bp, Homo sapien
tgtaccttctgcacgatggcgctca

SEQ ID NO: 5381 - DNA, 25 bp, Homo sapien
tcaccacgcgctcctgcaggttgat

SEQ ID NO: 5382 - DNA, 25 bp, Homo sapien
tatgccactgcttccccgtaactga

SEQ ID NO: 5383 - DNA, 25 bp, Homo sapien
tcatggcaaccggacaggcccggga

SEQ ID NO: 5384 - DNA, 25 bp, Homo sapien
gtcgtcatggcaaccggacaggccc

SEQ ID NO: 5385 - DNA, 25 bp, Homo sapien
ctcccgtcagcccaggggttctcgc

SEQ ID NO: 5386 - DNA, 25 bp, Homo sapien
acaggcccgggaagcgattggccac

SEQ ID NO: 5387 - DNA, 25 bp, Homo sapien
ccattgcacggagtacgcatgcata

SEQ ID NO: 5388 - DNA, 25 bp, Homo sapien
ttacgcacttccgggtccggacagc

SEQ ID NO: 5389 - DNA, 25 bp, Homo sapien
cgggaagcgattggccactccctgc

SEQ ID NO: 5390 - DNA, 25 bp, Homo sapien
cgtcagaatgagacaagcgagcttc

SEQ ID NO: 5391 - DNA, 25 bp, Homo sapien
ctgtgcagtgaacgtaaccggcatt

SEQ ID NO: 5392 - DNA, 25 bp, Homo sapien
gttcggtccttgcagcctcacagaa

SEQ ID NO: 5393 - DNA, 25 bp, Homo sapien
ggaagcccatggagcatgtctcctc

SEQ ID NO: 5394 - DNA, 25 bp, Homo sapien
tgtctcctcgccctgtgattcgaac

SEQ ID NO: 5395 - DNA, 25 bp, Homo sapien
actggcctacagacggtcgcttcgc

SEQ ID NO: 5396 - DNA, 25 bp, Homo sapien
cacagaatgaggttcctgcggcacc

SEQ ID NO: 5397 - DNA, 25 bp, Homo sapien
agcttctaaagcgatgccgtgaccg

SEQ ID NO: 5398 - DNA, 25 bp, Homo sapien
tgggtgcctcctacgccttggtaac

SEQ ID NO: 5399 - DNA, 25 bp, Homo sapien
cccttcctctgtgcggtctcctccc

SEQ ID NO: 5400 - DNA, 25 bp, Homo sapien
atgctgtgcggctcctcaggtgttc

SEQ ID NO: 5401 - DNA, 25 bp, Homo sapien
tgcggctcctcaggtgttcagttcc

SEQ ID NO: 5402 - DNA, 25 bp, Homo sapien
ggctcctcaggtgttcagttccgtg

SEQ ID NO: 5403 - DNA, 25 bp, Homo sapien
tcctcaggtgttcagttccgtgggt

SEQ ID NO: 5404 - DNA, 25 bp, Homo sapien
aggtgttcagttccgtgggtgcctc

SEQ ID NO: 5405 - DNA, 25 bp, Homo sapien
gggtttctgccgagcagtggggaaa

SEQ ID NO: 5406 - DNA, 25 bp, Homo sapien
agttgtggaagactccggaaagaag

SEQ ID NO: 5407 - DNA, 25 bp, Homo sapien
caggagtgcacgtctaggagttgat

SEQ ID NO: 5408 - DNA, 25 bp, Homo sapien
gaggagtctcgcgattgagtttgtc

SEQ ID NO: 5409 - DNA, 25 bp, Homo sapien
gaaagggatcgtgccctagggtctc

SEQ ID NO: 5410 - DNA, 25 bp, Homo sapien
agagatccagatgaagtcagtgccc

SEQ ID NO: 5411 - DNA, 25 bp, Homo sapien
atcagggtgaggtccgctggcattt

SEQ ID NO: 5412 - DNA, 25 bp, Homo sapien
acgccgtcctaggtggtcgcgcgct

SEQ ID NO: 5413 - DNA, 25 bp, Homo sapien
tcatgggcccaggagtgcacgtcta

SEQ ID NO: 5414 - DNA, 25 bp, Homo sapien
aagcagcatagagcggcgggacata

SEQ ID NO: 5415 - DNA, 25 bp, Homo sapien
ctgagccgctccgagtcgaaggagg

SEQ ID NO: 5416 - DNA, 25 bp, Homo sapien
gcaggccgggtcttctgtctcctga

SEQ ID NO: 5417 - DNA, 25 bp, Homo sapien
cttccactcgttccggggcactatg

SEQ ID NO: 5418 - DNA, 25 bp, Homo sapien
gcactctgatgccagggccttccac

SEQ ID NO: 5419 - DNA, 25 bp, Homo sapien
accacatagcgtaagggcaggctca

SEQ ID NO: 5420 - DNA, 25 bp, Homo sapien
cgccgtgtgcgataccaccacatag

SEQ ID NO: 5421 - DNA, 25 bp, Homo sapien
tgcgataccaccacatagcgtaagg

SEQ ID NO: 5422 - DNA, 25 bp, Homo sapien
cttggaatctcagtcgcgctatggg

SEQ ID NO: 5423 - DNA, 25 bp, Homo sapien
ctgggctccattttcaccacaggga

SEQ ID NO: 5424 - DNA, 25 bp, Homo sapien
tggacccagccgcaaactcaggagc

SEQ ID NO: 5425 - DNA, 25 bp, Homo sapien
gagcgttccaagtgtccagagcgtc

SEQ ID NO: 5426 - DNA, 25 bp, Homo sapien
gcgacagaaacatggcgactactta

SEQ ID NO: 5427 - DNA, 25 bp, Homo sapien
ttggaccgcctgacattgaaaaaga

SEQ ID NO: 5428 - DNA, 25 bp, Homo sapien
tttgcgaggccaaaacctgggtgtg

SEQ ID NO: 5429 - DNA, 25 bp, Homo sapien
cccgtggaagatgcacctgtgacct

SEQ ID NO: 5430 - DNA, 25 bp, Homo sapien
cgcaggcgtcgtcagtagacatcgc

SEQ ID NO: 5431 - DNA, 25 bp, Homo sapien
tcgcgcaggcgtcgtcagtagacat

SEQ ID NO: 5432 - DNA, 25 bp, Homo sapien
gcgtcgtcagtagacatcgcgcagg

SEQ ID NO: 5433 - DNA, 25 bp, Homo sapien
agacatcgcgcaggcgtcgtcagta

SEQ ID NO: 5434 - DNA, 25 bp, Homo sapien
tcgtcagtagacatcgcgcaggcgt

SEQ ID NO: 5435 - DNA, 25 bp, Homo sapien
aggcgtcgtcagtagacatcgcgca

SEQ ID NO: 5436 - DNA, 25 bp, Homo sapien
cgtcagtagacatcgcgcaggcgtc

SEQ ID NO: 5437 - DNA, 25 bp, Homo sapien
cgtcgtcagtagacatcgcgcaggc

SEQ ID NO: 5438 - DNA, 25 bp, Homo sapien
caagagcggcttcggggttcccgat

SEQ ID NO: 5439 - DNA, 25 bp, Homo sapien
gggattccctacgtctctggctgcc

SEQ ID NO: 5440 - DNA, 25 bp, Homo sapien
tgcctttccaagtctttccctctgg

SEQ ID NO: 5441 - DNA, 25 bp, Homo sapien
ttcaggagtgacataccgttgccca

SEQ ID NO: 5442 - DNA, 25 bp, Homo sapien
accgttgcccaatcagagcctcagg

SEQ ID NO: 5443 - DNA, 25 bp, Homo sapien
tgcagcgcgcaaggtactgaagttc

SEQ ID NO: 5444 - DNA, 25 bp, Homo sapien
tctccacccttagggactgcagggg

SEQ ID NO: 5445 - DNA, 25 bp, Homo sapien
tgcgggatacactgccgaggaagtc

SEQ ID NO: 5446 - DNA, 25 bp, Homo sapien
cctttgagccggaacaggatgactg

SEQ ID NO: 5447 - DNA, 25 bp, Homo sapien
ccagcgcggtggtaaaatgagccca

SEQ ID NO: 5448 - DNA, 25 bp, Homo sapien
ccctagactgagacgttggcgtttg

SEQ ID NO: 5449 - DNA, 25 bp, Homo sapien
tcagccaatggcaggtctacactgg

SEQ ID NO: 5450 - DNA, 25 bp, Homo sapien
ctgttctgcagatgaccggttctaa

SEQ ID NO: 5451 - DNA, 25 bp, Homo sapien
gtctctacgatgtgccggccaactc

SEQ ID NO: 5452 - DNA, 25 bp, Homo sapien
cggccaactccatgcggctcaagta

SEQ ID NO: 5453 - DNA, 25 bp, Homo sapien
gtgtagtttccacgcgtccagctcg

SEQ ID NO: 5454 - DNA, 25 bp, Homo sapien
gcgaactcgacagggccacacatcg

SEQ ID NO: 5455 - DNA, 25 bp, Homo sapien
tttcccgagtcaccaccagtgaatg

SEQ ID NO: 5456 - DNA, 25 bp, Homo sapien
tcaggtcgaccacggagctgcgcaa

SEQ ID NO: 5457 - DNA, 25 bp, Homo sapien
tgcgcaaggaaaagtcccgggatgc

SEQ ID NO: 5458 - DNA, 25 bp, Homo sapien
gaggtgctgtaccagctggctcaca

SEQ ID NO: 5459 - DNA, 25 bp, Homo sapien
cctggacaaggcctctatcatgcgc

SEQ ID NO: 5460 - DNA, 25 bp, Homo sapien
tcgaagtctatcacttgtgaggccc

SEQ ID NO: 5461 - DNA, 25 bp, Homo sapien
ccgggaagccttattctgacaaagc

SEQ ID NO: 5462 - DNA, 25 bp, Homo sapien
cggaaccatagcaacgcggagctgc

SEQ ID NO: 5463 - DNA, 25 bp, Homo sapien
gcagaggagctcaagactcaggcca

SEQ ID NO: 5464 - DNA, 25 bp, Homo sapien
gatggcgctgccaaggagcgacata

SEQ ID NO: 5465 - DNA, 25 bp, Homo sapien
tttacgacacttgtgcggcagcggc

SEQ ID NO: 5466 - DNA, 25 bp, Homo sapien
cttcggagagtgatacctaggagtg

SEQ ID NO: 5467 - DNA, 25 bp, Homo sapien
ctcaggccaatgactacttcaaagg

SEQ ID NO: 5468 - DNA, 25 bp, Homo sapien
ctacttcaaaggtgcgcccgcctgg

SEQ ID NO: 5469 - DNA, 25 bp, Homo sapien
cgcggggcagacactaccaagtgac

SEQ ID NO: 5470 - DNA, 25 bp, Homo sapien
tgggaatgtgctggaaagatacgcc

SEQ ID NO: 5471 - DNA, 25 bp, Homo sapien
cagtagagtcgctcagggtcagctc

SEQ ID NO: 5472 - DNA, 25 bp, Homo sapien
cccagcagctgctcagttatttgtc

SEQ ID NO: 5473 - DNA, 25 bp, Homo sapien
agttatttgtcgagtgctgacggtc

SEQ ID NO: 5474 - DNA, 25 bp, Homo sapien
gctgacggtcggtcggaagaaacca

SEQ ID NO: 5475 - DNA, 25 bp, Homo sapien
cccagatgcgcctagttgggaatgt

SEQ ID NO: 5476 - DNA, 25 bp, Homo sapien
taaaggccctgaggtctcgcaagga

SEQ ID NO: 5477 - DNA, 25 bp, Homo sapien
aaccacccggactgaggaaggctga

SEQ ID NO: 5478 - DNA, 25 bp, Homo sapien
gggcttccacgaggacgtccaaatc

SEQ ID NO: 5479 - DNA, 25 bp, Homo sapien
cccacgtggcttttctcgagagtct

SEQ ID NO: 5480 - DNA, 25 bp, Homo sapien
gcggaacaccttgccgatcttctta

SEQ ID NO: 5481 - DNA, 25 bp, Homo sapien
aacgtggtgtcccagctccaagttg

SEQ ID NO: 5482 - DNA, 25 bp, Homo sapien
cgaggtcagtcccaaggctcaaggc

SEQ ID NO: 5483 - DNA, 25 bp, Homo sapien
cccaggtagctgacgggcattttgc

SEQ ID NO: 5484 - DNA, 25 bp, Homo sapien
ggctcaaggcccactccaagctgga

SEQ ID NO: 5485 - DNA, 25 bp, Homo sapien
tgcggccctcttcttccaggaactg

SEQ ID NO: 5486 - DNA, 25 bp, Homo sapien
tgagcactcatgcaacttcagggca

SEQ ID NO: 5487 - DNA, 25 bp, Homo sapien
gaccgagcgcccacagcgtatcaga

SEQ ID NO: 5488 - DNA, 25 bp, Homo sapien
cttcagggcatcctcaaagggtcct

SEQ ID NO: 5489 - DNA, 25 bp, Homo sapien
ctcatccggccgtggtaccagggct

SEQ ID NO: 5490 - DNA, 25 bp, Homo sapien
acgctgtctcgcacaaggaagtccc

SEQ ID NO: 5491 - DNA, 25 bp, Homo sapien
catgccggtgaggacatactgcccg

SEQ ID NO: 5492 - DNA, 25 bp, Homo sapien
tccacgagcagcaggtgcttgggct

SEQ ID NO: 5493 - DNA, 25 bp, Homo sapien
gggcaagcagctactcctgccggga

SEQ ID NO: 5494 - DNA, 25 bp, Homo sapien
gttcagaccagcccaagccatcggg

SEQ ID NO: 5495 - DNA, 25 bp, Homo sapien
ttcagatcagcccaagccatcgggt

SEQ ID NO: 5496 - DNA, 25 bp, Homo sapien
ctgcgttcagatcagcccaagccat

SEQ ID NO: 5497 - DNA, 25 bp, Homo sapien
ggtgcccacctgcgttcagatcagc

SEQ ID NO: 5498 - DNA, 25 bp, Homo sapien
tcagatcagcccaagccatcgggtc

SEQ ID NO: 5499 - DNA, 25 bp, Homo sapien
gcgttcagatcagcccaagccatcg

SEQ ID NO: 5500 - DNA, 25 bp, Homo sapien
ttcagaccagcccaagccatcgggt

SEQ ID NO: 5501 - DNA, 25 bp, Homo sapien
tgcgttcagatcagcccaagccatc

SEQ ID NO: 5502 - DNA, 25 bp, Homo sapien
actcagtgccctgtcgccggactag

SEQ ID NO: 5503 - DNA, 25 bp, Homo sapien
gctgcacttgctcccgcggtgacgt

SEQ ID NO: 5504 - DNA, 25 bp, Homo sapien
tggcaaccgctgaagcatccatctc

SEQ ID NO: 5505 - DNA, 25 bp, Homo sapien
atctcctctgccattggccgactgg

SEQ ID NO: 5506 - DNA, 25 bp, Homo sapien
gccattggccgactggccgcattga

SEQ ID NO: 5507 - DNA, 25 bp, Homo sapien
ccgactggccgcattgaaatcaaga

SEQ ID NO: 5508 - DNA, 25 bp, Homo sapien
ggccgcattgaaatcaagagtctga

SEQ ID NO: 5509 - DNA, 25 bp, Homo sapien
tggcccagaggttgcactcagtgcc

SEQ ID NO: 5510 - DNA, 25 bp, Homo sapien
cgcagtggaatgcagccgtttccca

SEQ ID NO: 5511 - DNA, 25 bp, Homo sapien
cggaggccctctttcaacccaagtg

SEQ ID NO: 5512 - DNA, 25 bp, Homo sapien
gagcaagcgggtctggatacactcc

SEQ ID NO: 5513 - DNA, 25 bp, Homo sapien
tggcctgttcaggtcgcagagcaag

SEQ ID NO: 5514 - DNA, 25 bp, Homo sapien
gcgctgcaattggacctagggagcc

SEQ ID NO: 5515 - DNA, 25 bp, Homo sapien
cgtccagactcgatgccgttagcgg

SEQ ID NO: 5516 - DNA, 25 bp, Homo sapien
ccagccgggacttacttggcagatc

SEQ ID NO: 5517 - DNA, 25 bp, Homo sapien
gcaggtgccgacgtctccatggcaa

SEQ ID NO: 5518 - DNA, 25 bp, Homo sapien
ctggtggaatcagcgggcatcgcaa

SEQ ID NO: 5519 - DNA, 25 bp, Homo sapien
gctcatttcccgcttaagcaggccg

SEQ ID NO: 5520 - DNA, 25 bp, Homo sapien
ccagagtttggggatcgctcatttc

SEQ ID NO: 5521 - DNA, 25 bp, Homo sapien
gacgtggccacattcccagagtttg

SEQ ID NO: 5522 - DNA, 25 bp, Homo sapien
cgcagttctaggacgtggccacatt

SEQ ID NO: 5523 - DNA, 25 bp, Homo sapien
ggcatcgcaactcgcgcggattctt

SEQ ID NO: 5524 - DNA, 25 bp, Homo sapien
aactggggtgcctcctggtggaatc

SEQ ID NO: 5525 - DNA, 25 bp, Homo sapien
tcgtctgcggcgcagttctaggacg

SEQ ID NO: 5526 - DNA, 25 bp, Homo sapien
ctttggtgttcaagcggatggattc

SEQ ID NO: 5527 - DNA, 25 bp, Homo sapien
gatctcctcgatcacgatgcccagg

SEQ ID NO: 5528 - DNA, 25 bp, Homo sapien
tgacggtgaccagagccaagaactc

SEQ ID NO: 5529 - DNA, 25 bp, Homo sapien
cactaagtcggggacaccatttttg

SEQ ID NO: 5530 - DNA, 25 bp, Homo sapien
caatggccacgaactcaggattatc

SEQ ID NO: 5531 - DNA, 25 bp, Homo sapien
tccagcccagcgactcgataacaga

SEQ ID NO: 5532 - DNA, 25 bp, Homo sapien
tcgcttgtctttctcgtcgctccag

SEQ ID NO: 5533 - DNA, 25 bp, Homo sapien
gctgcgccaaggtggaaatgcactc

SEQ ID NO: 5534 - DNA, 25 bp, Homo sapien
cctgaacctcacgtgcgggaacctg

SEQ ID NO: 5535 - DNA, 25 bp, Homo sapien
ttgcaagcgcatcgacgtgatcacc

SEQ ID NO: 5536 - DNA, 25 bp, Homo sapien
aaggtggcccgcttccattgcaagc

SEQ ID NO: 5537 - DNA, 25 bp, Homo sapien
tgctctgctgcacgtacctcaaggt

SEQ ID NO: 5538 - DNA, 25 bp, Homo sapien
catggtggcctacacgtggctgcac

SEQ ID NO: 5539 - DNA, 25 bp, Homo sapien
gtgcaccgtggtcaacatgccgctc

SEQ ID NO: 5540 - DNA, 25 bp, Homo sapien
cttcgggttctaccgcacgctcagt

SEQ ID NO: 5541 - DNA, 25 bp, Homo sapien
ggctgccaactccatgctcagcatg

SEQ ID NO: 5542 - DNA, 25 bp, Homo sapien
gttgtctgtggaactctccttcctc

SEQ ID NO: 5543 - DNA, 25 bp, Homo sapien
cttgagcattcagcccctggggatg

SEQ ID NO: 5544 - DNA, 25 bp, Homo sapien
gtcgcctgttgtctgtggaactctc

SEQ ID NO: 5545 - DNA, 25 bp, Homo sapien
cagggcgttctgagccggcgcttta

SEQ ID NO: 5546 - DNA, 25 bp, Homo sapien
gtgttgtagggaccagcgcgacatc

SEQ ID NO: 5547 - DNA, 25 bp, Homo sapien
gaccagcgcgacatcgggtctaacc

SEQ ID NO: 5548 - DNA, 25 bp, Homo sapien
tggcaatcagaggggccgacagacc

SEQ ID NO: 5549 - DNA, 25 bp, Homo sapien
tctccctgcttgaaccgccggaggg

SEQ ID NO: 5550 - DNA, 25 bp, Homo sapien
ccaggcccaatagtgacgcggctca

SEQ ID NO: 5551 - DNA, 25 bp, Homo sapien
acctctgagcgttaggtggcacctt

SEQ ID NO: 5552 - DNA, 25 bp, Homo sapien
cggcggcaaacccaattcctgtgca

SEQ ID NO: 5553 - DNA, 25 bp, Homo sapien
gccaagctctcatttccgccatggg

SEQ ID NO: 5554 - DNA, 25 bp, Homo sapien
ccacgcggccacagagttcagactt

SEQ ID NO: 5555 - DNA, 25 bp, Homo sapien
gaaagcccttctgcatttgtcgcca

SEQ ID NO: 5556 - DNA, 25 bp, Homo sapien
tttggattgaaccatcgtccgtcgg

SEQ ID NO: 5557 - DNA, 25 bp, Homo sapien
ggcggagcttctaaaccctagcatt

SEQ ID NO: 5558 - DNA, 25 bp, Homo sapien
acccagagagccctggtggcgcttc

SEQ ID NO: 5559 - DNA, 25 bp, Homo sapien
gcaaagaggatgagcatggacgcca

SEQ ID NO: 5560 - DNA, 25 bp, Homo sapien
cgctccacggccatggcaaagagga

SEQ ID NO: 5561 - DNA, 25 bp, Homo sapien
cagtactgctggtgttggcccaggc

SEQ ID NO: 5562 - DNA, 25 bp, Homo sapien
ttctgctggcggtacatgcggcaga

SEQ ID NO: 5563 - DNA, 25 bp, Homo sapien
tgaccgagccgttgcagaggaagat

SEQ ID NO: 5564 - DNA, 25 bp, Homo sapien
tgttgcgcgcataggccacgaacac

SEQ ID NO: 5565 - DNA, 25 bp, Homo sapien
accggccacgaacatcagggtgctg

SEQ ID NO: 5566 - DNA, 25 bp, Homo sapien
cgggcctcggcaatcttggccatgt

SEQ ID NO: 5567 - DNA, 25 bp, Homo sapien
ccttcatgcggtcgatgttcacctc

SEQ ID NO: 5568 - DNA, 25 bp, Homo sapien
ggtcgatgttcacctccagcttcag

SEQ ID NO: 5569 - DNA, 25 bp, Homo sapien
cagcttcagctgttccaccgtcttg

SEQ ID NO: 5570 - DNA, 25 bp, Homo sapien
tgttccaccgtcttgcgggcctcgg

SEQ ID NO: 5571 - DNA, 25 bp, Homo sapien
gcaatcttggccatgttgttggaca

SEQ ID NO: 5572 - DNA, 25 bp, Homo sapien
ccggacagaccgcaggcccagaacc

SEQ ID NO: 5573 - DNA, 25 bp, Homo sapien
ccatgttgttggacatggttgcggc

SEQ ID NO: 5574 - DNA, 25 bp, Homo sapien
gagcttcctacctgttgctgctctg

SEQ ID NO: 5575 - DNA, 25 bp, Homo sapien
cggagcttcctacctgttgctgctc

SEQ ID NO: 5576 - DNA, 25 bp, Homo sapien
accggagcttcctacctgttgctgc

SEQ ID NO: 5577 - DNA, 25 bp, Homo sapien
gaccggagcttcctacctgttgctg

SEQ ID NO: 5578 - DNA, 25 bp, Homo sapien
ggaccggagcttcctacctgttgct

SEQ ID NO: 5579 - DNA, 25 bp, Homo sapien
ctcgcggcggtgacagaggctggga

SEQ ID NO: 5580 - DNA, 25 bp, Homo sapien
agacggtggccacggagcaggcaaa

SEQ ID NO: 5581 - DNA, 25 bp, Homo sapien
cgggaccggagcttcctacctgttg

SEQ ID NO: 5582 - DNA, 25 bp, Homo sapien
gccagataaaggagggaaaccaagc

SEQ ID NO: 5583 - DNA, 25 bp, Homo sapien
ttggggttctttctggacctggaga

SEQ ID NO: 5584 - DNA, 25 bp, Homo sapien
gagcatctttactgcagtcggccca

SEQ ID NO: 5585 - DNA, 25 bp, Homo sapien
taactcggttttcaccgcctggaca

SEQ ID NO: 5586 - DNA, 25 bp, Homo sapien
cgacccgagtccctggtggagattt

SEQ ID NO: 5587 - DNA, 25 bp, Homo sapien
agatttgggtctcggaccctagctc

SEQ ID NO: 5588 - DNA, 25 bp, Homo sapien
gagggaaaccaagcccacatctgga

SEQ ID NO: 5589 - DNA, 25 bp, Homo sapien
acatctggaaagcatcaggcgcgcc

SEQ ID NO: 5590 - DNA, 25 bp, Homo sapien
cggatccggttcattctggacgtgc

SEQ ID NO: 5591 - DNA, 25 bp, Homo sapien
ggaggcctcctgtgtttacatcctg

SEQ ID NO: 5592 - DNA, 25 bp, Homo sapien
agcgtggaggcctcctgtgtttaca

SEQ ID NO: 5593 - DNA, 25 bp, Homo sapien
gggattttgcaactccgcacgagga

SEQ ID NO: 5594 - DNA, 25 bp, Homo sapien
gcctgcgctgggattttgcaactcc

SEQ ID NO: 5595 - DNA, 25 bp, Homo sapien
tcattctggacgtgcttctgcccga

SEQ ID NO: 5596 - DNA, 25 bp, Homo sapien
tgtgtttacatcctgtcagtgctgg

SEQ ID NO: 5597 - DNA, 25 bp, Homo sapien
caacggcgaccggatccggttcatt

SEQ ID NO: 5598 - DNA, 25 bp, Homo sapien
gctcccggggtggtgactgctccac

SEQ ID NO: 5599 - DNA, 25 bp, Homo sapien
gcccgcgcagccgtaaagcagacga

SEQ ID NO: 5600 - DNA, 25 bp, Homo sapien
cagccgtaaagcagacgacgctggg

SEQ ID NO: 5601 - DNA, 25 bp, Homo sapien
gcagcgtcgatctccgcagtggagc

SEQ ID NO: 5602 - DNA, 25 bp, Homo sapien
cgcggcccagcaggctggtctcaga

SEQ ID NO: 5603 - DNA, 25 bp, Homo sapien
gcgcccgggatgtactgcgccttca

SEQ ID NO: 5604 - DNA, 25 bp, Homo sapien
gaaggcaggcgattctccctcgctg

SEQ ID NO: 5605 - DNA, 25 bp, Homo sapien
atgtactgcgccttcaccaagcggc

SEQ ID NO: 5606 - DNA, 25 bp, Homo sapien
cgggctgtcaccgtctcatctgcat

SEQ ID NO: 5607 - DNA, 25 bp, Homo sapien
ccgcccttgcttcaatgccattggt

SEQ ID NO: 5608 - DNA, 25 bp, Homo sapien
gagcgctggctaccattggactgtc

SEQ ID NO: 5609 - DNA, 25 bp, Homo sapien
gcccggtgtctgagcatccaaccga

SEQ ID NO: 5610 - DNA, 25 bp, Homo sapien
ttcctgacgaagactctcgggcgtg

SEQ ID NO: 5611 - DNA, 25 bp, Homo sapien
gcgaccgagcaacagccgcctattg

SEQ ID NO: 5612 - DNA, 25 bp, Homo sapien
tctcccggagccaatgtaactcgca

SEQ ID NO: 5613 - DNA, 25 bp, Homo sapien
gcctattggcgaataagcttcctga

SEQ ID NO: 5614 - DNA, 25 bp, Homo sapien
ttgtagccctggttgagcagcacct

SEQ ID NO: 5615 - DNA, 25 bp, Homo sapien
ctggatctggtcattgatgtcctca

SEQ ID NO: 5616 - DNA, 25 bp, Homo sapien
ccgctgaggctgacgtacatgatca

SEQ ID NO: 5617 - DNA, 25 bp, Homo sapien
tgacgtacatgatcacgcccactga

SEQ ID NO: 5618 - DNA, 25 bp, Homo sapien
accacatgtccagcgagcggttgta

SEQ ID NO: 5619 - DNA, 25 bp, Homo sapien
gatgtcctcatcctcgttgaaaggg

SEQ ID NO: 5620 - DNA, 25 bp, Homo sapien
tgcccaccactgagcggcggaacga

SEQ ID NO: 5621 - DNA, 25 bp, Homo sapien
gcggaacgacttctcgccgatgatg

SEQ ID NO: 5622 - DNA, 25 bp, Homo sapien
ctgctgagttgaaggctagggcaaa

SEQ ID NO: 5623 - DNA, 25 bp, Homo sapien
aaacggagaagaacctgagcaatgc

SEQ ID NO: 5624 - DNA, 25 bp, Homo sapien
acctgagcaatgcaccagcacaggc

SEQ ID NO: 5625 - DNA, 25 bp, Homo sapien
ctgagttgaaggctagggcaaaacg

SEQ ID NO: 5626 - DNA, 25 bp, Homo sapien
cagggcaccacgcacgggactccgc

SEQ ID NO: 5627 - DNA, 25 bp, Homo sapien
aggccccactgacgccgaggaacag

SEQ ID NO: 5628 - DNA, 25 bp, Homo sapien
acgggactccgcagcttccacgctc

SEQ ID NO: 5629 - DNA, 25 bp, Homo sapien
cgaggaacaggaggcacagggcacc

SEQ ID NO: 5630 - DNA, 25 bp, Homo sapien
cggactccaccgtgaggatttctga

SEQ ID NO: 5631 - DNA, 25 bp, Homo sapien
cccggcggcacaaggctgaagttct

SEQ ID NO: 5632 - DNA, 25 bp, Homo sapien
gtgacgatctcaaagcagtgtgggt

SEQ ID NO: 5633 - DNA, 25 bp, Homo sapien
gcgtcctgaaggatgacgggcatca

SEQ ID NO: 5634 - DNA, 25 bp, Homo sapien
tgacagcggaatttcctgcaggacg

SEQ ID NO: 5635 - DNA, 25 bp, Homo sapien
tgaggatttctgacagcggaatttc

SEQ ID NO: 5636 - DNA, 25 bp, Homo sapien
tggcattggcagtgacgatctcaaa

SEQ ID NO: 5637 - DNA, 25 bp, Homo sapien
ggctgaagttctgggcggactccac

SEQ ID NO: 5638 - DNA, 25 bp, Homo sapien
gccagagacgtggatgacaggcgcc

SEQ ID NO: 5639 - DNA, 25 bp, Homo sapien
acacatcagtgcgttggccccatgc

SEQ ID NO: 5640 - DNA, 25 bp, Homo sapien
tcaccagctcttcagccgtgcaggg

SEQ ID NO: 5641 - DNA, 25 bp, Homo sapien
tgccgaggcgcaccgagtggccact

SEQ ID NO: 5642 - DNA, 25 bp, Homo sapien
ccgagtggccactggccagagacgt

SEQ ID NO: 5643 - DNA, 25 bp, Homo sapien
tacggctctgtcgttggcaagaatg

SEQ ID NO: 5644 - DNA, 25 bp, Homo sapien
agttcggtggtgctacggctctgtc

SEQ ID NO: 5645 - DNA, 25 bp, Homo sapien
cggcccgtatacgatgaggcagaag

SEQ ID NO: 5646 - DNA, 25 bp, Homo sapien
tagctctcaccatcgcacttgaggc

SEQ ID NO: 5647 - DNA, 25 bp, Homo sapien
ctttagctctcaccatcgcacttga

SEQ ID NO: 5648 - DNA, 25 bp, Homo sapien
ccgtgccaggaccattacgctccgc

SEQ ID NO: 5649 - DNA, 25 bp, Homo sapien
aggccctggcgcactaggccgaaga

SEQ ID NO: 5650 - DNA, 25 bp, Homo sapien
gcgcactaggccgaagagcatctcc

SEQ ID NO: 5651 - DNA, 25 bp, Homo sapien
caggcgcccgataggagtgcaccgt

SEQ ID NO: 5652 - DNA, 25 bp, Homo sapien
gatctggaagtcctcgaaggtggcc

SEQ ID NO: 5653 - DNA, 25 bp, Homo sapien
cccgcagtgatcacagaaggcaggc

SEQ ID NO: 5654 - DNA, 25 bp, Homo sapien
gaaaagctcagagccgccttcagca

SEQ ID NO: 5655 - DNA, 25 bp, Homo sapien
tgtggcgacggaaaagctcagagcc

SEQ ID NO: 5656 - DNA, 25 bp, Homo sapien
gtagaagccacactcagggaactga

SEQ ID NO: 5657 - DNA, 25 bp, Homo sapien
aaagcaggatcttgtcgtaaaggcc

SEQ ID NO: 5658 - DNA, 25 bp, Homo sapien
ctccgggagcgtggacacctcgaat

SEQ ID NO: 5659 - DNA, 25 bp, Homo sapien
gacgtggggtcatgtttgaaaagca

SEQ ID NO: 5660 - DNA, 25 bp, Homo sapien
ggcggactgtgaccctcccagggca

SEQ ID NO: 5661 - DNA, 25 bp, Homo sapien
cgtaaaggccgtagaagccacactc

SEQ ID NO: 5662 - DNA, 25 bp, Homo sapien
gtgctccaagaagaggatcccactc

SEQ ID NO: 5663 - DNA, 25 bp, Homo sapien
ggcaggcgagaccagttccttccct

SEQ ID NO: 5664 - DNA, 25 bp, Homo sapien
acagtgcagtcgaccaatcggcgcg

SEQ ID NO: 5665 - DNA, 25 bp, Homo sapien
cagccaagcctggaaagttaacttt

SEQ ID NO: 5666 - DNA, 25 bp, Homo sapien
gccaggcgccagtagctctttttcc

SEQ ID NO: 5667 - DNA, 25 bp, Homo sapien
gattccagagataaaggggttcgca

SEQ ID NO: 5668 - DNA, 25 bp, Homo sapien
cctgggttctagatccgcgggatct

SEQ ID NO: 5669 - DNA, 25 bp, Homo sapien
gaggtcccagcgattgagattccaa

SEQ ID NO: 5670 - DNA, 25 bp, Homo sapien
ttactcccacaggagaccactcagg

SEQ ID NO: 5671 - DNA, 25 bp, Homo sapien
ggcgcccggcaagcttctgcttact

SEQ ID NO: 5672 - DNA, 25 bp, Homo sapien
cccagcgggctttctcggcttcgaa

SEQ ID NO: 5673 - DNA, 25 bp, Homo sapien
gacagcgctcacctgtaactcggcg

SEQ ID NO: 5674 - DNA, 25 bp, Homo sapien
aggagaccactcaggtctcccagac

SEQ ID NO: 5675 - DNA, 25 bp, Homo sapien
agcttctgcttactcccacaggaga

SEQ ID NO: 5676 - DNA, 25 bp, Homo sapien
ccggcggccattgctccaagatggc

SEQ ID NO: 5677 - DNA, 25 bp, Homo sapien
cgtgctggataaagtgcaggatccc

SEQ ID NO: 5678 - DNA, 25 bp, Homo sapien
ttcggctgcaacaaggagaccacgc

SEQ ID NO: 5679 - DNA, 25 bp, Homo sapien
gagtttgtggccctagtacctgatg

SEQ ID NO: 5680 - DNA, 25 bp, Homo sapien
tggccctgaacgtcagcctgcgaga

SEQ ID NO: 5681 - DNA, 25 bp, Homo sapien
tcatcccatgggactacgacgtgga

SEQ ID NO: 5682 - DNA, 25 bp, Homo sapien
catctacttggaggacgtgggcaac

SEQ ID NO: 5683 - DNA, 25 bp, Homo sapien
gacctacgtggccaccgagtttgtg

SEQ ID NO: 5684 - DNA, 25 bp, Homo sapien
gggcgactttttccgcgtgcagtac

SEQ ID NO: 5685 - DNA, 25 bp, Homo sapien
cccgcaatggcgtcatgaccaagga

SEQ ID NO: 5686 - DNA, 25 bp, Homo sapien
agaatttgctctcccactcagtgtg

SEQ ID NO: 5687 - DNA, 25 bp, Homo sapien
gtggtttccgcctgcgacagttcca

SEQ ID NO: 5688 - DNA, 25 bp, Homo sapien
ttaagaagcgtctgccgtgatcatg

SEQ ID NO: 5689 - DNA, 25 bp, Homo sapien
tggtttctcccgacgtgcacatcga

SEQ ID NO: 5690 - DNA, 25 bp, Homo sapien
cacgtttgcgtttggacctgtctgt

SEQ ID NO: 5691 - DNA, 25 bp, Homo sapien
gaagcgtattcactgtgcgccagta

SEQ ID NO: 5692 - DNA, 25 bp, Homo sapien
tttccctgcactgtgtcgtcactgc

SEQ ID NO: 5693 - DNA, 25 bp, Homo sapien
gtggcagtcctgatttccatgcttc

SEQ ID NO: 5694 - DNA, 25 bp, Homo sapien
ccagcagcgtggtgaccaggaaaaa

SEQ ID NO: 5695 - DNA, 25 bp, Homo sapien
gcactgaagttccttggctcttgga

SEQ ID NO: 5696 - DNA, 25 bp, Homo sapien
ctccttagagttgtgagttcacagc

SEQ ID NO: 5697 - DNA, 25 bp, Homo sapien
gactggaactttggagggctcctta

SEQ ID NO: 5698 - DNA, 25 bp, Homo sapien
cccgacgttcctaggactgagttga

SEQ ID NO: 5699 - DNA, 25 bp, Homo sapien
caccatgatgggaagcaccggggtt

SEQ ID NO: 5700 - DNA, 25 bp, Homo sapien
gatgatcatccgcagcagacgcagc

SEQ ID NO: 5701 - DNA, 25 bp, Homo sapien
ctgtcagcagcacaagcaggttggc

SEQ ID NO: 5702 - DNA, 25 bp, Homo sapien
agcctcggctatttacgcgtgggcc

SEQ ID NO: 5703 - DNA, 25 bp, Homo sapien
accatccgcggcagagaagggactt

SEQ ID NO: 5704 - DNA, 25 bp, Homo sapien
gtttcctctcgtttcaaagcttcca

SEQ ID NO: 5705 - DNA, 25 bp, Homo sapien
gactgtgtctcacgagtttcctctc

SEQ ID NO: 5706 - DNA, 25 bp, Homo sapien
ttctcgctacccacaagactgtgtc

SEQ ID NO: 5707 - DNA, 25 bp, Homo sapien
ttccagagcgccttcctctttcgga

SEQ ID NO: 5708 - DNA, 25 bp, Homo sapien
aagggacttgtcagcgcccgatcca

SEQ ID NO: 5709 - DNA, 25 bp, Homo sapien
gctagagcggacttccggtagaaaa

SEQ ID NO: 5710 - DNA, 25 bp, Homo sapien
tgcccagcgcagaaagttccttacc

SEQ ID NO: 5711 - DNA, 25 bp, Homo sapien
agagaaggtctcgagctcgggctcc

SEQ ID NO: 5712 - DNA, 25 bp, Homo sapien
cctcttgggagctttcttgggcttg

SEQ ID NO: 5713 - DNA, 25 bp, Homo sapien
gctccggagccgacttctccctctt

SEQ ID NO: 5714 - DNA, 25 bp, Homo sapien
tctcctgcccgtaataatcagggtc

SEQ ID NO: 5715 - DNA, 25 bp, Homo sapien
ccagcgcagaaagttccttacctgg

SEQ ID NO: 5716 - DNA, 25 bp, Homo sapien
gctcccggctccagatctcctgccc

SEQ ID NO: 5717 - DNA, 25 bp, Homo sapien
cccgtaataatcagggtcctcgagg

SEQ ID NO: 5718 - DNA, 25 bp, Homo sapien
ctcagccgccgctggactaggagca

SEQ ID NO: 5719 - DNA, 25 bp, Homo sapien
tgcctcgctggttgtcccttcgcgg

SEQ ID NO: 5720 - DNA, 25 bp, Homo sapien
gcggccgccgcaatagcggcatttt

SEQ ID NO: 5721 - DNA, 25 bp, Homo sapien
tctgctcgtttgcaagtcgcctcgc

SEQ ID NO: 5722 - DNA, 25 bp, Homo sapien
cagtagatcggctgcttgagacgcg

SEQ ID NO: 5723 - DNA, 25 bp, Homo sapien
ttcccattggctggtcaggtcccgc

SEQ ID NO: 5724 - DNA, 25 bp, Homo sapien
ctcttcttccgggacgacgaattgc

SEQ ID NO: 5725 - DNA, 25 bp, Homo sapien
tgaggcgggccacgcctcctcatat

SEQ ID NO: 5726 - DNA, 25 bp, Homo sapien
ctggttgagtcgctgctttcccgag

SEQ ID NO: 5727 - DNA, 25 bp, Homo sapien
cttcgtggctctgaggtgtaacggg

SEQ ID NO: 5728 - DNA, 25 bp, Homo sapien
gacatcgtctgtgtccaggtcagaa

SEQ ID NO: 5729 - DNA, 25 bp, Homo sapien
tcgtctgtgtccaggtcagaaagtg

SEQ ID NO: 5730 - DNA, 25 bp, Homo sapien
tctgtgtccaggtcagaaagtggcc

SEQ ID NO: 5731 - DNA, 25 bp, Homo sapien
aggaggcggtctgtcacctcggcca

SEQ ID NO: 5732 - DNA, 25 bp, Homo sapien
ggtctgtcacctcggccactgctga

SEQ ID NO: 5733 - DNA, 25 bp, Homo sapien
ctgggtctggttgagtcgctgcttt

SEQ ID NO: 5734 - DNA, 25 bp, Homo sapien
tttctacccgggctgatggtcaagg

SEQ ID NO: 5735 - DNA, 25 bp, Homo sapien
agccgggaaaacagggtgcagatcc

SEQ ID NO: 5736 - DNA, 25 bp, Homo sapien
tgcagatccggggagtcagacaccg

SEQ ID NO: 5737 - DNA, 25 bp, Homo sapien
gagccctgcacggatctcagtttcc

SEQ ID NO: 5738 - DNA, 25 bp, Homo sapien
ggtccaattcacacccgatgttctg

SEQ ID NO: 5739 - DNA, 25 bp, Homo sapien
tctcccgagggcactaagcgttgcc

SEQ ID NO: 5740 - DNA, 25 bp, Homo sapien
aacacgtggcgccatcccgagaggc

SEQ ID NO: 5741 - DNA, 25 bp, Homo sapien
cagtttccctagaaggtctcccgag

SEQ ID NO: 5742 - DNA, 25 bp, Homo sapien
tggtgtacccgcacctgcagaggct

SEQ ID NO: 5743 - DNA, 25 bp, Homo sapien
gaaccaatactctgcatctggagga

SEQ ID NO: 5744 - DNA, 25 bp, Homo sapien
gacccagggcaaacgcatcaaagtg

SEQ ID NO: 5745 - DNA, 25 bp, Homo sapien
gaaaccaaaggctccgaggacagtg

SEQ ID NO: 5746 - DNA, 25 bp, Homo sapien
ggctgtgagctcctctgtccatttc

SEQ ID NO: 5747 - DNA, 25 bp, Homo sapien
cgagttcacctctgtcatccgggca

SEQ ID NO: 5748 - DNA, 25 bp, Homo sapien
tgcccgtagccctgagaattaaacg

SEQ ID NO: 5749 - DNA, 25 bp, Homo sapien
cagtggcgacgaggatccctccagc

SEQ ID NO: 5750 - DNA, 25 bp, Homo sapien
ctccttgattttgtaccggactacg

SEQ ID NO: 5751 - DNA, 25 bp, Homo sapien
ttgcgctcggggaaagccgatattc

SEQ ID NO: 5752 - DNA, 25 bp, Homo sapien
ctctgtcatctaggccggtagtgcc

SEQ ID NO: 5753 - DNA, 25 bp, Homo sapien
cggcgtgaactgtccattggtcgga

SEQ ID NO: 5754 - DNA, 25 bp, Homo sapien
attggctatgcgctcgccactcagg

SEQ ID NO: 5755 - DNA, 25 bp, Homo sapien
aggttgcaacccatgtcactcagga

SEQ ID NO: 5756 - DNA, 25 bp, Homo sapien
aggcgcgattctacgaggctgcctc

SEQ ID NO: 5757 - DNA, 25 bp, Homo sapien
accgacctgtctcgtgcgcttttcg

SEQ ID NO: 5758 - DNA, 25 bp, Homo sapien
ttctgctcgagcaggggaaggaaac

SEQ ID NO: 5759 - DNA, 25 bp, Homo sapien
ctttcctgccggctgaaacccaccg

SEQ ID NO: 5760 - DNA, 25 bp, Homo sapien
tcacccgccagccagagaagggcgt

SEQ ID NO: 5761 - DNA, 25 bp, Homo sapien
caactccttctgctcgagcagggga

SEQ ID NO: 5762 - DNA, 25 bp, Homo sapien
gaaacagtgggcgaaccctgcaccc

SEQ ID NO: 5763 - DNA, 25 bp, Homo sapien
caccaggaaacagtgggcgaaccct

SEQ ID NO: 5764 - DNA, 25 bp, Homo sapien
gtccgtgtccaaacctactctccag

SEQ ID NO: 5765 - DNA, 25 bp, Homo sapien
ggctgaaacccaccgtccgtgtcca

SEQ ID NO: 5766 - DNA, 25 bp, Homo sapien
tcggcccgaaccagcctagaggctg

SEQ ID NO: 5767 - DNA, 25 bp, Homo sapien
ggtttcggaatcacctctgcgctga

SEQ ID NO: 5768 - DNA, 25 bp, Homo sapien
ctcctgatgggaatggggtatatat

SEQ ID NO: 5769 - DNA, 25 bp, Homo sapien
cacacttaagctcggagggctcctg

SEQ ID NO: 5770 - DNA, 25 bp, Homo sapien
gcgcggcctccatagttcctttggg

SEQ ID NO: 5771 - DNA, 25 bp, Homo sapien
ggctagagagagcatgagaaaccta

SEQ ID NO: 5772 - DNA, 25 bp, Homo sapien
ggggagccataaatagcctaagccg

SEQ ID NO: 5773 - DNA, 25 bp, Homo sapien
cccgccgcaatcaggaattgacaca

SEQ ID NO: 5774 - DNA, 25 bp, Homo sapien
ctaggattggttggaccctccgtca

SEQ ID NO: 5775 - DNA, 25 bp, Homo sapien
cgcgccatttttggggctaggattg

SEQ ID NO: 5776 - DNA, 25 bp, Homo sapien
tcacgtgacatgcagtcgccggatc

SEQ ID NO: 5777 - DNA, 25 bp, Homo sapien
ccggatcgcctttgagtctcgtgag

SEQ ID NO: 5778 - DNA, 25 bp, Homo sapien
gtctcgtgaggtacttttggtccca

SEQ ID NO: 5779 - DNA, 25 bp, Homo sapien
catgcgcagaagcactccgggcgtg

SEQ ID NO: 5780 - DNA, 25 bp, Homo sapien
ggcacagtatgaccggcagatccgc

SEQ ID NO: 5781 - DNA, 25 bp, Homo sapien
ctcggggccttaagccgcgccattt

SEQ ID NO: 5782 - DNA, 25 bp, Homo sapien
ccctgctggtcgctgtttcggggac

SEQ ID NO: 5783 - DNA, 25 bp, Homo sapien
cggccagtaccaccgcctgaggcgg

SEQ ID NO: 5784 - DNA, 25 bp, Homo sapien
tcgtactgcctcatggaaaatcctc

SEQ ID NO: 5785 - DNA, 25 bp, Homo sapien
cgggcctcgtactgcctcatggaaa

SEQ ID NO: 5786 - DNA, 25 bp, Homo sapien
atgcccgcacgctggggtctgtctt

SEQ ID NO: 5787 - DNA, 25 bp, Homo sapien
agcgttgcatgtacgggcctcgtac

SEQ ID NO: 5788 - DNA, 25 bp, Homo sapien
ctcagcagcgttgcatgtacgggcc

SEQ ID NO: 5789 - DNA, 25 bp, Homo sapien
cctcatggaaaatcctccggagccg

SEQ ID NO: 5790 - DNA, 25 bp, Homo sapien
cgggatatatgagccgcgccgccca

SEQ ID NO: 5791 - DNA, 25 bp, Homo sapien
gcacgggcgactccaggtgctgctc

SEQ ID NO: 5792 - DNA, 25 bp, Homo sapien
actgtgcgttgaggtcgtccgccat

SEQ ID NO: 5793 - DNA, 25 bp, Homo sapien
gcggctgctgactcaccggctataa

SEQ ID NO: 5794 - DNA, 25 bp, Homo sapien
gcggaagtcccacctgccgtctacc

SEQ ID NO: 5795 - DNA, 25 bp, Homo sapien
tagcccgggatatatgagccgcgcc

SEQ ID NO: 5796 - DNA, 25 bp, Homo sapien
ccggctataaatagcccgggatata

SEQ ID NO: 5797 - DNA, 25 bp, Homo sapien
acccgccgctcgtactgtgcgttga

SEQ ID NO: 5798 - DNA, 25 bp, Homo sapien
aatgagcgccctctgattcccagtc

SEQ ID NO: 5799 - DNA, 25 bp, Homo sapien
tggacgcaccaaagccatagcaatg

SEQ ID NO: 5800 - DNA, 25 bp, Homo sapien
cctgaagttcttgttcccttgaata

SEQ ID NO: 5801 - DNA, 25 bp, Homo sapien
actcagggccaagcagattttcctc

SEQ ID NO: 5802 - DNA, 25 bp, Homo sapien
agcgctgtctccctgagatttgcag

SEQ ID NO: 5803 - DNA, 25 bp, Homo sapien
ctcgggcttatgcagcagactttgc

SEQ ID NO: 5804 - DNA, 25 bp, Homo sapien
ggcaggtctttgtgcgctactttta

SEQ ID NO: 5805 - DNA, 25 bp, Homo sapien
tagcaatgatcatagggaccctcgg

SEQ ID NO: 5806 - DNA, 25 bp, Homo sapien
gttaggacccagatggagaagagtg

SEQ ID NO: 5807 - DNA, 25 bp, Homo sapien
aggacactgccgagggcaccaggcg

SEQ ID NO: 5808 - DNA, 25 bp, Homo sapien
tgcttcttgcaacacaaagaccaca

SEQ ID NO: 5809 - DNA, 25 bp, Homo sapien
gttcctccgagtctccagccctctc

SEQ ID NO: 5810 - DNA, 25 bp, Homo sapien
caggtcagcagggaagtaccagggc

SEQ ID NO: 5811 - DNA, 25 bp, Homo sapien
taccagggcccactgtacctccagc

SEQ ID NO: 5812 - DNA, 25 bp, Homo sapien
cactgtacctccagcctacccgggg

SEQ ID NO: 5813 - DNA, 25 bp, Homo sapien
ttgcaacacaaagaccacattggcc

SEQ ID NO: 5814 - DNA, 25 bp, Homo sapien
tgcgtacacagaccgaccgacgggc

SEQ ID NO: 5815 - DNA, 25 bp, Homo sapien
agcgatgcgtacacagaccgaccga

SEQ ID NO: 5816 - DNA, 25 bp, Homo sapien
gagcccgcaccccattgtttgtaaa

SEQ ID NO: 5817 - DNA, 25 bp, Homo sapien
tgctgctgccgctctaactgcagtg

SEQ ID NO: 5818 - DNA, 25 bp, Homo sapien
tgccgctctaactgcagtggcggct

SEQ ID NO: 5819 - DNA, 25 bp, Homo sapien
cctagcccaaggcaaggaggaccca

SEQ ID NO: 5820 - DNA, 25 bp, Homo sapien
atcgcccagacaccgggacagtcgg

SEQ ID NO: 5821 - DNA, 25 bp, Homo sapien
cgggacagtcggacacacacactga

SEQ ID NO: 5822 - DNA, 25 bp, Homo sapien
cgcgtgtgaaggttaccgcttcccg

SEQ ID NO: 5823 - DNA, 25 bp, Homo sapien
cccggagacggcgagcgcgctcatt

SEQ ID NO: 5824 - DNA, 25 bp, Homo sapien
ccgcgtgcccaatgccaggcgggca

SEQ ID NO: 5825 - DNA, 25 bp, Homo sapien
gttacccagcaacaagcctggccca

SEQ ID NO: 5826 - DNA, 25 bp, Homo sapien
cttcccggccagccagtgagcggta

SEQ ID NO: 5827 - DNA, 25 bp, Homo sapien
agcctggcccaaccaggcgcgagga

SEQ ID NO: 5828 - DNA, 25 bp, Homo sapien
cgcgcgtgtgaaggttaccgcttcc

SEQ ID NO: 5829 - DNA, 25 bp, Homo sapien
ccagtgagcggtacccgccgccgtt

SEQ ID NO: 5830 - DNA, 25 bp, Homo sapien
taacttggagactcggcccgcgccg

SEQ ID NO: 5831 - DNA, 25 bp, Homo sapien
tgcccgagaacagcggcgctgctct

SEQ ID NO: 5832 - DNA, 25 bp, Homo sapien
cgcgccagtgagaagctcccgaatc

SEQ ID NO: 5833 - DNA, 25 bp, Homo sapien
tgagaagctcccgaatcctgcggta

SEQ ID NO: 5834 - DNA, 25 bp, Homo sapien
gctcccgaatcctgcggtaacttgg

SEQ ID NO: 5835 - DNA, 25 bp, Homo sapien
taacttggtaacttggagactcggc

SEQ ID NO: 5836 - DNA, 25 bp, Homo sapien
ttggtaacttggagactcggcccgc

SEQ ID NO: 5837 - DNA, 25 bp, Homo sapien
atcctgcggtaacttggtaacttgg

SEQ ID NO: 5838 - DNA, 25 bp, Homo sapien
ggatgagctcactgcgagttggcca

SEQ ID NO: 5839 - DNA, 25 bp, Homo sapien
aagcccacctttgcaccagacgatg

SEQ ID NO: 5840 - DNA, 25 bp, Homo sapien
tcactgcgagttggccaggatttca

SEQ ID NO: 5841 - DNA, 25 bp, Homo sapien
agagctttatcgctcgggccaggcg

SEQ ID NO: 5842 - DNA, 25 bp, Homo sapien
ccctggttcggcacgagagctttat

SEQ ID NO: 5843 - DNA, 25 bp, Homo sapien
cccacgcagggcagacttcaggaag

SEQ ID NO: 5844 - DNA, 25 bp, Homo sapien
cggacggttcgctacttcgtcctcg

SEQ ID NO: 5845 - DNA, 25 bp, Homo sapien
gagttggccaggatttcatcagctt

SEQ ID NO: 5846 - DNA, 25 bp, Homo sapien
aggctggagctttgcacagaaaatc

SEQ ID NO: 5847 - DNA, 25 bp, Homo sapien
ggggccatagtgttgcttgttcagc

SEQ ID NO: 5848 - DNA, 25 bp, Homo sapien
ggccagaaagttttgccttactgga

SEQ ID NO: 5849 - DNA, 25 bp, Homo sapien
gtccagattcttggccgggacgttg

SEQ ID NO: 5850 - DNA, 25 bp, Homo sapien
aaagtttcgtctgagccacgggcgc

SEQ ID NO: 5851 - DNA, 25 bp, Homo sapien
gccagatgctgacgcaacgaggtgt

SEQ ID NO: 5852 - DNA, 25 bp, Homo sapien
ctggcattcccagccggattgaggc

SEQ ID NO: 5853 - DNA, 25 bp, Homo sapien
acctaaaagttgtggctggactgtg

SEQ ID NO: 5854 - DNA, 25 bp, Homo sapien
cgccgagtatgagcgcaaccagcgg

SEQ ID NO: 5855 - DNA, 25 bp, Homo sapien
gttcttgaacccaacccagtgcgga

SEQ ID NO: 5856 - DNA, 25 bp, Homo sapien
cagtgcggaacttcctggacgaccc

SEQ ID NO: 5857 - DNA, 25 bp, Homo sapien
acccagtgcggaacttcctggacga

SEQ ID NO: 5858 - DNA, 25 bp, Homo sapien
ccctggaggagtctgagcgggaccg

SEQ ID NO: 5859 - DNA, 25 bp, Homo sapien
tgaacccaacccagtgcggaacttc

SEQ ID NO: 5860 - DNA, 25 bp, Homo sapien
cgagtatgagcgcaaccagcgggtc

SEQ ID NO: 5861 - DNA, 25 bp, Homo sapien
tatgagcgcaaccagcgggtcagtg

SEQ ID NO: 5862 - DNA, 25 bp, Homo sapien
tgcttccgctcacccttgaactgtg

SEQ ID NO: 5863 - DNA, 25 bp, Homo sapien
gaggaggggtttatctggatttcca

SEQ ID NO: 5864 - DNA, 25 bp, Homo sapien
ctgaggatacctgaaagcgggctga

SEQ ID NO: 5865 - DNA, 25 bp, Homo sapien
gccggaatcctgacaggcggagtta

SEQ ID NO: 5866 - DNA, 25 bp, Homo sapien
ttccggaactagagtgtgggagcca

SEQ ID NO: 5867 - DNA, 25 bp, Homo sapien
ctcgagcactggagtagagcagtcc

SEQ ID NO: 5868 - DNA, 25 bp, Homo sapien
tagatgcctgggctggatgaagtcc

SEQ ID NO: 5869 - DNA, 25 bp, Homo sapien
gccagccctgtcgtattaaacgcag

SEQ ID NO: 5870 - DNA, 25 bp, Homo sapien
tctagagggcgcaatcactcgaggc

SEQ ID NO: 5871 - DNA, 25 bp, Homo sapien
cgcaatgcctctactggcctctaga

SEQ ID NO: 5872 - DNA, 25 bp, Homo sapien
gttccagcgagagtcttagagccca

SEQ ID NO: 5873 - DNA, 25 bp, Homo sapien
aagcgtgctgtgcacaggcgcaaga

SEQ ID NO: 5874 - DNA, 25 bp, Homo sapien
gaggcgcttgcaagtctgtaccgca

SEQ ID NO: 5875 - DNA, 25 bp, Homo sapien
cttccgattggctcttctgtggtgg

SEQ ID NO: 5876 - DNA, 25 bp, Homo sapien
aaacgcggacagagatggcacctga

SEQ ID NO: 5877 - DNA, 25 bp, Homo sapien
tagcgctcttgggaccggaagttaa

SEQ ID NO: 5878 - DNA, 25 bp, Homo sapien
cggtaggtcatgacgcaagcctcca

SEQ ID NO: 5879 - DNA, 25 bp, Homo sapien
tcctttgtaaggtctcccagggcgc

SEQ ID NO: 5880 - DNA, 25 bp, Homo sapien
gtgacttttgccctcctggaataac

SEQ ID NO: 5881 - DNA, 25 bp, Homo sapien
tcgcctctgtttttgtcggtccgcc

SEQ ID NO: 5882 - DNA, 25 bp, Homo sapien
ccgatgacctttccgcctcgggtga

SEQ ID NO: 5883 - DNA, 25 bp, Homo sapien
ctccaggttccggtttccgcatgcg

SEQ ID NO: 5884 - DNA, 25 bp, Homo sapien
ggtcgccgttattgcgtccagagta

SEQ ID NO: 5885 - DNA, 25 bp, Homo sapien
tccagagtacagtcggggaaaccga

SEQ ID NO: 5886 - DNA, 25 bp, Homo sapien
gcccatgaagggcaccgttatgccc

SEQ ID NO: 5887 - DNA, 25 bp, Homo sapien
acaagccggtgctggcaacccgagt

SEQ ID NO: 5888 - DNA, 25 bp, Homo sapien
ctgccaaacggttcaacgtccggag

SEQ ID NO: 5889 - DNA, 25 bp, Homo sapien
gtccggagtggttacggattcacca

SEQ ID NO: 5890 - DNA, 25 bp, Homo sapien
cgttcactggacagctgttaaaaga

SEQ ID NO: 5891 - DNA, 25 bp, Homo sapien
ccgacgtaggttccgctgattcatc

SEQ ID NO: 5892 - DNA, 25 bp, Homo sapien
gccgaagactctgggcagcggccca

SEQ ID NO: 5893 - DNA, 25 bp, Homo sapien
ggaagatgtcttcgttcactggaca

SEQ ID NO: 5894 - DNA, 25 bp, Homo sapien
tcgatcataggttgcacgatgcgtc

SEQ ID NO: 5895 - DNA, 25 bp, Homo sapien
caagacgaacacagagcgggccgga

SEQ ID NO: 5896 - DNA, 25 bp, Homo sapien
agagaggccaagacgaacacagagc

SEQ ID NO: 5897 - DNA, 25 bp, Homo sapien
gcacgatgcgtctccgggcgttaat

SEQ ID NO: 5898 - DNA, 25 bp, Homo sapien
tgtgcggttggattgatcgatcata

SEQ ID NO: 5899 - DNA, 25 bp, Homo sapien
ccctgtacctgtgcggttggattga

SEQ ID NO: 5900 - DNA, 25 bp, Homo sapien
ccacgtgtggctgcgtctcggtata

SEQ ID NO: 5901 - DNA, 25 bp, Homo sapien
tctccgggcgttaatgaacctggga

SEQ ID NO: 5902 - DNA, 25 bp, Homo sapien
attaaacagaaccaccaaggagcgg

SEQ ID NO: 5903 - DNA, 25 bp, Homo sapien
ctctcccttgtcttgtggaaattaa

SEQ ID NO: 5904 - DNA, 25 bp, Homo sapien
cccggtctctcccttgtcttgtgga

SEQ ID NO: 5905 - DNA, 25 bp, Homo sapien
cgagacggacacaccggggaccgca

SEQ ID NO: 5906 - DNA, 25 bp, Homo sapien
cgagacctaccctccgggccatggg

SEQ ID NO: 5907 - DNA, 25 bp, Homo sapien
agtgagcctgcagagctacagcacg

SEQ ID NO: 5908 - DNA, 25 bp, Homo sapien
tgcagagctacagcacgagggattg

SEQ ID NO: 5909 - DNA, 25 bp, Homo sapien
cagaaccaccaaggagcgggatagg

SEQ ID NO: 5910 - DNA, 25 bp, Homo sapien
tggccacgccatccatcacccgagc

SEQ ID NO: 5911 - DNA, 25 bp, Homo sapien
cattagccacggctcagcggtggcg

SEQ ID NO: 5912 - DNA, 25 bp, Homo sapien
agcccagactcctgtggctcattcg

SEQ ID NO: 5913 - DNA, 25 bp, Homo sapien
gactcctgtggctcattcgtcaccg

SEQ ID NO: 5914 - DNA, 25 bp, Homo sapien
gtggctcattcgtcaccggccctga

SEQ ID NO: 5915 - DNA, 25 bp, Homo sapien
cgtcaccggccctgacaaatgcctg

SEQ ID NO: 5916 - DNA, 25 bp, Homo sapien
taccattagccacggctcagcggtg

SEQ ID NO: 5917 - DNA, 25 bp, Homo sapien
caagcaatcataccattagccacgg

SEQ ID NO: 5918 - DNA, 25 bp, Homo sapien
ggcagtacgcctccaggctggcgaa

SEQ ID NO: 5919 - DNA, 25 bp, Homo sapien
tcacgttgccgatggacgcgtcggc

SEQ ID NO: 5920 - DNA, 25 bp, Homo sapien
cgacgcccaggccaaggaacacgtt

SEQ ID NO: 5921 - DNA, 25 bp, Homo sapien
gccgccaccttgctggcgaacgtgt

SEQ ID NO: 5922 - DNA, 25 bp, Homo sapien
cggtacagcagcacggcaatgccca

SEQ ID NO: 5923 - DNA, 25 bp, Homo sapien
aggaacacgttcaccgcgttggagc

SEQ ID NO: 5924 - DNA, 25 bp, Homo sapien
agtctctgcgcgaggccctagaagc

SEQ ID NO: 5925 - DNA, 25 bp, Homo sapien
cccacgaaggcgaagacggtgaaga

SEQ ID NO: 5926 - DNA, 25 bp, Homo sapien
atgaccaggatggagacaccaaagc

SEQ ID NO: 5927 - DNA, 25 bp, Homo sapien
gagacaccaaagcaggcccagccgt

SEQ ID NO: 5928 - DNA, 25 bp, Homo sapien
ggaagtgcatcacgtagtcaaagca

SEQ ID NO: 5929 - DNA, 25 bp, Homo sapien
ccaaagcaggcccagccgtggcagt

SEQ ID NO: 5930 - DNA, 25 bp, Homo sapien
ccagaacaccgtcaggaagtgcatc

SEQ ID NO: 5931 - DNA, 25 bp, Homo sapien
gagcaccttccagaacaccgtcagg

SEQ ID NO: 5932 - DNA, 25 bp, Homo sapien
agtcaaagcacgacggcagccgctc

SEQ ID NO: 5933 - DNA, 25 bp, Homo sapien
gggcacacaggcgaagagcaccttc

SEQ ID NO: 5934 - DNA, 25 bp, Homo sapien
agctccttctgcgtctcgcctggtt

SEQ ID NO: 5935 - DNA, 25 bp, Homo sapien
tcgtcgtcgatgatgccgatgcgca

SEQ ID NO: 5936 - DNA, 25 bp, Homo sapien
gtcctcctcgaagatgtcgtcgtcg

SEQ ID NO: 5937 - DNA, 25 bp, Homo sapien
ccactatgtgggcatggctcaccca

SEQ ID NO: 5938 - DNA, 25 bp, Homo sapien
gcagccgcacgaagaaatgctcgtc

SEQ ID NO: 5939 - DNA, 25 bp, Homo sapien
cactcgctcacgtgcagcaggcggt

SEQ ID NO: 5940 - DNA, 25 bp, Homo sapien
acatggtctcgtcgtcgccaaactc

SEQ ID NO: 5941 - DNA, 25 bp, Homo sapien
ggtttgaacaccagcgtgccctcgc

SEQ ID NO: 5942 - DNA, 25 bp, Homo sapien
ccacgtagaaggtgctgttgccctc

SEQ ID NO: 5943 - DNA, 25 bp, Homo sapien
ttgtcggccatccaggcgaatacca

SEQ ID NO: 5944 - DNA, 25 bp, Homo sapien
tcctcagtgcggtagtccacgtaga

SEQ ID NO: 5945 - DNA, 25 bp, Homo sapien
agcgcgtagtagttggcgatgccca

SEQ ID NO: 5946 - DNA, 25 bp, Homo sapien
cagctgctccagatccttgtccggg

SEQ ID NO: 5947 - DNA, 25 bp, Homo sapien
aacgtgccgtccagctcgatgctct

SEQ ID NO: 5948 - DNA, 25 bp, Homo sapien
tgcggtagcgcttgtacacgtactt

SEQ ID NO: 5949 - DNA, 25 bp, Homo sapien
ggacccacctgtactcgtagtcgga

SEQ ID NO: 5950 - DNA, 25 bp, Homo sapien
acaaacatgttgaaggcagcgctgc

SEQ ID NO: 5951 - DNA, 25 bp, Homo sapien
ctcacccgcctggaagttgtggccg

SEQ ID NO: 5952 - DNA, 25 bp, Homo sapien
ttgtggccgcagacttcgatgactg

SEQ ID NO: 5953 - DNA, 25 bp, Homo sapien
ggacaccgtctcattccagatgcga

SEQ ID NO: 5954 - DNA, 25 bp, Homo sapien
ggtgatctccttctcttttgacgtg

SEQ ID NO: 5955 - DNA, 25 bp, Homo sapien
ttttgacgtgatgacctcgatggcc

SEQ ID NO: 5956 - DNA, 25 bp, Homo sapien
aacggtcggcgatgatggacactcc

SEQ ID NO: 5957 - DNA, 25 bp, Homo sapien
gcacacggcgatgaccacaaacatg

SEQ ID NO: 5958 - DNA, 25 bp, Homo sapien
acgagaagcgcgtgaagctgtcctc

SEQ ID NO: 5959 - DNA, 25 bp, Homo sapien
tcgggcctcccaggcgactttgccc

SEQ ID NO: 5960 - DNA, 25 bp, Homo sapien
atgacgtacggaagctgccggcgtt

SEQ ID NO: 5961 - DNA, 25 bp, Homo sapien
tctaagcgacctgaaccgccgggtg

SEQ ID NO: 5962 - DNA, 25 bp, Homo sapien
tgaagctgtcctcgcgcaacggaca

SEQ ID NO: 5963 - DNA, 25 bp, Homo sapien
tgctctgcgacgagaagcgcgtgaa

SEQ ID NO: 5964 - DNA, 25 bp, Homo sapien
cgtacacattgctctgcgacgagaa

SEQ ID NO: 5965 - DNA, 25 bp, Homo sapien
acctacgactctctaagcgacctga

SEQ ID NO: 5966 - DNA, 25 bp, Homo sapien
acgcccgggtttgacagttctgcgc

SEQ ID NO: 5967 - DNA, 25 bp, Homo sapien
gaccgtctctcctcaaaccgtgttg

SEQ ID NO: 5968 - DNA, 25 bp, Homo sapien
cgcctcaggccatgtcaccttattg

SEQ ID NO: 5969 - DNA, 25 bp, Homo sapien
tcagcccggttctcacccaaagagg

SEQ ID NO: 5970 - DNA, 25 bp, Homo sapien
aggactgcgagttcttcactttgcg

SEQ ID NO: 5971 - DNA, 25 bp, Homo sapien
cccggaattgtccatggcggccaca

SEQ ID NO: 5972 - DNA, 25 bp, Homo sapien
cgcggaacacagatcggtaaaactc

SEQ ID NO: 5973 - DNA, 25 bp, Homo sapien
tcgcctcaagatagtgtcgcctcgg

SEQ ID NO: 5974 - DNA, 25 bp, Homo sapien
ctatgatgtagaagtgcggcaggca

SEQ ID NO: 5975 - DNA, 25 bp, Homo sapien
ggaacgagaccagacaggagccctg

SEQ ID NO: 5976 - DNA, 25 bp, Homo sapien
agcactcaccaaagcgcttccgggt

SEQ ID NO: 5977 - DNA, 25 bp, Homo sapien
ccaccagtgtggctccttgatggcg

SEQ ID NO: 5978 - DNA, 25 bp, Homo sapien
ccttgatggcggagaacttgacctc

SEQ ID NO: 5979 - DNA, 25 bp, Homo sapien
tcatagaggtctgtggtcccgcact

SEQ ID NO: 5980 - DNA, 25 bp, Homo sapien
cgcacttgggctgccctatgatgta

SEQ ID NO: 5981 - DNA, 25 bp, Homo sapien
cagcgcaggcggaagtgcttcccgt

SEQ ID NO: 5982 - DNA, 25 bp, Homo sapien
tcaagcaggggactaagactctctc

SEQ ID NO: 5983 - DNA, 25 bp, Homo sapien
agactctctcgtgttctgaaaaccc

SEQ ID NO: 5984 - DNA, 25 bp, Homo sapien
ctaacgtttgttaagtggcactcga

SEQ ID NO: 5985 - DNA, 25 bp, Homo sapien
ggcactcgagttgggatcagagcta

SEQ ID NO: 5986 - DNA, 25 bp, Homo sapien
cttccggatccttggtctgcggtga

SEQ ID NO: 5987 - DNA, 25 bp, Homo sapien
ccttcagcagcgacagacgaacggg

SEQ ID NO: 5988 - DNA, 25 bp, Homo sapien
cgtgtcatgttagggacaggatgca

SEQ ID NO: 5989 - DNA, 25 bp, Homo sapien
cggcaggtgccagtgaagatcgcca

SEQ ID NO: 5990 - DNA, 25 bp, Homo sapien
tctggaacacctgcatctgctcgtg

SEQ ID NO: 5991 - DNA, 25 bp, Homo sapien
atgctactcacgatgcggcgcagga

SEQ ID NO: 5992 - DNA, 25 bp, Homo sapien
gtcttctggtggacgatgctactca

SEQ ID NO: 5993 - DNA, 25 bp, Homo sapien
agtgttcctcccttcgctgtctgaa

SEQ ID NO: 5994 - DNA, 25 bp, Homo sapien
gccgagggcttgtggacaacaaaca

SEQ ID NO: 5995 - DNA, 25 bp, Homo sapien
ctcgtggctcacaagaggttcctgc

SEQ ID NO: 5996 - DNA, 25 bp, Homo sapien
atccgctgggacttggtgatcatct

SEQ ID NO: 5997 - DNA, 25 bp, Homo sapien
gtcgcagtcgaccttgaccttcttg

SEQ ID NO: 5998 - DNA, 25 bp, Homo sapien
ggctagcgaatgcaaggcccagatg

SEQ ID NO: 5999 - DNA, 25 bp, Homo sapien
ggataaatctgggtgccccaaagtg

SEQ ID NO: 6000 - DNA, 25 bp, Homo sapien
agagatttggagttttgctggaaga

SEQ ID NO: 6001 - DNA, 25 bp, Homo sapien
agatcctaaaaagggataaatctgg

SEQ ID NO: 6002 - DNA, 25 bp, Homo sapien
cccaaagtgggactatggaggagga

SEQ ID NO: 6003 - DNA, 25 bp, Homo sapien
gcctggaagaggctagcgaatgcaa

SEQ ID NO: 6004 - DNA, 25 bp, Homo sapien
gcccagatgcagaaggtggggaggt

SEQ ID NO: 6005 - DNA, 25 bp, Homo sapien
ttggagttttgctggaagatcctaa

SEQ ID NO: 6006 - DNA, 25 bp, Homo sapien
gtatcgtctgtttccgaggaccctg

SEQ ID NO: 6007 - DNA, 25 bp, Homo sapien
actccagccattgttcctggtgggc

SEQ ID NO: 6008 - DNA, 25 bp, Homo sapien
tcgtctgtttccgaggaccctgtcg

SEQ ID NO: 6009 - DNA, 25 bp, Homo sapien
gccgtatcgtctgtttccgaggacc

SEQ ID NO: 6010 - DNA, 25 bp, Homo sapien
ggaggccgtatcgtctgtttccgag

SEQ ID NO: 6011 - DNA, 25 bp, Homo sapien
ggcctctgagcagcgtcctggtgct

SEQ ID NO: 6012 - DNA, 25 bp, Homo sapien
agagtcccgggagcctccactccag

SEQ ID NO: 6013 - DNA, 25 bp, Homo sapien
tccactccagccattgttcctggtg

SEQ ID NO: 6014 - DNA, 25 bp, Homo sapien
ctagctgctaaaatccggacccgga

SEQ ID NO: 6015 - DNA, 25 bp, Homo sapien
actttatttccaccgcctagctgct

SEQ ID NO: 6016 - DNA, 25 bp, Homo sapien
gtcccagccgcatttgaagggagcg

SEQ ID NO: 6017 - DNA, 25 bp, Homo sapien
cagttgcctgatttcgtggcggctc

SEQ ID NO: 6018 - DNA, 25 bp, Homo sapien
ggcgagaggcccatttaacccgatg

SEQ ID NO: 6019 - DNA, 25 bp, Homo sapien
caaatctggccaatgatagtgtgta

SEQ ID NO: 6020 - DNA, 25 bp, Homo sapien
gcagtaggcccgattcaaatctggc

SEQ ID NO: 6021 - DNA, 25 bp, Homo sapien
ccagacctgggccaataggcggctg

SEQ ID NO: 6022 - DNA, 25 bp, Homo sapien
gctcaaacatcagggtgagtttctc

SEQ ID NO: 6023 - DNA, 25 bp, Homo sapien
agcggccgccatgcgatcaggcagt

SEQ ID NO: 6024 - DNA, 25 bp, Homo sapien
gagagaggagacctaacgttccacg

SEQ ID NO: 6025 - DNA, 25 bp, Homo sapien
gcgccgacggctgctcaaacatcag

SEQ ID NO: 6026 - DNA, 25 bp, Homo sapien
gggtgagtttctcacaatgtagcaa

SEQ ID NO: 6027 - DNA, 25 bp, Homo sapien
caatgtagcaatttctctttaaatc

SEQ ID NO: 6028 - DNA, 25 bp, Homo sapien
ttaactctctctacctgcgagtcgg

SEQ ID NO: 6029 - DNA, 25 bp, Homo sapien
catgcgatcaggcagtgcgctgacc

SEQ ID NO: 6030 - DNA, 25 bp, Homo sapien
cacgctcaatgggaactctgtgttc

SEQ ID NO: 6031 - DNA, 25 bp, Homo sapien
cagaacctgacgttcatggcggcgg

SEQ ID NO: 6032 - DNA, 25 bp, Homo sapien
cgctgcaagcgaacgtcttcaagca

SEQ ID NO: 6033 - DNA, 25 bp, Homo sapien
ggccctgagcaaacccatgagcgtc

SEQ ID NO: 6034 - DNA, 25 bp, Homo sapien
tgccgggccagaaccagttcctact

SEQ ID NO: 6035 - DNA, 25 bp, Homo sapien
cacaggtggacagctcatcgcgaac

SEQ ID NO: 6036 - DNA, 25 bp, Homo sapien
tcctcacaaaccagaacctggcggg

SEQ ID NO: 6037 - DNA, 25 bp, Homo sapien
tccagaagaacctctcggccgctgt

SEQ ID NO: 6038 - DNA, 25 bp, Homo sapien
cacccccgtcgccaaaggagctggc

SEQ ID NO: 6039 - DNA, 25 bp, Homo sapien
gtgcctgcctcggtcatagtcagcg

SEQ ID NO: 6040 - DNA, 25 bp, Homo sapien
tcaggcccccgacagccaggcttcc

SEQ ID NO: 6041 - DNA, 25 bp, Homo sapien
cagcagcctgtgtccgcagcacaga

SEQ ID NO: 6042 - DNA, 25 bp, Homo sapien
agcagcctgtgtccgcagcacagac

SEQ ID NO: 6043 - DNA, 25 bp, Homo sapien
agcctgtgtccgcagcacagaccca

SEQ ID NO: 6044 - DNA, 25 bp, Homo sapien
cctgtgtccgcagcacagacccagc

SEQ ID NO: 6045 - DNA, 25 bp, Homo sapien
tgcctgcctcggtcatagtcagcgc

SEQ ID NO: 6046 - DNA, 25 bp, Homo sapien
acgaggagtttgagacggtctccac

SEQ ID NO: 6047 - DNA, 25 bp, Homo sapien
acggtctccacgcagctgctgaaac

SEQ ID NO: 6048 - DNA, 25 bp, Homo sapien
gcacccaggccatgctcaataaata

SEQ ID NO: 6049 - DNA, 25 bp, Homo sapien
gctcaataaatatcggctcctgctc

SEQ ID NO: 6050 - DNA, 25 bp, Homo sapien
gagctcccatcacaaggacagtttg

SEQ ID NO: 6051 - DNA, 25 bp, Homo sapien
ggacagtttggaccttgcacgcatc

SEQ ID NO: 6052 - DNA, 25 bp, Homo sapien
ttcttgctggttcactcgcacgtcg

SEQ ID NO: 6053 - DNA, 25 bp, Homo sapien
gtccacggtgcgctatgctgaccct

SEQ ID NO: 6054 - DNA, 25 bp, Homo sapien
gagcacctgcagagcgccatcgaca

SEQ ID NO: 6055 - DNA, 25 bp, Homo sapien
gacgagctgtaccagcgtatgctga

SEQ ID NO: 6056 - DNA, 25 bp, Homo sapien
gcgcaagacctaccgcgagaacgtg

SEQ ID NO: 6057 - DNA, 25 bp, Homo sapien
gctcagcaaggtcgtgcacaacacg

SEQ ID NO: 6058 - DNA, 25 bp, Homo sapien
caccaagcttgtgatccggcacggc

SEQ ID NO: 6059 - DNA, 25 bp, Homo sapien
tctccagcgacagcccgcaggatga

SEQ ID NO: 6060 - DNA, 25 bp, Homo sapien
cgcaggatgacacgctcaccgagca

SEQ ID NO: 6061 - DNA, 25 bp, Homo sapien
agccgcatcgggctcaagctcaaga

SEQ ID NO: 6062 - DNA, 25 bp, Homo sapien
tccttctactgaaatccagtttttg

SEQ ID NO: 6063 - DNA, 25 bp, Homo sapien
ctgtgtccctccagaaagcgcagag

SEQ ID NO: 6064 - DNA, 25 bp, Homo sapien
agtctgtgtccctccagaaagcgca

SEQ ID NO: 6065 - DNA, 25 bp, Homo sapien
aggagtctgtgtccctccagaaagc

SEQ ID NO: 6066 - DNA, 25 bp, Homo sapien
ccagaggagtctgtgtccctccaga

SEQ ID NO: 6067 - DNA, 25 bp, Homo sapien
acactgaaaggccagaggagtctgt

SEQ ID NO: 6068 - DNA, 25 bp, Homo sapien
ctactgaaatccagtttttgaggtt

SEQ ID NO: 6069 - DNA, 25 bp, Homo sapien
ttgaagtttttgacctaaacactga

SEQ ID NO: 6070 - DNA, 25 bp, Homo sapien
caggcctatacgaccggacacactt

SEQ ID NO: 6071 - DNA, 25 bp, Homo sapien
atacgaccggacacactttgaccca

SEQ ID NO: 6072 - DNA, 25 bp, Homo sapien
agccctgcctgtacgaccggacact

SEQ ID NO: 6073 - DNA, 25 bp, Homo sapien
gtacgaccggacacattgcagcctg

SEQ ID NO: 6074 - DNA, 25 bp, Homo sapien
acacattgcagcctgggcccgtacg

SEQ ID NO: 6075 - DNA, 25 bp, Homo sapien
gggcccgtacgaccggacactctga

SEQ ID NO: 6076 - DNA, 25 bp, Homo sapien
gtacgaccggacacactttgaccca

SEQ ID NO: 6077 - DNA, 25 bp, Homo sapien
gcctgcctgtatgaccggacacgct

SEQ ID NO: 6078 - DNA, 25 bp, Homo sapien
ggcgcttcggatcctcgcgggaccc

SEQ ID NO: 6079 - DNA, 25 bp, Homo sapien
tggagctctcgcccgccgtgctaag

SEQ ID NO: 6080 - DNA, 25 bp, Homo sapien
attcgaaccccaggctggacgctgg

SEQ ID NO: 6081 - DNA, 25 bp, Homo sapien
cagcaccgcagctgtcgcctcccga

SEQ ID NO: 6082 - DNA, 25 bp, Homo sapien
tggaggcggaattcgaaccccaggc

SEQ ID NO: 6083 - DNA, 25 bp, Homo sapien
acgggaccgcgagcacaggccgctc

SEQ ID NO: 6084 - DNA, 25 bp, Homo sapien
gcccgccgtgctaaggcgtcttccc

SEQ ID NO: 6085 - DNA, 25 bp, Homo sapien
cacccggctcagacggctccggacg

SEQ ID NO: 6086 - DNA, 25 bp, Homo sapien
gcgccagtccgacgtcatgatcgtg

SEQ ID NO: 6087 - DNA, 25 bp, Homo sapien
ccgctacgacatggaccgctttggc

SEQ ID NO: 6088 - DNA, 25 bp, Homo sapien
agtgaaatcccacgtggtcccggcg

SEQ ID NO: 6089 - DNA, 25 bp, Homo sapien
ggccggcacactcaccaacaagatg

SEQ ID NO: 6090 - DNA, 25 bp, Homo sapien
caggtctacgaccagatgccggagc

SEQ ID NO: 6091 - DNA, 25 bp, Homo sapien
ccgtgccctgatggcgcttatcaaa

SEQ ID NO: 6092 - DNA, 25 bp, Homo sapien
cgcgctttacaactcttggggcccg

SEQ ID NO: 6093 - DNA, 25 bp, Homo sapien
ccgcagagttctctgtggcccatga

SEQ ID NO: 6094 - DNA, 25 bp, Homo sapien
aggacgcagacttcgacggcaagcc

SEQ ID NO: 6095 - DNA, 25 bp, Homo sapien
ttcctcaacaggtgtgccagccgcg

SEQ ID NO: 6096 - DNA, 25 bp, Homo sapien
ccaccatgttcagctggctgaagcg

SEQ ID NO: 6097 - DNA, 25 bp, Homo sapien
gcacggtgacctcggccctcaagga

SEQ ID NO: 6098 - DNA, 25 bp, Homo sapien
agcactaccgctttggggccttcca

SEQ ID NO: 6099 - DNA, 25 bp, Homo sapien
gggcaagaccagcttcatccagtac

SEQ ID NO: 6100 - DNA, 25 bp, Homo sapien
caccgactgctttgtggccgtcatg

SEQ ID NO: 6101 - DNA, 25 bp, Homo sapien
ccctcaaggagctgtaccgcacgaa

SEQ ID NO: 6102 - DNA, 25 bp, Homo sapien
ttgatgcgcacaagctggagatctc

SEQ ID NO: 6103 - DNA, 25 bp, Homo sapien
ctcggacgagttctcagaggccatc

SEQ ID NO: 6104 - DNA, 25 bp, Homo sapien
gacaagatccgcgtggtgctcaaca

SEQ ID NO: 6105 - DNA, 25 bp, Homo sapien
ggtgctcaacaaggccgacatggtg

SEQ ID NO: 6106 - DNA, 25 bp, Homo sapien
ggagcaggacctcttccgcgacatc

SEQ ID NO: 6107 - DNA, 25 bp, Homo sapien
ggcacgcagccttgcgcaagctcaa

SEQ ID NO: 6108 - DNA, 25 bp, Homo sapien
tcaacgacctggtgaagagggcccg

SEQ ID NO: 6109 - DNA, 25 bp, Homo sapien
agcgcgtggacctcatcatcctgct

SEQ ID NO: 6110 - DNA, 25 bp, Homo sapien
gagatcttctacaacctggcgcctg

SEQ ID NO: 6111 - DNA, 25 bp, Homo sapien
aagtttcactcgctgaagccgaagc

SEQ ID NO: 6112 - DNA, 25 bp, Homo sapien
ccgaagctgctagaggcactggacg

SEQ ID NO: 6113 - DNA, 25 bp, Homo sapien
gacgcacgacatcgccaagctcatg

SEQ ID NO: 6114 - DNA, 25 bp, Homo sapien
gccacctcatcgaggccaagctgga

SEQ ID NO: 6115 - DNA, 25 bp, Homo sapien
ctgagcggctccaaggccaagacct

SEQ ID NO: 6116 - DNA, 25 bp, Homo sapien
atctggaagctcagcgatgtggacc

SEQ ID NO: 6117 - DNA, 25 bp, Homo sapien
cactggacgagatgctgacgcacga

SEQ ID NO: 6118 - DNA, 25 bp, Homo sapien
cgtgcccttgcacaacctgggtaca

SEQ ID NO: 6119 - DNA, 25 bp, Homo sapien
tgtattcgggcacgaagtgctctcc

SEQ ID NO: 6120 - DNA, 25 bp, Homo sapien
ctgggtacataactcccgacgcgta

SEQ ID NO: 6121 - DNA, 25 bp, Homo sapien
gacgcgtaacaccaggaacacgctg

SEQ ID NO: 6122 - DNA, 25 bp, Homo sapien
aagtggtgaccttgcccacacgggc

SEQ ID NO: 6123 - DNA, 25 bp, Homo sapien
ctggcggacgctcagaaaacagata

SEQ ID NO: 6124 - DNA, 25 bp, Homo sapien
cagataggctgtggtcgccaaaatc

SEQ ID NO: 6125 - DNA, 25 bp, Homo sapien
atccctgcccaggtgattcggcgct

SEQ ID NO: 6126 - DNA, 25 bp, Homo sapien
cagtggctgagttcttcctttgaca

SEQ ID NO: 6127 - DNA, 25 bp, Homo sapien
cgcacgctgcaaaggggctttttgg

SEQ ID NO: 6128 - DNA, 25 bp, Homo sapien
cgcgcgcacgctgcaaaggggcttt

SEQ ID NO: 6129 - DNA, 25 bp, Homo sapien
gctacaggagcgcacgagcgggtac

SEQ ID NO: 6130 - DNA, 25 bp, Homo sapien
ctgagttcttcctttgacaagatgg

SEQ ID NO: 6131 - DNA, 25 bp, Homo sapien
gagggtgggaaatctgcgcgcgcac

SEQ ID NO: 6132 - DNA, 25 bp, Homo sapien
gacgccagtggctgagttcttcctt

SEQ ID NO: 6133 - DNA, 25 bp, Homo sapien
tttttgggacgccagtggctgagtt

SEQ ID NO: 6134 - DNA, 25 bp, Homo sapien
ggactgcctgtatcgagactctctc

SEQ ID NO: 6135 - DNA, 25 bp, Homo sapien
tcgccgtccgagtcgtttattggta

SEQ ID NO: 6136 - DNA, 25 bp, Homo sapien
cgtttattggtaagcccagcggcca

SEQ ID NO: 6137 - DNA, 25 bp, Homo sapien
gaggacccatgggagcccttgtatg

SEQ ID NO: 6138 - DNA, 25 bp, Homo sapien
ttcgacttgtgacacgctgggcatc

SEQ ID NO: 6139 - DNA, 25 bp, Homo sapien
cgctgggcatctcgggttataaaag

SEQ ID NO: 6140 - DNA, 25 bp, Homo sapien
gacgagtgtgtgtcaatttcgaacc

SEQ ID NO: 6141 - DNA, 25 bp, Homo sapien
agaccacccttgaggctgattccgg

SEQ ID NO: 6142 - DNA, 25 bp, Homo sapien
agttggaacaggactcaggatgcag

SEQ ID NO: 6143 - DNA, 25 bp, Homo sapien
gcatagagttggaacaggactcagg

SEQ ID NO: 6144 - DNA, 25 bp, Homo sapien
accgcgggttctcacgggtgcctga

SEQ ID NO: 6145 - DNA, 25 bp, Homo sapien
ctcacgggtgcctgaggtccgggca

SEQ ID NO: 6146 - DNA, 25 bp, Homo sapien
acagcctgggccgatcatgtgggcg

SEQ ID NO: 6147 - DNA, 25 bp, Homo sapien
atcatgtgggcgagtttgggctagc

SEQ ID NO: 6148 - DNA, 25 bp, Homo sapien
tttgggctagcatagagttggaaca

SEQ ID NO: 6149 - DNA, 25 bp, Homo sapien
ctagcatagagttggaacaggactc

SEQ ID NO: 6150 - DNA, 25 bp, Homo sapien
agccgggggccctcatatggtgggt

SEQ ID NO: 6151 - DNA, 25 bp, Homo sapien
ggggccctcatatggtgggtgcggg

SEQ ID NO: 6152 - DNA, 25 bp, Homo sapien
ggccctcatatggtgggtgcggggt

SEQ ID NO: 6153 - DNA, 25 bp, Homo sapien
gccctcatatggtgggtgcggggtg

SEQ ID NO: 6154 - DNA, 25 bp, Homo sapien
tgaacaccgggagagttttgaggcc

SEQ ID NO: 6155 - DNA, 25 bp, Homo sapien
caccgggagagttttgaggccggcg

SEQ ID NO: 6156 - DNA, 25 bp, Homo sapien
cgggagagttttgaggccggcgccg

SEQ ID NO: 6157 - DNA, 25 bp, Homo sapien
gggagagttttgaggccggcgccgc

SEQ ID NO: 6158 - DNA, 25 bp, Homo sapien
cgcgccaaactagctcgggagcggc

SEQ ID NO: 6159 - DNA, 25 bp, Homo sapien
agtcctgttccaactctatgctagc

SEQ ID NO: 6160 - DNA, 25 bp, Homo sapien
tgttccaactctatgctagcccaaa

SEQ ID NO: 6161 - DNA, 25 bp, Homo sapien
tgctagcccaaactcgcccacatga

SEQ ID NO: 6162 - DNA, 25 bp, Homo sapien
tcgcccacatgatcggcccaggctg

SEQ ID NO: 6163 - DNA, 25 bp, Homo sapien
tcaggcacccgtgagaacccgcggt

SEQ ID NO: 6164 - DNA, 25 bp, Homo sapien
gaatcgccgcgccaaactagctcgg

SEQ ID NO: 6165 - DNA, 25 bp, Homo sapien
ctgcatcctgagtcctgttccaact

SEQ ID NO: 6166 - DNA, 25 bp, Homo sapien
ccgtgaaagcactggtctgtccgtc

SEQ ID NO: 6167 - DNA, 25 bp, Homo sapien
ggaagcgccggcaactcccgagtca

SEQ ID NO: 6168 - DNA, 25 bp, Homo sapien
gcaaaagttcacaccgctcggggct

SEQ ID NO: 6169 - DNA, 25 bp, Homo sapien
ttctggaagcgcatccgagctcgca

SEQ ID NO: 6170 - DNA, 25 bp, Homo sapien
cgattccgactactgggctccttct

SEQ ID NO: 6171 - DNA, 25 bp, Homo sapien
tgtgtcgccgctgggtaacccttcc

SEQ ID NO: 6172 - DNA, 25 bp, Homo sapien
gaccaatggcgaagggactcctccc

SEQ ID NO: 6173 - DNA, 25 bp, Homo sapien
cgccgcaaggctagagccagggttc

SEQ ID NO: 6174 - DNA, 25 bp, Homo sapien
aggatgaggtgaacctcccgcgtcg

SEQ ID NO: 6175 - DNA, 25 bp, Homo sapien
gatctccggcactgaagtcgaagga

SEQ ID NO: 6176 - DNA, 25 bp, Homo sapien
tacctcgaaaggatctccggcactg

SEQ ID NO: 6177 - DNA, 25 bp, Homo sapien
caaagcccttctcgattacctcgaa

SEQ ID NO: 6178 - DNA, 25 bp, Homo sapien
agttcctccgcaaagtcagcttcgc

SEQ ID NO: 6179 - DNA, 25 bp, Homo sapien
gtcctcagttcctccgcaaagtcag

SEQ ID NO: 6180 - DNA, 25 bp, Homo sapien
agttgatttggctctctggacttcc

SEQ ID NO: 6181 - DNA, 25 bp, Homo sapien
cgatgggtgagttgatttggctctc

SEQ ID NO: 6182 - DNA, 25 bp, Homo sapien
ggtgacagttgtggctgcgtgtctc

SEQ ID NO: 6183 - DNA, 25 bp, Homo sapien
actcacagcactgccagtgagcctg

SEQ ID NO: 6184 - DNA, 25 bp, Homo sapien
tccagctgccgaccttcaggggaga

SEQ ID NO: 6185 - DNA, 25 bp, Homo sapien
cactgccagtgagcctggcgatgtc

SEQ ID NO: 6186 - DNA, 25 bp, Homo sapien
tgctgcggctgttctcggccaccag

SEQ ID NO: 6187 - DNA, 25 bp, Homo sapien
cggaacttgctgaagaccccggagg

SEQ ID NO: 6188 - DNA, 25 bp, Homo sapien
cagctgccgaccttcaggggagagc

SEQ ID NO: 6189 - DNA, 25 bp, Homo sapien
gcctggcgatgtcgcggaacttgct

SEQ ID NO: 6190 - DNA, 25 bp, Homo sapien
catcctatggatgggccgactcgga

SEQ ID NO: 6191 - DNA, 25 bp, Homo sapien
gccaacggaggaggctactaccact

SEQ ID NO: 6192 - DNA, 25 bp, Homo sapien
acggaggaggctactaccactattc

SEQ ID NO: 6193 - DNA, 25 bp, Homo sapien
ggctactaccactattcctactcgg

SEQ ID NO: 6194 - DNA, 25 bp, Homo sapien
cactattcctactcggtggtgaggg

SEQ ID NO: 6195 - DNA, 25 bp, Homo sapien
cgtggacatctacatcccaggtagg

SEQ ID NO: 6196 - DNA, 25 bp, Homo sapien
acatctacatcccaggtagggccgg

SEQ ID NO: 6197 - DNA, 25 bp, Homo sapien
caccgcccacgagggagctggagac

SEQ ID NO: 6198 - DNA, 25 bp, Homo sapien
cgcctcccatctgcttgcggacggc

SEQ ID NO: 6199 - DNA, 25 bp, Homo sapien
cctcccgcagagcacactgggaaaa

SEQ ID NO: 6200 - DNA, 25 bp, Homo sapien
acactgggaaaatgcccgcgctttc

SEQ ID NO: 6201 - DNA, 25 bp, Homo sapien
cattcgcgcgcagacgtctgcgggc

SEQ ID NO: 6202 - DNA, 25 bp, Homo sapien
aagttcgcgccacggcattcgcgcg

SEQ ID NO: 6203 - DNA, 25 bp, Homo sapien
gcgcctctgcagtcccaagttcgcg

SEQ ID NO: 6204 - DNA, 25 bp, Homo sapien
gggcaacacactcagatccgccagg

SEQ ID NO: 6205 - DNA, 25 bp, Homo sapien
tccctcgccctggatgagcgggtgt

SEQ ID NO: 6206 - DNA, 25 bp, Homo sapien
ctcaagtacagctacgtgcggcttg

SEQ ID NO: 6207 - DNA, 25 bp, Homo sapien
tctcgtgggccgagttcagccgctt

SEQ ID NO: 6208 - DNA, 25 bp, Homo sapien
acgctcatcgacgtgctcaagtaca

SEQ ID NO: 6209 - DNA, 25 bp, Homo sapien
ttcttcgtcaagagctccatgcacc

SEQ ID NO: 6210 - DNA, 25 bp, Homo sapien
ttcttcgacgcgtggtgccagcagc

SEQ ID NO: 6211 - DNA, 25 bp, Homo sapien
gccttcttctcgtgggccgagttca

SEQ ID NO: 6212 - DNA, 25 bp, Homo sapien
ctacgtgcggcttgtgtgcaaggac

SEQ ID NO: 6213 - DNA, 25 bp, Homo sapien
agttcagccgcttcttcgacgcgtg

SEQ ID NO: 6214 - DNA, 25 bp, Homo sapien
caagatctccaagcagttcgtggcc

SEQ ID NO: 6215 - DNA, 25 bp, Homo sapien
tgcacgtgctcgagggcctcttccg

SEQ ID NO: 6216 - DNA, 25 bp, Homo sapien
accgcctcgtggtgacggagtgcca

SEQ ID NO: 6217 - DNA, 25 bp, Homo sapien
gcccgctggagttcgcctactactt

SEQ ID NO: 6218 - DNA, 25 bp, Homo sapien
gcctgctgtcctactgcaagggccg

SEQ ID NO: 6219 - DNA, 25 bp, Homo sapien
tgtcctactgcaagggccgcgacca

SEQ ID NO: 6220 - DNA, 25 bp, Homo sapien
ttcatcatcgtcaagctgagcccgc

SEQ ID NO: 6221 - DNA, 25 bp, Homo sapien
gacggagtgccagctgacccactca

SEQ ID NO: 6222 - DNA, 25 bp, Homo sapien
cgcagttgcctgcagtgcgccagct

SEQ ID NO: 6223 - DNA, 25 bp, Homo sapien
gtgttcttcctgacgtcgcgcacca

SEQ ID NO: 6224 - DNA, 25 bp, Homo sapien
cttccctcgcatgctgctggtggac

SEQ ID NO: 6225 - DNA, 25 bp, Homo sapien
agacgctcttcagcaaggcgcagga

SEQ ID NO: 6226 - DNA, 25 bp, Homo sapien
gccttcgtggactacttcgagcgca

SEQ ID NO: 6227 - DNA, 25 bp, Homo sapien
ctacttcgagcgcaactgggagccc

SEQ ID NO: 6228 - DNA, 25 bp, Homo sapien
ccagagacctggacgcgtgtgccct

SEQ ID NO: 6229 - DNA, 25 bp, Homo sapien
agtgccttcgcgacctggtggccat

SEQ ID NO: 6230 - DNA, 25 bp, Homo sapien
gtccaagtccctttgctgagtgtga

SEQ ID NO: 6231 - DNA, 25 bp, Homo sapien
ggcccgcttggatctccttgtccaa

SEQ ID NO: 6232 - DNA, 25 bp, Homo sapien
ttacccgctgagcattgtggggccc

SEQ ID NO: 6233 - DNA, 25 bp, Homo sapien
ggtctccatggttacgagccgctca

SEQ ID NO: 6234 - DNA, 25 bp, Homo sapien
tgcgcagtagaacccgcgggcccag

SEQ ID NO: 6235 - DNA, 25 bp, Homo sapien
agcgctttcgcgtccaagtcccttt

SEQ ID NO: 6236 - DNA, 25 bp, Homo sapien
cgggaaacctgcttcggtctccatg

SEQ ID NO: 6237 - DNA, 25 bp, Homo sapien
gggcccagagctccatctgagcatg

SEQ ID NO: 6238 - DNA, 25 bp, Homo sapien
tgctgtctgcaaaagcctcattgtc

SEQ ID NO: 6239 - DNA, 25 bp, Homo sapien
cagagacatctggaagccggagcta

SEQ ID NO: 6240 - DNA, 25 bp, Homo sapien
aggcacgaatgacccacgtgttcag

SEQ ID NO: 6241 - DNA, 25 bp, Homo sapien
gctgcgccaccgacagagacatctg

SEQ ID NO: 6242 - DNA, 25 bp, Homo sapien
cccagggacttgagagttgctgtct

SEQ ID NO: 6243 - DNA, 25 bp, Homo sapien
tgtgcctgagtgtccgtactaaggg

SEQ ID NO: 6244 - DNA, 25 bp, Homo sapien
ctagtggaagagtaagtgtgcctga

SEQ ID NO: 6245 - DNA, 25 bp, Homo sapien
cataccgtgctgcagcgttgcgaaa

SEQ ID NO: 6246 - DNA, 25 bp, Homo sapien
tctagtacgagtaaagcggatcctc

SEQ ID NO: 6247 - DNA, 25 bp, Homo sapien
ccgaccagaaggaaatcgccgtctt

SEQ ID NO: 6248 - DNA, 25 bp, Homo sapien
gcattcgaggtcagagtttctagta

SEQ ID NO: 6249 - DNA, 25 bp, Homo sapien
tctgcttctggaactgcattcgagg

SEQ ID NO: 6250 - DNA, 25 bp, Homo sapien
cttaggagaaccacttcccttcttg

SEQ ID NO: 6251 - DNA, 25 bp, Homo sapien
aggcatttagtgagcgccgtggact

SEQ ID NO: 6252 - DNA, 25 bp, Homo sapien
agggttcgtgtgtgtcctcacctct

SEQ ID NO: 6253 - DNA, 25 bp, Homo sapien
tcgccgtcttggaagatctaagtcc

SEQ ID NO: 6254 - DNA, 25 bp, Homo sapien
tctccaaggagcatattccaacgtc

SEQ ID NO: 6255 - DNA, 25 bp, Homo sapien
gcaagttctgaattgtctccaagga

SEQ ID NO: 6256 - DNA, 25 bp, Homo sapien
aagcaacgctttgcgggcagcgccc

SEQ ID NO: 6257 - DNA, 25 bp, Homo sapien
caacggatgcgcctgtccaggatca

SEQ ID NO: 6258 - DNA, 25 bp, Homo sapien
ggatcaccacctgtcaagctcgctg

SEQ ID NO: 6259 - DNA, 25 bp, Homo sapien
ggagcccacacctctgcacggtgaa

SEQ ID NO: 6260 - DNA, 25 bp, Homo sapien
aggtgaacgtgactcccacacacgc

SEQ ID NO: 6261 - DNA, 25 bp, Homo sapien
tggctgcgagcagttccggccaaaa

SEQ ID NO: 6262 - DNA, 25 bp, Homo sapien
acggtctctgctagtcttgtggctc

SEQ ID NO: 6263 - DNA, 25 bp, Homo sapien
ccacgtatccagtggagcccaggta

SEQ ID NO: 6264 - DNA, 25 bp, Homo sapien
cgtgatgtggctgggcaaatgccca

SEQ ID NO: 6265 - DNA, 25 bp, Homo sapien
gtggccaagagagccacggtctctg

SEQ ID NO: 6266 - DNA, 25 bp, Homo sapien
ggcctccgctcgaatcagacgctgt

SEQ ID NO: 6267 - DNA, 25 bp, Homo sapien
ctagtcttgtggctcaaaatggacc

SEQ ID NO: 6268 - DNA, 25 bp, Homo sapien
aggtccacgctcagggtgccgtcca

SEQ ID NO: 6269 - DNA, 25 bp, Homo sapien
ctgaggccgccaaaagtgacgtggc

SEQ ID NO: 6270 - DNA, 25 bp, Homo sapien
tgaggtctcactagtaccgcgggcc

SEQ ID NO: 6271 - DNA, 25 bp, Homo sapien
gttgaaagagcctgcggtgacctgt

SEQ ID NO: 6272 - DNA, 25 bp, Homo sapien
ggtgacctgtatggaagccctcgaa

SEQ ID NO: 6273 - DNA, 25 bp, Homo sapien
cgaagccaggccgaggtcctacaag

SEQ ID NO: 6274 - DNA, 25 bp, Homo sapien
tcttaagctgactgtgaccacgtta

SEQ ID NO: 6275 - DNA, 25 bp, Homo sapien
acagcctcagcggttcactacgcaa

SEQ ID NO: 6276 - DNA, 25 bp, Homo sapien
ctgcgtacgctcagctcagctcata

SEQ ID NO: 6277 - DNA, 25 bp, Homo sapien
cggacaccagtacaggacggggctt

SEQ ID NO: 6278 - DNA, 25 bp, Homo sapien
tcgccctggtcagcggcatcatcta

SEQ ID NO: 6279 - DNA, 25 bp, Homo sapien
ggcatcatctacatccacctacgga

SEQ ID NO: 6280 - DNA, 25 bp, Homo sapien
ggcactgcatgacgtgtggttttca

SEQ ID NO: 6281 - DNA, 25 bp, Homo sapien
ttcggatactgcttcgccctggcct

SEQ ID NO: 6282 - DNA, 25 bp, Homo sapien
ctatgccattcacgccgaggagatc

SEQ ID NO: 6283 - DNA, 25 bp, Homo sapien
gtttactggcgccttgatctatgcc

SEQ ID NO: 6284 - DNA, 25 bp, Homo sapien
gtggttttcatcttccgcaggcgtg

SEQ ID NO: 6285 - DNA, 25 bp, Homo sapien
ccatgggatattgggaaatgtagtc

SEQ ID NO: 6286 - DNA, 25 bp, Homo sapien
ctgcagatctggtaccgcaggtagc

SEQ ID NO: 6287 - DNA, 25 bp, Homo sapien
gcccaaagtcccgagcgtggaaggc

SEQ ID NO: 6288 - DNA, 25 bp, Homo sapien
gggtggacatcgtggcccaaagtcc

SEQ ID NO: 6289 - DNA, 25 bp, Homo sapien
ccgctgctctgcgaagaccctgggg

SEQ ID NO: 6290 - DNA, 25 bp, Homo sapien
tgtcaataaacctgccctcgggctg

SEQ ID NO: 6291 - DNA, 25 bp, Homo sapien
cccagcctgcttgtgtcccgtgagg

SEQ ID NO: 6292 - DNA, 25 bp, Homo sapien
aagcgagactgaggcaaggtccctg

SEQ ID NO: 6293 - DNA, 25 bp, Homo sapien
gtgtcccgtgaggttgtcaataaac

SEQ ID NO: 6294 - DNA, 25 bp, Homo sapien
ccgagttgttggacgtactgcgata

SEQ ID NO: 6295 - DNA, 25 bp, Homo sapien
ctgcgatagtacagcatgtgcgcca

SEQ ID NO: 6296 - DNA, 25 bp, Homo sapien
ccaggaagctgtgagccagcagcgc

SEQ ID NO: 6297 - DNA, 25 bp, Homo sapien
acgtcctaccttcgggcgagccttg

SEQ ID NO: 6298 - DNA, 25 bp, Homo sapien
ccgaacatctgcaggcgggacagcg

SEQ ID NO: 6299 - DNA, 25 bp, Homo sapien
gtctcttcgcaaacccgtcaggttc

SEQ ID NO: 6300 - DNA, 25 bp, Homo sapien
gagcagctccgagttgttggacgta

SEQ ID NO: 6301 - DNA, 25 bp, Homo sapien
ccgtcaggttcacccgtgggaactg

SEQ ID NO: 6302 - DNA, 25 bp, Homo sapien
cgctcgcggtactgctgggcccagt

SEQ ID NO: 6303 - DNA, 25 bp, Homo sapien
cccattttggctgccagcgatgaga

SEQ ID NO: 6304 - DNA, 25 bp, Homo sapien
ccctggggttccacatcttgcgata

SEQ ID NO: 6305 - DNA, 25 bp, Homo sapien
ccttggagaagggaatgaagcgctc

SEQ ID NO: 6306 - DNA, 25 bp, Homo sapien
agcagctgctccttggagaagggaa

SEQ ID NO: 6307 - DNA, 25 bp, Homo sapien
tacctgtattaggaggcggagcagc

SEQ ID NO: 6308 - DNA, 25 bp, Homo sapien
ctgggacaggcggtacctgtattag

SEQ ID NO: 6309 - DNA, 25 bp, Homo sapien
gggttccacatcttgcgatactccc

SEQ ID NO: 6310 - DNA, 25 bp, Homo sapien
gtcaatgcgggctgtccatttctca

SEQ ID NO: 6311 - DNA, 25 bp, Homo sapien
gaggttcggcttcacccagcagtaa

SEQ ID NO: 6312 - DNA, 25 bp, Homo sapien
cgcatgcgcaaagcttcggtcaatg

SEQ ID NO: 6313 - DNA, 25 bp, Homo sapien
actacgcatgcgttgcctgcctttc

SEQ ID NO: 6314 - DNA, 25 bp, Homo sapien
ggagtgtctccttgtcagcttgcta

SEQ ID NO: 6315 - DNA, 25 bp, Homo sapien
tggacgcgagactccctagagggat

SEQ ID NO: 6316 - DNA, 25 bp, Homo sapien
ccggctcgtgtcagctcctgagtag

SEQ ID NO: 6317 - DNA, 25 bp, Homo sapien
ccaatcagctgtggaggagcgaaaa

SEQ ID NO: 6318 - DNA, 25 bp, Homo sapien
cgcacgagcgggacttccagatttt

SEQ ID NO: 6319 - DNA, 25 bp, Homo sapien
tctcaccggcgcacgagcgggactt

SEQ ID NO: 6320 - DNA, 25 bp, Homo sapien
tcccaggaatcggaagagattcatg

SEQ ID NO: 6321 - DNA, 25 bp, Homo sapien
gagaggtctcccaggaatcggaaga

SEQ ID NO: 6322 - DNA, 25 bp, Homo sapien
cgggacttccagattttgagcagta

SEQ ID NO: 6323 - DNA, 25 bp, Homo sapien
ctgctttgccgtggcggcgctaaac

SEQ ID NO: 6324 - DNA, 25 bp, Homo sapien
aagagggaccctaggtgcgctccgc

SEQ ID NO: 6325 - DNA, 25 bp, Homo sapien
tttgagcagtagcaagatgatggcg

SEQ ID NO: 6326 - DNA, 25 bp, Homo sapien
caggggtctctcgagcgtctgccat

SEQ ID NO: 6327 - DNA, 25 bp, Homo sapien
acggggactgaatgttaatcgcatc

SEQ ID NO: 6328 - DNA, 25 bp, Homo sapien
taatcgcatcccgagtgagtgtgtg

SEQ ID NO: 6329 - DNA, 25 bp, Homo sapien
agcgagtgtgtgagtccctcccgct

SEQ ID NO: 6330 - DNA, 25 bp, Homo sapien
ggcagacggggactgaatgttaatc

SEQ ID NO: 6331 - DNA, 25 bp, Homo sapien
cgtctgccatctgcccggtgaggat

SEQ ID NO: 6332 - DNA, 25 bp, Homo sapien
ctgcccggtgaggatctgtgtgtcc

SEQ ID NO: 6333 - DNA, 25 bp, Homo sapien
tgtgtgcgagaacacagcgagtgtg

SEQ ID NO: 6334 - DNA, 25 bp, Homo sapien
cgctcgtgttctcggggcccgcgta

SEQ ID NO: 6335 - DNA, 25 bp, Homo sapien
cccgtggcgctggtgctcaacggct

SEQ ID NO: 6336 - DNA, 25 bp, Homo sapien
gctggtgctcaacggctcggacccg

SEQ ID NO: 6337 - DNA, 25 bp, Homo sapien
agctctgcgacctgctgtcggggtt

SEQ ID NO: 6338 - DNA, 25 bp, Homo sapien
gcacggcgtggtcttcgaagacgac

SEQ ID NO: 6339 - DNA, 25 bp, Homo sapien
gtcttcgaagacgactcgcgcgcgc

SEQ ID NO: 6340 - DNA, 25 bp, Homo sapien
tcgcgcccatcctcgacttcctgtc

SEQ ID NO: 6341 - DNA, 25 bp, Homo sapien
ctcgctgcccatcgtggccgtgcac

SEQ ID NO: 6342 - DNA, 25 bp, Homo sapien
tacccgagaggaaataggcccggca

SEQ ID NO: 6343 - DNA, 25 bp, Homo sapien
agggatttaggcatctggactctgc

SEQ ID NO: 6344 - DNA, 25 bp, Homo sapien
aataggcccggcaggtgtttttgcg

SEQ ID NO: 6345 - DNA, 25 bp, Homo sapien
tgtgtttccggcaaaggatgttttc

SEQ ID NO: 6346 - DNA, 25 bp, Homo sapien
cctgggagcggctgtaaataatacc

SEQ ID NO: 6347 - DNA, 25 bp, Homo sapien
aaaggatgttttccgagaaggcctg

SEQ ID NO: 6348 - DNA, 25 bp, Homo sapien
ggcacgccgcgttcacgtgctgtcg

SEQ ID NO: 6349 - DNA, 25 bp, Homo sapien
cgtgcaggccgcagatgaggaaaca

SEQ ID NO: 6350 - DNA, 25 bp, Homo sapien
tggcctcactggatctggctacgtc

SEQ ID NO: 6351 - DNA, 25 bp, Homo sapien
gcgaggccgtgctcagtgcccagct

SEQ ID NO: 6352 - DNA, 25 bp, Homo sapien
cgtgattatggtttccttcctgagc

SEQ ID NO: 6353 - DNA, 25 bp, Homo sapien
ccaggccctgctgcgtgattatggt

SEQ ID NO: 6354 - DNA, 25 bp, Homo sapien
atctggctacgtctggttcatggtg

SEQ ID NO: 6355 - DNA, 25 bp, Homo sapien
cgagcccgtgttccgcgcagctgag

SEQ ID NO: 6356 - DNA, 25 bp, Homo sapien
cagctccgcagtgtcagcgcgcaga

SEQ ID NO: 6357 - DNA, 25 bp, Homo sapien
cctgccgggctgtttgcagtgcgct

SEQ ID NO: 6358 - DNA, 25 bp, Homo sapien
aagatcgatggcgtctggaacggca

SEQ ID NO: 6359 - DNA, 25 bp, Homo sapien
ggcaagcacggaaagaagatcgatg

SEQ ID NO: 6360 - DNA, 25 bp, Homo sapien
ccgcccggaaaagcgctgctgcaag

SEQ ID NO: 6361 - DNA, 25 bp, Homo sapien
ttctgaagcggctggcgcataccat

SEQ ID NO: 6362 - DNA, 25 bp, Homo sapien
tacctggtcaccaatggcaagcacg

SEQ ID NO: 6363 - DNA, 25 bp, Homo sapien
tggcgcataccatcggcttcagcta

SEQ ID NO: 6364 - DNA, 25 bp, Homo sapien
ggcttcagctacgacctctacctgg

SEQ ID NO: 6365 - DNA, 25 bp, Homo sapien
aagggtttctgcatcgacattctga

SEQ ID NO: 6366 - DNA, 25 bp, Homo sapien
tccgtgtcagtctgtccgcttgagc

SEQ ID NO: 6367 - DNA, 25 bp, Homo sapien
agaccggcatcagcgtcatggtggc

SEQ ID NO: 6368 - DNA, 25 bp, Homo sapien
ctccgagatcgtggacttctccgtc

SEQ ID NO: 6369 - DNA, 25 bp, Homo sapien
tcaccatcaacgaggagcgctccga

SEQ ID NO: 6370 - DNA, 25 bp, Homo sapien
ccaggtgttctaccagcgcgcagac

SEQ ID NO: 6371 - DNA, 25 bp, Homo sapien
gcgcgcagcaatggcacggtgtccc

SEQ ID NO: 6372 - DNA, 25 bp, Homo sapien
tctgctcgccgtccgtgtcagtctg

SEQ ID NO: 6373 - DNA, 25 bp, Homo sapien
agcgcgcagacatggccatcggctc

SEQ ID NO: 6374 - DNA, 25 bp, Homo sapien
cctcgagtccgaggtatgacgcggc

SEQ ID NO: 6375 - DNA, 25 bp, Homo sapien
gctcgctcgaggacctcagctcgtg

SEQ ID NO: 6376 - DNA, 25 bp, Homo sapien
atctcagctgctcgcacgatggcct

SEQ ID NO: 6377 - DNA, 25 bp, Homo sapien
actgtcggcactgcgccagcctgga

SEQ ID NO: 6378 - DNA, 25 bp, Homo sapien
ggccgctactggtcggtcgacaagc

SEQ ID NO: 6379 - DNA, 25 bp, Homo sapien
tcggcgcacttctctagcctcgagt

SEQ ID NO: 6380 - DNA, 25 bp, Homo sapien
gagccctggtggttcgccgacttcc

SEQ ID NO: 6381 - DNA, 25 bp, Homo sapien
actctgccgcttggccttcgaggac

SEQ ID NO: 6382 - DNA, 25 bp, Homo sapien
acaggcttgagaaccccgagatcgc

SEQ ID NO: 6383 - DNA, 25 bp, Homo sapien
gggctcccacacaggcttgagaacc

SEQ ID NO: 6384 - DNA, 25 bp, Homo sapien
agtgggtacgtgtcgtacaggatcc

SEQ ID NO: 6385 - DNA, 25 bp, Homo sapien
aacagaagcccacgcggtcagggcc

SEQ ID NO: 6386 - DNA, 25 bp, Homo sapien
cggagaacagaagcccacgcggtca

SEQ ID NO: 6387 - DNA, 25 bp, Homo sapien
tccctgcacggagaacagaagccca

SEQ ID NO: 6388 - DNA, 25 bp, Homo sapien
acaggatccctgcacggagaacaga

SEQ ID NO: 6389 - DNA, 25 bp, Homo sapien
gtacgtgtcgtacaggatccctgca

SEQ ID NO: 6390 - DNA, 25 bp, Homo sapien
tccgattagcggtcccaggagtttc

SEQ ID NO: 6391 - DNA, 25 bp, Homo sapien
gagtttccaaggtaaccgcgcagta

SEQ ID NO: 6392 - DNA, 25 bp, Homo sapien
tctcattaggcggaaagcgaaaccc

SEQ ID NO: 6393 - DNA, 25 bp, Homo sapien
ttcgctggcgccattacctgagttc

SEQ ID NO: 6394 - DNA, 25 bp, Homo sapien
tctccgtatccgcaggcttctttcg

SEQ ID NO: 6395 - DNA, 25 bp, Homo sapien
cgcgaagatgcagtttctccgtatc

SEQ ID NO: 6396 - DNA, 25 bp, Homo sapien
ggaggcctatgtgctctaccaccga

SEQ ID NO: 6397 - DNA, 25 bp, Homo sapien
ccgagtccggcgacacaagttccga

SEQ ID NO: 6398 - DNA, 25 bp, Homo sapien
gtgcagaccaccagatcacacagtg

SEQ ID NO: 6399 - DNA, 25 bp, Homo sapien
tcttccgcaccatcagcgtctgagg

SEQ ID NO: 6400 - DNA, 25 bp, Homo sapien
cgctgtcaggcttcaccatcttccg

SEQ ID NO: 6401 - DNA, 25 bp, Homo sapien
cagtgcccagggctcctggtcagca

SEQ ID NO: 6402 - DNA, 25 bp, Homo sapien
aaggagctgcactggcacccgcagt

SEQ ID NO: 6403 - DNA, 25 bp, Homo sapien
ccaccagatcacacagtgggacctg

SEQ ID NO: 6404 - DNA, 25 bp, Homo sapien
tctttgcagcctcgggtgcagacca

SEQ ID NO: 6405 - DNA, 25 bp, Homo sapien
agctgctgttcgtgcaccagggcga

SEQ ID NO: 6406 - DNA, 25 bp, Homo sapien
ggccttctggctcattgcctcgctg

SEQ ID NO: 6407 - DNA, 25 bp, Homo sapien
tcaccacatgcgtggacgtgcgctg

SEQ ID NO: 6408 - DNA, 25 bp, Homo sapien
ccgcggtcgcttcgtcaagaaagac

SEQ ID NO: 6409 - DNA, 25 bp, Homo sapien
cgggcactgcaacgtgcgtttcgta

SEQ ID NO: 6410 - DNA, 25 bp, Homo sapien
tgcgtttcgtaaacctgggtggcca

SEQ ID NO: 6411 - DNA, 25 bp, Homo sapien
acctgagcgacctgttcaccacatg

SEQ ID NO: 6412 - DNA, 25 bp, Homo sapien
tggtcttcagcgagaacgccgtcgt

SEQ ID NO: 6413 - DNA, 25 bp, Homo sapien
aagcgcaacgagacgctggtcttca

SEQ ID NO: 6414 - DNA, 25 bp, Homo sapien
agtcgtagacttgtcgcgccgcttt

SEQ ID NO: 6415 - DNA, 25 bp, Homo sapien
tccaggccattgtttgggctgagcc

SEQ ID NO: 6416 - DNA, 25 bp, Homo sapien
agactccaagtgtccagggcctttg

SEQ ID NO: 6417 - DNA, 25 bp, Homo sapien
ttctcattggagagcaagcctgtca

SEQ ID NO: 6418 - DNA, 25 bp, Homo sapien
ggccgtctacctctggccggacata

SEQ ID NO: 6419 - DNA, 25 bp, Homo sapien
caccggctttttgtacgactgttgg

SEQ ID NO: 6420 - DNA, 25 bp, Homo sapien
ttggccctggagaacgatcctttgg

SEQ ID NO: 6421 - DNA, 25 bp, Homo sapien
ggaagagtcttttcagcgctgagga

SEQ ID NO: 6422 - DNA, 25 bp, Homo sapien
gtcagatcccgtacttttgtggagg

SEQ ID NO: 6423 - DNA, 25 bp, Homo sapien
cgcttttgagctctccgatgggatg

SEQ ID NO: 6424 - DNA, 25 bp, Homo sapien
cgcttcggaatttcgggctttgatc

SEQ ID NO: 6425 - DNA, 25 bp, Homo sapien
gcgtcgcagtttcccgagactccgt

SEQ ID NO: 6426 - DNA, 25 bp, Homo sapien
gcccgctgtgttcgcttttgagctc

SEQ ID NO: 6427 - DNA, 25 bp, Homo sapien
tctctttcccacaggtgccagggaa

SEQ ID NO: 6428 - DNA, 25 bp, Homo sapien
acggagtcatcgacccaagaaggtc

SEQ ID NO: 6429 - DNA, 25 bp, Homo sapien
tacagttatcggcaggctgtgcggc

SEQ ID NO: 6430 - DNA, 25 bp, Homo sapien
agggccaccggtttactgcacagct

SEQ ID NO: 6431 - DNA, 25 bp, Homo sapien
gagaagagtccttgtccgcccttgc

SEQ ID NO: 6432 - DNA, 25 bp, Homo sapien
gacgccggagagtcactgcaactta

SEQ ID NO: 6433 - DNA, 25 bp, Homo sapien
gatctttgctcctcccgcggattcg

SEQ ID NO: 6434 - DNA, 25 bp, Homo sapien
cggccgcgcatcaaggatctttgct

SEQ ID NO: 6435 - DNA, 25 bp, Homo sapien
ataccaatcgcgtgggtcccgtcct

SEQ ID NO: 6436 - DNA, 25 bp, Homo sapien
cacgcggcgtctatgaagcgcaaca

SEQ ID NO: 6437 - DNA, 25 bp, Homo sapien
ccgcccttgctgacgagaagactga

SEQ ID NO: 6438 - DNA, 25 bp, Homo sapien
ggacttctcagggtcgcactcgctc

SEQ ID NO: 6439 - DNA, 25 bp, Homo sapien
ggccaaggttgggcgatgcaaaccc

SEQ ID NO: 6440 - DNA, 25 bp, Homo sapien
gcctccgccactgtgcgggagtttc

SEQ ID NO: 6441 - DNA, 25 bp, Homo sapien
gggagtttccgcttctctgagcatc

SEQ ID NO: 6442 - DNA, 25 bp, Homo sapien
tccgcttctctgagcatccgatgtc

SEQ ID NO: 6443 - DNA, 25 bp, Homo sapien
tccgatgtcccatctgccatgcggg

SEQ ID NO: 6444 - DNA, 25 bp, Homo sapien
ctcacctcgcgaaatacgcacaggc

SEQ ID NO: 6445 - DNA, 25 bp, Homo sapien
aggatgggacttctcagggtcgcac

SEQ ID NO: 6446 - DNA, 25 bp, Homo sapien
ccggctctaggctcctgctccctcc

SEQ ID NO: 6447 - DNA, 25 bp, Homo sapien
cccgtggaaggagaccatcttgcgc

SEQ ID NO: 6448 - DNA, 25 bp, Homo sapien
tcgaagaggtagacggtcacgtccc

SEQ ID NO: 6449 - DNA, 25 bp, Homo sapien
ggttccgcacctggtcgaagaggta

SEQ ID NO: 6450 - DNA, 25 bp, Homo sapien
gcccttcccggctctaggctcctgc

SEQ ID NO: 6451 - DNA, 25 bp, Homo sapien
gtggaaggagaccatcttgcgcttc

SEQ ID NO: 6452 - DNA, 25 bp, Homo sapien
aggagaccatcttgcgcttcctctc

SEQ ID NO: 6453 - DNA, 25 bp, Homo sapien
tccgcacctggtcgaagaggtagac

SEQ ID NO: 6454 - DNA, 25 bp, Homo sapien
gttgtctacccatccggcctttgcg

SEQ ID NO: 6455 - DNA, 25 bp, Homo sapien
ctgcggcctcgtgttgtctacccat

SEQ ID NO: 6456 - DNA, 25 bp, Homo sapien
gtctccgctgagtgccgtgtctccg

SEQ ID NO: 6457 - DNA, 25 bp, Homo sapien
gtcgtggcatctcggggcccttcct

SEQ ID NO: 6458 - DNA, 25 bp, Homo sapien
gtccaagaatagtcgtggcatctcg

SEQ ID NO: 6459 - DNA, 25 bp, Homo sapien
ggtcccaagtccaagaatagtcgtg

SEQ ID NO: 6460 - DNA, 25 bp, Homo sapien
ctcacctttgatctgctcgctgttc

SEQ ID NO: 6461 - DNA, 25 bp, Homo sapien
gacccgacatgtttacccacactca

SEQ ID NO: 6462 - DNA, 25 bp, Homo sapien
aggaagctgcctgacgctgaggact

SEQ ID NO: 6463 - DNA, 25 bp, Homo sapien
agccgctcagcaggaagctgcctga

SEQ ID NO: 6464 - DNA, 25 bp, Homo sapien
ggatgtagtactcgctgctcacgga

SEQ ID NO: 6465 - DNA, 25 bp, Homo sapien
cgtgctcctccaagcggatgtagta

SEQ ID NO: 6466 - DNA, 25 bp, Homo sapien
tggacagcgcctcgtagaaagggtt

SEQ ID NO: 6467 - DNA, 25 bp, Homo sapien
cccacaggcactcgaggttgaggcc

SEQ ID NO: 6468 - DNA, 25 bp, Homo sapien
tgcccgcagcgaggagtcgtcctcg

SEQ ID NO: 6469 - DNA, 25 bp, Homo sapien
gcttgggccacctccaaggctgctg

SEQ ID NO: 6470 - DNA, 25 bp, Homo sapien
tctggggtcaggtagtagtcctcct

SEQ ID NO: 6471 - DNA, 25 bp, Homo sapien
tgggccagcccgtagtctccgatgc

SEQ ID NO: 6472 - DNA, 25 bp, Homo sapien
tagtagtcctcctgagggaaccagg

SEQ ID NO: 6473 - DNA, 25 bp, Homo sapien
ggtccaccaccatgaaggtcccgtg

SEQ ID NO: 6474 - DNA, 25 bp, Homo sapien
gcgcagtgggatccacaggcgctct

SEQ ID NO: 6475 - DNA, 25 bp, Homo sapien
tctccgatgcgcacggtcaggtcag

SEQ ID NO: 6476 - DNA, 25 bp, Homo sapien
cctaccttgtagttgctgtgggcca

SEQ ID NO: 6477 - DNA, 25 bp, Homo sapien
tcaccagatgttgctctcgcggctc

SEQ ID NO: 6478 - DNA, 25 bp, Homo sapien
aggctcttaccgaccagtaagcaca

SEQ ID NO: 6479 - DNA, 25 bp, Homo sapien
gcacagacttcctgctgccggggcg

SEQ ID NO: 6480 - DNA, 25 bp, Homo sapien
ctcttaccgaccagtaagcacagca

SEQ ID NO: 6481 - DNA, 25 bp, Homo sapien
gtcgagcagcacgaagacccacctc

SEQ ID NO: 6482 - DNA, 25 bp, Homo sapien
cgaagacccacctccgctgcatggt

SEQ ID NO: 6483 - DNA, 25 bp, Homo sapien
cgtgcgggcgccacggggacctcgt

SEQ ID NO: 6484 - DNA, 25 bp, Homo sapien
ctgtgcgggtctccgagcggcgtga

SEQ ID NO: 6485 - DNA, 25 bp, Homo sapien
cccaaggctcttaccgaccagtaag

SEQ ID NO: 6486 - DNA, 25 bp, Homo sapien
ctggcaccgccggtaacgtgattaa

SEQ ID NO: 6487 - DNA, 25 bp, Homo sapien
gtaacgtgattaaggccggcgctcc

SEQ ID NO: 6488 - DNA, 25 bp, Homo sapien
cgcttggcagcgaaatgccagattg

SEQ ID NO: 6489 - DNA, 25 bp, Homo sapien
tttctctgaccagctcgagggctct

SEQ ID NO: 6490 - DNA, 25 bp, Homo sapien
tgtaggagttcttggccagagaatc

SEQ ID NO: 6491 - DNA, 25 bp, Homo sapien
ccgcgctatgggcacatttgtagga

SEQ ID NO: 6492 - DNA, 25 bp, Homo sapien
gcagttcccggctcagcatgcactg

SEQ ID NO: 6493 - DNA, 25 bp, Homo sapien
tgagcagccagcatcccagaggaac

SEQ ID NO: 6494 - DNA, 25 bp, Homo sapien
ggctggacggcgacccgacctcgat

SEQ ID NO: 6495 - DNA, 25 bp, Homo sapien
gacccgacctcgatcgcgcgccgcc

SEQ ID NO: 6496 - DNA, 25 bp, Homo sapien
ggctgcagttctcgccgggcgcgaa

SEQ ID NO: 6497 - DNA, 25 bp, Homo sapien
accggcttgcccaggatgcgcaggt

SEQ ID NO: 6498 - DNA, 25 bp, Homo sapien
ccagcgctccatcaccggcttgccc

SEQ ID NO: 6499 - DNA, 25 bp, Homo sapien
cgcgtgcatatagggggtctcccag

SEQ ID NO: 6500 - DNA, 25 bp, Homo sapien
ggtgcctaacgtgtgcgggccccac

SEQ ID NO: 6501 - DNA, 25 bp, Homo sapien
gcccggggacgcgaacctgcaggct

SEQ ID NO: 6502 - DNA, 25 bp, Homo sapien
ggacccgcgcgaccctggcctcctc

SEQ ID NO: 6503 - DNA, 25 bp, Homo sapien
gactgatggcccgacagactcaccg

SEQ ID NO: 6504 - DNA, 25 bp, Homo sapien
atggcccgacagactcaccggggtg

SEQ ID NO: 6505 - DNA, 25 bp, Homo sapien
agacggccgcaaggaggatgagggc

SEQ ID NO: 6506 - DNA, 25 bp, Homo sapien
ccggacagactgatggcccgacaga

SEQ ID NO: 6507 - DNA, 25 bp, Homo sapien
ggcaggcatcttgtcgaggatggca

SEQ ID NO: 6508 - DNA, 25 bp, Homo sapien
gccaccggacagactgatggcccga

SEQ ID NO: 6509 - DNA, 25 bp, Homo sapien
aagacgcgcaccaggtgacggggca

SEQ ID NO: 6510 - DNA, 25 bp, Homo sapien
aaactgaggcaggttcatcgcggga

SEQ ID NO: 6511 - DNA, 25 bp, Homo sapien
cagagcgcagccgtcctcatcgggg

SEQ ID NO: 6512 - DNA, 25 bp, Homo sapien
gccctcagggtgtctcattggagaa

SEQ ID NO: 6513 - DNA, 25 bp, Homo sapien
aagacgcagcctcagcaacactcgg

SEQ ID NO: 6514 - DNA, 25 bp, Homo sapien
cggggagtgagaaaagacgcaattc

SEQ ID NO: 6515 - DNA, 25 bp, Homo sapien
tccatcgtccgtgagcacctgcgag

SEQ ID NO: 6516 - DNA, 25 bp, Homo sapien
tttccaccaaaacgcgcagccgtgg

SEQ ID NO: 6517 - DNA, 25 bp, Homo sapien
gagaaaagacgcaattcgctgcccg

SEQ ID NO: 6518 - DNA, 25 bp, Homo sapien
gtccgccagcgttgggagtaattca

SEQ ID NO: 6519 - DNA, 25 bp, Homo sapien
cccagtcccagttaacagttgagtc

SEQ ID NO: 6520 - DNA, 25 bp, Homo sapien
atggtgtcctcttgccctttacaaa

SEQ ID NO: 6521 - DNA, 25 bp, Homo sapien
caaacgcttttagggctgtgccttc

SEQ ID NO: 6522 - DNA, 25 bp, Homo sapien
cccgccgtgttaatagagtttcaga

SEQ ID NO: 6523 - DNA, 25 bp, Homo sapien
gggccggatcgatagatgtcatcta

SEQ ID NO: 6524 - DNA, 25 bp, Homo sapien
tttgaagtcggtacctgcaagctgc

SEQ ID NO: 6525 - DNA, 25 bp, Homo sapien
tgcaggcgccagtaatagaatatcg

SEQ ID NO: 6526 - DNA, 25 bp, Homo sapien
gactcagcccagacaggaggcgtta

SEQ ID NO: 6527 - DNA, 25 bp, Homo sapien
ggccagagaagccacgccggccttt

SEQ ID NO: 6528 - DNA, 25 bp, Homo sapien
cattccctgcgtgctgggctacgga

SEQ ID NO: 6529 - DNA, 25 bp, Homo sapien
tccttgcattccctgcgtgctgggc

SEQ ID NO: 6530 - DNA, 25 bp, Homo sapien
cagcccagacaggaggcgttagcag

SEQ ID NO: 6531 - DNA, 25 bp, Homo sapien
ctgatctcgggagtccctggcgccg

SEQ ID NO: 6532 - DNA, 25 bp, Homo sapien
agcgagatccgggagggagactcag

SEQ ID NO: 6533 - DNA, 25 bp, Homo sapien
gctctgcggttccaggcgtttcctt

SEQ ID NO: 6534 - DNA, 25 bp, Homo sapien
caggccacctatgaccgagggtttc

SEQ ID NO: 6535 - DNA, 25 bp, Homo sapien
aatttcaccagtcagcagggtcacc

SEQ ID NO: 6536 - DNA, 25 bp, Homo sapien
cacctatgaccgagggtttctgggg

SEQ ID NO: 6537 - DNA, 25 bp, Homo sapien
tcactccacgtgaagctgggggtcg

SEQ ID NO: 6538 - DNA, 25 bp, Homo sapien
cgctgcaggccacctatgaccgagg

SEQ ID NO: 6539 - DNA, 25 bp, Homo sapien
gccgcgtacagcgtccggaactcaa

SEQ ID NO: 6540 - DNA, 25 bp, Homo sapien
aaggctgaaggcgtcaacaatttca

SEQ ID NO: 6541 - DNA, 25 bp, Homo sapien
ggcgtcaacaatttcaccagtcagc

SEQ ID NO: 6542 - DNA, 25 bp, Homo sapien
tgcctttccacgcagagtccactgg

SEQ ID NO: 6543 - DNA, 25 bp, Homo sapien
ttggccactgtccagtcttcagctg

SEQ ID NO: 6544 - DNA, 25 bp, Homo sapien
tgcccgcgtccacatcggtggtggt

SEQ ID NO: 6545 - DNA, 25 bp, Homo sapien
cgctggccctcggaatatagaaagc

SEQ ID NO: 6546 - DNA, 25 bp, Homo sapien
cgctgcacgcaggtctggaacgcct

SEQ ID NO: 6547 - DNA, 25 bp, Homo sapien
ttgctcaacagagcctccagtgcca

SEQ ID NO: 6548 - DNA, 25 bp, Homo sapien
tgggaccggagtccactccttccag

SEQ ID NO: 6549 - DNA, 25 bp, Homo sapien
cctgaacctcatccgcactgaggaa

SEQ ID NO: 6550 - DNA, 25 bp, Homo sapien
cctagcccaaaaccacggcggatgg

SEQ ID NO: 6551 - DNA, 25 bp, Homo sapien
acgccgcaaagcgagctcaccatga

SEQ ID NO: 6552 - DNA, 25 bp, Homo sapien
acttctctgtggtgagttggacgac

SEQ ID NO: 6553 - DNA, 25 bp, Homo sapien
gacgactgactagccgggcgataac

SEQ ID NO: 6554 - DNA, 25 bp, Homo sapien
cccaggccgtgttctcgatagcttt

SEQ ID NO: 6555 - DNA, 25 bp, Homo sapien
ctagtcggggcatctggaaatttcc

SEQ ID NO: 6556 - DNA, 25 bp, Homo sapien
ttcgggcgtttccttatcaggttca

SEQ ID NO: 6557 - DNA, 25 bp, Homo sapien
gatctcgcgctgcacttcgtaggcg

SEQ ID NO: 6558 - DNA, 25 bp, Homo sapien
attggctgagcggatgcacaccctc

SEQ ID NO: 6559 - DNA, 25 bp, Homo sapien
gcgccctcgtattggtgcggcccag

SEQ ID NO: 6560 - DNA, 25 bp, Homo sapien
caagctcgcgagctgactggctcca

SEQ ID NO: 6561 - DNA, 25 bp, Homo sapien
ctgcaccaagctcgcgagctgactg

SEQ ID NO: 6562 - DNA, 25 bp, Homo sapien
cacgatggcggccagtctcccgaag

SEQ ID NO: 6563 - DNA, 25 bp, Homo sapien
atggggccgcgacgtcgtctccgct

SEQ ID NO: 6564 - DNA, 25 bp, Homo sapien
ttggtgctgacttgcgggaccgcct

SEQ ID NO: 6565 - DNA, 25 bp, Homo sapien
acaacggcgctgtctatggggccgc

SEQ ID NO: 6566 - DNA, 25 bp, Homo sapien
cgtctcaggattgcgctcgctttca

SEQ ID NO: 6567 - DNA, 25 bp, Homo sapien
cggagtctattttacgcgtcgccca

SEQ ID NO: 6568 - DNA, 25 bp, Homo sapien
atcggtacactgctcactgggcctc

SEQ ID NO: 6569 - DNA, 25 bp, Homo sapien
cccgagggtagtgcctgatcaatga

SEQ ID NO: 6570 - DNA, 25 bp, Homo sapien
ggtgcctccatttagctggccaatc

SEQ ID NO: 6571 - DNA, 25 bp, Homo sapien
gccggcgctaggatttgcactaatg

SEQ ID NO: 6572 - DNA, 25 bp, Homo sapien
aggcagtcgcttcattcctctcaga

SEQ ID NO: 6573 - DNA, 25 bp, Homo sapien
ctggctctggggttctcaagattta

SEQ ID NO: 6574 - DNA, 25 bp, Homo sapien
agcgtgcgctcccacagcagtggcg

SEQ ID NO: 6575 - DNA, 25 bp, Homo sapien
aactggacacagaattcgaggccgc

SEQ ID NO: 6576 - DNA, 25 bp, Homo sapien
ccgagccgcacgaacccggccctgg

SEQ ID NO: 6577 - DNA, 25 bp, Homo sapien
gacacctctcgacaactggacacag

SEQ ID NO: 6578 - DNA, 25 bp, Homo sapien
gtccaggtctacgtactccacatcg

SEQ ID NO: 6579 - DNA, 25 bp, Homo sapien
ggtctacgtactccacatcgccgaa

SEQ ID NO: 6580 - DNA, 25 bp, Homo sapien
gcagccaggtcccacggtcccagcc

SEQ ID NO: 6581 - DNA, 25 bp, Homo sapien
acatcgccgaacggcagcgtgcgct

SEQ ID NO: 6582 - DNA, 25 bp, Homo sapien
gaggcgggacactgacctacatttg

SEQ ID NO: 6583 - DNA, 25 bp, Homo sapien
cgagcctggctcttgcaaaatctgc

SEQ ID NO: 6584 - DNA, 25 bp, Homo sapien
aacggaaggcgctttgcaatctgca

SEQ ID NO: 6585 - DNA, 25 bp, Homo sapien
ggcgtggccaaagcaaacttctttc

SEQ ID NO: 6586 - DNA, 25 bp, Homo sapien
cggctgcaaacacggaccaatcgtc

SEQ ID NO: 6587 - DNA, 25 bp, Homo sapien
agcgcgtgaagttgccttgcctttc

SEQ ID NO: 6588 - DNA, 25 bp, Homo sapien
tccttctacaaggtgggcgagcctg

SEQ ID NO: 6589 - DNA, 25 bp, Homo sapien
tgtccagatcaagcggtcggctctt

SEQ ID NO: 6590 - DNA, 25 bp, Homo sapien
cacgcacagacggagtacccctgga

SEQ ID NO: 6591 - DNA, 25 bp, Homo sapien
cccgaatgagaacctgagggagtct

SEQ ID NO: 6592 - DNA, 25 bp, Homo sapien
ccgttgccgcctgtagggcttcctg

SEQ ID NO: 6593 - DNA, 25 bp, Homo sapien
ttcccgactgcgcgtcctgagggac

SEQ ID NO: 6594 - DNA, 25 bp, Homo sapien
gcctccagacttcctggtcggggga

SEQ ID NO: 6595 - DNA, 25 bp, Homo sapien
cggcttcccgtcctgggggatcctg

SEQ ID NO: 6596 - DNA, 25 bp, Homo sapien
cgccgacgagatcgggtgaggacga

SEQ ID NO: 6597 - DNA, 25 bp, Homo sapien
gccatgaacaactcgggcgccgacg

SEQ ID NO: 6598 - DNA, 25 bp, Homo sapien
ttttgctaaaagttccgcacgcctg

SEQ ID NO: 6599 - DNA, 25 bp, Homo sapien
gcaagcatagtgtcgtcggggctct

SEQ ID NO: 6600 - DNA, 25 bp, Homo sapien
ctctctgcagtgcaccgtcgaggta

SEQ ID NO: 6601 - DNA, 25 bp, Homo sapien
gcccgctgcttgtaaacggccagca

SEQ ID NO: 6602 - DNA, 25 bp, Homo sapien
atctcacgtctagtgctccggcctg

SEQ ID NO: 6603 - DNA, 25 bp, Homo sapien
ctctgcgacgtctgattggctctct

SEQ ID NO: 6604 - DNA, 25 bp, Homo sapien
aattactttgttggtgctcgaggca

SEQ ID NO: 6605 - DNA, 25 bp, Homo sapien
gtcgaggtagaaggctcagctccta

SEQ ID NO: 6606 - DNA, 25 bp, Homo sapien
agctctaagctcagcccgctccctg

SEQ ID NO: 6607 - DNA, 25 bp, Homo sapien
gtgcgcgcacagtgctgaccacgga

SEQ ID NO: 6608 - DNA, 25 bp, Homo sapien
acaccgtttcaggggcgagtgacgc

SEQ ID NO: 6609 - DNA, 25 bp, Homo sapien
ccatggcaccgtggggcaagcggct

SEQ ID NO: 6610 - DNA, 25 bp, Homo sapien
ctgcttgacatctcgggcgtgctgt

SEQ ID NO: 6611 - DNA, 25 bp, Homo sapien
acatctcgggcgtgctgtacgacag

SEQ ID NO: 6612 - DNA, 25 bp, Homo sapien
tggggccgccgagctctaagctcag

SEQ ID NO: 6613 - DNA, 25 bp, Homo sapien
gcgcacagtgctgaccacggacgac

SEQ ID NO: 6614 - DNA, 25 bp, Homo sapien
tggccatgacactggcagcggcctc

SEQ ID NO: 6615 - DNA, 25 bp, Homo sapien
gcagcgtggccatgacactggcagc

SEQ ID NO: 6616 - DNA, 25 bp, Homo sapien
acagcgggcagcgtggccatgacac

SEQ ID NO: 6617 - DNA, 25 bp, Homo sapien
ccgggccagtggtatggtggcggca

SEQ ID NO: 6618 - DNA, 25 bp, Homo sapien
cggcagctctcgcaccccgggccag

SEQ ID NO: 6619 - DNA, 25 bp, Homo sapien
cagtctcgatgggacgggcggcagc

SEQ ID NO: 6620 - DNA, 25 bp, Homo sapien
gccagggccagtctcgatgggacgg

SEQ ID NO: 6621 - DNA, 25 bp, Homo sapien
cgcaggactcacgtaggcaagggtg

SEQ ID NO: 6622 - DNA, 25 bp, Homo sapien
gggctcacctgccaaggacttcgca

SEQ ID NO: 6623 - DNA, 25 bp, Homo sapien
gctggcaatggcctccagggctcac

SEQ ID NO: 6624 - DNA, 25 bp, Homo sapien
acgtggtgttcgctggcaatggcct

SEQ ID NO: 6625 - DNA, 25 bp, Homo sapien
gtgccgggagagcatcaacagctcc

SEQ ID NO: 6626 - DNA, 25 bp, Homo sapien
aggacttcgcactgctcacacagtg

SEQ ID NO: 6627 - DNA, 25 bp, Homo sapien
caacagctcccttggggacgtggtg

SEQ ID NO: 6628 - DNA, 25 bp, Homo sapien
gcctcccggtctttgtggtcaccag

SEQ ID NO: 6629 - DNA, 25 bp, Homo sapien
tggtcaccagcgatgacatggcctg

SEQ ID NO: 6630 - DNA, 25 bp, Homo sapien
gggtgcgactgagccggatgtgctg

SEQ ID NO: 6631 - DNA, 25 bp, Homo sapien
acagctggtgacaaagccggagggg

SEQ ID NO: 6632 - DNA, 25 bp, Homo sapien
aggtgcaggaagacagcgagctcga

SEQ ID NO: 6633 - DNA, 25 bp, Homo sapien
aagacagcgagctcgaggcagtggg

SEQ ID NO: 6634 - DNA, 25 bp, Homo sapien
tgagcggagagctgggttatttcac

SEQ ID NO: 6635 - DNA, 25 bp, Homo sapien
tgggttatttcacgggaacagctgg

SEQ ID NO: 6636 - DNA, 25 bp, Homo sapien
ggttatttcacgggaacagctggtg

SEQ ID NO: 6637 - DNA, 25 bp, Homo sapien
agagctgggttatttcacgggaaca

SEQ ID NO: 6638 - DNA, 25 bp, Homo sapien
cgggcacctttgtaggggtccatgt

SEQ ID NO: 6639 - DNA, 25 bp, Homo sapien
cacatcccgggggagtacgtccgct

SEQ ID NO: 6640 - DNA, 25 bp, Homo sapien
gggagtacgtccgcttcaccggcta

SEQ ID NO: 6641 - DNA, 25 bp, Homo sapien
ccgggcacctttgtaggggtccatg

SEQ ID NO: 6642 - DNA, 25 bp, Homo sapien
ggcacctttgtaggggtccatgttc

SEQ ID NO: 6643 - DNA, 25 bp, Homo sapien
gcacctttgtaggggtccatgttcg

SEQ ID NO: 6644 - DNA, 25 bp, Homo sapien
cctttgtaggggtccatgttcgccg

SEQ ID NO: 6645 - DNA, 25 bp, Homo sapien
ggcctgcaggtgaacgggagccggc

SEQ ID NO: 6646 - DNA, 25 bp, Homo sapien
cgccaggagatcctccaggagttca

SEQ ID NO: 6647 - DNA, 25 bp, Homo sapien
gtacgccctggccaagatgaacggg

SEQ ID NO: 6648 - DNA, 25 bp, Homo sapien
tcccggcccagatgcacagcaccct

SEQ ID NO: 6649 - DNA, 25 bp, Homo sapien
accacctgaacgactggatggagga

SEQ ID NO: 6650 - DNA, 25 bp, Homo sapien
cctggcagaactaccacctgaacga

SEQ ID NO: 6651 - DNA, 25 bp, Homo sapien
tcagaatcaccctgccggtgctgca

SEQ ID NO: 6652 - DNA, 25 bp, Homo sapien
catcttcagaatcaccctgccggtg

SEQ ID NO: 6653 - DNA, 25 bp, Homo sapien
gcccagaagttcctgcggggcctgc

SEQ ID NO: 6654 - DNA, 25 bp, Homo sapien
agctgctgccggagctctgagacct

SEQ ID NO: 6655 - DNA, 25 bp, Homo sapien
gcgctccaggagcatagacttggtc

SEQ ID NO: 6656 - DNA, 25 bp, Homo sapien
ctcttcattggtccgcaagctcata

SEQ ID NO: 6657 - DNA, 25 bp, Homo sapien
tcattggctagttttttcgacaccc

SEQ ID NO: 6658 - DNA, 25 bp, Homo sapien
gccttcaaggcttcctaccgctggt

SEQ ID NO: 6659 - DNA, 25 bp, Homo sapien
ttcattggctcctcttctctaaaga

SEQ ID NO: 6660 - DNA, 25 bp, Homo sapien
agggcgagcgcccataagccatgcc

SEQ ID NO: 6661 - DNA, 25 bp, Homo sapien
tgggcttgacctagagcagccaaga

SEQ ID NO: 6662 - DNA, 25 bp, Homo sapien
caggtggtcgtgtcctggccctacc

SEQ ID NO: 6663 - DNA, 25 bp, Homo sapien
agcacccgctgggagggcctgtgcg

SEQ ID NO: 6664 - DNA, 25 bp, Homo sapien
tgagagcggggacgtcagggttccc

SEQ ID NO: 6665 - DNA, 25 bp, Homo sapien
gcaggtggtcgtgtcctggccctac

SEQ ID NO: 6666 - DNA, 25 bp, Homo sapien
tggtcgtgtcctggccctaccggca

SEQ ID NO: 6667 - DNA, 25 bp, Homo sapien
gtgtcctggccctaccggcaggtgc

SEQ ID NO: 6668 - DNA, 25 bp, Homo sapien
gtcctggccctaccggcaggtgcca

SEQ ID NO: 6669 - DNA, 25 bp, Homo sapien
ggaacggtggcaggcggactgacag

SEQ ID NO: 6670 - DNA, 25 bp, Homo sapien
gccgataccacggatacctttattg

SEQ ID NO: 6671 - DNA, 25 bp, Homo sapien
tgacatttcaaggttcgcgcgctcg

SEQ ID NO: 6672 - DNA, 25 bp, Homo sapien
ttcacggtgcaaggcatcgtccgtc

SEQ ID NO: 6673 - DNA, 25 bp, Homo sapien
agctcctgctgctcaagatcccaga

SEQ ID NO: 6674 - DNA, 25 bp, Homo sapien
ctcctgtccgtagaagcccgtgaca

SEQ ID NO: 6675 - DNA, 25 bp, Homo sapien
ctcccagaaagctttgcgctcaggc

SEQ ID NO: 6676 - DNA, 25 bp, Homo sapien
cgcgctcgtttggtattggttctca

SEQ ID NO: 6677 - DNA, 25 bp, Homo sapien
catggcgataattggctggcagctc

SEQ ID NO: 6678 - DNA, 25 bp, Homo sapien
aggtcgcccgggtgcagctcagcct

SEQ ID NO: 6679 - DNA, 25 bp, Homo sapien
caggaggcacccgttgtgcgtgact

SEQ ID NO: 6680 - DNA, 25 bp, Homo sapien
agctccagctcacgggcggaatgct

SEQ ID NO: 6681 - DNA, 25 bp, Homo sapien
gcggaatgctgcacgcacagcgcca

SEQ ID NO: 6682 - DNA, 25 bp, Homo sapien
aagcgcaggactggctcacggccgt

SEQ ID NO: 6683 - DNA, 25 bp, Homo sapien
cgcacaggcgacaggagaaggccca

SEQ ID NO: 6684 - DNA, 25 bp, Homo sapien
cgggggtccttgtacatgaacagga

SEQ ID NO: 6685 - DNA, 25 bp, Homo sapien
tgtccacatagggagccggggaccc

SEQ ID NO: 6686 - DNA, 25 bp, Homo sapien
tttctgagcgctccttgcctccaga

SEQ ID NO: 6687 - DNA, 25 bp, Homo sapien
gccatgctaagtgcctgctgtctcc

SEQ ID NO: 6688 - DNA, 25 bp, Homo sapien
tgaaggctaagctccgacacgctgc

SEQ ID NO: 6689 - DNA, 25 bp, Homo sapien
acgctgcgccgcaaagacaagtttt

SEQ ID NO: 6690 - DNA, 25 bp, Homo sapien
agacaagttttctgagcgctccttg

SEQ ID NO: 6691 - DNA, 25 bp, Homo sapien
gtctgcagttccgatttgggcgtcg

SEQ ID NO: 6692 - DNA, 25 bp, Homo sapien
cactgagtcaactgatcgaagtccc

SEQ ID NO: 6693 - DNA, 25 bp, Homo sapien
cctggatgaggcactgagtcaactg

SEQ ID NO: 6694 - DNA, 25 bp, Homo sapien
atgaaaccatccctacagtcacggc

SEQ ID NO: 6695 - DNA, 25 bp, Homo sapien
gcgcacactcatgaaaccatcccga

SEQ ID NO: 6696 - DNA, 25 bp, Homo sapien
tcatgaaaccatccctacagtcacg

SEQ ID NO: 6697 - DNA, 25 bp, Homo sapien
tcatgaaaccatcccgaccgtcacg

SEQ ID NO: 6698 - DNA, 25 bp, Homo sapien
tgaaaccatccctacagtcacggcg

SEQ ID NO: 6699 - DNA, 25 bp, Homo sapien
atcccgaccgtcacggcagcgagca

SEQ ID NO: 6700 - DNA, 25 bp, Homo sapien
gaccgtcacggcagcgagcactcac

SEQ ID NO: 6701 - DNA, 25 bp, Homo sapien
atccctacagtcacggcggcgagca

SEQ ID NO: 6702 - DNA, 25 bp, Homo sapien
gtgaggtcggctctcgttcaggcct

SEQ ID NO: 6703 - DNA, 25 bp, Homo sapien
ctggccgccaggctggcagttcttc

SEQ ID NO: 6704 - DNA, 25 bp, Homo sapien
ggctctcgttcaggcctgcagggtc

SEQ ID NO: 6705 - DNA, 25 bp, Homo sapien
cgccaggctggcagttcttcgggct

SEQ ID NO: 6706 - DNA, 25 bp, Homo sapien
tgccgcagcccctctggttggaagg

SEQ ID NO: 6707 - DNA, 25 bp, Homo sapien
tgaatgagttcattatgtctcagcg

SEQ ID NO: 6708 - DNA, 25 bp, Homo sapien
gttcattatgtctcagcgcgccctg

SEQ ID NO: 6709 - DNA, 25 bp, Homo sapien
tcattatgtctcagcgcgccctggc

SEQ ID NO: 6710 - DNA, 25 bp, Homo sapien
tcgcacaaagcgaaggcgtccacgc

SEQ ID NO: 6711 - DNA, 25 bp, Homo sapien
agagacccaggacgacacgccaaga

SEQ ID NO: 6712 - DNA, 25 bp, Homo sapien
cgtgtccgacgaagaagacctggga

SEQ ID NO: 6713 - DNA, 25 bp, Homo sapien
tccggcgccgaagatcttgaggacc

SEQ ID NO: 6714 - DNA, 25 bp, Homo sapien
acgctcttgtagttggcgcccgatg

SEQ ID NO: 6715 - DNA, 25 bp, Homo sapien
gcctgctaggccgtagcgctctagc

SEQ ID NO: 6716 - DNA, 25 bp, Homo sapien
tagagtccaacacgcaccgtccagt

SEQ ID NO: 6717 - DNA, 25 bp, Homo sapien
gccgtggccagcacgctcttgtagt

SEQ ID NO: 6718 - DNA, 25 bp, Homo sapien
ggaaaggatctctcaagtccgcgta

SEQ ID NO: 6719 - DNA, 25 bp, Homo sapien
agcaaacgtcacatcgccctgggag

SEQ ID NO: 6720 - DNA, 25 bp, Homo sapien
tcccggagatggtggaagaaagtcc

SEQ ID NO: 6721 - DNA, 25 bp, Homo sapien
gcctcttcccgaaggtggtcgtgca

SEQ ID NO: 6722 - DNA, 25 bp, Homo sapien
ttccagcgctgaggcataacctgca

SEQ ID NO: 6723 - DNA, 25 bp, Homo sapien
cactccatgccgttgctggtgacca

SEQ ID NO: 6724 - DNA, 25 bp, Homo sapien
ctgggaggtgtcgatgttttcttta

SEQ ID NO: 6725 - DNA, 25 bp, Homo sapien
agggtgaactctctgcggatctgtt

SEQ ID NO: 6726 - DNA, 25 bp, Homo sapien
agacggagcgcccagttgcaatgct

SEQ ID NO: 6727 - DNA, 25 bp, Homo sapien
tgcgcgaaggcttcacccagggcag

SEQ ID NO: 6728 - DNA, 25 bp, Homo sapien
ccagggcaggctacctggcttctga

SEQ ID NO: 6729 - DNA, 25 bp, Homo sapien
cagcatcattgcgtggaccaggaga

SEQ ID NO: 6730 - DNA, 25 bp, Homo sapien
gagaacctgtttgccaggctgccgc

SEQ ID NO: 6731 - DNA, 25 bp, Homo sapien
cccagttgcaatgctggagccggga

SEQ ID NO: 6732 - DNA, 25 bp, Homo sapien
ccgacacctgggtgcttcgagcctg

SEQ ID NO: 6733 - DNA, 25 bp, Homo sapien
tgagcagccgcagcatcattgcgtg

SEQ ID NO: 6734 - DNA, 25 bp, Homo sapien
tccactcgtgggctctgattccgta

SEQ ID NO: 6735 - DNA, 25 bp, Homo sapien
tgattccgtactgcggaacaacgga

SEQ ID NO: 6736 - DNA, 25 bp, Homo sapien
cccgctggccttttatttcgtattg

SEQ ID NO: 6737 - DNA, 25 bp, Homo sapien
ttgcacttcaggtgagtcattggta

SEQ ID NO: 6738 - DNA, 25 bp, Homo sapien
ttcacaccgggaacatccactcgtg

SEQ ID NO: 6739 - DNA, 25 bp, Homo sapien
gctttgggagtgtcgcaaccacatg

SEQ ID NO: 6740 - DNA, 25 bp, Homo sapien
aaggtgtatccttgaccgcacgaca

SEQ ID NO: 6741 - DNA, 25 bp, Homo sapien
cacgacaaggagtaatgggcggacc

SEQ ID NO: 6742 - DNA, 25 bp, Homo sapien
cgaaagcacgcacgctggtccctgt

SEQ ID NO: 6743 - DNA, 25 bp, Homo sapien
cagagaatgacgaacaggagcgcgc

SEQ ID NO: 6744 - DNA, 25 bp, Homo sapien
cccactgggcagagaatgacgaaca

SEQ ID NO: 6745 - DNA, 25 bp, Homo sapien
cctccagggaagtaggcacccactg

SEQ ID NO: 6746 - DNA, 25 bp, Homo sapien
tcacggagcctccagggaagtaggc

SEQ ID NO: 6747 - DNA, 25 bp, Homo sapien
tacccacctaacttgtagttgccga

SEQ ID NO: 6748 - DNA, 25 bp, Homo sapien
ccagtgcgccagtcgttctggggat

SEQ ID NO: 6749 - DNA, 25 bp, Homo sapien
gtgctacttacccacctaacttgta

SEQ ID NO: 6750 - DNA, 25 bp, Homo sapien
cccagagcggctgcggccatgatcc

SEQ ID NO: 6751 - DNA, 25 bp, Homo sapien
gccatgatccgtgcggcgcgtaact

SEQ ID NO: 6752 - DNA, 25 bp, Homo sapien
tccgtgcggcgcgtaactgtgcccg

SEQ ID NO: 6753 - DNA, 25 bp, Homo sapien
gcgcggctccgaagagagacgttcc

SEQ ID NO: 6754 - DNA, 25 bp, Homo sapien
gctccgaagagagacgttccggcca

SEQ ID NO: 6755 - DNA, 25 bp, Homo sapien
ccgaagagagacgttccggccacgc

SEQ ID NO: 6756 - DNA, 25 bp, Homo sapien
cagctccagggcgtcggcagggagc

SEQ ID NO: 6757 - DNA, 25 bp, Homo sapien
gcgccgagtcggaccggctgcaggc

SEQ ID NO: 6758 - DNA, 25 bp, Homo sapien
cagggcgtcgccctgtttttctgcg

SEQ ID NO: 6759 - DNA, 25 bp, Homo sapien
gccacagccaatccgcagcagccct

SEQ ID NO: 6760 - DNA, 25 bp, Homo sapien
ggacccttccctcacagggcgtcgc

SEQ ID NO: 6761 - DNA, 25 bp, Homo sapien
ggcgtcgccctgtttttctgcgctc

SEQ ID NO: 6762 - DNA, 25 bp, Homo sapien
cgccctgtttttctgcgctccgccc

SEQ ID NO: 6763 - DNA, 25 bp, Homo sapien
ggccaatcagcggttggtgcacacg

SEQ ID NO: 6764 - DNA, 25 bp, Homo sapien
ccaatcagcggttggtgcacacgcc

SEQ ID NO: 6765 - DNA, 25 bp, Homo sapien
caatcagcggttggtgcacacgccc

SEQ ID NO: 6766 - DNA, 25 bp, Homo sapien
ggtacctccagaccacgtcctcgcg

SEQ ID NO: 6767 - DNA, 25 bp, Homo sapien
ccctcgtcttgtggcaggaccggag

SEQ ID NO: 6768 - DNA, 25 bp, Homo sapien
agagtgactcgcagaggccatgccc

SEQ ID NO: 6769 - DNA, 25 bp, Homo sapien
aagctggattgtagcagagtgactc

SEQ ID NO: 6770 - DNA, 25 bp, Homo sapien
ttttgggcggattagaagctggatt

SEQ ID NO: 6771 - DNA, 25 bp, Homo sapien
ctccgattggctgccgcttttgggc

SEQ ID NO: 6772 - DNA, 25 bp, Homo sapien
ccgaattagccaccgggggagatct

SEQ ID NO: 6773 - DNA, 25 bp, Homo sapien
gctgccgcttttgggcggattagaa

SEQ ID NO: 6774 - DNA, 25 bp, Homo sapien
gacctgtgatcgcttctggcagacc

SEQ ID NO: 6775 - DNA, 25 bp, Homo sapien
cgctcggaaactccgccgtgacgtt

SEQ ID NO: 6776 - DNA, 25 bp, Homo sapien
agatgaacgcgctggcctccctaac

SEQ ID NO: 6777 - DNA, 25 bp, Homo sapien
aggcagccggagatactctgagtta

SEQ ID NO: 6778 - DNA, 25 bp, Homo sapien
ttgttgatcttatgcaagacgctgc

SEQ ID NO: 6779 - DNA, 25 bp, Homo sapien
tatcggttcccatcccagttgttga

SEQ ID NO: 6780 - DNA, 25 bp, Homo sapien
aatctccgcgagaagtcctgtctta

SEQ ID NO: 6781 - DNA, 25 bp, Homo sapien
ccgtgacgttgcaaaagctggaatc

SEQ ID NO: 6782 - DNA, 25 bp, Homo sapien
cgcgctataacttccaggcacttcg

SEQ ID NO: 6783 - DNA, 25 bp, Homo sapien
agtcaccaagaacgcaccggaggtc

SEQ ID NO: 6784 - DNA, 25 bp, Homo sapien
gctacagagccagcgtggaccaatc

SEQ ID NO: 6785 - DNA, 25 bp, Homo sapien
ccgctggacgtggatgaaagctaca

SEQ ID NO: 6786 - DNA, 25 bp, Homo sapien
ctttcacgaaaatgcgagcggcttc

SEQ ID NO: 6787 - DNA, 25 bp, Homo sapien
cgtcaagaggctgggattccgagaa

SEQ ID NO: 6788 - DNA, 25 bp, Homo sapien
tctctcttttggcataggcgggaaa

SEQ ID NO: 6789 - DNA, 25 bp, Homo sapien
ccaggcacttcgtggggcgaaaata

SEQ ID NO: 6790 - DNA, 25 bp, Homo sapien
gccgctttgacagtttatgaggtga

SEQ ID NO: 6791 - DNA, 25 bp, Homo sapien
atgaggtggcctcagtcggcgtttc

SEQ ID NO: 6792 - DNA, 25 bp, Homo sapien
tgaggtgatgacgttgcagctatga

SEQ ID NO: 6793 - DNA, 25 bp, Homo sapien
tggaccctcactgggccgctttgac

SEQ ID NO: 6794 - DNA, 25 bp, Homo sapien
gggccagaatgaatggaccctcact

SEQ ID NO: 6795 - DNA, 25 bp, Homo sapien
caatcggcccagtgtggggcgcacc

SEQ ID NO: 6796 - DNA, 25 bp, Homo sapien
tccctgtgggcacaatcggcccagt

SEQ ID NO: 6797 - DNA, 25 bp, Homo sapien
cagctatgattgatgaggtggcctc

SEQ ID NO: 6798 - DNA, 25 bp, Homo sapien
gggttgcttctagatcctcccggtc

SEQ ID NO: 6799 - DNA, 25 bp, Homo sapien
ccagcacgtggccacatgtccttag

SEQ ID NO: 6800 - DNA, 25 bp, Homo sapien
gtacagagcacttcggggccagcac

SEQ ID NO: 6801 - DNA, 25 bp, Homo sapien
tggcgagtgtcgctgagtccacact

SEQ ID NO: 6802 - DNA, 25 bp, Homo sapien
cgcgggaatctgagggttgcttcta

SEQ ID NO: 6803 - DNA, 25 bp, Homo sapien
agctgttgggctttgaaagtgtccc

SEQ ID NO: 6804 - DNA, 25 bp, Homo sapien
catgtccttagctgttgggctttga

SEQ ID NO: 6805 - DNA, 25 bp, Homo sapien
tccacactggtgtacagagcacttc

SEQ ID NO: 6806 - DNA, 25 bp, Homo sapien
cccgcgtatccgacgagcctaaagt

SEQ ID NO: 6807 - DNA, 25 bp, Homo sapien
cgacgtcaaggtgtggttccctctg

SEQ ID NO: 6808 - DNA, 25 bp, Homo sapien
gttccctctgtaaggcggagctaaa

SEQ ID NO: 6809 - DNA, 25 bp, Homo sapien
cggagctaaacggtgcattcgccca

SEQ ID NO: 6810 - DNA, 25 bp, Homo sapien
ctaaatgaccgctctgccgactgga

SEQ ID NO: 6811 - DNA, 25 bp, Homo sapien
ggcatcgtgtctgtcggcctcatct

SEQ ID NO: 6812 - DNA, 25 bp, Homo sapien
gcggggcgtcaggtacttaattcgc

SEQ ID NO: 6813 - DNA, 25 bp, Homo sapien
ctgccgactggagccaacgagaatc

SEQ ID NO: 6814 - DNA, 25 bp, Homo sapien
atcgggagatgctcattggacagtc

SEQ ID NO: 6815 - DNA, 25 bp, Homo sapien
tggacagtcacgtgacgggaccaaa

SEQ ID NO: 6816 - DNA, 25 bp, Homo sapien
cggccacgtgaaggacgcacgttca

SEQ ID NO: 6817 - DNA, 25 bp, Homo sapien
gacgcacgttcagcggggctctcac

SEQ ID NO: 6818 - DNA, 25 bp, Homo sapien
gggctgtgcgatctccaagcactga

SEQ ID NO: 6819 - DNA, 25 bp, Homo sapien
tcggaccctcgagaaccaggggatc

SEQ ID NO: 6820 - DNA, 25 bp, Homo sapien
actgaggggcagaaactcccggatc

SEQ ID NO: 6821 - DNA, 25 bp, Homo sapien
ccactgctggcacttatcgggagat

SEQ ID NO: 6822 - DNA, 25 bp, Homo sapien
tagggcttctatttcgaccgcgatg

SEQ ID NO: 6823 - DNA, 25 bp, Homo sapien
tgagactcctatgtgctccggattg

SEQ ID NO: 6824 - DNA, 25 bp, Homo sapien
agggccggcgcaccataaaagaagc

SEQ ID NO: 6825 - DNA, 25 bp, Homo sapien
tggtcaatttgtacctgcaggcctc

SEQ ID NO: 6826 - DNA, 25 bp, Homo sapien
cgtgagccacttcttccgcgaattg

SEQ ID NO: 6827 - DNA, 25 bp, Homo sapien
ttccaggacatcaaggtaactagtg

SEQ ID NO: 6828 - DNA, 25 bp, Homo sapien
tgagccctcttaaccgctggaaata

SEQ ID NO: 6829 - DNA, 25 bp, Homo sapien
gggacctgccagcaccgtttttgtg

SEQ ID NO: 6830 - DNA, 25 bp, Homo sapien
acgctcctcgcccagggagctggtg

SEQ ID NO: 6831 - DNA, 25 bp, Homo sapien
tcctcgtcctcatcgtagcgctcgc

SEQ ID NO: 6832 - DNA, 25 bp, Homo sapien
cttagttacgctcctcgcccaggga

SEQ ID NO: 6833 - DNA, 25 bp, Homo sapien
gtgtccacagagttgcgcttgctgc

SEQ ID NO: 6834 - DNA, 25 bp, Homo sapien
cagagttgcgcttgctgccgctggt

SEQ ID NO: 6835 - DNA, 25 bp, Homo sapien
ccactctggtgcacggatgttgcgc

SEQ ID NO: 6836 - DNA, 25 bp, Homo sapien
tgcacggatgttgcgccggtccttg

SEQ ID NO: 6837 - DNA, 25 bp, Homo sapien
gggcggacttagttacgctcctcgc

SEQ ID NO: 6838 - DNA, 25 bp, Homo sapien
ttgcaagacgctcggcttcctattg

SEQ ID NO: 6839 - DNA, 25 bp, Homo sapien
ctcggcttcctattgcaagaccgca

SEQ ID NO: 6840 - DNA, 25 bp, Homo sapien
ccgaagcgttgggacctaggcagaa

SEQ ID NO: 6841 - DNA, 25 bp, Homo sapien
ggaggccgcagcgtcactgagccca

SEQ ID NO: 6842 - DNA, 25 bp, Homo sapien
gcagtgaaacctcgcagccgccagg

SEQ ID NO: 6843 - DNA, 25 bp, Homo sapien
atttccgcgtgtcctcattggtgga

SEQ ID NO: 6844 - DNA, 25 bp, Homo sapien
cttgccgctgcgctttacggaaacg

SEQ ID NO: 6845 - DNA, 25 bp, Homo sapien
cccgacgggaagcttgcaagacgct

SEQ ID NO: 6846 - DNA, 25 bp, Homo sapien
tgctacagaagtcgaggctgagacc

SEQ ID NO: 6847 - DNA, 25 bp, Homo sapien
ctgccatagctggagttctcggtac

SEQ ID NO: 6848 - DNA, 25 bp, Homo sapien
tactgtaggctttcggcacgctgta

SEQ ID NO: 6849 - DNA, 25 bp, Homo sapien
ctgtaggactcctgagccagagaca

SEQ ID NO: 6850 - DNA, 25 bp, Homo sapien
agacctggggcgtctcttcgaagct

SEQ ID NO: 6851 - DNA, 25 bp, Homo sapien
gaactttggttcttgctgctacaga

SEQ ID NO: 6852 - DNA, 25 bp, Homo sapien
agcgccggcttcaagctgccatagc

SEQ ID NO: 6853 - DNA, 25 bp, Homo sapien
gggctgaggcctgaactttggttct

SEQ ID NO: 6854 - DNA, 25 bp, Homo sapien
cggtggtggtctgcgagttgtgggg

SEQ ID NO: 6855 - DNA, 25 bp, Homo sapien
aaagccgtgattccttctggccccg

SEQ ID NO: 6856 - DNA, 25 bp, Homo sapien
tttgtggtcagtgggaggcgccagc

SEQ ID NO: 6857 - DNA, 25 bp, Homo sapien
cccgctgggagagccagtgtactgc

SEQ ID NO: 6858 - DNA, 25 bp, Homo sapien
tactttgtggtcagtgggaggcgcc

SEQ ID NO: 6859 - DNA, 25 bp, Homo sapien
actttgtggtcagtgggaggcgcca

SEQ ID NO: 6860 - DNA, 25 bp, Homo sapien
gccccaaagccgtgattccttctgg

SEQ ID NO: 6861 - DNA, 25 bp, Homo sapien
ccaaagccgtgattccttctggccc

SEQ ID NO: 6862 - DNA, 25 bp, Homo sapien
tcgtctcgctgctctggtactttgt

SEQ ID NO: 6863 - DNA, 25 bp, Homo sapien
gctgctctggtactttgtggtcagt

SEQ ID NO: 6864 - DNA, 25 bp, Homo sapien
cctcgtctcgctgctctggtacttt

SEQ ID NO: 6865 - DNA, 25 bp, Homo sapien
cgtctcgctgctctggtactttgtg

SEQ ID NO: 6866 - DNA, 25 bp, Homo sapien
tctcgctgctctggtactttgtggt

SEQ ID NO: 6867 - DNA, 25 bp, Homo sapien
tcgctgctctggtactttgtggtca

SEQ ID NO: 6868 - DNA, 25 bp, Homo sapien
cgctgctctggtactttgtggtcag

SEQ ID NO: 6869 - DNA, 25 bp, Homo sapien
agtgtactgcgccctcgtctcgctg

SEQ ID NO: 6870 - DNA, 25 bp, Homo sapien
ttgctgctataggagtcgagactga

SEQ ID NO: 6871 - DNA, 25 bp, Homo sapien
tcgcttccttgcgaaggagcatgtg

SEQ ID NO: 6872 - DNA, 25 bp, Homo sapien
cagagttggggcgtctcttctaagc

SEQ ID NO: 6873 - DNA, 25 bp, Homo sapien
gtaggtttcctgagccggagacatg

SEQ ID NO: 6874 - DNA, 25 bp, Homo sapien
acctaggtccgacaccgcgtagtga

SEQ ID NO: 6875 - DNA, 25 bp, Homo sapien
taatgagtgcgagcccacctaggtc

SEQ ID NO: 6876 - DNA, 25 bp, Homo sapien
cccacactgcggatagacttaatga

SEQ ID NO: 6877 - DNA, 25 bp, Homo sapien
tcgagactgagaccaccggtcaggg

SEQ ID NO: 6878 - DNA, 25 bp, Homo sapien
cgggccgggagagcaagtgtactgc

SEQ ID NO: 6879 - DNA, 25 bp, Homo sapien
cgctggtctcgccagcgccggcttc

SEQ ID NO: 6880 - DNA, 25 bp, Homo sapien
ttgtggtcagtaggagggttcagct

SEQ ID NO: 6881 - DNA, 25 bp, Homo sapien
gagggttcagctgcggtgtctgagc

SEQ ID NO: 6882 - DNA, 25 bp, Homo sapien
caaatcttaccttttctcctgaatc

SEQ ID NO: 6883 - DNA, 25 bp, Homo sapien
gaatcctgctttgcagtcggaggta

SEQ ID NO: 6884 - DNA, 25 bp, Homo sapien
tcctgctttgcagtcggaggtagag

SEQ ID NO: 6885 - DNA, 25 bp, Homo sapien
cggagctccgctggtctcgccagcg

SEQ ID NO: 6886 - DNA, 25 bp, Homo sapien
cacgtaggccgagccagaggttgtc

SEQ ID NO: 6887 - DNA, 25 bp, Homo sapien
tgctgaggacctcgtcgaaagccca

SEQ ID NO: 6888 - DNA, 25 bp, Homo sapien
ccagaggttgtctcccatctgctga

SEQ ID NO: 6889 - DNA, 25 bp, Homo sapien
gcccgccatgggtcttgggcacgta

SEQ ID NO: 6890 - DNA, 25 bp, Homo sapien
aggagcaggggactcaaatgcagtc

SEQ ID NO: 6891 - DNA, 25 bp, Homo sapien
tcgctgctctggtactttgtggtca

SEQ ID NO: 6892 - DNA, 25 bp, Homo sapien
cctcgtctcgctgctctggtacttt

SEQ ID NO: 6893 - DNA, 25 bp, Homo sapien
tcccatctgctgaggacctcgtcga

SEQ ID NO: 6894 - DNA, 25 bp, Homo sapien
aatggggaagcttcccgccaagaca

SEQ ID NO: 6895 - DNA, 25 bp, Homo sapien
cgtgatgccggtttgtttgtaggtc

SEQ ID NO: 6896 - DNA, 25 bp, Homo sapien
cccttagttggaaaatatgcagatg

SEQ ID NO: 6897 - DNA, 25 bp, Homo sapien
atggctggctccttgatggagtccc

SEQ ID NO: 6898 - DNA, 25 bp, Homo sapien
cagccgggccagtgtcactggattt

SEQ ID NO: 6899 - DNA, 25 bp, Homo sapien
ttcagcaagatgagaggccaccagc

SEQ ID NO: 6900 - DNA, 25 bp, Homo sapien
ccttaggagacaatacaggacgttc

SEQ ID NO: 6901 - DNA, 25 bp, Homo sapien
cactggatttgagggagggccattt

SEQ ID NO: 6902 - DNA, 25 bp, Homo sapien
cgtctcgaggcagaagacgacgatg

SEQ ID NO: 6903 - DNA, 25 bp, Homo sapien
tgtccgcgcgtaaaaatagcccggc

SEQ ID NO: 6904 - DNA, 25 bp, Homo sapien
tcgaagaaatactcgcggcgcgcgt

SEQ ID NO: 6905 - DNA, 25 bp, Homo sapien
tcttccaggaagacgtcgagcggca

SEQ ID NO: 6906 - DNA, 25 bp, Homo sapien
gggaaactcgaaaagcagccacagc

SEQ ID NO: 6907 - DNA, 25 bp, Homo sapien
accagcacggagactacggcgagca

SEQ ID NO: 6908 - DNA, 25 bp, Homo sapien
tcgcggaagtcaggcagcgtctcga

SEQ ID NO: 6909 - DNA, 25 bp, Homo sapien
gcctgagagctctcgggaaactcga

SEQ ID NO: 6910 - DNA, 25 bp, Homo sapien
tccatctttgttctgtgaggtcttg

SEQ ID NO: 6911 - DNA, 25 bp, Homo sapien
ctcctgcgcctagaggaggagaccc

SEQ ID NO: 6912 - DNA, 25 bp, Homo sapien
tgtcacgctccacctagccggggag

SEQ ID NO: 6913 - DNA, 25 bp, Homo sapien
ttgggcagctgtctgccgggcactt

SEQ ID NO: 6914 - DNA, 25 bp, Homo sapien
tggtgccttgtcacgcaccctgtgc

SEQ ID NO: 6915 - DNA, 25 bp, Homo sapien
gctgtgtggtgccttgtcacgcacc

SEQ ID NO: 6916 - DNA, 25 bp, Homo sapien
tcagctcttcccatgtccatctttg

SEQ ID NO: 6917 - DNA, 25 bp, Homo sapien
tgtgctttgcggtgtcacgctccac

SEQ ID NO: 6918 - DNA, 25 bp, Homo sapien
cggcggagaggtacgttacagttct

SEQ ID NO: 6919 - DNA, 25 bp, Homo sapien
ccgaagcaggagttgttgttgctga

SEQ ID NO: 6920 - DNA, 25 bp, Homo sapien
cggaatcagacggacgtggacgccc

SEQ ID NO: 6921 - DNA, 25 bp, Homo sapien
tgctccagtcgctatcggaggccgc

SEQ ID NO: 6922 - DNA, 25 bp, Homo sapien
tgaggtactcaaggtgcccaaaggc

SEQ ID NO: 6923 - DNA, 25 bp, Homo sapien
agagtctcgcggacataggcggttc

SEQ ID NO: 6924 - DNA, 25 bp, Homo sapien
cgcatgcgcgaaagatccgggaagt

SEQ ID NO: 6925 - DNA, 25 bp, Homo sapien
tacagttctctacgcaaaacgcatg

SEQ ID NO: 6926 - DNA, 25 bp, Homo sapien
cgcttccgcacagggaccgggaccg

SEQ ID NO: 6927 - DNA, 25 bp, Homo sapien
acaggtctgcccacctcatccaggc

SEQ ID NO: 6928 - DNA, 25 bp, Homo sapien
gcgatgacacctcccgctacgatga

SEQ ID NO: 6929 - DNA, 25 bp, Homo sapien
cccgctacgatgagaggtaagattg

SEQ ID NO: 6930 - DNA, 25 bp, Homo sapien
acaaggagcgagaacggcgacgctc

SEQ ID NO: 6931 - DNA, 25 bp, Homo sapien
gcgctcacggagtcgcgacaaggag

SEQ ID NO: 6932 - DNA, 25 bp, Homo sapien
ggcattcaggccgcgatgacacctc

SEQ ID NO: 6933 - DNA, 25 bp, Homo sapien
agcggagcaaggacaaggaccggga

SEQ ID NO: 6934 - DNA, 25 bp, Homo sapien
tgtccgactaggcttcggccgtcct

SEQ ID NO: 6935 - DNA, 25 bp, Homo sapien
ctgaactcctgcgtctagggctgga

SEQ ID NO: 6936 - DNA, 25 bp, Homo sapien
agagggtctagaggcctgaactcct

SEQ ID NO: 6937 - DNA, 25 bp, Homo sapien
agttgtagttttctcggccttctgt

SEQ ID NO: 6938 - DNA, 25 bp, Homo sapien
tgccaacgcttcagctcaggggttc

SEQ ID NO: 6939 - DNA, 25 bp, Homo sapien
ttctgctccgctatccgagaggtga

SEQ ID NO: 6940 - DNA, 25 bp, Homo sapien
tccagcgagttctgcagagccgctt

SEQ ID NO: 6941 - DNA, 25 bp, Homo sapien
gtctctgacactcggggtttctgcg

SEQ ID NO: 6942 - DNA, 25 bp, Homo sapien
ctccagggctccgaagcgacagagc

SEQ ID NO: 6943 - DNA, 25 bp, Homo sapien
gtgcctattggtcgacgcgccttat

SEQ ID NO: 6944 - DNA, 25 bp, Homo sapien
cgctactcgctccaggtgacatcat

SEQ ID NO: 6945 - DNA, 25 bp, Homo sapien
cgccgtctgtcagtctcctgttaaa

SEQ ID NO: 6946 - DNA, 25 bp, Homo sapien
agccggggtcgcgactcgcgttcca

SEQ ID NO: 6947 - DNA, 25 bp, Homo sapien
ccgcggaccaggcaggtaagagccc

SEQ ID NO: 6948 - DNA, 25 bp, Homo sapien
attggccgctcttcgccgtctgtca

SEQ ID NO: 6949 - DNA, 25 bp, Homo sapien
ccaggagcttggatttcccggtccg

SEQ ID NO: 6950 - DNA, 25 bp, Homo sapien
cacgagaaggactcgctgcagcgcc

SEQ ID NO: 6951 - DNA, 25 bp, Homo sapien
accgccgccatgatgtgcgaggtga

SEQ ID NO: 6952 - DNA, 25 bp, Homo sapien
ccatgatgtgcgaggtgatgcccac

SEQ ID NO: 6953 - DNA, 25 bp, Homo sapien
tgcccaccatcagcgaggatggccg

SEQ ID NO: 6954 - DNA, 25 bp, Homo sapien
ctcatggtcacgatgctcacggagc

SEQ ID NO: 6955 - DNA, 25 bp, Homo sapien
cgatgctcacggagcgcgagcgcct

SEQ ID NO: 6956 - DNA, 25 bp, Homo sapien
cacaggacgggttggctacagcgca

SEQ ID NO: 6957 - DNA, 25 bp, Homo sapien
cgcgagctcggccacgagaaggact

SEQ ID NO: 6958 - DNA, 25 bp, Homo sapien
cggggattccaaccggcgcacagca

SEQ ID NO: 6959 - DNA, 25 bp, Homo sapien
cggtgctgtgccgtcagatgagcca

SEQ ID NO: 6960 - DNA, 25 bp, Homo sapien
attgctcatgaatggcggaacctcg

SEQ ID NO: 6961 - DNA, 25 bp, Homo sapien
ctccctcgcgcattgctcatgaatg

SEQ ID NO: 6962 - DNA, 25 bp, Homo sapien
tgggtccctcgcctttccgtagagc

SEQ ID NO: 6963 - DNA, 25 bp, Homo sapien
tgtgccgtcagatgagccagctgga

SEQ ID NO: 6964 - DNA, 25 bp, Homo sapien
caccgcgcaccgtgagctgggcaag

SEQ ID NO: 6965 - DNA, 25 bp, Homo sapien
caactccaagctgcagcgcgacctc

SEQ ID NO: 6966 - DNA, 25 bp, Homo sapien
tatggaggagcggattacaacactg

SEQ ID NO: 6967 - DNA, 25 bp, Homo sapien
tacaacactggagaagcgctacctg

SEQ ID NO: 6968 - DNA, 25 bp, Homo sapien
tctgcacgacgccaacgacaaactg

SEQ ID NO: 6969 - DNA, 25 bp, Homo sapien
ctagcaaggagtcgttgtatcggca

SEQ ID NO: 6970 - DNA, 25 bp, Homo sapien
cccagagtgaagagaagagccgtca

SEQ ID NO: 6971 - DNA, 25 bp, Homo sapien
gttggacgacgccaagcagaagctg

SEQ ID NO: 6972 - DNA, 25 bp, Homo sapien
gaaagcggagaccttgcccgagata

SEQ ID NO: 6973 - DNA, 25 bp, Homo sapien
cttgcccgagatagaggcgcagctg

SEQ ID NO: 6974 - DNA, 25 bp, Homo sapien
cgcctgccgggccaatgtcaagagc

SEQ ID NO: 6975 - DNA, 25 bp, Homo sapien
atgtcaagagcggtgccatcatggc

SEQ ID NO: 6976 - DNA, 25 bp, Homo sapien
gccatcatggccaacctgtcagaca

SEQ ID NO: 6977 - DNA, 25 bp, Homo sapien
ctgtcagacacggagatccagcgcg

SEQ ID NO: 6978 - DNA, 25 bp, Homo sapien
atccagcgcgagatcggcatcagca

SEQ ID NO: 6979 - DNA, 25 bp, Homo sapien
agatcggcatcagcaacccgctgca

SEQ ID NO: 6980 - DNA, 25 bp, Homo sapien
gtgtccggcggccaattccagcctt

SEQ ID NO: 6981 - DNA, 25 bp, Homo sapien
gctacgcctcgccatccaggagatg

SEQ ID NO: 6982 - DNA, 25 bp, Homo sapien
gcgcacacgcagagactctggagct

SEQ ID NO: 6983 - DNA, 25 bp, Homo sapien
tgagccaagacctcgaggcgctgct

SEQ ID NO: 6984 - DNA, 25 bp, Homo sapien
aacccaggctgagccaagacctcga

SEQ ID NO: 6985 - DNA, 25 bp, Homo sapien
gcagagcccacactggaacccaggc

SEQ ID NO: 6986 - DNA, 25 bp, Homo sapien
aaggccgccctcgagtacgtggcag

SEQ ID NO: 6987 - DNA, 25 bp, Homo sapien
tctggagctgacagcctgtcgtgcc

SEQ ID NO: 6988 - DNA, 25 bp, Homo sapien
gtggcgcacacgcagagactctgga

SEQ ID NO: 6989 - DNA, 25 bp, Homo sapien
acaggcgcacatctactctctgggg

SEQ ID NO: 6990 - DNA, 25 bp, Homo sapien
tgtctgcaaacgatgcgggaacttc

SEQ ID NO: 6991 - DNA, 25 bp, Homo sapien
gacggcccttctcgccatgtgcaaa

SEQ ID NO: 6992 - DNA, 25 bp, Homo sapien
tgtgactcgaccagtgtgcctgtgc

SEQ ID NO: 6993 - DNA, 25 bp, Homo sapien
tgtgctctgacaagtctcacgcctg

SEQ ID NO: 6994 - DNA, 25 bp, Homo sapien
cttcctgaagtgtttgcaactcgtc

SEQ ID NO: 6995 - DNA, 25 bp, Homo sapien
agcggctagtcagggctcaagttga

SEQ ID NO: 6996 - DNA, 25 bp, Homo sapien
gactcccacgggcttgcaaaatcca

SEQ ID NO: 6997 - DNA, 25 bp, Homo sapien
gccgagcgctttgtacgagcgactc

SEQ ID NO: 6998 - DNA, 25 bp, Homo sapien
acctcactcggacggaagaatcttc

SEQ ID NO: 6999 - DNA, 25 bp, Homo sapien
ggctgtccggctcctatacctagga

SEQ ID NO: 7000 - DNA, 25 bp, Homo sapien
ggcctggaccaaaccacatgaactg

SEQ ID NO: 7001 - DNA, 25 bp, Homo sapien
cgccgaggactggaccatctgtaca

SEQ ID NO: 7002 - DNA, 25 bp, Homo sapien
ggcgtaactcccgactcagctgaga

SEQ ID NO: 7003 - DNA, 25 bp, Homo sapien
cccgtcaggatgaaatggataaatc

SEQ ID NO: 7004 - DNA, 25 bp, Homo sapien
cgcccaatgcgagtttgagtccttg

SEQ ID NO: 7005 - DNA, 25 bp, Homo sapien
cggtccggacctattcctgctagtg

SEQ ID NO: 7006 - DNA, 25 bp, Homo sapien
tagcagaactgacagtgctggaggc

SEQ ID NO: 7007 - DNA, 25 bp, Homo sapien
gcgggcagagatagcagaactgaca

SEQ ID NO: 7008 - DNA, 25 bp, Homo sapien
gtttcgcagaccagcgggcagagat

SEQ ID NO: 7009 - DNA, 25 bp, Homo sapien
agcgcagaccgtttcgcagaccagc

SEQ ID NO: 7010 - DNA, 25 bp, Homo sapien
tgctcacctggagcgcagaccgttt

SEQ ID NO: 7011 - DNA, 25 bp, Homo sapien
tgctcagagccttggccacgcctcc

SEQ ID NO: 7012 - DNA, 25 bp, Homo sapien
cccggcccacgtgctcagagccttg

SEQ ID NO: 7013 - DNA, 25 bp, Homo sapien
agaccgtttcgcagaccagcgggca

SEQ ID NO: 7014 - DNA, 25 bp, Homo sapien
ccgcccacgtggcagcaaggatatg

SEQ ID NO: 7015 - DNA, 25 bp, Homo sapien
tgcagtgagcgtctgcacctcgcga

SEQ ID NO: 7016 - DNA, 25 bp, Homo sapien
ctgggactcattgtcaccgggaaga

SEQ ID NO: 7017 - DNA, 25 bp, Homo sapien
tatggcccgcaaggtaaggctgatg

SEQ ID NO: 7018 - DNA, 25 bp, Homo sapien
ttgtgcccaacgctgccaatggctg

SEQ ID NO: 7019 - DNA, 25 bp, Homo sapien
gtggaagttaaacgagctgagcctc

SEQ ID NO: 7020 - DNA, 25 bp, Homo sapien
tcgccctaaaccagagctcggtttg

SEQ ID NO: 7021 - DNA, 25 bp, Homo sapien
agccgcggttcacagtgtccttgag

SEQ ID NO: 7022 - DNA, 25 bp, Homo sapien
ttgcccttggagtctcccctgtgtg

SEQ ID NO: 7023 - DNA, 25 bp, Homo sapien
cggccgcggcagcatggtggtgccg

SEQ ID NO: 7024 - DNA, 25 bp, Homo sapien
aaagtggaggatccggtttgctctg

SEQ ID NO: 7025 - DNA, 25 bp, Homo sapien
tctgtccccttatcgcggcctggga

SEQ ID NO: 7026 - DNA, 25 bp, Homo sapien
catctcgcgcttgcccttggagtct

SEQ ID NO: 7027 - DNA, 25 bp, Homo sapien
aactccttctgttcccatctcgcgc

SEQ ID NO: 7028 - DNA, 25 bp, Homo sapien
ccctgtctggcatcctcctttctga

SEQ ID NO: 7029 - DNA, 25 bp, Homo sapien
ccaggctaggctggaaagtggagga

SEQ ID NO: 7030 - DNA, 25 bp, Homo sapien
gccgcaagcacagcaatgtgaggcg

SEQ ID NO: 7031 - DNA, 25 bp, Homo sapien
cagtggccatggaggatgccttcgg

SEQ ID NO: 7032 - DNA, 25 bp, Homo sapien
accgtgtgggacagcgatgcacaca

SEQ ID NO: 7033 - DNA, 25 bp, Homo sapien
gacagcgatgcacacaccacggaga

SEQ ID NO: 7034 - DNA, 25 bp, Homo sapien
gatgcacacaccacggagaagccca

SEQ ID NO: 7035 - DNA, 25 bp, Homo sapien
agaagcccaccgatgcctacggaga

SEQ ID NO: 7036 - DNA, 25 bp, Homo sapien
gcacagcaatgtgaggcgggcctct

SEQ ID NO: 7037 - DNA, 25 bp, Homo sapien
atgcctacggagagctggacttcac

SEQ ID NO: 7038 - DNA, 25 bp, Homo sapien
aatgaccggcctgagttcgtgcgct

SEQ ID NO: 7039 - DNA, 25 bp, Homo sapien
agttcgtgcgcttgctcatttccca

SEQ ID NO: 7040 - DNA, 25 bp, Homo sapien
gctcatttcccacggcctcagcctg

SEQ ID NO: 7041 - DNA, 25 bp, Homo sapien
atgcgcctggcccaactctacagcg

SEQ ID NO: 7042 - DNA, 25 bp, Homo sapien
gcggcgccctccaactcgctcatcc

SEQ ID NO: 7043 - DNA, 25 bp, Homo sapien
tccgcaaccttttggaccaggcgtc

SEQ ID NO: 7044 - DNA, 25 bp, Homo sapien
tttggaccaggcgtcccacagcgca

SEQ ID NO: 7045 - DNA, 25 bp, Homo sapien
gccctgctgaatgaccggcctgagt

SEQ ID NO: 7046 - DNA, 25 bp, Homo sapien
tgcctacgccgctggttccacttct

SEQ ID NO: 7047 - DNA, 25 bp, Homo sapien
tgctgctcgtggatttccagccggc

SEQ ID NO: 7048 - DNA, 25 bp, Homo sapien
cttttctcgcgggtgctgctcgtgg

SEQ ID NO: 7049 - DNA, 25 bp, Homo sapien
gtggtcagctacctgctgttcctgc

SEQ ID NO: 7050 - DNA, 25 bp, Homo sapien
cttcatgggcaacgtggtcagctac

SEQ ID NO: 7051 - DNA, 25 bp, Homo sapien
tttcacgctgctgtgcgaggaactg

SEQ ID NO: 7052 - DNA, 25 bp, Homo sapien
gtgaccatcttcatgggcaacgtgg

SEQ ID NO: 7053 - DNA, 25 bp, Homo sapien
ctatttctgggctttcacgctgctg

SEQ ID NO: 7054 - DNA, 25 bp, Homo sapien
ctgctaacgtgggaatcggtgcata

SEQ ID NO: 7055 - DNA, 25 bp, Homo sapien
gagaactttctgctggcacgcgcta

SEQ ID NO: 7056 - DNA, 25 bp, Homo sapien
catgttctcgaatcaccaggggctg

SEQ ID NO: 7057 - DNA, 25 bp, Homo sapien
ccaaatgactaacgggcgtggctta

SEQ ID NO: 7058 - DNA, 25 bp, Homo sapien
ccggccctcgagcatttccgtaaga

SEQ ID NO: 7059 - DNA, 25 bp, Homo sapien
tgctcaggcaattgtgcaggcgacc

SEQ ID NO: 7060 - DNA, 25 bp, Homo sapien
gcgttaccgcctcatccgggaattc

SEQ ID NO: 7061 - DNA, 25 bp, Homo sapien
tctgaagcgcacgtcccagaagtga

SEQ ID NO: 7062 - DNA, 25 bp, Homo sapien
tcctctgactgctcacgcgccactc

SEQ ID NO: 7063 - DNA, 25 bp, Homo sapien
gacacccacgatgccacgcttcagg

SEQ ID NO: 7064 - DNA, 25 bp, Homo sapien
cgcacgtgtgcacatcctctgactg

SEQ ID NO: 7065 - DNA, 25 bp, Homo sapien
tgtagcaaacactgtaaccacttcg

SEQ ID NO: 7066 - DNA, 25 bp, Homo sapien
ctttcccgccgattctctgcgcatg

SEQ ID NO: 7067 - DNA, 25 bp, Homo sapien
gtttgggcgacacccctcgatctgc

SEQ ID NO: 7068 - DNA, 25 bp, Homo sapien
ttccctacagctgtagcaaacactg

SEQ ID NO: 7069 - DNA, 25 bp, Homo sapien
tcgacagatcggtttgggcgacacc

SEQ ID NO: 7070 - DNA, 25 bp, Homo sapien
actatgtgcagttccaggtaagccc

SEQ ID NO: 7071 - DNA, 25 bp, Homo sapien
agaccctggcgtggcttcgccatct

SEQ ID NO: 7072 - DNA, 25 bp, Homo sapien
gtcgcctggtctcccagtacccaga

SEQ ID NO: 7073 - DNA, 25 bp, Homo sapien
gcttcgccatctacctcgagagact

SEQ ID NO: 7074 - DNA, 25 bp, Homo sapien
agagctgggactatgtgcagttcca

SEQ ID NO: 7075 - DNA, 25 bp, Homo sapien
gagaaaaccatccaaaagtacggca

SEQ ID NO: 7076 - DNA, 25 bp, Homo sapien
gcgggacgtcgtagagaaaaccatc

SEQ ID NO: 7077 - DNA, 25 bp, Homo sapien
agtacccagaccctggcgtggcttc

SEQ ID NO: 7078 - DNA, 25 bp, Homo sapien
agctcatttcgctccacgtcctgga

SEQ ID NO: 7079 - DNA, 25 bp, Homo sapien
tcgaggtccaagagcggctgtattt

SEQ ID NO: 7080 - DNA, 25 bp, Homo sapien
gctgtatttggggactgctgttcgt

SEQ ID NO: 7081 - DNA, 25 bp, Homo sapien
cctagggattccactctttgaaatc

SEQ ID NO: 7082 - DNA, 25 bp, Homo sapien
gggaccattagaggtattgcatttt

SEQ ID NO: 7083 - DNA, 25 bp, Homo sapien
gcaccgtggacacctaaagccgacg

SEQ ID NO: 7084 - DNA, 25 bp, Homo sapien
gaaaacggctggcttccgcaccgtg

SEQ ID NO: 7085 - DNA, 25 bp, Homo sapien
ctgctgttcgtgagggaccattaga

SEQ ID NO: 7086 - DNA, 25 bp, Homo sapien
cctgcagagagccacatctaccgcg

SEQ ID NO: 7087 - DNA, 25 bp, Homo sapien
tgtcagtgagtagcggcctgagaaa

SEQ ID NO: 7088 - DNA, 25 bp, Homo sapien
agcataaacctgtcgaatggggcgg

SEQ ID NO: 7089 - DNA, 25 bp, Homo sapien
ggagcataaacctgtcgaatggggc

SEQ ID NO: 7090 - DNA, 25 bp, Homo sapien
tcggagcataaacctgtcgaatggg

SEQ ID NO: 7091 - DNA, 25 bp, Homo sapien
ctgtcagtgagtagcggcctgagaa

SEQ ID NO: 7092 - DNA, 25 bp, Homo sapien
caggggttcggagcataaacctgtc

SEQ ID NO: 7093 - DNA, 25 bp, Homo sapien
ggggttcggagcataaacctgtcga

SEQ ID NO: 7094 - DNA, 25 bp, Homo sapien
tgtgcagaaacctggaccacgtcta

SEQ ID NO: 7095 - DNA, 25 bp, Homo sapien
accggctcgctcgataccgttaggc

SEQ ID NO: 7096 - DNA, 25 bp, Homo sapien
gacgctctcgatattcctgtgcaga

SEQ ID NO: 7097 - DNA, 25 bp, Homo sapien
tcctgctattggctgcgatctccct

SEQ ID NO: 7098 - DNA, 25 bp, Homo sapien
cctttctctatagctcgggttcatg

SEQ ID NO: 7099 - DNA, 25 bp, Homo sapien
gtagcagctattcccgcctcatcag

SEQ ID NO: 7100 - DNA, 25 bp, Homo sapien
tgggttcaagacgaggaccagcctg

SEQ ID NO: 7101 - DNA, 25 bp, Homo sapien
cctttctccgcagatgactgtcatg

SEQ ID NO: 7102 - DNA, 25 bp, Homo sapien
tcctcactgaggctcggtcacggga

SEQ ID NO: 7103 - DNA, 25 bp, Homo sapien
cgcacgcctcacctcctaagaagca

SEQ ID NO: 7104 - DNA, 25 bp, Homo sapien
ttcagagacggtcccgcaaacgcac

SEQ ID NO: 7105 - DNA, 25 bp, Homo sapien
ggctgcgaaccattcagagacggtc

SEQ ID NO: 7106 - DNA, 25 bp, Homo sapien
cgggcaaaaagagggctgcgaacca

SEQ ID NO: 7107 - DNA, 25 bp, Homo sapien
tgaggctcggtcacgggagcaaatt

SEQ ID NO: 7108 - DNA, 25 bp, Homo sapien
aggcaccctaactccggccagagtt

SEQ ID NO: 7109 - DNA, 25 bp, Homo sapien
tcggtcacgggagcaaattcgggcc

SEQ ID NO: 7110 - DNA, 25 bp, Homo sapien
gtctgcacggcccagacccaggatt

SEQ ID NO: 7111 - DNA, 25 bp, Homo sapien
tttggacgagggcagaaccacaacg

SEQ ID NO: 7112 - DNA, 25 bp, Homo sapien
gacccaggattccaaacttgtgaac

SEQ ID NO: 7113 - DNA, 25 bp, Homo sapien
caatcacaaacttggcggcaaagtg

SEQ ID NO: 7114 - DNA, 25 bp, Homo sapien
acccgtggactcaaggcaggctcgg

SEQ ID NO: 7115 - DNA, 25 bp, Homo sapien
tggcttcggacagggcttctcagac

SEQ ID NO: 7116 - DNA, 25 bp, Homo sapien
cggcaaagtggcgactcaaccttgg

SEQ ID NO: 7117 - DNA, 25 bp, Homo sapien
cccagcaggttacgggcaggacttg

SEQ ID NO: 7118 - DNA, 25 bp, Homo sapien
cgctctagaccagacctgggctcga

SEQ ID NO: 7119 - DNA, 25 bp, Homo sapien
ttggctttaacagtacgtgggcggc

SEQ ID NO: 7120 - DNA, 25 bp, Homo sapien
ggactccgaaacgagggccgcaatc

SEQ ID NO: 7121 - DNA, 25 bp, Homo sapien
ccgcaatcagagaacaccgccagga

SEQ ID NO: 7122 - DNA, 25 bp, Homo sapien
tggtctccaggactgaggtcaactg

SEQ ID NO: 7123 - DNA, 25 bp, Homo sapien
cgcggagcgcaaccaacgctctaga

SEQ ID NO: 7124 - DNA, 25 bp, Homo sapien
ctgggctcgagaccataactgtttg

SEQ ID NO: 7125 - DNA, 25 bp, Homo sapien
gccagggaatgaactcacggctctg

SEQ ID NO: 7126 - DNA, 25 bp, Homo sapien
tcccgagactaggacgtggctccag

SEQ ID NO: 7127 - DNA, 25 bp, Homo sapien
ggatgtccgttgtgtcccgagacta

SEQ ID NO: 7128 - DNA, 25 bp, Homo sapien
cgtgacacgcgtcggccgccggttt

SEQ ID NO: 7129 - DNA, 25 bp, Homo sapien
ccgccggtttgcacctgcgtcttaa

SEQ ID NO: 7130 - DNA, 25 bp, Homo sapien
cctgcgtcttaagaggagtccgggc

SEQ ID NO: 7131 - DNA, 25 bp, Homo sapien
ttctggcgggaaaagctcacgcgca

SEQ ID NO: 7132 - DNA, 25 bp, Homo sapien
actcaactgccgttcgtcgttcgtg

SEQ ID NO: 7133 - DNA, 25 bp, Homo sapien
ttcgtcgttcgtggatgtccgttgt

SEQ ID NO: 7134 - DNA, 25 bp, Homo sapien
catgtacgagttcagccagtggcgg

SEQ ID NO: 7135 - DNA, 25 bp, Homo sapien
agcagcttgtgcatgtacgagttca

SEQ ID NO: 7136 - DNA, 25 bp, Homo sapien
gggcgcatccaacaccagcagcttg

SEQ ID NO: 7137 - DNA, 25 bp, Homo sapien
ggcatggtctttattaagatgggga

SEQ ID NO: 7138 - DNA, 25 bp, Homo sapien
gcgcagggcatggtctttattaaga

SEQ ID NO: 7139 - DNA, 25 bp, Homo sapien
tcgcgcaggaactaggcgcagtccg

SEQ ID NO: 7140 - DNA, 25 bp, Homo sapien
caacgcacacgcaggtcgcgcagga

SEQ ID NO: 7141 - DNA, 25 bp, Homo sapien
accgcgcgtccagactcgctcttgc

SEQ ID NO: 7142 - DNA, 25 bp, Homo sapien
tttgtgctgctgtggtgtctttacc

SEQ ID NO: 7143 - DNA, 25 bp, Homo sapien
ccaaggtcaatgaaagccctggctc

SEQ ID NO: 7144 - DNA, 25 bp, Homo sapien
tgtctgcaatttcacccaagagtcc

SEQ ID NO: 7145 - DNA, 25 bp, Homo sapien
ctcctgatcggtcggccgcacaaaa

SEQ ID NO: 7146 - DNA, 25 bp, Homo sapien
caagagtccagtgccgctcccaatg

SEQ ID NO: 7147 - DNA, 25 bp, Homo sapien
gaccgcgctgctgatcggcatcttt

SEQ ID NO: 7148 - DNA, 25 bp, Homo sapien
tcccaatgcggttggaaacggcttc

SEQ ID NO: 7149 - DNA, 25 bp, Homo sapien
ccggcttccggacgacggagatgaa

SEQ ID NO: 7150 - DNA, 25 bp, Homo sapien
ggatccgcggttctcaccagagatg

SEQ ID NO: 7151 - DNA, 25 bp, Homo sapien
aggaagttccctacagagctgacca

SEQ ID NO: 7152 - DNA, 25 bp, Homo sapien
gccactcatgttccaccttttgtga

SEQ ID NO: 7153 - DNA, 25 bp, Homo sapien
tcacgttgaaccctggcggagagac

SEQ ID NO: 7154 - DNA, 25 bp, Homo sapien
ccacgccgttggagatgcccatgag

SEQ ID NO: 7155 - DNA, 25 bp, Homo sapien
ggcgtcacaccggaatctcactcga

SEQ ID NO: 7156 - DNA, 25 bp, Homo sapien
tgcgagtagccgaccaccaacagca

SEQ ID NO: 7157 - DNA, 25 bp, Homo sapien
gctatgtccaggtggttcacgttga

SEQ ID NO: 7158 - DNA, 25 bp, Homo sapien
ctgcggcagaagttggccacgatga

SEQ ID NO: 7159 - DNA, 25 bp, Homo sapien
cacgatgatggcatagactggcata

SEQ ID NO: 7160 - DNA, 25 bp, Homo sapien
gcatagacgtgaagaagcgccgcca

SEQ ID NO: 7161 - DNA, 25 bp, Homo sapien
cgccgccagggagtgctaaacttct

SEQ ID NO: 7162 - DNA, 25 bp, Homo sapien
ccgatgggcacgatgatggtcatga

SEQ ID NO: 7163 - DNA, 25 bp, Homo sapien
aacttgcgcacgttggtggtggaca

SEQ ID NO: 7164 - DNA, 25 bp, Homo sapien
tgctgatctcgaagccgaacacttc

SEQ ID NO: 7165 - DNA, 25 bp, Homo sapien
tcctgggctctaccttgctgatctc

SEQ ID NO: 7166 - DNA, 25 bp, Homo sapien
agccgtctcccgtgcagcaaaactg

SEQ ID NO: 7167 - DNA, 25 bp, Homo sapien
tgtgtgtttccacagcgccaacagc

SEQ ID NO: 7168 - DNA, 25 bp, Homo sapien
tccatttcgggctacaccttcagtg

SEQ ID NO: 7169 - DNA, 25 bp, Homo sapien
gatttccatcatggcggcgtccatt

SEQ ID NO: 7170 - DNA, 25 bp, Homo sapien
ccacttcccatgatgccaaggggtc

SEQ ID NO: 7171 - DNA, 25 bp, Homo sapien
cttctagacttaagaggggcgcacg

SEQ ID NO: 7172 - DNA, 25 bp, Homo sapien
tatcaaccgctgtctgaggcgtgtc

SEQ ID NO: 7173 - DNA, 25 bp, Homo sapien
aaccggcgttcctcagccttcaaga

SEQ ID NO: 7174 - DNA, 25 bp, Homo sapien
gttgcaacccgcctcctaggttcta

SEQ ID NO: 7175 - DNA, 25 bp, Homo sapien
ggaaccgtccctgatctacacgctg

SEQ ID NO: 7176 - DNA, 25 bp, Homo sapien
tggcgtcctcgatgtacttgcgctc

SEQ ID NO: 7177 - DNA, 25 bp, Homo sapien
gttccagtcccgtctcctctagagt

SEQ ID NO: 7178 - DNA, 25 bp, Homo sapien
ccgtagacgtagaaaacagagctcc

SEQ ID NO: 7179 - DNA, 25 bp, Homo sapien
gctccatcctgagtactgcacaagg

SEQ ID NO: 7180 - DNA, 25 bp, Homo sapien
atgagtttcgcgctctctccgatgg

SEQ ID NO: 7181 - DNA, 25 bp, Homo sapien
aggttcgtggcttgctatctctccc

SEQ ID NO: 7182 - DNA, 25 bp, Homo sapien
acggattgggcggagctattccgac

SEQ ID NO: 7183 - DNA, 25 bp, Homo sapien
cggtgggtcgtgctgttattgacca

SEQ ID NO: 7184 - DNA, 25 bp, Homo sapien
ttattgaccatggagacgatggcca

SEQ ID NO: 7185 - DNA, 25 bp, Homo sapien
ccctaaggcgaggtcagaactaagg

SEQ ID NO: 7186 - DNA, 25 bp, Homo sapien
caggttgcagcggatgccaaagctg

SEQ ID NO: 7187 - DNA, 25 bp, Homo sapien
gccaaagctgatgcagaagcccaga

SEQ ID NO: 7188 - DNA, 25 bp, Homo sapien
cgaagcaggtgcagtccaccaccgg

SEQ ID NO: 7189 - DNA, 25 bp, Homo sapien
ggcggagctattccgacagcgtttc

SEQ ID NO: 7190 - DNA, 25 bp, Homo sapien
gaaaactggacagatgggtggaccc

SEQ ID NO: 7191 - DNA, 25 bp, Homo sapien
gaaactcctcctggcggaactccat

SEQ ID NO: 7192 - DNA, 25 bp, Homo sapien
gagcacgacccgctagcttccgaaa

SEQ ID NO: 7193 - DNA, 25 bp, Homo sapien
gctcaccggtgcagcttcccgagag

SEQ ID NO: 7194 - DNA, 25 bp, Homo sapien
tgggaattagcatcctcctcagatc

SEQ ID NO: 7195 - DNA, 25 bp, Homo sapien
tatcgcccgttcatctgtcagtctg

SEQ ID NO: 7196 - DNA, 25 bp, Homo sapien
cgtcggagcccacggcagaaaactg

SEQ ID NO: 7197 - DNA, 25 bp, Homo sapien
tcagtctgcgcccaggtgggaatta

SEQ ID NO: 7198 - DNA, 25 bp, Homo sapien
cctcagcgctcgtttgagaagggcc

SEQ ID NO: 7199 - DNA, 25 bp, Homo sapien
taaattttcatgatgcggcccgcgg

SEQ ID NO: 7200 - DNA, 25 bp, Homo sapien
tcgcttccagccttgactggctgtg

SEQ ID NO: 7201 - DNA, 25 bp, Homo sapien
gccgctgccaaaacttgggcctttg

SEQ ID NO: 7202 - DNA, 25 bp, Homo sapien
ggcctttgccgaaaccatcgccatg

SEQ ID NO: 7203 - DNA, 25 bp, Homo sapien
ttcaggacctgggaatgagttactc

SEQ ID NO: 7204 - DNA, 25 bp, Homo sapien
cgggccgcaaatgcatttggtatta

SEQ ID NO: 7205 - DNA, 25 bp, Homo sapien
gaggaaaggactcagccgcacactt

SEQ ID NO: 7206 - DNA, 25 bp, Homo sapien
cctcgtaacccggagccgcgagtga

SEQ ID NO: 7207 - DNA, 25 bp, Homo sapien
acatgccggcagtctcgcgataact

SEQ ID NO: 7208 - DNA, 25 bp, Homo sapien
atccgcgcccgcacaggcagaagta

SEQ ID NO: 7209 - DNA, 25 bp, Homo sapien
aggcgcggaccaaagcgatctcttc

SEQ ID NO: 7210 - DNA, 25 bp, Homo sapien
ccaaagcgatctcttctgaggatcc

SEQ ID NO: 7211 - DNA, 25 bp, Homo sapien
tgagtgttgcgatttggcgcgtctc

SEQ ID NO: 7212 - DNA, 25 bp, Homo sapien
gggccttcatgtccgggtcctcgta

SEQ ID NO: 7213 - DNA, 25 bp, Homo sapien
tttggcgcgtctctgccgggcctat

SEQ ID NO: 7214 - DNA, 25 bp, Homo sapien
tcgccatggccctgggaaagagatc

SEQ ID NO: 7215 - DNA, 25 bp, Homo sapien
tctggccctcaatcgactccggata

SEQ ID NO: 7216 - DNA, 25 bp, Homo sapien
ccgtggggaatatgtgtctctagac

SEQ ID NO: 7217 - DNA, 25 bp, Homo sapien
ctccgtcctacgtgccgaactgtaa

SEQ ID NO: 7218 - DNA, 25 bp, Homo sapien
acaggactggagtatgccacacttc

SEQ ID NO: 7219 - DNA, 25 bp, Homo sapien
acaagctggtatcgcgttatcgaca

SEQ ID NO: 7220 - DNA, 25 bp, Homo sapien
gatctaggcgtcctcgagaccctca

SEQ ID NO: 7221 - DNA, 25 bp, Homo sapien
gccacacttccggtctatcggtaaa

SEQ ID NO: 7222 - DNA, 25 bp, Homo sapien
ggagccctcctaactattcgcaaag

SEQ ID NO: 7223 - DNA, 25 bp, Homo sapien
tattcgcaaagtacccacatcgccg

SEQ ID NO: 7224 - DNA, 25 bp, Homo sapien
gtgcgcatgctcctaaatacgcttc

SEQ ID NO: 7225 - DNA, 25 bp, Homo sapien
gcgtggctgctctctgtatcttgta

SEQ ID NO: 7226 - DNA, 25 bp, Homo sapien
tgtcgctcttcggacctcaaggttc

SEQ ID NO: 7227 - DNA, 25 bp, Homo sapien
gagatcttcacctcgctggagtacg

SEQ ID NO: 7228 - DNA, 25 bp, Homo sapien
ggagtcccgtcatccactgcggtag

SEQ ID NO: 7229 - DNA, 25 bp, Homo sapien
gcccaataggatcgcgccctgtagg

SEQ ID NO: 7230 - DNA, 25 bp, Homo sapien
tgtcgtggacgccgcctggtccgac

SEQ ID NO: 7231 - DNA, 25 bp, Homo sapien
aagggcgtgcccttcgacggagcct

SEQ ID NO: 7232 - DNA, 25 bp, Homo sapien
acacggcggacgtagactcggccgt

SEQ ID NO: 7233 - DNA, 25 bp, Homo sapien
tctcctcataccctggaggccgttg

SEQ ID NO: 7234 - DNA, 25 bp, Homo sapien
gctgctgacggacacggcggacgta

SEQ ID NO: 7235 - DNA, 25 bp, Homo sapien
tgcccttcgacggagcctggcggga

SEQ ID NO: 7236 - DNA, 25 bp, Homo sapien
cctaggaagggcgtgcccttcgacg

SEQ ID NO: 7237 - DNA, 25 bp, Homo sapien
agacccgtgcgctcccgtctcctca

SEQ ID NO: 7238 - DNA, 25 bp, Homo sapien
cacgggggcccagacgtgagtacat

SEQ ID NO: 7239 - DNA, 25 bp, Homo sapien
ccttgacactcgcatccggcctcgc

SEQ ID NO: 7240 - DNA, 25 bp, Homo sapien
cttcggtgcccacaggcggctgcaa

SEQ ID NO: 7241 - DNA, 25 bp, Homo sapien
tggatcaacgcccacggcctcagag

SEQ ID NO: 7242 - DNA, 25 bp, Homo sapien
ggcactgtctggatcaacgcccacg

SEQ ID NO: 7243 - DNA, 25 bp, Homo sapien
acaggctccaggtgggcactgtctg

SEQ ID NO: 7244 - DNA, 25 bp, Homo sapien
tcctctgttggacaccttcatcttc

SEQ ID NO: 7245 - DNA, 25 bp, Homo sapien
ctgttttcctctgttggacaccttc

SEQ ID NO: 7246 - DNA, 25 bp, Homo sapien
tgaccgcggaggtccaaccggaaga

SEQ ID NO: 7247 - DNA, 25 bp, Homo sapien
accggaagaatgtccggattggaca

SEQ ID NO: 7248 - DNA, 25 bp, Homo sapien
ccctcaaaaatatggccgccgaggc

SEQ ID NO: 7249 - DNA, 25 bp, Homo sapien
agcgtgtgaacgagatgaacagccc

SEQ ID NO: 7250 - DNA, 25 bp, Homo sapien
cactcacaaacatggcggacagagc

SEQ ID NO: 7251 - DNA, 25 bp, Homo sapien
ggggtaatggcgcttccactcacaa

SEQ ID NO: 7252 - DNA, 25 bp, Homo sapien
ttcagtcgcttgaaggggtaatggc

SEQ ID NO: 7253 - DNA, 25 bp, Homo sapien
gccttccctggggaatctctgcgca

SEQ ID NO: 7254 - DNA, 25 bp, Homo sapien
gctgacgtcaccctgtgtcgaccag

SEQ ID NO: 7255 - DNA, 25 bp, Homo sapien
agcaccctcaagaccgcagtcggcc

SEQ ID NO: 7256 - DNA, 25 bp, Homo sapien
gtctggccttgacgttgtgccgctc

SEQ ID NO: 7257 - DNA, 25 bp, Homo sapien
gcggaccctcggagaccatgtcctg

SEQ ID NO: 7258 - DNA, 25 bp, Homo sapien
tcggagaccatgtcctgactgaggg

SEQ ID NO: 7259 - DNA, 25 bp, Homo sapien
ccgctgtcggcgcttccatcttggg

SEQ ID NO: 7260 - DNA, 25 bp, Homo sapien
tccgcccagcttgtttaccgaccgc

SEQ ID NO: 7261 - DNA, 25 bp, Homo sapien
gctcgccgcggggtttatttggctc

SEQ ID NO: 7262 - DNA, 25 bp, Homo sapien
tcctgaggcgtgttactggaagtcg

SEQ ID NO: 7263 - DNA, 25 bp, Homo sapien
cgattgtcctgaggcgtgttactgg

SEQ ID NO: 7264 - DNA, 25 bp, Homo sapien
tggcgattgtcctgaggcgtgttac

SEQ ID NO: 7265 - DNA, 25 bp, Homo sapien
attggcgattgtcctgaggcgtgtt

SEQ ID NO: 7266 - DNA, 25 bp, Homo sapien
cgttttggggattggcgattgtcct

SEQ ID NO: 7267 - DNA, 25 bp, Homo sapien
ctggaatgaactcgttttccgtcgt

SEQ ID NO: 7268 - DNA, 25 bp, Homo sapien
tcgttttggggattggcgattgtcc

SEQ ID NO: 7269 - DNA, 25 bp, Homo sapien
gtcctgaggcgtgttactggaagtc

SEQ ID NO: 7270 - DNA, 25 bp, Homo sapien
cctgcagctccggttcttttaattc

SEQ ID NO: 7271 - DNA, 25 bp, Homo sapien
actttgatttcacgtggaggtgtta

SEQ ID NO: 7272 - DNA, 25 bp, Homo sapien
tcggggcaatgagaaactgagtttt

SEQ ID NO: 7273 - DNA, 25 bp, Homo sapien
tgagttttggccaaaatggaaggta

SEQ ID NO: 7274 - DNA, 25 bp, Homo sapien
aggtatttttatcccgctcagtgcg

SEQ ID NO: 7275 - DNA, 25 bp, Homo sapien
gcggggcactctggaatgaactcgt

SEQ ID NO: 7276 - DNA, 25 bp, Homo sapien
cagtgcgcgggctactttgatttca

SEQ ID NO: 7277 - DNA, 25 bp, Homo sapien
ttaattctcaatgcctttctgcggg

SEQ ID NO: 7278 - DNA, 25 bp, Homo sapien
caaggccgtgctgcgtttctcctta

SEQ ID NO: 7279 - DNA, 25 bp, Homo sapien
tgcctaaataatcgcgcccggcgtt

SEQ ID NO: 7280 - DNA, 25 bp, Homo sapien
tggtcacatcttccctgcctaaata

SEQ ID NO: 7281 - DNA, 25 bp, Homo sapien
gatggactccgtacgactctcgcga

SEQ ID NO: 7282 - DNA, 25 bp, Homo sapien
agagccacgcggtatccaaatccca

SEQ ID NO: 7283 - DNA, 25 bp, Homo sapien
cctcatccggtttgaaggctgaacg

SEQ ID NO: 7284 - DNA, 25 bp, Homo sapien
tggggcctaagactctcgcgagaca

SEQ ID NO: 7285 - DNA, 25 bp, Homo sapien
cgaatcgcccgctggtttaagtgca

SEQ ID NO: 7286 - DNA, 25 bp, Homo sapien
tccagttcaggggtgaaagttcttc

SEQ ID NO: 7287 - DNA, 25 bp, Homo sapien
attgttgtcagtctggaccgagccc

SEQ ID NO: 7288 - DNA, 25 bp, Homo sapien
cccaggtcgtcctctcagcatgggg

SEQ ID NO: 7289 - DNA, 25 bp, Homo sapien
ggcgctgccttctccgctcaattaa

SEQ ID NO: 7290 - DNA, 25 bp, Homo sapien
aactttctcaacgtctcctgctggg

SEQ ID NO: 7291 - DNA, 25 bp, Homo sapien
acctgtcgcctcttgtgtctgtttc

SEQ ID NO: 7292 - DNA, 25 bp, Homo sapien
gccgggactctcagcctatcaagtg

SEQ ID NO: 7293 - DNA, 25 bp, Homo sapien
gttcttcaggtacgaggagggcatt

SEQ ID NO: 7294 - DNA, 25 bp, Homo sapien
actgctgcattgtgcagcacgcggg

SEQ ID NO: 7295 - DNA, 25 bp, Homo sapien
gagctgcaacttcggttcctgcgga

SEQ ID NO: 7296 - DNA, 25 bp, Homo sapien
agcagccctggcttttccgtgctta

SEQ ID NO: 7297 - DNA, 25 bp, Homo sapien
aacttcggttcctgcggaatgggct

SEQ ID NO: 7298 - DNA, 25 bp, Homo sapien
aacagtgacggatccttccacgcct

SEQ ID NO: 7299 - DNA, 25 bp, Homo sapien
cctcgtcgtcactaacagtcaaaag

SEQ ID NO: 7300 - DNA, 25 bp, Homo sapien
acagtcaaaagtggcgatgagcacc

SEQ ID NO: 7301 - DNA, 25 bp, Homo sapien
tgagcaccactactgctgcattgtg

SEQ ID NO: 7302 - DNA, 25 bp, Homo sapien
ttgggcacatttgcgggaacgcaga

SEQ ID NO: 7303 - DNA, 25 bp, Homo sapien
agagcggccgaattgggcacatttg

SEQ ID NO: 7304 - DNA, 25 bp, Homo sapien
gcaggccgcggtttcctttgtggac

SEQ ID NO: 7305 - DNA, 25 bp, Homo sapien
cagagtgccgcgacgactgccagga

SEQ ID NO: 7306 - DNA, 25 bp, Homo sapien
cgtgaggcgttgtgactagaacagc

SEQ ID NO: 7307 - DNA, 25 bp, Homo sapien
cgttgtgactagaacagctggaggt

SEQ ID NO: 7308 - DNA, 25 bp, Homo sapien
cgtgagacgctcgtgcgagctcatt

SEQ ID NO: 7309 - DNA, 25 bp, Homo sapien
acgactgccaggagttgtagttctc

SEQ ID NO: 7310 - DNA, 25 bp, Homo sapien
cgccggagtgcgtagggtctcccca

SEQ ID NO: 7311 - DNA, 25 bp, Homo sapien
gacacccagctttgctcttggtctc

SEQ ID NO: 7312 - DNA, 25 bp, Homo sapien
gctgacacccagctttgctcttggt

SEQ ID NO: 7313 - DNA, 25 bp, Homo sapien
caggcgggatcagctgacacccagc

SEQ ID NO: 7314 - DNA, 25 bp, Homo sapien
tcgcctgatgcaggcgggatcagct

SEQ ID NO: 7315 - DNA, 25 bp, Homo sapien
agatcaaggtgtgtgcggccgtccc

SEQ ID NO: 7316 - DNA, 25 bp, Homo sapien
tcacaaaactgcctggtgcatcctc

SEQ ID NO: 7317 - DNA, 25 bp, Homo sapien
cgggccgctcacaaaactgcctggt

SEQ ID NO: 7318 - DNA, 25 bp, Homo sapien
aggagctgcgcaacgccacctatgg

SEQ ID NO: 7319 - DNA, 25 bp, Homo sapien
cagcaggcccgctcgttctggagaa

SEQ ID NO: 7320 - DNA, 25 bp, Homo sapien
gcttggtcccgaaattgacccgcgc

SEQ ID NO: 7321 - DNA, 25 bp, Homo sapien
cgcggaccgtggactgtattttcag

SEQ ID NO: 7322 - DNA, 25 bp, Homo sapien
gcttctaggcggatcgtggaccgca

SEQ ID NO: 7323 - DNA, 25 bp, Homo sapien
acgcagcagcggcacatacgggact

SEQ ID NO: 7324 - DNA, 25 bp, Homo sapien
gcctgggacacgtacgacacggacc

SEQ ID NO: 7325 - DNA, 25 bp, Homo sapien
ggccctgcatcgtagtaggtccctc

SEQ ID NO: 7326 - DNA, 25 bp, Homo sapien
acgccgcgaatgaaggcgccacgtc

SEQ ID NO: 7327 - DNA, 25 bp, Homo sapien
ttgcgcacccaagccggtttatttg

SEQ ID NO: 7328 - DNA, 25 bp, Homo sapien
aggcctgcatcaccggccgtgattt

SEQ ID NO: 7329 - DNA, 25 bp, Homo sapien
cgtgcgctgtaggagcactgtttgc

SEQ ID NO: 7330 - DNA, 25 bp, Homo sapien
gccgtgatttctccgcttgcagctt

SEQ ID NO: 7331 - DNA, 25 bp, Homo sapien
agcactgtttgcacggccctgcatc

SEQ ID NO: 7332 - DNA, 25 bp, Homo sapien
accggccgtgatttctccgcttgca

SEQ ID NO: 7333 - DNA, 25 bp, Homo sapien
tgaaggcgccacgtcgttgcgcacc

SEQ ID NO: 7334 - DNA, 25 bp, Homo sapien
ctccagcttggtggccttggcttcg

SEQ ID NO: 7335 - DNA, 25 bp, Homo sapien
ccacgcggtccacggagctgtctag

SEQ ID NO: 7336 - DNA, 25 bp, Homo sapien
ggtcacggcacacacgtagcgctcg

SEQ ID NO: 7337 - DNA, 25 bp, Homo sapien
agctgtctagcggtgtgaagtgcac

SEQ ID NO: 7338 - DNA, 25 bp, Homo sapien
agtgcacgggcgtcaggtccgacat

SEQ ID NO: 7339 - DNA, 25 bp, Homo sapien
ccgacatgcgcaggggcttccctga

SEQ ID NO: 7340 - DNA, 25 bp, Homo sapien
cttccctgacatggggcaggtcacc

SEQ ID NO: 7341 - DNA, 25 bp, Homo sapien
aggtgactcacgagggccgcagcac

SEQ ID NO: 7342 - DNA, 25 bp, Homo sapien
cccgacaccggaaaggagcactatt

SEQ ID NO: 7343 - DNA, 25 bp, Homo sapien
accggaagtagagctgcccctagtt

SEQ ID NO: 7344 - DNA, 25 bp, Homo sapien
gcctggcttgctcaagtcctctctt

SEQ ID NO: 7345 - DNA, 25 bp, Homo sapien
tctctttctctctccggaaacgtga

SEQ ID NO: 7346 - DNA, 25 bp, Homo sapien
ctccggaaacgtgagtagctaatcg

SEQ ID NO: 7347 - DNA, 25 bp, Homo sapien
cgtgagtagctaatcgaaagttccg

SEQ ID NO: 7348 - DNA, 25 bp, Homo sapien
gtccctcggtcgcttcttcaactgt

SEQ ID NO: 7349 - DNA, 25 bp, Homo sapien
ccctagttgcggaagtgcctcgcct

SEQ ID NO: 7350 - DNA, 25 bp, Homo sapien
gactctttaaaagccggcggtgcgc

SEQ ID NO: 7351 - DNA, 25 bp, Homo sapien
tccacggtctacactgggcaggact

SEQ ID NO: 7352 - DNA, 25 bp, Homo sapien
ctttaagcagcttcccaagggattc

SEQ ID NO: 7353 - DNA, 25 bp, Homo sapien
tggccctaaaggagctgcattggta

SEQ ID NO: 7354 - DNA, 25 bp, Homo sapien
ccacagcgcgtgttaggaatgcaga

SEQ ID NO: 7355 - DNA, 25 bp, Homo sapien
agcatcccagagctttccgagcgga

SEQ ID NO: 7356 - DNA, 25 bp, Homo sapien
tccaggtttctaagggattcagcaa

SEQ ID NO: 7357 - DNA, 25 bp, Homo sapien
ctggcccatgtccttacctggactg

SEQ ID NO: 7358 - DNA, 25 bp, Homo sapien
cccagccgccttgtgcaaagatggc

SEQ ID NO: 7359 - DNA, 25 bp, Homo sapien
gttttctgtgcaaacgcgccctaca

SEQ ID NO: 7360 - DNA, 25 bp, Homo sapien
ccgggcgcatcggaactggttttct

SEQ ID NO: 7361 - DNA, 25 bp, Homo sapien
atgaaatgaactgcgatcccgggcg

SEQ ID NO: 7362 - DNA, 25 bp, Homo sapien
caccgcggccaattcatggacagga

SEQ ID NO: 7363 - DNA, 25 bp, Homo sapien
caggctcgcattgcacccagggagc

SEQ ID NO: 7364 - DNA, 25 bp, Homo sapien
gggcatatttgcaagcgcgctcggt

SEQ ID NO: 7365 - DNA, 25 bp, Homo sapien
ttttctctcgcaagcgccggggcaa

SEQ ID NO: 7366 - DNA, 25 bp, Homo sapien
tgattggttgcctttgaggctgctg

SEQ ID NO: 7367 - DNA, 25 bp, Homo sapien
gagacggacatcttacaccgccagg

SEQ ID NO: 7368 - DNA, 25 bp, Homo sapien
tgctggtcgctgcttcatttctcgc

SEQ ID NO: 7369 - DNA, 25 bp, Homo sapien
gtctcctctgattggttgcctttga

SEQ ID NO: 7370 - DNA, 25 bp, Homo sapien
tgctgtgtctcctctgattggttgc

SEQ ID NO: 7371 - DNA, 25 bp, Homo sapien
ctgattggctgttgaaagttccgcc

SEQ ID NO: 7372 - DNA, 25 bp, Homo sapien
atcttacaccgccaggcctatgcgg

SEQ ID NO: 7373 - DNA, 25 bp, Homo sapien
tgcttcatttctcgccggattcgtc

SEQ ID NO: 7374 - DNA, 25 bp, Homo sapien
gctctataacttctcgggtgctgcc

SEQ ID NO: 7375 - DNA, 25 bp, Homo sapien
agttcaacctgctggcttcctcttc

SEQ ID NO: 7376 - DNA, 25 bp, Homo sapien
gtgctgcacctgaagccctcgcagg

SEQ ID NO: 7377 - DNA, 25 bp, Homo sapien
ccacggagctcttcatctcgggtgc

SEQ ID NO: 7378 - DNA, 25 bp, Homo sapien
tggctcgctgttctctctgacgcgc

SEQ ID NO: 7379 - DNA, 25 bp, Homo sapien
gcaaacaggtaagcccagcgccggc

SEQ ID NO: 7380 - DNA, 25 bp, Homo sapien
gtcatgaaccttatctcggccctgg

SEQ ID NO: 7381 - DNA, 25 bp, Homo sapien
cgcagtccttcctggcaaacaggta

SEQ ID NO: 7382 - DNA, 25 bp, Homo sapien
caccaaactcggagggcaaggatcc

SEQ ID NO: 7383 - DNA, 25 bp, Homo sapien
tggccgcaagcccacgaaggcgaaa

SEQ ID NO: 7384 - DNA, 25 bp, Homo sapien
ccaggcgccatgcaggaattgctcg

SEQ ID NO: 7385 - DNA, 25 bp, Homo sapien
gggatactggcgtaggcccaccaaa

SEQ ID NO: 7386 - DNA, 25 bp, Homo sapien
tatgatccctatgggccctactgtc

SEQ ID NO: 7387 - DNA, 25 bp, Homo sapien
ccaagaagctgtacgcccaggagta

SEQ ID NO: 7388 - DNA, 25 bp, Homo sapien
gacaaggccgatgttcccgccgaca

SEQ ID NO: 7389 - DNA, 25 bp, Homo sapien
ctgactccttgctccaagacgagga

SEQ ID NO: 7390 - DNA, 25 bp, Homo sapien
accagcggacggcagacacggccag

SEQ ID NO: 7391 - DNA, 25 bp, Homo sapien
caccaggcagctcctcggactcgga

SEQ ID NO: 7392 - DNA, 25 bp, Homo sapien
ggcaggcggcaacgctacagcaggc

SEQ ID NO: 7393 - DNA, 25 bp, Homo sapien
taccaaggtgaaggctgaaccgccc

SEQ ID NO: 7394 - DNA, 25 bp, Homo sapien
caaagcccggcctaccaaggtgaag

SEQ ID NO: 7395 - DNA, 25 bp, Homo sapien
gggacaacctgccacatcccggctg

SEQ ID NO: 7396 - DNA, 25 bp, Homo sapien
agacacggccagagcggagtctcgc

SEQ ID NO: 7397 - DNA, 25 bp, Homo sapien
ggagtctcgccacgggacaacctgc

SEQ ID NO: 7398 - DNA, 25 bp, Homo sapien
atgagagacctgtgctttgccctga

SEQ ID NO: 7399 - DNA, 25 bp, Homo sapien
cctgggatcctagccaagctttcga

SEQ ID NO: 7400 - DNA, 25 bp, Homo sapien
cagcaggttttgaggagtagctcca

SEQ ID NO: 7401 - DNA, 25 bp, Homo sapien
gcatcgtctccgaggccttagtatg

SEQ ID NO: 7402 - DNA, 25 bp, Homo sapien
cgggctacgctaatgaggctactgc

SEQ ID NO: 7403 - DNA, 25 bp, Homo sapien
aagctagagtctccgcccgctaagg

SEQ ID NO: 7404 - DNA, 25 bp, Homo sapien
tttattctttcagcagacggggcgg

SEQ ID NO: 7405 - DNA, 25 bp, Homo sapien
ccctgtgacactgctgcttggggca

SEQ ID NO: 7406 - DNA, 25 bp, Homo sapien
cccagcaagccttgtgcgcgcaggt

SEQ ID NO: 7407 - DNA, 25 bp, Homo sapien
atgaatgtccgcgttcggtgtcgcc

SEQ ID NO: 7408 - DNA, 25 bp, Homo sapien
taatgaacctcagcgcgccaagccg

SEQ ID NO: 7409 - DNA, 25 bp, Homo sapien
ctcgttcacgtcagcttcccaaggg

SEQ ID NO: 7410 - DNA, 25 bp, Homo sapien
gcttgttgcatgaatgtccgcgttc

SEQ ID NO: 7411 - DNA, 25 bp, Homo sapien
tgcgcgcaggtgatgtttgctgaat

SEQ ID NO: 7412 - DNA, 25 bp, Homo sapien
ggattttgttttgttcagtgcaggg

SEQ ID NO: 7413 - DNA, 25 bp, Homo sapien
tcgccgtagagaccgttgccgggaa

SEQ ID NO: 7414 - DNA, 25 bp, Homo sapien
catgtgtcccattggcttctgggaa

SEQ ID NO: 7415 - DNA, 25 bp, Homo sapien
tctgttctgcctggcgcctcttacg

SEQ ID NO: 7416 - DNA, 25 bp, Homo sapien
aattcccttgcgtctgttctgcctg

SEQ ID NO: 7417 - DNA, 25 bp, Homo sapien
ttgaaatcccggcaagctcggcggc

SEQ ID NO: 7418 - DNA, 25 bp, Homo sapien
caagccacgggtcctagagggcttc

SEQ ID NO: 7419 - DNA, 25 bp, Homo sapien
ccggactacaattcccttgcgtctg

SEQ ID NO: 7420 - DNA, 25 bp, Homo sapien
acttggggcgtctctgggcctagac

SEQ ID NO: 7421 - DNA, 25 bp, Homo sapien
cgccgtgctcggtacttgaaatccc

SEQ ID NO: 7422 - DNA, 25 bp, Homo sapien
tcacctaagcgggaggtcctgtacg

SEQ ID NO: 7423 - DNA, 25 bp, Homo sapien
tgggccggcttgacaagtccgaccc

SEQ ID NO: 7424 - DNA, 25 bp, Homo sapien
cgccatcaagcggaccatcacggtg

SEQ ID NO: 7425 - DNA, 25 bp, Homo sapien
cacctcgtgtggtgaccgcgacagc

SEQ ID NO: 7426 - DNA, 25 bp, Homo sapien
gctggtccgcccacgcgcaagaagt

SEQ ID NO: 7427 - DNA, 25 bp, Homo sapien
acgacttcttgtccctgcatgcgga

SEQ ID NO: 7428 - DNA, 25 bp, Homo sapien
tcctgtacgactccgagggactgag

SEQ ID NO: 7429 - DNA, 25 bp, Homo sapien
gcaagatcctgacccaacggcggga

SEQ ID NO: 7430 - DNA, 25 bp, Homo sapien
cagccagggcaggatccgtggcttt

SEQ ID NO: 7431 - DNA, 25 bp, Homo sapien
aggtccagctgcgacaccagccagg

SEQ ID NO: 7432 - DNA, 25 bp, Homo sapien
gtgcggctcttgttcacccaggcca

SEQ ID NO: 7433 - DNA, 25 bp, Homo sapien
gattccgaaatcctcctgctgtgca

SEQ ID NO: 7434 - DNA, 25 bp, Homo sapien
gcacgcacctggaagattccgaaat

SEQ ID NO: 7435 - DNA, 25 bp, Homo sapien
cagccgggcccactaggagtccttt

SEQ ID NO: 7436 - DNA, 25 bp, Homo sapien
ttttattcccgtaaccctgcagctc

SEQ ID NO: 7437 - DNA, 25 bp, Homo sapien
gcctgcgcgtatagggcatttcctg

SEQ ID NO: 7438 - DNA, 25 bp, Homo sapien
cgggatgttgcacacggcaattcct

SEQ ID NO: 7439 - DNA, 25 bp, Homo sapien
agatggtagagtccgctgtctcttc

SEQ ID NO: 7440 - DNA, 25 bp, Homo sapien
tgcacacggcaattcctgaaaggga

SEQ ID NO: 7441 - DNA, 25 bp, Homo sapien
gagaaaacctcaagatcagtgggga

SEQ ID NO: 7442 - DNA, 25 bp, Homo sapien
ccgccctcctgagactcggttgttg

SEQ ID NO: 7443 - DNA, 25 bp, Homo sapien
gggaggcccaccttatcgtctagca

SEQ ID NO: 7444 - DNA, 25 bp, Homo sapien
ttatcgtctagcagacgcggggctg

SEQ ID NO: 7445 - DNA, 25 bp, Homo sapien
tcctgaaagggatgaggccaaggcc

SEQ ID NO: 7446 - DNA, 25 bp, Homo sapien
caggcgcgggaaagttgaactaata

SEQ ID NO: 7447 - DNA, 25 bp, Homo sapien
tccgggtagctctcaaactcgaggc

SEQ ID NO: 7448 - DNA, 25 bp, Homo sapien
cctttcccgtcagctgagctctaga

SEQ ID NO: 7449 - DNA, 25 bp, Homo sapien
gctgggagcgtcacatgcaaattga

SEQ ID NO: 7450 - DNA, 25 bp, Homo sapien
caaattgagcgtgcacccagcgttc

SEQ ID NO: 7451 - DNA, 25 bp, Homo sapien
gggctcttccgcgttacctacgatg

SEQ ID NO: 7452 - DNA, 25 bp, Homo sapien
agttcagtggaggagaccgcaagtt

SEQ ID NO: 7453 - DNA, 25 bp, Homo sapien
agcgttccgccctttctacgctggg

SEQ ID NO: 7454 - DNA, 25 bp, Homo sapien
ctgcgcagcaagctggtccgcctgt

SEQ ID NO: 7455 - DNA, 25 bp, Homo sapien
ttccaccctacagctggcctcggac

SEQ ID NO: 7456 - DNA, 25 bp, Homo sapien
gtccgcctgtcctccgactctttcg

SEQ ID NO: 7457 - DNA, 25 bp, Homo sapien
cccgcctggccctagccatggagct

SEQ ID NO: 7458 - DNA, 25 bp, Homo sapien
ctcagcgtggagcacgtgcacagct

SEQ ID NO: 7459 - DNA, 25 bp, Homo sapien
tggagcacgtgcacagcttcacgcc

SEQ ID NO: 7460 - DNA, 25 bp, Homo sapien
ctcccggccctctattggctggccc

SEQ ID NO: 7461 - DNA, 25 bp, Homo sapien
tgacgcggaccctgcctcttccacc

SEQ ID NO: 7462 - DNA, 25 bp, Homo sapien
gcgtgacgtcgcttccggataaacc

SEQ ID NO: 7463 - DNA, 25 bp, Homo sapien
tatcgtttgaggtgacggctcccta

SEQ ID NO: 7464 - DNA, 25 bp, Homo sapien
gccgcacgttccacatccggggata

SEQ ID NO: 7465 - DNA, 25 bp, Homo sapien
aatgaaatcttccagcggggtcgcg

SEQ ID NO: 7466 - DNA, 25 bp, Homo sapien
actagacggtattctcagacgggcc

SEQ ID NO: 7467 - DNA, 25 bp, Homo sapien
caccagtcgcgcttcttgcaataga

SEQ ID NO: 7468 - DNA, 25 bp, Homo sapien
ctacccgtgggccaattgccgtgtt

SEQ ID NO: 7469 - DNA, 25 bp, Homo sapien
cctgacctatgatggacgtattctc

SEQ ID NO: 7470 - DNA, 25 bp, Homo sapien
cctctgctgcgcacttcctagggtc

SEQ ID NO: 7471 - DNA, 25 bp, Homo sapien
ctagggtcgcctcgccaagccgttg

SEQ ID NO: 7472 - DNA, 25 bp, Homo sapien
cctcgccaagccgttgccttggaga

SEQ ID NO: 7473 - DNA, 25 bp, Homo sapien
ttgccttggagaccgaggttagcct

SEQ ID NO: 7474 - DNA, 25 bp, Homo sapien
ttggagaccgaggttagcctgaatc

SEQ ID NO: 7475 - DNA, 25 bp, Homo sapien
agaccgaggttagcctgaatctctg

SEQ ID NO: 7476 - DNA, 25 bp, Homo sapien
atgcgtgcctggggccttagccaga

SEQ ID NO: 7477 - DNA, 25 bp, Homo sapien
ccctctagtgaccggcggtgggact

SEQ ID NO: 7478 - DNA, 25 bp, Homo sapien
acctcctggtgggttccgccctcat

SEQ ID NO: 7479 - DNA, 25 bp, Homo sapien
tggacttcaccatcgacctggactt

SEQ ID NO: 7480 - DNA, 25 bp, Homo sapien
ccatcgacctggacttcaagggcca

SEQ ID NO: 7481 - DNA, 25 bp, Homo sapien
acttcaagggccagctgtgcgagct

SEQ ID NO: 7482 - DNA, 25 bp, Homo sapien
tgtgcgagctgtcctgctccaccga

SEQ ID NO: 7483 - DNA, 25 bp, Homo sapien
caccgactaccggatgcgctgaggc

SEQ ID NO: 7484 - DNA, 25 bp, Homo sapien
ctaccggatgcgctgaggcccggct

SEQ ID NO: 7485 - DNA, 25 bp, Homo sapien
ggctcatcgtcgcatagcctgcctg

SEQ ID NO: 7486 - DNA, 25 bp, Homo sapien
gccgcatgtgcacttgccctgcatt

SEQ ID NO: 7487 - DNA, 25 bp, Homo sapien
ttctcttccggaggggcgctcctca

SEQ ID NO: 7488 - DNA, 25 bp, Homo sapien
cagggtcccaactgtctactaaccg

SEQ ID NO: 7489 - DNA, 25 bp, Homo sapien
gcatctacaaccagagccagcgctt

SEQ ID NO: 7490 - DNA, 25 bp, Homo sapien
ccttttcttggaatcccgctgctta

SEQ ID NO: 7491 - DNA, 25 bp, Homo sapien
tggaatcccgctgcttagctacctg

SEQ ID NO: 7492 - DNA, 25 bp, Homo sapien
agctacctgcgggtgtcattggccc

SEQ ID NO: 7493 - DNA, 25 bp, Homo sapien
tgagggtgaggtcgcatctacaacc

SEQ ID NO: 7494 - DNA, 25 bp, Homo sapien
cctctcagtcgaggctgggtctcta

SEQ ID NO: 7495 - DNA, 25 bp, Homo sapien
caccgcctggcggagatcatatact

SEQ ID NO: 7496 - DNA, 25 bp, Homo sapien
acggaagtcccactgtctaccttga

SEQ ID NO: 7497 - DNA, 25 bp, Homo sapien
ccctggcgtgaaagggctgagattt

SEQ ID NO: 7498 - DNA, 25 bp, Homo sapien
gcgcctgacgttataatgcacctgg

SEQ ID NO: 7499 - DNA, 25 bp, Homo sapien
tgcgacctcccagctgagccttgtt

SEQ ID NO: 7500 - DNA, 25 bp, Homo sapien
ctggattcgctgtctccaccaagga

SEQ ID NO: 7501 - DNA, 25 bp, Homo sapien
gcctatctgtatgttggagcttcta

SEQ ID NO: 7502 - DNA, 25 bp, Homo sapien
atgcagagaaacctaataccgtgtg

SEQ ID NO: 7503 - DNA, 25 bp, Homo sapien
tgcacagaaacctaacaccgtgtgg

SEQ ID NO: 7504 - DNA, 25 bp, Homo sapien
ctcataccgtgtggatgacgcagta

SEQ ID NO: 7505 - DNA, 25 bp, Homo sapien
gtggatgacgcagtacctataccca

SEQ ID NO: 7506 - DNA, 25 bp, Homo sapien
accgtgtggatgacacagtatctac

SEQ ID NO: 7507 - DNA, 25 bp, Homo sapien
gtgcacggaaacctaacaccgtgtg

SEQ ID NO: 7508 - DNA, 25 bp, Homo sapien
tgacgcagtacctatatccaacgtg

SEQ ID NO: 7509 - DNA, 25 bp, Homo sapien
tgacgcagtacctatacccaacatg

SEQ ID NO: 7510 - DNA, 25 bp, Homo sapien
tctcgcccagcgctaggagcggcag

SEQ ID NO: 7511 - DNA, 25 bp, Homo sapien
tcgcggtggtctcgcccagcgctag

SEQ ID NO: 7512 - DNA, 25 bp, Homo sapien
attggctgtctcacccgcatccctc

SEQ ID NO: 7513 - DNA, 25 bp, Homo sapien
tcattggctgtctcacccgcatccc

SEQ ID NO: 7514 - DNA, 25 bp, Homo sapien
ttcccgcgccctcattggctgtctc

SEQ ID NO: 7515 - DNA, 25 bp, Homo sapien
tcttcccgcgccctcattggctgtc

SEQ ID NO: 7516 - DNA, 25 bp, Homo sapien
ctgcacgtaagcgggtgtgtgtcct

SEQ ID NO: 7517 - DNA, 25 bp, Homo sapien
ccgccagcccagctgcacgtaagcg

SEQ ID NO: 7518 - DNA, 25 bp, Homo sapien
taaacttgcgagttatacgccctgc

SEQ ID NO: 7519 - DNA, 25 bp, Homo sapien
gccacccgatgctgttcagttacca

SEQ ID NO: 7520 - DNA, 25 bp, Homo sapien
ctctccgacgaggacttcgactgga

SEQ ID NO: 7521 - DNA, 25 bp, Homo sapien
tgcagtggtacctgcggctcaagtc

SEQ ID NO: 7522 - DNA, 25 bp, Homo sapien
tcctggtgggcgtccaattatgtga

SEQ ID NO: 7523 - DNA, 25 bp, Homo sapien
aattatgtgagtcccgccaccgcca

SEQ ID NO: 7524 - DNA, 25 bp, Homo sapien
tgtgagctcgcctgctaaacttgcg

SEQ ID NO: 7525 - DNA, 25 bp, Homo sapien
cctgaagggctaaggttgtgagctc

SEQ ID NO: 7526 - DNA, 25 bp, Homo sapien
tgctgccactcacgcgggcctggag

SEQ ID NO: 7527 - DNA, 25 bp, Homo sapien
tgacagcacgtgacacggggagatt

SEQ ID NO: 7528 - DNA, 25 bp, Homo sapien
gtcagcctgagagcgacagccgacc

SEQ ID NO: 7529 - DNA, 25 bp, Homo sapien
catagccggccaggtcagcctgaga

SEQ ID NO: 7530 - DNA, 25 bp, Homo sapien
acttgtgccatagccggccaggtca

SEQ ID NO: 7531 - DNA, 25 bp, Homo sapien
agggctccgcgacttgtgccatagc

SEQ ID NO: 7532 - DNA, 25 bp, Homo sapien
ggagattgctggctcgcagccaccg

SEQ ID NO: 7533 - DNA, 25 bp, Homo sapien
cagcacgtgacacggggagattgct

SEQ ID NO: 7534 - DNA, 25 bp, Homo sapien
cacctgattgcggaccctgacacgg

SEQ ID NO: 7535 - DNA, 25 bp, Homo sapien
gcaggacgttgccttcaaacagacg

SEQ ID NO: 7536 - DNA, 25 bp, Homo sapien
ggacgttgccttcaaacagacgccg

SEQ ID NO: 7537 - DNA, 25 bp, Homo sapien
ggaacccatactcgccgatcagctt

SEQ ID NO: 7538 - DNA, 25 bp, Homo sapien
cgtctgcgcctgagtgcaggacccg

SEQ ID NO: 7539 - DNA, 25 bp, Homo sapien
gattgcggaccctgacacggcgctg

SEQ ID NO: 7540 - DNA, 25 bp, Homo sapien
cctgattgcggaccctgacacggcg

SEQ ID NO: 7541 - DNA, 25 bp, Homo sapien
cagcaggacgttgccttcaaacaga

SEQ ID NO: 7542 - DNA, 25 bp, Homo sapien
atgccggtgaacagcttctgcaatt

SEQ ID NO: 7543 - DNA, 25 bp, Homo sapien
acctcagctcttcgatgccggtgaa

SEQ ID NO: 7544 - DNA, 25 bp, Homo sapien
cgccgatctcgttttcgaggctccg

SEQ ID NO: 7545 - DNA, 25 bp, Homo sapien
ccacccatgtcaccgcccacctcag

SEQ ID NO: 7546 - DNA, 25 bp, Homo sapien
tctacccaccttcgttcctcgaggc

SEQ ID NO: 7547 - DNA, 25 bp, Homo sapien
cctggagactcctcccgtgtctcta

SEQ ID NO: 7548 - DNA, 25 bp, Homo sapien
cttcgatgccggtgaacagcttctg

SEQ ID NO: 7549 - DNA, 25 bp, Homo sapien
attcctgctcgctcacgtaggggcc

SEQ ID NO: 7550 - DNA, 25 bp, Homo sapien
aatcagtgtttgacctggccgcgcg

SEQ ID NO: 7551 - DNA, 25 bp, Homo sapien
gcggtgttcatctccgacatccgga

SEQ ID NO: 7552 - DNA, 25 bp, Homo sapien
gccaatcgtagcgtcgtgcctttgc

SEQ ID NO: 7553 - DNA, 25 bp, Homo sapien
cgggcccatgatacgcaatcgaacc

SEQ ID NO: 7554 - DNA, 25 bp, Homo sapien
ggagagccgctagatccaatcagtg

SEQ ID NO: 7555 - DNA, 25 bp, Homo sapien
caggtctacccgttcattggtccca

SEQ ID NO: 7556 - DNA, 25 bp, Homo sapien
ggaattgcaggcgtcgctccaccta

SEQ ID NO: 7557 - DNA, 25 bp, Homo sapien
cctatcccagccgagcggagtgaca

SEQ ID NO: 7558 - DNA, 25 bp, Homo sapien
aagtgccgtcacaaatggagcatcg

SEQ ID NO: 7559 - DNA, 25 bp, Homo sapien
tgtgcgccgtggcagcgatgggaaa

SEQ ID NO: 7560 - DNA, 25 bp, Homo sapien
atgcactgtggctcgggagatgagc

SEQ ID NO: 7561 - DNA, 25 bp, Homo sapien
atgagcgccatgacagagatgggaa

SEQ ID NO: 7562 - DNA, 25 bp, Homo sapien
cgcgccgtgacggagatgggaaagt

SEQ ID NO: 7563 - DNA, 25 bp, Homo sapien
agatgggaaagtggcctggagtcag

SEQ ID NO: 7564 - DNA, 25 bp, Homo sapien
ggaaagtgccgtcacaaatggagca

SEQ ID NO: 7565 - DNA, 25 bp, Homo sapien
aggtgggaaagtgccgtcacaaatg

SEQ ID NO: 7566 - DNA, 25 bp, Homo sapien
ccaaccgtgatgacgtccagggcta

SEQ ID NO: 7567 - DNA, 25 bp, Homo sapien
acgtccagggctatgccgccaagac

SEQ ID NO: 7568 - DNA, 25 bp, Homo sapien
tgctacagatcgtcaccaaccgtga

SEQ ID NO: 7569 - DNA, 25 bp, Homo sapien
gtggtaccgtgtgctacagatcgtc

SEQ ID NO: 7570 - DNA, 25 bp, Homo sapien
acctcatccgcattgcgggcgacta

SEQ ID NO: 7571 - DNA, 25 bp, Homo sapien
gactacagctggtacgtggacacca

SEQ ID NO: 7572 - DNA, 25 bp, Homo sapien
ggccgagaagtacgccgtggactac

SEQ ID NO: 7573 - DNA, 25 bp, Homo sapien
gcaggtcctgaaggtggccatcctg

SEQ ID NO: 7574 - DNA, 25 bp, Homo sapien
acaggcccgcaacgggtccagcagt

SEQ ID NO: 7575 - DNA, 25 bp, Homo sapien
ggcccgcagagtagacacagctcca

SEQ ID NO: 7576 - DNA, 25 bp, Homo sapien
ccagactgacgaaggtcgtgcccgc

SEQ ID NO: 7577 - DNA, 25 bp, Homo sapien
ggccggacaccaccagactgacgaa

SEQ ID NO: 7578 - DNA, 25 bp, Homo sapien
cagctccaggctcggcagcagagtc

SEQ ID NO: 7579 - DNA, 25 bp, Homo sapien
cgcgggttcacctgtggatacaact

SEQ ID NO: 7580 - DNA, 25 bp, Homo sapien
taggtgaatgactggagcgcagtcc

SEQ ID NO: 7581 - DNA, 25 bp, Homo sapien
tagcgggtgtcctaagagcgaaagc

SEQ ID NO: 7582 - DNA, 25 bp, Homo sapien
ccttcggtttagatacaggcgtcca

SEQ ID NO: 7583 - DNA, 25 bp, Homo sapien
gccgcgactgctcctgcagaatagg

SEQ ID NO: 7584 - DNA, 25 bp, Homo sapien
acagcagatgcacagtgccgcccgt

SEQ ID NO: 7585 - DNA, 25 bp, Homo sapien
gcggtccctcacgtggggactgtca

SEQ ID NO: 7586 - DNA, 25 bp, Homo sapien
gtcttggagcatggcggtaatcaga

SEQ ID NO: 7587 - DNA, 25 bp, Homo sapien
agcatggcggtaatcagagtaactc

SEQ ID NO: 7588 - DNA, 25 bp, Homo sapien
atcagagtaactcggcctgtggtcc

SEQ ID NO: 7589 - DNA, 25 bp, Homo sapien
aactcggcctgtggtccggagccgc

SEQ ID NO: 7590 - DNA, 25 bp, Homo sapien
cggcgcaggcgcatttctgctcatt

SEQ ID NO: 7591 - DNA, 25 bp, Homo sapien
agtgagtgctgtttccgcgactcta

SEQ ID NO: 7592 - DNA, 25 bp, Homo sapien
ctagaacgaagcctcagcgcgtgcc

SEQ ID NO: 7593 - DNA, 25 bp, Homo sapien
gcacaaacatggcagcattcccagc

SEQ ID NO: 7594 - DNA, 25 bp, Homo sapien
tgctcccggccatcgagtgagtgct

SEQ ID NO: 7595 - DNA, 25 bp, Homo sapien
ggaccctacttcgaggggctccgca

SEQ ID NO: 7596 - DNA, 25 bp, Homo sapien
aggggctccgcaagcactacctgct

SEQ ID NO: 7597 - DNA, 25 bp, Homo sapien
ttgtgattgagggtacggccaacct

SEQ ID NO: 7598 - DNA, 25 bp, Homo sapien
tgaagttgtggctcgcgcgtcttcc

SEQ ID NO: 7599 - DNA, 25 bp, Homo sapien
ccagcttggtgtcgccttcgttctt

SEQ ID NO: 7600 - DNA, 25 bp, Homo sapien
gctcatattactgctgactccgcgg

SEQ ID NO: 7601 - DNA, 25 bp, Homo sapien
cgcggcccgatttaaacgcgggctg

SEQ ID NO: 7602 - DNA, 25 bp, Homo sapien
ccggcacgctcgcttgtttttccta

SEQ ID NO: 7603 - DNA, 25 bp, Homo sapien
tttttcctattggagagttgctcgc

SEQ ID NO: 7604 - DNA, 25 bp, Homo sapien
agttgctcgctctccgggcaggaaa

SEQ ID NO: 7605 - DNA, 25 bp, Homo sapien
gggcgggctcatattactgctgact

SEQ ID NO: 7606 - DNA, 25 bp, Homo sapien
tgcctttgccagcagttctcgatgc

SEQ ID NO: 7607 - DNA, 25 bp, Homo sapien
cagcagttctcgatgcagatggacc

SEQ ID NO: 7608 - DNA, 25 bp, Homo sapien
cagatggacctgatccggcagcagc

SEQ ID NO: 7609 - DNA, 25 bp, Homo sapien
acctgatccggcagcagcttgagtt

SEQ ID NO: 7610 - DNA, 25 bp, Homo sapien
cagcttgagttcgaggcccagcaca

SEQ ID NO: 7611 - DNA, 25 bp, Homo sapien
agcacatccgctcgctgatggagga

SEQ ID NO: 7612 - DNA, 25 bp, Homo sapien
ccgctcgctgatggaggagcgcttc

SEQ ID NO: 7613 - DNA, 25 bp, Homo sapien
agcgcttcggcacctcggacgagat

SEQ ID NO: 7614 - DNA, 25 bp, Homo sapien
gagggatcattttacctccaggatc

SEQ ID NO: 7615 - DNA, 25 bp, Homo sapien
caagcactccgtagctggggaccgg

SEQ ID NO: 7616 - DNA, 25 bp, Homo sapien
ctgctgccaagcactccgtagctgg

SEQ ID NO: 7617 - DNA, 25 bp, Homo sapien
gatcccatgacgttctgctgccaag

SEQ ID NO: 7618 - DNA, 25 bp, Homo sapien
accggccttgcattggatcccatga

SEQ ID NO: 7619 - DNA, 25 bp, Homo sapien
tccaggatcccggtacaggtgaccg

SEQ ID NO: 7620 - DNA, 25 bp, Homo sapien
ggtgtcgggctgctcccgtccatac

SEQ ID NO: 7621 - DNA, 25 bp, Homo sapien
cggtacaggtgaccggcgtcctgca

SEQ ID NO: 7622 - DNA, 25 bp, Homo sapien
aatggcttcgtgagtggtgccagca

SEQ ID NO: 7623 - DNA, 25 bp, Homo sapien
agtgccgctgttccggaactcgcgc

SEQ ID NO: 7624 - DNA, 25 bp, Homo sapien
gccggatcatggacaatggcttcgt

SEQ ID NO: 7625 - DNA, 25 bp, Homo sapien
catggacaatggcttcgtgagtggt

SEQ ID NO: 7626 - DNA, 25 bp, Homo sapien
accctagtgccgctgttccggaact

SEQ ID NO: 7627 - DNA, 25 bp, Homo sapien
ttcgtgagtggtgccagcagacgca

SEQ ID NO: 7628 - DNA, 25 bp, Homo sapien
cggccagggcagagcgagcccggac

SEQ ID NO: 7629 - DNA, 25 bp, Homo sapien
cggatcatggacaatggcttcgtga

SEQ ID NO: 7630 - DNA, 25 bp, Homo sapien
ctgctggccacttgagaaagaactc

SEQ ID NO: 7631 - DNA, 25 bp, Homo sapien
tgaggaggcccttcccacaaatgtc

SEQ ID NO: 7632 - DNA, 25 bp, Homo sapien
gggctgtctcacacgtggtcacaca

SEQ ID NO: 7633 - DNA, 25 bp, Homo sapien
cctggtcataccctgttcacgtgga

SEQ ID NO: 7634 - DNA, 25 bp, Homo sapien
atcggcgcaggagaagtctttcttc

SEQ ID NO: 7635 - DNA, 25 bp, Homo sapien
ttcacgtggacatatccggccgaca

SEQ ID NO: 7636 - DNA, 25 bp, Homo sapien
cacgcgcacaggaacaggacactta

SEQ ID NO: 7637 - DNA, 25 bp, Homo sapien
tgcttcttgagaaaggtggacttcc

SEQ ID NO: 7638 - DNA, 25 bp, Homo sapien
agggtctctcggcagccctgacctt

SEQ ID NO: 7639 - DNA, 25 bp, Homo sapien
gttcctcggcggacggaaatgactc

SEQ ID NO: 7640 - DNA, 25 bp, Homo sapien
gccacttccgaccagggaggtcctg

SEQ ID NO: 7641 - DNA, 25 bp, Homo sapien
ccactttccagcgtacaggcagaga

SEQ ID NO: 7642 - DNA, 25 bp, Homo sapien
cgtttcccaggcgacgacgcgtgct

SEQ ID NO: 7643 - DNA, 25 bp, Homo sapien
accattaactgctccggaagtccca

SEQ ID NO: 7644 - DNA, 25 bp, Homo sapien
tcctcccacatccactagaaagttt

SEQ ID NO: 7645 - DNA, 25 bp, Homo sapien
taaacgggcttgagcggcgcacagc

SEQ ID NO: 7646 - DNA, 25 bp, Homo sapien
agagagacgacagacccaatcggga

SEQ ID NO: 7647 - DNA, 25 bp, Homo sapien
cccaatcgggaaacgggacagatgc

SEQ ID NO: 7648 - DNA, 25 bp, Homo sapien
aacgggacagatgccgctcctcggc

SEQ ID NO: 7649 - DNA, 25 bp, Homo sapien
tcccggatcggcctcagattagcag

SEQ ID NO: 7650 - DNA, 25 bp, Homo sapien
gctccctccctggacttcaatattt

SEQ ID NO: 7651 - DNA, 25 bp, Homo sapien
tggacttcaatatttccgcttcagc

SEQ ID NO: 7652 - DNA, 25 bp, Homo sapien
atgctcgccgcgatgcggtccaggt

SEQ ID NO: 7653 - DNA, 25 bp, Homo sapien
ctggaagtcgctggtgttaagccgc

SEQ ID NO: 7654 - DNA, 25 bp, Homo sapien
agggctcctcgaccatgggcagcat

SEQ ID NO: 7655 - DNA, 25 bp, Homo sapien
gctcctcgaccatgggcagcatagg

SEQ ID NO: 7656 - DNA, 25 bp, Homo sapien
ctccgtgccagtccgggcccggaag

SEQ ID NO: 7657 - DNA, 25 bp, Homo sapien
cagcataggcacaggggcccgggcg

SEQ ID NO: 7658 - DNA, 25 bp, Homo sapien
cgatgtcgtggaggcaacggcgcgc

SEQ ID NO: 7659 - DNA, 25 bp, Homo sapien
gcagcaccagctccgtgccagtccg

SEQ ID NO: 7660 - DNA, 25 bp, Homo sapien
cgaccatgggcagcataggcacagg

SEQ ID NO: 7661 - DNA, 25 bp, Homo sapien
ctcgaccatgggcagcataggcaca

SEQ ID NO: 7662 - DNA, 25 bp, Homo sapien
ggccgtcctcatatgctcaatcatg

SEQ ID NO: 7663 - DNA, 25 bp, Homo sapien
ccaccctcgaggttccagtggaata

SEQ ID NO: 7664 - DNA, 25 bp, Homo sapien
gtagccggatccaccttcagcgtct

SEQ ID NO: 7665 - DNA, 25 bp, Homo sapien
cccgtattaacatggccttagctga

SEQ ID NO: 7666 - DNA, 25 bp, Homo sapien
tgcctcttgtggtgtacagctcctc

SEQ ID NO: 7667 - DNA, 25 bp, Homo sapien
tctcgcgacggtgactcagaaattc

SEQ ID NO: 7668 - DNA, 25 bp, Homo sapien
ggggcttcatccgaaccagttgaca

SEQ ID NO: 7669 - DNA, 25 bp, Homo sapien
ctcagaaattcgtccggggccgctt

SEQ ID NO: 7670 - DNA, 25 bp, Homo sapien
atgtctcgcccagcgcacttctgag

SEQ ID NO: 7671 - DNA, 25 bp, Homo sapien
aggcctgagaagcatgtctcgccca

SEQ ID NO: 7672 - DNA, 25 bp, Homo sapien
ccagcccggtgtgtcttcattgttt

SEQ ID NO: 7673 - DNA, 25 bp, Homo sapien
tgtttcccagcacgaagcacagagt

SEQ ID NO: 7674 - DNA, 25 bp, Homo sapien
ccgcagcacatcaacgagctgacta

SEQ ID NO: 7675 - DNA, 25 bp, Homo sapien
caggcagcctcgttctgcacaggca

SEQ ID NO: 7676 - DNA, 25 bp, Homo sapien
tgcacaggcactttagcccgagcca

SEQ ID NO: 7677 - DNA, 25 bp, Homo sapien
agtacgtgctcagaatgctcccgga

SEQ ID NO: 7678 - DNA, 25 bp, Homo sapien
atccttttcggtttgccagagcgcc

SEQ ID NO: 7679 - DNA, 25 bp, Homo sapien
gcgcgttcaacagcacaagcccgga

SEQ ID NO: 7680 - DNA, 25 bp, Homo sapien
agaggtctcgatctgcacgtgcaca

SEQ ID NO: 7681 - DNA, 25 bp, Homo sapien
cgtcggccttcagcaccttcagatt

SEQ ID NO: 7682 - DNA, 25 bp, Homo sapien
cctgcggaagcttaggaacaccttg

SEQ ID NO: 7683 - DNA, 25 bp, Homo sapien
tccgaccacgtgtacgaggccagca

SEQ ID NO: 7684 - DNA, 25 bp, Homo sapien
agggaccgtccagtcatccttttcg

SEQ ID NO: 7685 - DNA, 25 bp, Homo sapien
tcaatgtgctcctcgcgccagaagg

SEQ ID NO: 7686 - DNA, 25 bp, Homo sapien
acgattcttcgtgcttggttgttcc

SEQ ID NO: 7687 - DNA, 25 bp, Homo sapien
cgtagtgaaagagctgcggaccctg

SEQ ID NO: 7688 - DNA, 25 bp, Homo sapien
tgttcctgcgcagtagcccaccagt

SEQ ID NO: 7689 - DNA, 25 bp, Homo sapien
tagactcgatgtttgtcagcccgcg

SEQ ID NO: 7690 - DNA, 25 bp, Homo sapien
gccatggagtgagtaaccgcttacc

SEQ ID NO: 7691 - DNA, 25 bp, Homo sapien
tgctccgccacccagtatatatctg

SEQ ID NO: 7692 - DNA, 25 bp, Homo sapien
gtaaaggcaattggaccgctcgggc

SEQ ID NO: 7693 - DNA, 25 bp, Homo sapien
gtcctcggatcacagtctcttctca

SEQ ID NO: 7694 - DNA, 25 bp, Homo sapien
cctcacctctgtacttggggactgg

SEQ ID NO: 7695 - DNA, 25 bp, Homo sapien
ggggattattccctcattgctcatc

SEQ ID NO: 7696 - DNA, 25 bp, Homo sapien
tgcagccgctcagagaagcttctcg

SEQ ID NO: 7697 - DNA, 25 bp, Homo sapien
tctagccgctttggaacgccttctg

SEQ ID NO: 7698 - DNA, 25 bp, Homo sapien
gccttctggttctactgcgcatgtg

SEQ ID NO: 7699 - DNA, 25 bp, Homo sapien
cgtttccatggcaacctaccgcttg

SEQ ID NO: 7700 - DNA, 25 bp, Homo sapien
ctaccgcttgctcttcggaaaaggt

SEQ ID NO: 7701 - DNA, 25 bp, Homo sapien
tggactacaaactgatgccgcctgg

SEQ ID NO: 7702 - DNA, 25 bp, Homo sapien
gcgcgcaaatgtcactcgtcctcga

SEQ ID NO: 7703 - DNA, 25 bp, Homo sapien
tctgctgaaggtctcagtggccctc

SEQ ID NO: 7704 - DNA, 25 bp, Homo sapien
ctgccactgcgctatttgtactaca

SEQ ID NO: 7705 - DNA, 25 bp, Homo sapien
acccagattcgaaggttatccaaga

SEQ ID NO: 7706 - DNA, 25 bp, Homo sapien
tcccaagccggtcaagtggaaatga

SEQ ID NO: 7707 - DNA, 25 bp, Homo sapien
ccgctgtttaccgtttgcttgcaac

SEQ ID NO: 7708 - DNA, 25 bp, Homo sapien
ggaagcggctccatttacaagtgta

SEQ ID NO: 7709 - DNA, 25 bp, Homo sapien
gtcctcgacgtggagttctgctgaa

SEQ ID NO: 7710 - DNA, 25 bp, Homo sapien
cctcgcgcctggagcagattgacaa

SEQ ID NO: 7711 - DNA, 25 bp, Homo sapien
gcccacatcatcacgggtgagcaga

SEQ ID NO: 7712 - DNA, 25 bp, Homo sapien
aacggggctcctcgagttctgcccg

SEQ ID NO: 7713 - DNA, 25 bp, Homo sapien
atcatcacgggtgagcagactgggt

SEQ ID NO: 7714 - DNA, 25 bp, Homo sapien
ggcagaacggggctcctcgagttct

SEQ ID NO: 7715 - DNA, 25 bp, Homo sapien
caggaccgagtgcagcagacggagc

SEQ ID NO: 7716 - DNA, 25 bp, Homo sapien
agcagattgacaaggagctgctgga

SEQ ID NO: 7717 - DNA, 25 bp, Homo sapien
cctggagcagattgacaaggagctg

SEQ ID NO: 7718 - DNA, 25 bp, Homo sapien
ctgatggcagatgcgggagaaactc

SEQ ID NO: 7719 - DNA, 25 bp, Homo sapien
ttaccggagcccgtaagcagtatgg

SEQ ID NO: 7720 - DNA, 25 bp, Homo sapien
gaaacgcctgtctttctccatggca

SEQ ID NO: 7721 - DNA, 25 bp, Homo sapien
acacgaagtcgtggcttattctggc

SEQ ID NO: 7722 - DNA, 25 bp, Homo sapien
atggcaactgtctacgccgcaggct

SEQ ID NO: 7723 - DNA, 25 bp, Homo sapien
cgcgcctgtcagactccctgatgaa

SEQ ID NO: 7724 - DNA, 25 bp, Homo sapien
cacggcaaccgtcaactctggaaac

SEQ ID NO: 7725 - DNA, 25 bp, Homo sapien
agctgcgtctatttcctgtggatca

SEQ ID NO: 7726 - DNA, 25 bp, Homo sapien
ccgcactgatactaggtgggactca

SEQ ID NO: 7727 - DNA, 25 bp, Homo sapien
tgtctcggaactgtaagtcccggta

SEQ ID NO: 7728 - DNA, 25 bp, Homo sapien
cctgagcagtccctgtctcggaact

SEQ ID NO: 7729 - DNA, 25 bp, Homo sapien
cgccggactcctggcaaacagcaga

SEQ ID NO: 7730 - DNA, 25 bp, Homo sapien
ggagcttctgctagcctgtctggcc

SEQ ID NO: 7731 - DNA, 25 bp, Homo sapien
ccgagtcgtctgagccgcactgata

SEQ ID NO: 7732 - DNA, 25 bp, Homo sapien
gcaaacagcagacgcccaattcctg

SEQ ID NO: 7733 - DNA, 25 bp, Homo sapien
gattccgctggacagccaggccttc

SEQ ID NO: 7734 - DNA, 25 bp, Homo sapien
agagcagcagaagggtcaaagccag

SEQ ID NO: 7735 - DNA, 25 bp, Homo sapien
caaggggtcgcactgcaggcagccc

SEQ ID NO: 7736 - DNA, 25 bp, Homo sapien
cagcaccaaggggtcgcactgcagg

SEQ ID NO: 7737 - DNA, 25 bp, Homo sapien
ttcagcgcgtagtcccggaagaaag

SEQ ID NO: 7738 - DNA, 25 bp, Homo sapien
ccacaaacacgttcagcgcgtagtc

SEQ ID NO: 7739 - DNA, 25 bp, Homo sapien
gtggtctccggcatccctcgcccag

SEQ ID NO: 7740 - DNA, 25 bp, Homo sapien
tgtgacgtcacagagagaacccggc

SEQ ID NO: 7741 - DNA, 25 bp, Homo sapien
gacgtcacagagagaacccggcccg

SEQ ID NO: 7742 - DNA, 25 bp, Homo sapien
cccgccagccgctctttttgattgg

SEQ ID NO: 7743 - DNA, 25 bp, Homo sapien
cattcatgccttgcgcacaaagcgg

SEQ ID NO: 7744 - DNA, 25 bp, Homo sapien
ggtgacgcggacactcaccttgggc

SEQ ID NO: 7745 - DNA, 25 bp, Homo sapien
gcggacactcaccttgggcgcgcag

SEQ ID NO: 7746 - DNA, 25 bp, Homo sapien
gctctttttgattggcggctcccgt

SEQ ID NO: 7747 - DNA, 25 bp, Homo sapien
gacaacttctgattggcccagcccg

SEQ ID NO: 7748 - DNA, 25 bp, Homo sapien
ccgcgttcttttcccacggctggca

SEQ ID NO: 7749 - DNA, 25 bp, Homo sapien
gctggcacccttcgacaacttctga

SEQ ID NO: 7750 - DNA, 25 bp, Homo sapien
cgggctcccgccctgtgacgcgacg

SEQ ID NO: 7751 - DNA, 25 bp, Homo sapien
gcaggtgctgggtgacatcagagcc

SEQ ID NO: 7752 - DNA, 25 bp, Homo sapien
tcccgccctgtgacgcgacggggcc

SEQ ID NO: 7753 - DNA, 25 bp, Homo sapien
gcggaggtcgctgcacctgaagaga

SEQ ID NO: 7754 - DNA, 25 bp, Homo sapien
tgcacctgaagagaacggggattcc

SEQ ID NO: 7755 - DNA, 25 bp, Homo sapien
gtagccccgaggatctgcgagttga

SEQ ID NO: 7756 - DNA, 25 bp, Homo sapien
cacctgaagagaacggggattcccg

SEQ ID NO: 7757 - DNA, 25 bp, Homo sapien
tgaagagaacggggattcccgcgcc

SEQ ID NO: 7758 - DNA, 25 bp, Homo sapien
agcggtactactccggcctcatcta

SEQ ID NO: 7759 - DNA, 25 bp, Homo sapien
tcatctacgtgagtgggctcctgct

SEQ ID NO: 7760 - DNA, 25 bp, Homo sapien
tgccttcggagcttcacgggttcga

SEQ ID NO: 7761 - DNA, 25 bp, Homo sapien
cgggaccagatccagcgcatgaacc

SEQ ID NO: 7762 - DNA, 25 bp, Homo sapien
cccaagttcagcaaggccgaggaca

SEQ ID NO: 7763 - DNA, 25 bp, Homo sapien
atggccgagctgacctgcctcaacg

SEQ ID NO: 7764 - DNA, 25 bp, Homo sapien
cacaacctccgggagcggtactact

SEQ ID NO: 7765 - DNA, 25 bp, Homo sapien
tgacctgcctcaacgaggcctcggt

SEQ ID NO: 7766 - DNA, 25 bp, Homo sapien
gttctgctgcgctctggttccagct

SEQ ID NO: 7767 - DNA, 25 bp, Homo sapien
tcgcttccgaagctccgtggcttct

SEQ ID NO: 7768 - DNA, 25 bp, Homo sapien
ggcttctcctcactccggcgggtga

SEQ ID NO: 7769 - DNA, 25 bp, Homo sapien
ggtgactccggctttgctgaggctc

SEQ ID NO: 7770 - DNA, 25 bp, Homo sapien
tcctcctggttcctgacgacgctgg

SEQ ID NO: 7771 - DNA, 25 bp, Homo sapien
acgacgctggtttgtgttgcttctc

SEQ ID NO: 7772 - DNA, 25 bp, Homo sapien
gttgcttctcggctcgtgctgcctc

SEQ ID NO: 7773 - DNA, 25 bp, Homo sapien
caaacaccgacttcgcatgaggctc

SEQ ID NO: 7774 - DNA, 25 bp, Homo sapien
gcatccgcatctgtcgccagggctt

SEQ ID NO: 7775 - DNA, 25 bp, Homo sapien
ggtgctggaccagcttcgctgcaac

SEQ ID NO: 7776 - DNA, 25 bp, Homo sapien
gtcctggagggcatccgcatctgtc

SEQ ID NO: 7777 - DNA, 25 bp, Homo sapien
agcttcgctgcaacggggtcctgga

SEQ ID NO: 7778 - DNA, 25 bp, Homo sapien
accagcttcgctgcaacggggtcct

SEQ ID NO: 7779 - DNA, 25 bp, Homo sapien
tgctggaccagcttcgctgcaacgg

SEQ ID NO: 7780 - DNA, 25 bp, Homo sapien
agcggtgagctagagcgagggccca

SEQ ID NO: 7781 - DNA, 25 bp, Homo sapien
cccaaccgcatcctcttccaggagt

SEQ ID NO: 7782 - DNA, 25 bp, Homo sapien
gctggagcggcagaaccgggccctg

SEQ ID NO: 7783 - DNA, 25 bp, Homo sapien
gtcggcaagagcgtgagcagggccc

SEQ ID NO: 7784 - DNA, 25 bp, Homo sapien
cagcaaggatgacgtcggcaagagc

SEQ ID NO: 7785 - DNA, 25 bp, Homo sapien
ctgagcagcaaggatgacgtcggca

SEQ ID NO: 7786 - DNA, 25 bp, Homo sapien
aggcactgctgagcagcaaggatga

SEQ ID NO: 7787 - DNA, 25 bp, Homo sapien
tgtcactgacacgggcactggagga

SEQ ID NO: 7788 - DNA, 25 bp, Homo sapien
cagtggaggaacgtgagcgggccga

SEQ ID NO: 7789 - DNA, 25 bp, Homo sapien
actgctgagcagcaaggatgacgtc

SEQ ID NO: 7790 - DNA, 25 bp, Homo sapien
cgtgattgaagaccgcctacctgtg

SEQ ID NO: 7791 - DNA, 25 bp, Homo sapien
ttcttgcccgctagtccacgtaatg

SEQ ID NO: 7792 - DNA, 25 bp, Homo sapien
ggccgggactatcgaagattgctta

SEQ ID NO: 7793 - DNA, 25 bp, Homo sapien
tgtggtctcctccatccctgagtgc

SEQ ID NO: 7794 - DNA, 25 bp, Homo sapien
tgagcccttaggatcgatttgttta

SEQ ID NO: 7795 - DNA, 25 bp, Homo sapien
tgcgtcctccaagaatccctgggtg

SEQ ID NO: 7796 - DNA, 25 bp, Homo sapien
ttctgcatcccaaagagcgttgctc

SEQ ID NO: 7797 - DNA, 25 bp, Homo sapien
ctccgcacatgcaatcacggttgtc

SEQ ID NO: 7798 - DNA, 25 bp, Homo sapien
ccaacaatgcggggccggcaaaaca

SEQ ID NO: 7799 - DNA, 25 bp, Homo sapien
gacgtaggccattgccagcagcctc

SEQ ID NO: 7800 - DNA, 25 bp, Homo sapien
tccaccacgagcacgcagagcgggg

SEQ ID NO: 7801 - DNA, 25 bp, Homo sapien
cgcagagcggggatttctacgaaaa

SEQ ID NO: 7802 - DNA, 25 bp, Homo sapien
aatcctaaacgtggggtcctctgca

SEQ ID NO: 7803 - DNA, 25 bp, Homo sapien
cggtatgacgacgtaggccattgcc

SEQ ID NO: 7804 - DNA, 25 bp, Homo sapien
tttcacttgcgctcccggggagccg

SEQ ID NO: 7805 - DNA, 25 bp, Homo sapien
tcgtcgccggcggaaagcgagccac

SEQ ID NO: 7806 - DNA, 25 bp, Homo sapien
tcctccctgagtggcgcagtgaggc

SEQ ID NO: 7807 - DNA, 25 bp, Homo sapien
atgctaattccaacttggatcgggg

SEQ ID NO: 7808 - DNA, 25 bp, Homo sapien
tagtggctccgcgaaagtgcacaca

SEQ ID NO: 7809 - DNA, 25 bp, Homo sapien
gatactcctcactacaaatcggctc

SEQ ID NO: 7810 - DNA, 25 bp, Homo sapien
cctcccggctatttgctcttcttta

SEQ ID NO: 7811 - DNA, 25 bp, Homo sapien
cccgagaggatgctaattccaactt

SEQ ID NO: 7812 - DNA, 25 bp, Homo sapien
tcagcgcggcatggctcccggttcg

SEQ ID NO: 7813 - DNA, 25 bp, Homo sapien
cggggtctctttttgcaaaccaatg

SEQ ID NO: 7814 - DNA, 25 bp, Homo sapien
ccatgaaccgtgaagtgaccacact

SEQ ID NO: 7815 - DNA, 25 bp, Homo sapien
gcagcgtgagctggaagatgtcaca

SEQ ID NO: 7816 - DNA, 25 bp, Homo sapien
gccgagtccatgaaccgtgaagtga

SEQ ID NO: 7817 - DNA, 25 bp, Homo sapien
gtgaccacactgaggaaccggcttc

SEQ ID NO: 7818 - DNA, 25 bp, Homo sapien
aaccggcttcggtatggtcatccca

SEQ ID NO: 7819 - DNA, 25 bp, Homo sapien
ggtcatcccacgtacaggcctgacg

SEQ ID NO: 7820 - DNA, 25 bp, Homo sapien
gtggggagcaccctaactccataaa

SEQ ID NO: 7821 - DNA, 25 bp, Homo sapien
gatgtcacagagtcggccgagtcca

SEQ ID NO: 7822 - DNA, 25 bp, Homo sapien
ccaggaggatacagcgcgcacgctg

SEQ ID NO: 7823 - DNA, 25 bp, Homo sapien
acgcggcgctgcacaacatcgtctt

SEQ ID NO: 7824 - DNA, 25 bp, Homo sapien
acaacatcgtcttctcgcagccgga

SEQ ID NO: 7825 - DNA, 25 bp, Homo sapien
cgcgcaaggagatgcgcgtcctgca

SEQ ID NO: 7826 - DNA, 25 bp, Homo sapien
cgtcctgcacgtgctggagcagatc

SEQ ID NO: 7827 - DNA, 25 bp, Homo sapien
cagatccgggcctactgcgagacct

SEQ ID NO: 7828 - DNA, 25 bp, Homo sapien
cctccgcgcaattaacgtgcagcta

SEQ ID NO: 7829 - DNA, 25 bp, Homo sapien
attaacgtgcagctagggcttcccg

SEQ ID NO: 7830 - DNA, 25 bp, Homo sapien
gacgaagcggaccacccgcaggaag

SEQ ID NO: 7831 - DNA, 25 bp, Homo sapien
gatgcggacgaagcggaccacccgc

SEQ ID NO: 7832 - DNA, 25 bp, Homo sapien
caggatgcggacgaagcggaccacc

SEQ ID NO: 7833 - DNA, 25 bp, Homo sapien
gcacgtctttggcggccttggagct

SEQ ID NO: 7834 - DNA, 25 bp, Homo sapien
ccacgaagtgccgggtcagcttgaa

SEQ ID NO: 7835 - DNA, 25 bp, Homo sapien
ctggcgcggagcgtgtgtcccagca

SEQ ID NO: 7836 - DNA, 25 bp, Homo sapien
ccttggagctgaggcccgagaggcc

SEQ ID NO: 7837 - DNA, 25 bp, Homo sapien
cggggtcggcgccaatgcgctcagc

SEQ ID NO: 7838 - DNA, 25 bp, Homo sapien
cgcagccgcagtgttgctgctttcc

SEQ ID NO: 7839 - DNA, 25 bp, Homo sapien
cgcagcggctaggggccgtcttaac

SEQ ID NO: 7840 - DNA, 25 bp, Homo sapien
ggagcctattcaacgcgcagccgca

SEQ ID NO: 7841 - DNA, 25 bp, Homo sapien
ccgcagtgttgctgctttccggcgg

SEQ ID NO: 7842 - DNA, 25 bp, Homo sapien
aggccaagggccaagagtctaatta

SEQ ID NO: 7843 - DNA, 25 bp, Homo sapien
ggccaagagtctaattaactccttc

SEQ ID NO: 7844 - DNA, 25 bp, Homo sapien
acggcggccagtaccgcggacagct

SEQ ID NO: 7845 - DNA, 25 bp, Homo sapien
ttccgggccggagcctattcaacgc

SEQ ID NO: 7846 - DNA, 25 bp, Homo sapien
tcgagcggtacgtctcatggcgcac

SEQ ID NO: 7847 - DNA, 25 bp, Homo sapien
aagcagaggcgcttgagctcgccgc

SEQ ID NO: 7848 - DNA, 25 bp, Homo sapien
gcgcctcgaaggagtcgagcgcctc

SEQ ID NO: 7849 - DNA, 25 bp, Homo sapien
cgaaggagtcgagcgcctcctcagc

SEQ ID NO: 7850 - DNA, 25 bp, Homo sapien
aagccgagctcctcctcaaacaggg

SEQ ID NO: 7851 - DNA, 25 bp, Homo sapien
cgtacgcgaagactcccgggtgccg

SEQ ID NO: 7852 - DNA, 25 bp, Homo sapien
gtcgtagtcgaagcgtgccgccgcc

SEQ ID NO: 7853 - DNA, 25 bp, Homo sapien
cggtcaaagaagaactcgtcggcgc

SEQ ID NO: 7854 - DNA, 25 bp, Homo sapien
tgaggcaatataggcaggaccgata

SEQ ID NO: 7855 - DNA, 25 bp, Homo sapien
ataggcaggaccgataaaaaatggg

SEQ ID NO: 7856 - DNA, 25 bp, Homo sapien
gcaccgtcaagactgaggcaatata

SEQ ID NO: 7857 - DNA, 25 bp, Homo sapien
aaagcgccaggaagcaccgtcaaga

SEQ ID NO: 7858 - DNA, 25 bp, Homo sapien
acaccgcggcggactgcagattgga

SEQ ID NO: 7859 - DNA, 25 bp, Homo sapien
ttctaacgaacgctacaccgcggcg

SEQ ID NO: 7860 - DNA, 25 bp, Homo sapien
ctaggagtctcagaggtcgggttct

SEQ ID NO: 7861 - DNA, 25 bp, Homo sapien
cgaggcgagaacttctaacgaacgc

SEQ ID NO: 7862 - DNA, 25 bp, Homo sapien
cacggagccaggagcctttgacgaa

SEQ ID NO: 7863 - DNA, 25 bp, Homo sapien
tgagcaaactgcaaggcgacaaggc

SEQ ID NO: 7864 - DNA, 25 bp, Homo sapien
aggcggacgtcaccctgagcaaact

SEQ ID NO: 7865 - DNA, 25 bp, Homo sapien
cgaagcgatgtccaaggcccggaag

SEQ ID NO: 7866 - DNA, 25 bp, Homo sapien
tcgccgaggatccacacaggtactg

SEQ ID NO: 7867 - DNA, 25 bp, Homo sapien
ttttactgagtagcgctagctctgc

SEQ ID NO: 7868 - DNA, 25 bp, Homo sapien
gactcgtagtacaaggcccatcaca

SEQ ID NO: 7869 - DNA, 25 bp, Homo sapien
tccgtgggtccatgcacaaagcttt

SEQ ID NO: 7870 - DNA, 25 bp, Homo sapien
ttagttctgggtagcaagaggctga

SEQ ID NO: 7871 - DNA, 25 bp, Homo sapien
gattgccagatttttcgaccggtcg

SEQ ID NO: 7872 - DNA, 25 bp, Homo sapien
cgaccggtcgttttgtcgaatcatt

SEQ ID NO: 7873 - DNA, 25 bp, Homo sapien
tcgaatcatttagttctgggtagca

SEQ ID NO: 7874 - DNA, 25 bp, Homo sapien
gggatgcgattaaaggattgccaga

SEQ ID NO: 7875 - DNA, 25 bp, Homo sapien
agatccgggggaatggtatccttgc

SEQ ID NO: 7876 - DNA, 25 bp, Homo sapien
ttgcccccttgaacaggaactggta

SEQ ID NO: 7877 - DNA, 25 bp, Homo sapien
cttttgacggaaggtagcgtaggcg

SEQ ID NO: 7878 - DNA, 25 bp, Homo sapien
agggcctggaaaccggacaagcaga

SEQ ID NO: 7879 - DNA, 25 bp, Homo sapien
aagaagacgtcaccgaggatccaga

SEQ ID NO: 7880 - DNA, 25 bp, Homo sapien
cgacaactgggtgtcgcggccacaa

SEQ ID NO: 7881 - DNA, 25 bp, Homo sapien
tgcaaggcaacaagacgacaactgg

SEQ ID NO: 7882 - DNA, 25 bp, Homo sapien
agaggcggacgccatttcgagtagt

SEQ ID NO: 7883 - DNA, 25 bp, Homo sapien
gtcaccgaggatccagaagggccct

SEQ ID NO: 7884 - DNA, 25 bp, Homo sapien
atgcgcttcacttgggcgtcacccg

SEQ ID NO: 7885 - DNA, 25 bp, Homo sapien
catttcgagtagtctgcaaggcaac

SEQ ID NO: 7886 - DNA, 25 bp, Homo sapien
ctaagcggaccggaagttcgtcaag

SEQ ID NO: 7887 - DNA, 25 bp, Homo sapien
gagtttccaacttccgtgcggggca

SEQ ID NO: 7888 - DNA, 25 bp, Homo sapien
agttcgtcaagtttcacgctccgcc

SEQ ID NO: 7889 - DNA, 25 bp, Homo sapien
ttgccggaagaagtggcgaagttac

SEQ ID NO: 7890 - DNA, 25 bp, Homo sapien
cttttgagggtatttgagtagcggc

SEQ ID NO: 7891 - DNA, 25 bp, Homo sapien
aacccaggtaggtgcacccgagagt

SEQ ID NO: 7892 - DNA, 25 bp, Homo sapien
ccagggcaacaggagtagttcactc

SEQ ID NO: 7893 - DNA, 25 bp, Homo sapien
agttcactccgcgagaggccgtcca

SEQ ID NO: 7894 - DNA, 25 bp, Homo sapien
aggtgcagacgttccctaggctgct

SEQ ID NO: 7895 - DNA, 25 bp, Homo sapien
agcactgacccggaggttctgccga

SEQ ID NO: 7896 - DNA, 25 bp, Homo sapien
cccgaaggcccggagtctgagacga

SEQ ID NO: 7897 - DNA, 25 bp, Homo sapien
cccggtgagaaatggcgagagccac

SEQ ID NO: 7898 - DNA, 25 bp, Homo sapien
tgagaaatggcgagagccacagccg

SEQ ID NO: 7899 - DNA, 25 bp, Homo sapien
atgccgagcgcaccctcggggagct

SEQ ID NO: 7900 - DNA, 25 bp, Homo sapien
gaaggtgcagacgttccctaggctg

SEQ ID NO: 7901 - DNA, 25 bp, Homo sapien
agagacgccctcaggagaagccgcc

SEQ ID NO: 7902 - DNA, 25 bp, Homo sapien
agcagtggggtaacgtgcacaggaa

SEQ ID NO: 7903 - DNA, 25 bp, Homo sapien
gtaacgtgcacaggaaggtgtcatc

SEQ ID NO: 7904 - DNA, 25 bp, Homo sapien
ggtaacgtgcacaggaaggtgtcat

SEQ ID NO: 7905 - DNA, 25 bp, Homo sapien
taacgtgcacaggaaggtgacgtcc

SEQ ID NO: 7906 - DNA, 25 bp, Homo sapien
taacgtgcacaggaaggtgacgtcg

SEQ ID NO: 7907 - DNA, 25 bp, Homo sapien
acgtgcacaggaaggtgacgtcccg

SEQ ID NO: 7908 - DNA, 25 bp, Homo sapien
acgtgcacaggaaggtgtcatcgcg

SEQ ID NO: 7909 - DNA, 25 bp, Homo sapien
aacgtgcacaggaaggtgacgtcgc

SEQ ID NO: 7910 - DNA, 25 bp, Homo sapien
cgcaagcgaaagaagggcccagccc

SEQ ID NO: 7911 - DNA, 25 bp, Homo sapien
ctgggccacgagctttgccgtgtct

SEQ ID NO: 7912 - DNA, 25 bp, Homo sapien
ctacaacgtgctcagctgcgaaggc

SEQ ID NO: 7913 - DNA, 25 bp, Homo sapien
ggacgctttcatgcggcgcaagtgc

SEQ ID NO: 7914 - DNA, 25 bp, Homo sapien
cggaacctgccagatggacgctttc

SEQ ID NO: 7915 - DNA, 25 bp, Homo sapien
cttcttccggcgcagtgtggtccgt

SEQ ID NO: 7916 - DNA, 25 bp, Homo sapien
tgcgaaggctgcaagggcttcttcc

SEQ ID NO: 7917 - DNA, 25 bp, Homo sapien
gaagaggaaccagagcgcaagcgaa

SEQ ID NO: 7918 - DNA, 25 bp, Homo sapien
cgtggaggcgttgcagcagccctac

SEQ ID NO: 7919 - DNA, 25 bp, Homo sapien
cacgcgcatcaagaggccgcaggta

SEQ ID NO: 7920 - DNA, 25 bp, Homo sapien
tgcagcagccctacgtggaggcgct

SEQ ID NO: 7921 - DNA, 25 bp, Homo sapien
atcaacatcttctcggccgaccggc

SEQ ID NO: 7922 - DNA, 25 bp, Homo sapien
gacgacgctgagtacgccctgctca

SEQ ID NO: 7923 - DNA, 25 bp, Homo sapien
atcttcgagttctcgcgggccatgc

SEQ ID NO: 7924 - DNA, 25 bp, Homo sapien
aggcctgcaggtggagttcatcaac

SEQ ID NO: 7925 - DNA, 25 bp, Homo sapien
gctgctgtcctacacgcgcatcaag

SEQ ID NO: 7926 - DNA, 25 bp, Homo sapien
aagaccttgcctctgtgccgcggag

SEQ ID NO: 7927 - DNA, 25 bp, Homo sapien
tgcacgttacggagaccatcacatg

SEQ ID NO: 7928 - DNA, 25 bp, Homo sapien
cccaagggtcgctggagtcagtatc

SEQ ID NO: 7929 - DNA, 25 bp, Homo sapien
gcagggattgttttcattctcagcc

SEQ ID NO: 7930 - DNA, 25 bp, Homo sapien
cgctaatgagggctttgcagggatt

SEQ ID NO: 7931 - DNA, 25 bp, Homo sapien
tgcagccgccggtaattcgctaatg

SEQ ID NO: 7932 - DNA, 25 bp, Homo sapien
aggggcgaagcctgtaatcactgca

SEQ ID NO: 7933 - DNA, 25 bp, Homo sapien
ctaggcctcaagtcccgaccgtgga

SEQ ID NO: 7934 - DNA, 25 bp, Homo sapien
tcgtccgacgatagcttcagcctca

SEQ ID NO: 7935 - DNA, 25 bp, Homo sapien
gggtactgcccacgcgaacatatgc

SEQ ID NO: 7936 - DNA, 25 bp, Homo sapien
tgctgcgtaatctggtgcactccaa

SEQ ID NO: 7937 - DNA, 25 bp, Homo sapien
gtggaggacatctccgccctgcaca

SEQ ID NO: 7938 - DNA, 25 bp, Homo sapien
gggctgctttgacgacgacgatgca

SEQ ID NO: 7939 - DNA, 25 bp, Homo sapien
ggcccaagactatgcttccgattcg

SEQ ID NO: 7940 - DNA, 25 bp, Homo sapien
gcccagcctgtacgtgcgcaagcag

SEQ ID NO: 7941 - DNA, 25 bp, Homo sapien
gcctgaccatcgtgagcaacgcgtg

SEQ ID NO: 7942 - DNA, 25 bp, Homo sapien
tgtgcctcacgacgcccactgagga

SEQ ID NO: 7943 - DNA, 25 bp, Homo sapien
gcagcctcagtcaagaccagcggga

SEQ ID NO: 7944 - DNA, 25 bp, Homo sapien
tgtccttcgtatccgggctgtcagt

SEQ ID NO: 7945 - DNA, 25 bp, Homo sapien
attcaattgtcacgtggctgcacca

SEQ ID NO: 7946 - DNA, 25 bp, Homo sapien
gcttctacggcaacgactcggacga

SEQ ID NO: 7947 - DNA, 25 bp, Homo sapien
cgcagacaaggacggctcaaagccc

SEQ ID NO: 7948 - DNA, 25 bp, Homo sapien
gctccggggacgaacagtgatctac

SEQ ID NO: 7949 - DNA, 25 bp, Homo sapien
ccaggagggcgccaattcaattgtc

SEQ ID NO: 7950 - DNA, 25 bp, Homo sapien
agcagccaggcacatagatctgaga

SEQ ID NO: 7951 - DNA, 25 bp, Homo sapien
tggccttgcccgcacttgggcaggc

SEQ ID NO: 7952 - DNA, 25 bp, Homo sapien
gatcttgggcgtcaggtcaccagct

SEQ ID NO: 7953 - DNA, 25 bp, Homo sapien
cgcccagaccgcacgaggtcgtgaa

SEQ ID NO: 7954 - DNA, 25 bp, Homo sapien
gggcctgccctgcagtcgaacaagc

SEQ ID NO: 7955 - DNA, 25 bp, Homo sapien
aaacgctgtttgaagcgggtgagta

SEQ ID NO: 7956 - DNA, 25 bp, Homo sapien
agagacggttgcgagggcacccttt

SEQ ID NO: 7957 - DNA, 25 bp, Homo sapien
gcggagttaagggaatttttcagca

SEQ ID NO: 7958 - DNA, 25 bp, Homo sapien
cacggacatcgtcggctgcaactgg

SEQ ID NO: 7959 - DNA, 25 bp, Homo sapien
tcccagctgggaaatacgccctgag

SEQ ID NO: 7960 - DNA, 25 bp, Homo sapien
gcccgcctcattgatgtgccaagtc

SEQ ID NO: 7961 - DNA, 25 bp, Homo sapien
tggtcagtcacccaccggaagggcc

SEQ ID NO: 7962 - DNA, 25 bp, Homo sapien
tgcgcgtgctcagcttcgatatcga

SEQ ID NO: 7963 - DNA, 25 bp, Homo sapien
ccctacgaggccaacgtcgactttg

SEQ ID NO: 7964 - DNA, 25 bp, Homo sapien
gtcgactttgagatccggtacggcc

SEQ ID NO: 7965 - DNA, 25 bp, Homo sapien
caggttcatggtggacacggacatc

SEQ ID NO: 7966 - DNA, 25 bp, Homo sapien
tcaaggtcgtatcccagctgttgcg

SEQ ID NO: 7967 - DNA, 25 bp, Homo sapien
tatcccagctgttgcggcaggtcag

SEQ ID NO: 7968 - DNA, 25 bp, Homo sapien
ccgcctggctgtgtactgcctgaag

SEQ ID NO: 7969 - DNA, 25 bp, Homo sapien
gccagcaggtcaaggtcgtatccca

SEQ ID NO: 7970 - DNA, 25 bp, Homo sapien
tcagctacctgctcagtcgtggcca

SEQ ID NO: 7971 - DNA, 25 bp, Homo sapien
aaggatgcctacctgccactgcggc

SEQ ID NO: 7972 - DNA, 25 bp, Homo sapien
tactgcctgaaggatgcctacctgc

SEQ ID NO: 7973 - DNA, 25 bp, Homo sapien
aggtcagtagccgagacttgtcctc

SEQ ID NO: 7974 - DNA, 25 bp, Homo sapien
ggtcaagcgcaagctcacctaccag

SEQ ID NO: 7975 - DNA, 25 bp, Homo sapien
ctgtaccagttcctgctggggctac

SEQ ID NO: 7976 - DNA, 25 bp, Homo sapien
ctcgcaagaagctgcgcctgtacca

SEQ ID NO: 7977 - DNA, 25 bp, Homo sapien
agcacaaggaactcctggcgcgccg

SEQ ID NO: 7978 - DNA, 25 bp, Homo sapien
aggggaaccgcaagcgcatgaccta

SEQ ID NO: 7979 - DNA, 25 bp, Homo sapien
agcgcatgacctaccagaagctggc

SEQ ID NO: 7980 - DNA, 25 bp, Homo sapien
ccaagaccggcgagatccgcaaggt

SEQ ID NO: 7981 - DNA, 25 bp, Homo sapien
ccaccgcagggactcgcaagaagct

SEQ ID NO: 7982 - DNA, 25 bp, Homo sapien
gtcctgcctacgctaggaaaccgga

SEQ ID NO: 7983 - DNA, 25 bp, Homo sapien
cgcagtggcagtctgcctggcaacc

SEQ ID NO: 7984 - DNA, 25 bp, Homo sapien
tgacatcacatggaactgacgccgg

SEQ ID NO: 7985 - DNA, 25 bp, Homo sapien
aactgacgccggattggctggacgc

SEQ ID NO: 7986 - DNA, 25 bp, Homo sapien
gggtccctcacgctgcgttactagc

SEQ ID NO: 7987 - DNA, 25 bp, Homo sapien
gcctggcaacccgtgacatcacatg

SEQ ID NO: 7988 - DNA, 25 bp, Homo sapien
cgctgcgttactagccaggcagtcc

SEQ ID NO: 7989 - DNA, 25 bp, Homo sapien
agctctttgggtttgcccacgcccg

SEQ ID NO: 7990 - DNA, 25 bp, Homo sapien
agcgctgtggcttcaccgtcaagaa

SEQ ID NO: 7991 - DNA, 25 bp, Homo sapien
ctctccagccgaggaatgggtccct

SEQ ID NO: 7992 - DNA, 25 bp, Homo sapien
ccagccggtcaccatcagggagatt

SEQ ID NO: 7993 - DNA, 25 bp, Homo sapien
tgaccctgcgctccgaaagaccaag

SEQ ID NO: 7994 - DNA, 25 bp, Homo sapien
ctgccctttccgtgtcgtcgacagg

SEQ ID NO: 7995 - DNA, 25 bp, Homo sapien
agtgggcgagcagctcaaccttgtc

SEQ ID NO: 7996 - DNA, 25 bp, Homo sapien
ggaccagcgacttcgacaccgtgtt

SEQ ID NO: 7997 - DNA, 25 bp, Homo sapien
ctgagcgtgcagatcgagaacatga

SEQ ID NO: 7998 - DNA, 25 bp, Homo sapien
ggagcgggctttatgacgtcacaca

SEQ ID NO: 7999 - DNA, 25 bp, Homo sapien
tcctgctcttgctgatggcggtagc

SEQ ID NO: 8000 - DNA, 25 bp, Homo sapien
tggaatcttggagaatccgacgtcc

SEQ ID NO: 8001 - DNA, 25 bp, Homo sapien
ctctttagctgtgcatagcgggcgc

SEQ ID NO: 8002 - DNA, 25 bp, Homo sapien
acagccgtcccttcgctggtgggaa

SEQ ID NO: 8003 - DNA, 25 bp, Homo sapien
tgacgtcacacaagagcgggctcct

SEQ ID NO: 8004 - DNA, 25 bp, Homo sapien
tacgcgcactgtgacgtcatgatgc

SEQ ID NO: 8005 - DNA, 25 bp, Homo sapien
ctcctgatttgtgatgacgtccctg

SEQ ID NO: 8006 - DNA, 25 bp, Homo sapien
ctggggaagaagtttgaacctctca

SEQ ID NO: 8007 - DNA, 25 bp, Homo sapien
tccgaggaatcttctgcacaggtga

SEQ ID NO: 8008 - DNA, 25 bp, Homo sapien
ctaattcacgtaacgggagccgccg

SEQ ID NO: 8009 - DNA, 25 bp, Homo sapien
cacgcggacactacctgcaggatcg

SEQ ID NO: 8010 - DNA, 25 bp, Homo sapien
agcctaggagtcagataccgcgaga

SEQ ID NO: 8011 - DNA, 25 bp, Homo sapien
ttcgggacaaagatcgcgagattta

SEQ ID NO: 8012 - DNA, 25 bp, Homo sapien
gtcacagctacttcttcctggcaga

SEQ ID NO: 8013 - DNA, 25 bp, Homo sapien
tatcgcctgccctggatcgaagtga

SEQ ID NO: 8014 - DNA, 25 bp, Homo sapien
ccttcgcggcgctcttgccacctgc

SEQ ID NO: 8015 - DNA, 25 bp, Homo sapien
ccctgcacgtggatgtggccggcaa

SEQ ID NO: 8016 - DNA, 25 bp, Homo sapien
tgggcgtgtcggtggtgacgcaccc

SEQ ID NO: 8017 - DNA, 25 bp, Homo sapien
gccatgaggtggaggacgtggacct

SEQ ID NO: 8018 - DNA, 25 bp, Homo sapien
ctggagctgttcaacacctcggtgc

SEQ ID NO: 8019 - DNA, 25 bp, Homo sapien
gctgttcaacacctcggtgcagctg

SEQ ID NO: 8020 - DNA, 25 bp, Homo sapien
ttcaacacctcggtgcagctgcagc

SEQ ID NO: 8021 - DNA, 25 bp, Homo sapien
tgtcggaccagctgaccctgcacgt

SEQ ID NO: 8022 - DNA, 25 bp, Homo sapien
taggctctcgcgatagcttcctggc

SEQ ID NO: 8023 - DNA, 25 bp, Homo sapien
cgtcacacaagggaaagggatcaga

SEQ ID NO: 8024 - DNA, 25 bp, Homo sapien
cgggcctaggaaatgccgcactaca

SEQ ID NO: 8025 - DNA, 25 bp, Homo sapien
tccaccgagccaggggtttccgcat

SEQ ID NO: 8026 - DNA, 25 bp, Homo sapien
tcagaggcccttctttcgcatacgg

SEQ ID NO: 8027 - DNA, 25 bp, Homo sapien
cgcagacgcagcgtgacgtcacaca

SEQ ID NO: 8028 - DNA, 25 bp, Homo sapien
tctaggaaacttagtaggtaggctc

SEQ ID NO: 8029 - DNA, 25 bp, Homo sapien
cgcccactactgctcagagattcta

SEQ ID NO: 8030 - DNA, 25 bp, Homo sapien
cttgtagaaggccacgagcatcacc

SEQ ID NO: 8031 - DNA, 25 bp, Homo sapien
gccagagcacgtcgcagttgcaatg

SEQ ID NO: 8032 - DNA, 25 bp, Homo sapien
gctccacgatgacgggcgcatagca

SEQ ID NO: 8033 - DNA, 25 bp, Homo sapien
ccatgccctcggtgacgttgaggtc

SEQ ID NO: 8034 - DNA, 25 bp, Homo sapien
ctgagttcgtcaccatgcacgtgta

SEQ ID NO: 8035 - DNA, 25 bp, Homo sapien
catgacgtcgtccaggtccttgagg

SEQ ID NO: 8036 - DNA, 25 bp, Homo sapien
tcgtcctccacgttgatgatctcca

SEQ ID NO: 8037 - DNA, 25 bp, Homo sapien
gggcgttctccgtcacatccgtgat

SEQ ID NO: 8038 - DNA, 25 bp, Homo sapien
ggacgacaccgtcagctgtccgact

SEQ ID NO: 8039 - DNA, 25 bp, Homo sapien
ctctgcagtgttaaacggacgtgta

SEQ ID NO: 8040 - DNA, 25 bp, Homo sapien
cggacgtgtaaatagtggtaaatag

SEQ ID NO: 8041 - DNA, 25 bp, Homo sapien
tggtaaatagtgaaagcctgtcctt

SEQ ID NO: 8042 - DNA, 25 bp, Homo sapien
gcctgtccttccctaaatgtaaagc

SEQ ID NO: 8043 - DNA, 25 bp, Homo sapien
aatgtaaagccatctgtccggcgta

SEQ ID NO: 8044 - DNA, 25 bp, Homo sapien
tgtccggcgtaaggacgacaccgtc

SEQ ID NO: 8045 - DNA, 25 bp, Homo sapien
cacgtttctgtaccgggtctctgca

SEQ ID NO: 8046 - DNA, 25 bp, Homo sapien
tcaatgttcatgctccgcgtggacg

SEQ ID NO: 8047 - DNA, 25 bp, Homo sapien
ctggatgccgttctcttgcaggttc

SEQ ID NO: 8048 - DNA, 25 bp, Homo sapien
caggttcaggtaccgcgtgttgacc

SEQ ID NO: 8049 - DNA, 25 bp, Homo sapien
cggccaggtctctccgtgtgcagat

SEQ ID NO: 8050 - DNA, 25 bp, Homo sapien
agatcacccggctggcctggttgct

SEQ ID NO: 8051 - DNA, 25 bp, Homo sapien
cctggttgctgcaggagcaggccac

SEQ ID NO: 8052 - DNA, 25 bp, Homo sapien
gccaggacatcctaccgggcggcag

SEQ ID NO: 8053 - DNA, 25 bp, Homo sapien
gggcacgcgccatcctcaatgttca

SEQ ID NO: 8054 - DNA, 25 bp, Homo sapien
aaaggcaggttagaaggcgaaggct

SEQ ID NO: 8055 - DNA, 25 bp, Homo sapien
cggctccggctactcccagctgcct

SEQ ID NO: 8056 - DNA, 25 bp, Homo sapien
tgcctggagcccgagttcctgtctg

SEQ ID NO: 8057 - DNA, 25 bp, Homo sapien
gagcccgagttcctgtctggcggct

SEQ ID NO: 8058 - DNA, 25 bp, Homo sapien
aaggctgcggaagatgctacaggaa

SEQ ID NO: 8059 - DNA, 25 bp, Homo sapien
acttgggatgtgaggcgcatagcaa

SEQ ID NO: 8060 - DNA, 25 bp, Homo sapien
gcgcatagcaatggggcgctgcgga

SEQ ID NO: 8061 - DNA, 25 bp, Homo sapien
ccgagttcctgtctggcggctgcgc

SEQ ID NO: 8062 - DNA, 25 bp, Homo sapien
ccaatcgccactctggaacaggtgt

SEQ ID NO: 8063 - DNA, 25 bp, Homo sapien
cgccactctggaacaggtgtgcgcg

SEQ ID NO: 8064 - DNA, 25 bp, Homo sapien
aatcgccactctggaacaggtgtgc

SEQ ID NO: 8065 - DNA, 25 bp, Homo sapien
gcccaatcgccactctggaacaggt

SEQ ID NO: 8066 - DNA, 25 bp, Homo sapien
ggcccaatcgccactctggaacagg

SEQ ID NO: 8067 - DNA, 25 bp, Homo sapien
gggcccaatcgccactctggaacag

SEQ ID NO: 8068 - DNA, 25 bp, Homo sapien
ccactctggaacaggtgtgcgcggc

SEQ ID NO: 8069 - DNA, 25 bp, Homo sapien
tcgccactctggaacaggtgtgcgc

SEQ ID NO: 8070 - DNA, 25 bp, Homo sapien
ccgaatcgccactttgcaacaggtg

SEQ ID NO: 8071 - DNA, 25 bp, Homo sapien
gcctagggccgaatcgccactttgc

SEQ ID NO: 8072 - DNA, 25 bp, Homo sapien
ggccgaatcgccactttgcaacagg

SEQ ID NO: 8073 - DNA, 25 bp, Homo sapien
cgaatcgccactttgcaacaggtgc

SEQ ID NO: 8074 - DNA, 25 bp, Homo sapien
aatcgccactttgcaacaggtgcgc

SEQ ID NO: 8075 - DNA, 25 bp, Homo sapien
tcgccactttgcaacaggtgcgcgc

SEQ ID NO: 8076 - DNA, 25 bp, Homo sapien
ccactttgcaacaggtgcgcgcggc

SEQ ID NO: 8077 - DNA, 25 bp, Homo sapien
ctagggccgaatcgccactttgcaa

SEQ ID NO: 8078 - DNA, 25 bp, Homo sapien
tgacgtcaccgaggcttgtccctgc

SEQ ID NO: 8079 - DNA, 25 bp, Homo sapien
ccactctgaaacaggtgcgcgcggt

SEQ ID NO: 8080 - DNA, 25 bp, Homo sapien
gacgccgtttcctgccctttatctc

SEQ ID NO: 8081 - DNA, 25 bp, Homo sapien
cgcgtttgctggagtagtcggccac

SEQ ID NO: 8082 - DNA, 25 bp, Homo sapien
cgactagtgacgtcaccgaggcttg

SEQ ID NO: 8083 - DNA, 25 bp, Homo sapien
agctcacaagctgcggcggccggct

SEQ ID NO: 8084 - DNA, 25 bp, Homo sapien
tcacgcgcgagctcacaagctgcgg

SEQ ID NO: 8085 - DNA, 25 bp, Homo sapien
agtagtcggccacgccttgccaatc

SEQ ID NO: 8086 - DNA, 25 bp, Homo sapien
ggttcagcgtgttcttcttgatgga

SEQ ID NO: 8087 - DNA, 25 bp, Homo sapien
tcttgatggaggttttccgcttctt

SEQ ID NO: 8088 - DNA, 25 bp, Homo sapien
cgtcgaacaccagcgcctcattata

SEQ ID NO: 8089 - DNA, 25 bp, Homo sapien
tcgtagtctaccacggcgatgctga

SEQ ID NO: 8090 - DNA, 25 bp, Homo sapien
gccgatcacctcgttgtgcccgatg

SEQ ID NO: 8091 - DNA, 25 bp, Homo sapien
actagctgatgccagtgctccacgg

SEQ ID NO: 8092 - DNA, 25 bp, Homo sapien
cgactcacgaacatgcagggcgttc

SEQ ID NO: 8093 - DNA, 25 bp, Homo sapien
cctcattataggtggggttcagcgt

SEQ ID NO: 8094 - DNA, 25 bp, Homo sapien
aagcccagcttgatgtcgaccgcgg

SEQ ID NO: 8095 - DNA, 25 bp, Homo sapien
cagctcagcgtcctcttggagaagg

SEQ ID NO: 8096 - DNA, 25 bp, Homo sapien
cagcgcggccggttcatggccgcta

SEQ ID NO: 8097 - DNA, 25 bp, Homo sapien
ggggtgctcttacctctcccaaagc

SEQ ID NO: 8098 - DNA, 25 bp, Homo sapien
gacagttggctgctcagggcctcgc

SEQ ID NO: 8099 - DNA, 25 bp, Homo sapien
tcggccacggacagttggctgctca

SEQ ID NO: 8100 - DNA, 25 bp, Homo sapien
acaagacgacgctgaccggtggctt

SEQ ID NO: 8101 - DNA, 25 bp, Homo sapien
tcgcggaagtccagcggcgtcacct

SEQ ID NO: 8102 - DNA, 25 bp, Homo sapien
aatgtctgatctaggggctgaggcc

SEQ ID NO: 8103 - DNA, 25 bp, Homo sapien
aggccgggagaaaaagctcagctta

SEQ ID NO: 8104 - DNA, 25 bp, Homo sapien
agctcagcttaacagtcacatcttg

SEQ ID NO: 8105 - DNA, 25 bp, Homo sapien
tcccgttgagggcttagagactaca

SEQ ID NO: 8106 - DNA, 25 bp, Homo sapien
tgaagtccttaatgcctccgggctg

SEQ ID NO: 8107 - DNA, 25 bp, Homo sapien
atgctggggtcccaagacgcttcag

SEQ ID NO: 8108 - DNA, 25 bp, Homo sapien
ggccacggaatgaggaaacgatccc

SEQ ID NO: 8109 - DNA, 25 bp, Homo sapien
cgccgggtaatgagagagaatgtct

SEQ ID NO: 8110 - DNA, 25 bp, Homo sapien
gtgattaggacgcagaaccaggcta

SEQ ID NO: 8111 - DNA, 25 bp, Homo sapien
atcgcggtcacggacttccagacgc

SEQ ID NO: 8112 - DNA, 25 bp, Homo sapien
cttacaggtggctcatcgcggtcac

SEQ ID NO: 8113 - DNA, 25 bp, Homo sapien
ggctgaaacgacctgcgagttcctt

SEQ ID NO: 8114 - DNA, 25 bp, Homo sapien
cttcgacgatcaaagccagggctga

SEQ ID NO: 8115 - DNA, 25 bp, Homo sapien
ggaccagggcctgtaaacgactcca

SEQ ID NO: 8116 - DNA, 25 bp, Homo sapien
atggagcctcgacagacagtgatta

SEQ ID NO: 8117 - DNA, 25 bp, Homo sapien
gaccaggcagggactcttcgacgat

SEQ ID NO: 8118 - DNA, 25 bp, Homo sapien
ccctggtcacacctagatcgacgta

SEQ ID NO: 8119 - DNA, 25 bp, Homo sapien
atctcgaactccacgccctggaggt

SEQ ID NO: 8120 - DNA, 25 bp, Homo sapien
cagttggggagccacggatgtcaaa

SEQ ID NO: 8121 - DNA, 25 bp, Homo sapien
cccagaggtttagcgccaaacggct

SEQ ID NO: 8122 - DNA, 25 bp, Homo sapien
gccacgtcgaacttggtccagaacc

SEQ ID NO: 8123 - DNA, 25 bp, Homo sapien
cagccaatcagccacgtcgaacttg

SEQ ID NO: 8124 - DNA, 25 bp, Homo sapien
agccatcgatctcgtggtccaggaa

SEQ ID NO: 8125 - DNA, 25 bp, Homo sapien
tcgacgtagtcctccttggtcaagg

SEQ ID NO: 8126 - DNA, 25 bp, Homo sapien
gcagcggttccacgaaaaggaattc

SEQ ID NO: 8127 - DNA, 25 bp, Homo sapien
ggacctccagggcttgcttactccg

SEQ ID NO: 8128 - DNA, 25 bp, Homo sapien
aaaggaattcgccatcttccacatc

SEQ ID NO: 8129 - DNA, 25 bp, Homo sapien
actctggcttttcgaagctgttgga

SEQ ID NO: 8130 - DNA, 25 bp, Homo sapien
cgttctcttcgctggccctcgggga

SEQ ID NO: 8131 - DNA, 25 bp, Homo sapien
tgcccgcagactccagtcggaggta

SEQ ID NO: 8132 - DNA, 25 bp, Homo sapien
gttttcaaggaaccgcacgtgcagc

SEQ ID NO: 8133 - DNA, 25 bp, Homo sapien
ggctggcagttttcaaggaaccgca

SEQ ID NO: 8134 - DNA, 25 bp, Homo sapien
agcgagttcgagtccaggctccact

SEQ ID NO: 8135 - DNA, 25 bp, Homo sapien
atggtgaacactggatcctctgccg

SEQ ID NO: 8136 - DNA, 25 bp, Homo sapien
gcagcacgcgcttctttgccttgga

SEQ ID NO: 8137 - DNA, 25 bp, Homo sapien
gtcgacgacgcagccacttccgatt

SEQ ID NO: 8138 - DNA, 25 bp, Homo sapien
aacctggacgcgctacgatgagagc

SEQ ID NO: 8139 - DNA, 25 bp, Homo sapien
tccactggctgggtagaaaagcatc

SEQ ID NO: 8140 - DNA, 25 bp, Homo sapien
tccgaggctcgtctttctgaaaagg

SEQ ID NO: 8141 - DNA, 25 bp, Homo sapien
ggatagtgcccttgagactcggatc

SEQ ID NO: 8142 - DNA, 25 bp, Homo sapien
tgtgggcaaagaacacggatgacgc

SEQ ID NO: 8143 - DNA, 25 bp, Homo sapien
ctgctcgtactctgtgggcaaagaa

SEQ ID NO: 8144 - DNA, 25 bp, Homo sapien
gctgctgctcgtactctgtgggcaa

SEQ ID NO: 8145 - DNA, 25 bp, Homo sapien
tttttctccatgctgggcaccggcg

SEQ ID NO: 8146 - DNA, 25 bp, Homo sapien
cacggtccgctttttctccatgctg

SEQ ID NO: 8147 - DNA, 25 bp, Homo sapien
gagccatctgatacacggtccgctt

SEQ ID NO: 8148 - DNA, 25 bp, Homo sapien
ggctgggccgtcttactgagagcca

SEQ ID NO: 8149 - DNA, 25 bp, Homo sapien
gaacacggatgacgcccagggagcc

SEQ ID NO: 8150 - DNA, 25 bp, Homo sapien
gcgcgctccgttacctgtagatgta

SEQ ID NO: 8151 - DNA, 25 bp, Homo sapien
gtagatgtaccagacgctgcgccgc

SEQ ID NO: 8152 - DNA, 25 bp, Homo sapien
ctgtagatgtaccagacgctgcgcc

SEQ ID NO: 8153 - DNA, 25 bp, Homo sapien
tacctgtagatgtaccagacgctgc

SEQ ID NO: 8154 - DNA, 25 bp, Homo sapien
cgttacctgtagatgtaccagacgc

SEQ ID NO: 8155 - DNA, 25 bp, Homo sapien
ctccgttacctgtagatgtaccaga

SEQ ID NO: 8156 - DNA, 25 bp, Homo sapien
ccgccgccgaccgcagacaaagcca

SEQ ID NO: 8157 - DNA, 25 bp, Homo sapien
cgctccgttacctgtagatgtacca

SEQ ID NO: 8158 - DNA, 25 bp, Homo sapien
acgcacctcgacacagtcggcaaga

SEQ ID NO: 8159 - DNA, 25 bp, Homo sapien
gtcggcaagaaaggccaggacattc

SEQ ID NO: 8160 - DNA, 25 bp, Homo sapien
gaggggcgaacacaccaccacagct

SEQ ID NO: 8161 - DNA, 25 bp, Homo sapien
gagacacacggaaggaccgcccagc

SEQ ID NO: 8162 - DNA, 25 bp, Homo sapien
gaggggaagctgagacgcaccacac

SEQ ID NO: 8163 - DNA, 25 bp, Homo sapien
acagcagcacgtgggagccagcgag

SEQ ID NO: 8164 - DNA, 25 bp, Homo sapien
ccaccacagaccaacacgcaacgca

SEQ ID NO: 8165 - DNA, 25 bp, Homo sapien
aggccaggacattcagactgggccc

SEQ ID NO: 8166 - DNA, 25 bp, Homo sapien
gcaggcgctattcggtggtcaagcg

SEQ ID NO: 8167 - DNA, 25 bp, Homo sapien
gccaagggcggccatcagactagga

SEQ ID NO: 8168 - DNA, 25 bp, Homo sapien
cctcgggacactcgctggcactgtg

SEQ ID NO: 8169 - DNA, 25 bp, Homo sapien
acactcgctggcactgtggcgttcc

SEQ ID NO: 8170 - DNA, 25 bp, Homo sapien
gttcctcgtcctcgcttgtcgcggg

SEQ ID NO: 8171 - DNA, 25 bp, Homo sapien
gacggcagcatcacaggcggctgca

SEQ ID NO: 8172 - DNA, 25 bp, Homo sapien
gccatcagactaggagcccgggacc

SEQ ID NO: 8173 - DNA, 25 bp, Homo sapien
tcgtcctcgcttgtcgcggggctgt

SEQ ID NO: 8174 - DNA, 25 bp, Homo sapien
gccgcacagcccacctcgcgatctg

SEQ ID NO: 8175 - DNA, 25 bp, Homo sapien
ccggggcggcatgaatcaaacgctc

SEQ ID NO: 8176 - DNA, 25 bp, Homo sapien
tgaatcaaacgctccgcggctaaga

SEQ ID NO: 8177 - DNA, 25 bp, Homo sapien
gctccgcggctaagaatagctggca

SEQ ID NO: 8178 - DNA, 25 bp, Homo sapien
cggctaagaatagctggcacgcagc

SEQ ID NO: 8179 - DNA, 25 bp, Homo sapien
ctcccatcaaggatgcgatctggga

SEQ ID NO: 8180 - DNA, 25 bp, Homo sapien
gcgtaacccaatttggtgtcgccca

SEQ ID NO: 8181 - DNA, 25 bp, Homo sapien
ccaatttggtgtcgcccagggcaac

SEQ ID NO: 8182 - DNA, 25 bp, Homo sapien
agcagagcagcagtgtcggacggaa

SEQ ID NO: 8183 - DNA, 25 bp, Homo sapien
tcggcaatgggcttggcctggcgca

SEQ ID NO: 8184 - DNA, 25 bp, Homo sapien
gcctggcgcagtggggacggctcca

SEQ ID NO: 8185 - DNA, 25 bp, Homo sapien
cggctgtggaagagactctcgggct

SEQ ID NO: 8186 - DNA, 25 bp, Homo sapien
cagcagtgtcggacggaagatggag

SEQ ID NO: 8187 - DNA, 25 bp, Homo sapien
gctccaggtccgagcggtcccggct

SEQ ID NO: 8188 - DNA, 25 bp, Homo sapien
gcctgtgtgcacgtgcacgggcctg

SEQ ID NO: 8189 - DNA, 25 bp, Homo sapien
acctgagcagcgtggaggtcggcaa

SEQ ID NO: 8190 - DNA, 25 bp, Homo sapien
ccaacggtggcacgctcgagaactg

SEQ ID NO: 8191 - DNA, 25 bp, Homo sapien
cttccagactctgaatgcatgaccc

SEQ ID NO: 8192 - DNA, 25 bp, Homo sapien
acaagtgcttcctgctctcgcgcga

SEQ ID NO: 8193 - DNA, 25 bp, Homo sapien
ctctcgcgcgacttcgaagctcagg

SEQ ID NO: 8194 - DNA, 25 bp, Homo sapien
agatggaggcgctcactcggtacct

SEQ ID NO: 8195 - DNA, 25 bp, Homo sapien
cctcttcgaaaacggccagcgcgtg

SEQ ID NO: 8196 - DNA, 25 bp, Homo sapien
agcggcgtctctactacgtctgcga

SEQ ID NO: 8197 - DNA, 25 bp, Homo sapien
gcgtgtccttcttcgcctggcatcg

SEQ ID NO: 8198 - DNA, 25 bp, Homo sapien
tgactcctacgggtcacctcgcaag

SEQ ID NO: 8199 - DNA, 25 bp, Homo sapien
tgtcacgcgcccacgggtaggaaaa

SEQ ID NO: 8200 - DNA, 25 bp, Homo sapien
cccgaggtactctggaaaatgtagt

SEQ ID NO: 8201 - DNA, 25 bp, Homo sapien
ctcccatgtgaggttcgcctgcctt

SEQ ID NO: 8202 - DNA, 25 bp, Homo sapien
ccgcagtaaccggatgactcctacg

SEQ ID NO: 8203 - DNA, 25 bp, Homo sapien
ccagcaccacgtttttccgcagtaa

SEQ ID NO: 8204 - DNA, 25 bp, Homo sapien
gagcagcaggcgcatcaccgcctta

SEQ ID NO: 8205 - DNA, 25 bp, Homo sapien
ccgcagtctccaatcagagctcaga

SEQ ID NO: 8206 - DNA, 25 bp, Homo sapien
aggccgatcccggtgcacacggtgc

SEQ ID NO: 8207 - DNA, 25 bp, Homo sapien
cgctggaggccgatcccggtgcaca

SEQ ID NO: 8208 - DNA, 25 bp, Homo sapien
cacgctggagagtgcccaggccaac

SEQ ID NO: 8209 - DNA, 25 bp, Homo sapien
gcacggactttgaccgcacgctgga

SEQ ID NO: 8210 - DNA, 25 bp, Homo sapien
cccgtggctgaggataaggtcaggg

SEQ ID NO: 8211 - DNA, 25 bp, Homo sapien
atccgcagcacggactttgaccgca

SEQ ID NO: 8212 - DNA, 25 bp, Homo sapien
gtgtacatccgcagcacggactttg

SEQ ID NO: 8213 - DNA, 25 bp, Homo sapien
gctccaggtgtacatccgcagcacg

SEQ ID NO: 8214 - DNA, 25 bp, Homo sapien
gcccgacacgagagagaatccgctg

SEQ ID NO: 8215 - DNA, 25 bp, Homo sapien
cgccagctataggagtcgcaaactc

SEQ ID NO: 8216 - DNA, 25 bp, Homo sapien
ggacacgtgcgtctttccacacagc

SEQ ID NO: 8217 - DNA, 25 bp, Homo sapien
ccagcatttctctctccgaagcggg

SEQ ID NO: 8218 - DNA, 25 bp, Homo sapien
gccattttatagtgcgcgccgctcg

SEQ ID NO: 8219 - DNA, 25 bp, Homo sapien
gcctgcttccgctagaatcttcctg

SEQ ID NO: 8220 - DNA, 25 bp, Homo sapien
ctctgggtccttgcaaacgccctga

SEQ ID NO: 8221 - DNA, 25 bp, Homo sapien
cctgcgtccggcaattctgaagaca

SEQ ID NO: 8222 - DNA, 25 bp, Homo sapien
agccgtgtcctacctaagcccagtg

SEQ ID NO: 8223 - DNA, 25 bp, Homo sapien
gcagcgaggcggacatccaaacagc

SEQ ID NO: 8224 - DNA, 25 bp, Homo sapien
gaggtcttcaggacaccgaccggta

SEQ ID NO: 8225 - DNA, 25 bp, Homo sapien
agcggaactcagacgctgactccga

SEQ ID NO: 8226 - DNA, 25 bp, Homo sapien
tacaccctcgaggatgagacccaag

SEQ ID NO: 8227 - DNA, 25 bp, Homo sapien
tccaaggaatagcacccgaggtctt

SEQ ID NO: 8228 - DNA, 25 bp, Homo sapien
tggccacgccctggatattcgacct

SEQ ID NO: 8229 - DNA, 25 bp, Homo sapien
gactcggagtacagcggcccaccta

SEQ ID NO: 8230 - DNA, 25 bp, Homo sapien
ctgggcacctacatctcccgtgtta

SEQ ID NO: 8231 - DNA, 25 bp, Homo sapien
gccgatacgttttccctgatgtaga

SEQ ID NO: 8232 - DNA, 25 bp, Homo sapien
gacccagttgttgtagccttcagtg

SEQ ID NO: 8233 - DNA, 25 bp, Homo sapien
gtagcccttgttctctaggcccagg

SEQ ID NO: 8234 - DNA, 25 bp, Homo sapien
cgccctcacccgtgttgaaatagta

SEQ ID NO: 8235 - DNA, 25 bp, Homo sapien
cgcctactgtgtgcatgttctcttg

SEQ ID NO: 8236 - DNA, 25 bp, Homo sapien
gccctggactggttcacatctctca

SEQ ID NO: 8237 - DNA, 25 bp, Homo sapien
tgcggtcaccaaggctagctccaga

SEQ ID NO: 8238 - DNA, 25 bp, Homo sapien
ctctcatgaagctgtgcgggcgagt

SEQ ID NO: 8239 - DNA, 25 bp, Homo sapien
tcccaggcgcactctcatgaagctg

SEQ ID NO: 8240 - DNA, 25 bp, Homo sapien
ctggactaggcgcagcaacatgatg

SEQ ID NO: 8241 - DNA, 25 bp, Homo sapien
aacatgatgtcgttgcggtggctgc

SEQ ID NO: 8242 - DNA, 25 bp, Homo sapien
ggaatgacccgagacgtggtccgta

SEQ ID NO: 8243 - DNA, 25 bp, Homo sapien
gtggtccgtagttgctctgggccat

SEQ ID NO: 8244 - DNA, 25 bp, Homo sapien
tgctctgggccatcgcgcttgcgca

SEQ ID NO: 8245 - DNA, 25 bp, Homo sapien
cgcttgcgcaggttgtgctctccca

SEQ ID NO: 8246 - DNA, 25 bp, Homo sapien
cgcacccggtctgcgctcggctccc

SEQ ID NO: 8247 - DNA, 25 bp, Homo sapien
gcgccgaacccaggcgcgcacccgg

SEQ ID NO: 8248 - DNA, 25 bp, Homo sapien
ggacgtccttcacctccaccgcggc

SEQ ID NO: 8249 - DNA, 25 bp, Homo sapien
tcctggacgtgtccgcggacgtcct

SEQ ID NO: 8250 - DNA, 25 bp, Homo sapien
atgtcctcctggacgtgtccgcgga

SEQ ID NO: 8251 - DNA, 25 bp, Homo sapien
cgcgatcgatgtcctcctggacgtg

SEQ ID NO: 8252 - DNA, 25 bp, Homo sapien
ctggctcaggctcgcgcgatcgatg

SEQ ID NO: 8253 - DNA, 25 bp, Homo sapien
aggctcgcgcgatcgatgtcctcct

SEQ ID NO: 8254 - DNA, 25 bp, Homo sapien
cgtccaacttgatgagcatgaggtc

SEQ ID NO: 8255 - DNA, 25 bp, Homo sapien
tgtcagactcggacacggattcgtc

SEQ ID NO: 8256 - DNA, 25 bp, Homo sapien
tacagcgggtcatagagcttactgc

SEQ ID NO: 8257 - DNA, 25 bp, Homo sapien
acgcactgcagcacggtaggcattc

SEQ ID NO: 8258 - DNA, 25 bp, Homo sapien
cggtagggcactgcgaagcaatgct

SEQ ID NO: 8259 - DNA, 25 bp, Homo sapien
tctgttgtactctgggtgccgtacg

SEQ ID NO: 8260 - DNA, 25 bp, Homo sapien
caatgctgatgctccggatggtgtc

SEQ ID NO: 8261 - DNA, 25 bp, Homo sapien
cgttagcgagcaagggtctgttgta

SEQ ID NO: 8262 - DNA, 25 bp, Homo sapien
cgagctccacgtgggcggagctact

SEQ ID NO: 8263 - DNA, 25 bp, Homo sapien
gactgtgtcttgcttgacctcgtga

SEQ ID NO: 8264 - DNA, 25 bp, Homo sapien
tgacgtcatagagacgggctctgaa

SEQ ID NO: 8265 - DNA, 25 bp, Homo sapien
ccacaggctgtgctgttccaagaag

SEQ ID NO: 8266 - DNA, 25 bp, Homo sapien
cggagctattttgtgtaagtggttc

SEQ ID NO: 8267 - DNA, 25 bp, Homo sapien
cctgacatcacgaggggcgagatct

SEQ ID NO: 8268 - DNA, 25 bp, Homo sapien
agtcttagtgtccagaggggagtca

SEQ ID NO: 8269 - DNA, 25 bp, Homo sapien
aaccattgaggctgggaccctacga

SEQ ID NO: 8270 - DNA, 25 bp, Homo sapien
tcgcgcagtcccagcgaaaaggctg

SEQ ID NO: 8271 - DNA, 25 bp, Homo sapien
gaccgcaagctggacgtgactgtaa

SEQ ID NO: 8272 - DNA, 25 bp, Homo sapien
gccagaggttagatgggttgaacca

SEQ ID NO: 8273 - DNA, 25 bp, Homo sapien
aggctgcaggagcaatgacaacagg

SEQ ID NO: 8274 - DNA, 25 bp, Homo sapien
aagaaatgcgctccagaagctcggc

SEQ ID NO: 8275 - DNA, 25 bp, Homo sapien
ccgaagcatttttaactgcggtgcc

SEQ ID NO: 8276 - DNA, 25 bp, Homo sapien
tcagcgccgagcttcttcgtagttc

SEQ ID NO: 8277 - DNA, 25 bp, Homo sapien
cgccatccaggccacggaatgaggc

SEQ ID NO: 8278 - DNA, 25 bp, Homo sapien
acctccagctgtgggagttccgaga

SEQ ID NO: 8279 - DNA, 25 bp, Homo sapien
cccagaaatgcggaaaaggaccaca

SEQ ID NO: 8280 - DNA, 25 bp, Homo sapien
gagccataggcttcggggtccaagc

SEQ ID NO: 8281 - DNA, 25 bp, Homo sapien
ctcggggatggatctcctcctactt

SEQ ID NO: 8282 - DNA, 25 bp, Homo sapien
tctcctcctgctggaaggacaccgg

SEQ ID NO: 8283 - DNA, 25 bp, Homo sapien
tcctcctacttgtttccgcagtgcg

SEQ ID NO: 8284 - DNA, 25 bp, Homo sapien
ggccgttgaagagcgagacctgcca

SEQ ID NO: 8285 - DNA, 25 bp, Homo sapien
ctggctagaacgtcgctggtcgata

SEQ ID NO: 8286 - DNA, 25 bp, Homo sapien
agagtccacggaagagcgaggatcc

SEQ ID NO: 8287 - DNA, 25 bp, Homo sapien
gcttggtgacgggaacacattctcc

SEQ ID NO: 8288 - DNA, 25 bp, Homo sapien
ccagagttgcgccatcagcagcggc

SEQ ID NO: 8289 - DNA, 25 bp, Homo sapien
cggagctctcatggccaggatctgc

SEQ ID NO: 8290 - DNA, 25 bp, Homo sapien
caggggcgggttaaaacagatgctc

SEQ ID NO: 8291 - DNA, 25 bp, Homo sapien
ggaacagcggtaatgggcacaatta

SEQ ID NO: 8292 - DNA, 25 bp, Homo sapien
ttccgcgtcccgcaggtggagaaac

SEQ ID NO: 8293 - DNA, 25 bp, Homo sapien
gagccagtgggagcctctttctcaa

SEQ ID NO: 8294 - DNA, 25 bp, Homo sapien
ctccacggacactcaggcgctcctg

SEQ ID NO: 8295 - DNA, 25 bp, Homo sapien
tgctcggtccagtcgagctggctga

SEQ ID NO: 8296 - DNA, 25 bp, Homo sapien
ctgtgccggatctgctcggtccagt

SEQ ID NO: 8297 - DNA, 25 bp, Homo sapien
acagagaagccgctgtgccggatct

SEQ ID NO: 8298 - DNA, 25 bp, Homo sapien
atgggtcacagagaagccgctgtgc

SEQ ID NO: 8299 - DNA, 25 bp, Homo sapien
ctcgtcgaggctcccaggtagccgg

SEQ ID NO: 8300 - DNA, 25 bp, Homo sapien
tcgtgctcgtggctcgtcgaggctc

SEQ ID NO: 8301 - DNA, 25 bp, Homo sapien
gcgcacccagtacctgctgccggtg

SEQ ID NO: 8302 - DNA, 25 bp, Homo sapien
ctcctaccattgtcccgaatggccg

SEQ ID NO: 8303 - DNA, 25 bp, Homo sapien
cgcgcattcttacctcctgacaagg

SEQ ID NO: 8304 - DNA, 25 bp, Homo sapien
gcgcattcttacctcctgacaaggc

SEQ ID NO: 8305 - DNA, 25 bp, Homo sapien
ctcctgacaaggccaaggtcaggga

SEQ ID NO: 8306 - DNA, 25 bp, Homo sapien
attgtcccgaatggccgccgcgcct

SEQ ID NO: 8307 - DNA, 25 bp, Homo sapien
tgttgagggcgtgcccggaacctcc

SEQ ID NO: 8308 - DNA, 25 bp, Homo sapien
gaggcgatcactagggccaggggcc

SEQ ID NO: 8309 - DNA, 25 bp, Homo sapien
caaggtcagggaggcgatcactagg

SEQ ID NO: 8310 - DNA, 25 bp, Homo sapien
cgtcgccccgtaggaagttcatgag

SEQ ID NO: 8311 - DNA, 25 bp, Homo sapien
ccgcgtcgccccgtaggaagttcat

SEQ ID NO: 8312 - DNA, 25 bp, Homo sapien
tttcaggtgaatgggcccccgtctc

SEQ ID NO: 8313 - DNA, 25 bp, Homo sapien
ttcccaaccccacatggaaggccag

SEQ ID NO: 8314 - DNA, 25 bp, Homo sapien
ccgcggcatcagatcccggcgggag

SEQ ID NO: 8315 - DNA, 25 bp, Homo sapien
tcgggcgcgtagacgcactcctcgg

SEQ ID NO: 8316 - DNA, 25 bp, Homo sapien
gcactcctcggagaagtagtcgagg

SEQ ID NO: 8317 - DNA, 25 bp, Homo sapien
acgcactcctcggagaagtagtcga

SEQ ID NO: 8318 - DNA, 25 bp, Homo sapien
cactgcctcggagagtgccgctctg

SEQ ID NO: 8319 - DNA, 25 bp, Homo sapien
ggcgagcaccgtgtgcagcacctcg

SEQ ID NO: 8320 - DNA, 25 bp, Homo sapien
ctcatcgacggccacgagctgcagt

SEQ ID NO: 8321 - DNA, 25 bp, Homo sapien
taggccacgaccgtgagcggcagct

SEQ ID NO: 8322 - DNA, 25 bp, Homo sapien
ccaaagaggtcttcgtaggccacga

SEQ ID NO: 8323 - DNA, 25 bp, Homo sapien
tcacctgtcacgatgtgcgtggctc

SEQ ID NO: 8324 - DNA, 25 bp, Homo sapien
cgccttctggagcatgcgcctgaat

SEQ ID NO: 8325 - DNA, 25 bp, Homo sapien
gccgcagcactccacagaaggtgca

SEQ ID NO: 8326 - DNA, 25 bp, Homo sapien
cccacggaaagcgtgtggatgctgt

SEQ ID NO: 8327 - DNA, 25 bp, Homo sapien
cctcgatgacatcggtgatggtacc

SEQ ID NO: 8328 - DNA, 25 bp, Homo sapien
ctggcgctgtaaatgtggatgtgct

SEQ ID NO: 8329 - DNA, 25 bp, Homo sapien
accttggtcacaccacgccggaagg

SEQ ID NO: 8330 - DNA, 25 bp, Homo sapien
ggcccagatgaagagcgtgcccagc

SEQ ID NO: 8331 - DNA, 25 bp, Homo sapien
ttgcagttgtcgtagtgcaggccgc

SEQ ID NO: 8332 - DNA, 25 bp, Homo sapien
gatggtaccgtccagcatccgtacg

SEQ ID NO: 8333 - DNA, 25 bp, Homo sapien
tgtagccgtcgcagttgcagttgtc

SEQ ID NO: 8334 - DNA, 25 bp, Homo sapien
cacagaggccttacgctcgaagaga

SEQ ID NO: 8335 - DNA, 25 bp, Homo sapien
ctcacccgggcagaactcagtgctg

SEQ ID NO: 8336 - DNA, 25 bp, Homo sapien
cttggggctttcttgcctagaactc

SEQ ID NO: 8337 - DNA, 25 bp, Homo sapien
ctagaactcccagaagcccatgcga

SEQ ID NO: 8338 - DNA, 25 bp, Homo sapien
gcgacacttccgctggatgcgccta

SEQ ID NO: 8339 - DNA, 25 bp, Homo sapien
ggcctatgatttctgccctttgagg

SEQ ID NO: 8340 - DNA, 25 bp, Homo sapien
tgggaatcctggctacaaggcctca

SEQ ID NO: 8341 - DNA, 25 bp, Homo sapien
gactaccactcccataaggtcttgg

SEQ ID NO: 8342 - DNA, 25 bp, Homo sapien
ctgctctgggatgaacttgcctttc

SEQ ID NO: 8343 - DNA, 25 bp, Homo sapien
agtcctttcctgaccgcgttcttga

SEQ ID NO: 8344 - DNA, 25 bp, Homo sapien
tttgggcgccaaatttcttctcagc

SEQ ID NO: 8345 - DNA, 25 bp, Homo sapien
cagaggaatcctacgggcttgagcc

SEQ ID NO: 8346 - DNA, 25 bp, Homo sapien
acacttgcctctgggagctgacgca

SEQ ID NO: 8347 - DNA, 25 bp, Homo sapien
agtggctgcacaggcctctttagta

SEQ ID NO: 8348 - DNA, 25 bp, Homo sapien
gcggtcttgcctcgtgactgatcca

SEQ ID NO: 8349 - DNA, 25 bp, Homo sapien
acgctccaaggggtcagctgactga

SEQ ID NO: 8350 - DNA, 25 bp, Homo sapien
tgattggctctggacaaacccgcgc

SEQ ID NO: 8351 - DNA, 25 bp, Homo sapien
cagctcccgcgagaagggtcaggcc

SEQ ID NO: 8352 - DNA, 25 bp, Homo sapien
gactcccagttcagcgaatccgtta

SEQ ID NO: 8353 - DNA, 25 bp, Homo sapien
cgttagccttcctctgccttagtca

SEQ ID NO: 8354 - DNA, 25 bp, Homo sapien
gtgaggcactccgtgtttgtgtaca

SEQ ID NO: 8355 - DNA, 25 bp, Homo sapien
cggttattccacgtgtcagtcagtt

SEQ ID NO: 8356 - DNA, 25 bp, Homo sapien
gcgctctcttatgcggctgcgcatc

SEQ ID NO: 8357 - DNA, 25 bp, Homo sapien
tcagtcagttcatcgggcgcatccg

SEQ ID NO: 8358 - DNA, 25 bp, Homo sapien
agcacaacctccagggccgcatcgg

SEQ ID NO: 8359 - DNA, 25 bp, Homo sapien
caggcctgtccagccggggcaagaa

SEQ ID NO: 8360 - DNA, 25 bp, Homo sapien
aggaccacatccagagccgcatcgt

SEQ ID NO: 8361 - DNA, 25 bp, Homo sapien
cagagccgcatcgtgtactacctga

SEQ ID NO: 8362 - DNA, 25 bp, Homo sapien
tcgtgtactacctgatgaacatcca

SEQ ID NO: 8363 - DNA, 25 bp, Homo sapien
atgaacatccacgtgcagccgcgta

SEQ ID NO: 8364 - DNA, 25 bp, Homo sapien
ccggcacggcgagaacgagcacaac

SEQ ID NO: 8365 - DNA, 25 bp, Homo sapien
tggtgaaccgggtgcaggaccacat

SEQ ID NO: 8366 - DNA, 25 bp, Homo sapien
gggcagacactggactcggggtccc

SEQ ID NO: 8367 - DNA, 25 bp, Homo sapien
cctgttaggggtcttcatctgtacg

SEQ ID NO: 8368 - DNA, 25 bp, Homo sapien
ggataatgccctgttaggggtcttc

SEQ ID NO: 8369 - DNA, 25 bp, Homo sapien
cccgggtcggatctccgaactgagt

SEQ ID NO: 8370 - DNA, 25 bp, Homo sapien
gagggtcgcagacacctagccctgc

SEQ ID NO: 8371 - DNA, 25 bp, Homo sapien
caggcaagagggtcgcagacaccta

SEQ ID NO: 8372 - DNA, 25 bp, Homo sapien
gtcatcagccgaggtaccgcagcgc

SEQ ID NO: 8373 - DNA, 25 bp, Homo sapien
tcggatctccgaactgagttggggt

SEQ ID NO: 8374 - DNA, 25 bp, Homo sapien
cccgaggtacatgaggtgctagaac

SEQ ID NO: 8375 - DNA, 25 bp, Homo sapien
ccctaacgactaggggtgcactacg

SEQ ID NO: 8376 - DNA, 25 bp, Homo sapien
taggagaattcgctgacccttgccc

SEQ ID NO: 8377 - DNA, 25 bp, Homo sapien
ggtctttagtcccttcgattgtgag

SEQ ID NO: 8378 - DNA, 25 bp, Homo sapien
agcttctaggtgatgggatctgtcc

SEQ ID NO: 8379 - DNA, 25 bp, Homo sapien
tcaatgctgaggatctgtcgggcaa

SEQ ID NO: 8380 - DNA, 25 bp, Homo sapien
accagcagagttcaggagtccctaa

SEQ ID NO: 8381 - DNA, 25 bp, Homo sapien
tcgggcaagatttaggggaccagca

SEQ ID NO: 8382 - DNA, 25 bp, Homo sapien
gcgcggatgccttcggggagaccct

SEQ ID NO: 8383 - DNA, 25 bp, Homo sapien
cgcgccctctcacccggcgtgactg

SEQ ID NO: 8384 - DNA, 25 bp, Homo sapien
tgactgtgcaggtacgcgtggccac

SEQ ID NO: 8385 - DNA, 25 bp, Homo sapien
actgtgcaggtacgcgtggccacca

SEQ ID NO: 8386 - DNA, 25 bp, Homo sapien
ccaccaggtggcgagcaaggcaggt

SEQ ID NO: 8387 - DNA, 25 bp, Homo sapien
ccgccagcagcacagaggacactgg

SEQ ID NO: 8388 - DNA, 25 bp, Homo sapien
acagaggacactggcccggcgcgga

SEQ ID NO: 8389 - DNA, 25 bp, Homo sapien
gccacgagcagcggaagcggaggct

SEQ ID NO: 8390 - DNA, 25 bp, Homo sapien
accggtatgctgctcctccttgctg

SEQ ID NO: 8391 - DNA, 25 bp, Homo sapien
cgcacagggcgcacgatgagcagct

SEQ ID NO: 8392 - DNA, 25 bp, Homo sapien
cggcgcagcgcaaggtcacgttact

SEQ ID NO: 8393 - DNA, 25 bp, Homo sapien
ccactcacagaagacgctgacgtcg

SEQ ID NO: 8394 - DNA, 25 bp, Homo sapien
cgccaggctccacgtgatgtcggcg

SEQ ID NO: 8395 - DNA, 25 bp, Homo sapien
gacgccgctaggactcccggagact

SEQ ID NO: 8396 - DNA, 25 bp, Homo sapien
aaggtcacgttactgcccgcggtga

SEQ ID NO: 8397 - DNA, 25 bp, Homo sapien
ctctcacccgccactgtaaggttga

SEQ ID NO: 8398 - DNA, 25 bp, Homo sapien
tccacgttccctatgagttcatgtc

SEQ ID NO: 8399 - DNA, 25 bp, Homo sapien
catgtccttatgtcttccctgagcc

SEQ ID NO: 8400 - DNA, 25 bp, Homo sapien
acacggggaatccactgatggcgtc

SEQ ID NO: 8401 - DNA, 25 bp, Homo sapien
cgtcggtgctctgcatgatcatgtc

SEQ ID NO: 8402 - DNA, 25 bp, Homo sapien
gctgtccagtttacccgcgagaatt

SEQ ID NO: 8403 - DNA, 25 bp, Homo sapien
ccgcaagatgagctagctgggcctg

SEQ ID NO: 8404 - DNA, 25 bp, Homo sapien
ttccacgcattcttcacggtgtagc

SEQ ID NO: 8405 - DNA, 25 bp, Homo sapien
ggtactcgtattcccacgcctctga

SEQ ID NO: 8406 - DNA, 25 bp, Homo sapien
tggccagagaactcgcgccgctttt

SEQ ID NO: 8407 - DNA, 25 bp, Homo sapien
aggcatttttgctgaggcttttgtc

SEQ ID NO: 8408 - DNA, 25 bp, Homo sapien
gagcgcctttctgcgccttcaggca

SEQ ID NO: 8409 - DNA, 25 bp, Homo sapien
gattggttagagtcccgcccacttg

SEQ ID NO: 8410 - DNA, 25 bp, Homo sapien
cactattctcggctctgattggcca

SEQ ID NO: 8411 - DNA, 25 bp, Homo sapien
cttccgatttgtaggggaacgcagc

SEQ ID NO: 8412 - DNA, 25 bp, Homo sapien
gccttctccctctggttggcgagcg

SEQ ID NO: 8413 - DNA, 25 bp, Homo sapien
ttaagcgtcgcgagccactattctc

SEQ ID NO: 8414 - DNA, 25 bp, Homo sapien
gggcgatctggaccttccctgacca

SEQ ID NO: 8415 - DNA, 25 bp, Homo sapien
ctgtgctgcagttcaggacgccgcc

SEQ ID NO: 8416 - DNA, 25 bp, Homo sapien
ctcgggctgtgctgcagttcaggac

SEQ ID NO: 8417 - DNA, 25 bp, Homo sapien
gagctccggacctggtcctgggttc

SEQ ID NO: 8418 - DNA, 25 bp, Homo sapien
tgtcctttgagctccggacctggtc

SEQ ID NO: 8419 - DNA, 25 bp, Homo sapien
cggaagaagggcgatctggaccttc

SEQ ID NO: 8420 - DNA, 25 bp, Homo sapien
ggaccttccctgaccagcgtctttg

SEQ ID NO: 8421 - DNA, 25 bp, Homo sapien
accagcgtctttgtgtcctttgagc

SEQ ID NO: 8422 - DNA, 25 bp, Homo sapien
tgccctcccattggtcctagcgggg

SEQ ID NO: 8423 - DNA, 25 bp, Homo sapien
ctccaatcggctcggatgtttcttt

SEQ ID NO: 8424 - DNA, 25 bp, Homo sapien
aatcgcgtcccgtttctccaatcgg

SEQ ID NO: 8425 - DNA, 25 bp, Homo sapien
ttgcgataacgcgtcctaccctttg

SEQ ID NO: 8426 - DNA, 25 bp, Homo sapien
actggtctcgccaatgaatcgcgtc

SEQ ID NO: 8427 - DNA, 25 bp, Homo sapien
gaagcgggttcactgttgcgataac

SEQ ID NO: 8428 - DNA, 25 bp, Homo sapien
agaatcattcttttgcgtaatcccg

SEQ ID NO: 8429 - DNA, 25 bp, Homo sapien
ctgtccggcctaatcagaatcattc

SEQ ID NO: 8430 - DNA, 25 bp, Homo sapien
ctccctaccaagtttctgaagttga

SEQ ID NO: 8431 - DNA, 25 bp, Homo sapien
cgcggttcaacagcgcctacggaaa

SEQ ID NO: 8432 - DNA, 25 bp, Homo sapien
gcggagcgtagcttcaaaagtgtta

SEQ ID NO: 8433 - DNA, 25 bp, Homo sapien
ccatgataactgttggcggagcgta

SEQ ID NO: 8434 - DNA, 25 bp, Homo sapien
ctgaagttgaatgaaccgcggaata

SEQ ID NO: 8435 - DNA, 25 bp, Homo sapien
taatccgtatgggtgcggccatgcc

SEQ ID NO: 8436 - DNA, 25 bp, Homo sapien
gatggcggcctccaatatcataatc

SEQ ID NO: 8437 - DNA, 25 bp, Homo sapien
aggtacgccgttatacgccatgata

SEQ ID NO: 8438 - DNA, 25 bp, Homo sapien
ggaccggcctagtacactctgggag

SEQ ID NO: 8439 - DNA, 25 bp, Homo sapien
aagtgtttcgggacgacgcaacgca

SEQ ID NO: 8440 - DNA, 25 bp, Homo sapien
tgcgcacgcgtggagatctgcaaaa

SEQ ID NO: 8441 - DNA, 25 bp, Homo sapien
ttcagctccgcgcatgcacagagac

SEQ ID NO: 8442 - DNA, 25 bp, Homo sapien
gacgcggcccaatcctaggaatgtg

SEQ ID NO: 8443 - DNA, 25 bp, Homo sapien
cccagtttgtccgagagccgcaagt

SEQ ID NO: 8444 - DNA, 25 bp, Homo sapien
tgcgtaactgttcaccgcgtccacg

SEQ ID NO: 8445 - DNA, 25 bp, Homo sapien
agcgcaggtgctatcttcccttttc

SEQ ID NO: 8446 - DNA, 25 bp, Homo sapien
aacgtccacggccaactgcgggcag

SEQ ID NO: 8447 - DNA, 25 bp, Homo sapien
ctggctctcgcgattcaggagacgc

SEQ ID NO: 8448 - DNA, 25 bp, Homo sapien
gcgaccgcctgaccgggcttcagga

SEQ ID NO: 8449 - DNA, 25 bp, Homo sapien
tccctcacttcctgcggcttttggt

SEQ ID NO: 8450 - DNA, 25 bp, Homo sapien
ttgtcagggcaaccgtagcgacgcc

SEQ ID NO: 8451 - DNA, 25 bp, Homo sapien
gcgactccgcaggtttcaacgctcg

SEQ ID NO: 8452 - DNA, 25 bp, Homo sapien
cgctcggacacggaaatacggtttg

SEQ ID NO: 8453 - DNA, 25 bp, Homo sapien
atacggtttgcgtctcctcgcgctt

SEQ ID NO: 8454 - DNA, 25 bp, Homo sapien
ctccctccgccgtccatgctcgggc

SEQ ID NO: 8455 - DNA, 25 bp, Homo sapien
ccatgctcgggccaagtgctgtgcg

SEQ ID NO: 8456 - DNA, 25 bp, Homo sapien
tgctgtgcggttcctgcttctgcac

SEQ ID NO: 8457 - DNA, 25 bp, Homo sapien
cagcacatggtgcttgtgggctacc

SEQ ID NO: 8458 - DNA, 25 bp, Homo sapien
acatggtgcttgtgggctacctgct

SEQ ID NO: 8459 - DNA, 25 bp, Homo sapien
tgtgcctcctgccacgtggcatgcg

SEQ ID NO: 8460 - DNA, 25 bp, Homo sapien
gtcatgtgcctcctgccacgtggca

SEQ ID NO: 8461 - DNA, 25 bp, Homo sapien
ggcacacgtgctgcgcacgctggca

SEQ ID NO: 8462 - DNA, 25 bp, Homo sapien
ccgggtgaggtctgcctgtaaatga

SEQ ID NO: 8463 - DNA, 25 bp, Homo sapien
ctcatgaacttcctgcggggcggct

SEQ ID NO: 8464 - DNA, 25 bp, Homo sapien
tcatgaacttcctgcggggcggctg

SEQ ID NO: 8465 - DNA, 25 bp, Homo sapien
gcaggaggtggtgccgtacgggcac

SEQ ID NO: 8466 - DNA, 25 bp, Homo sapien
gcccgggtgaggtctgcctgtaaat

SEQ ID NO: 8467 - DNA, 25 bp, Homo sapien
cgggtgaggtctgcctgtaaatgac

SEQ ID NO: 8468 - DNA, 25 bp, Homo sapien
cgcccgggtgaggtctgcctgtaaa

SEQ ID NO: 8469 - DNA, 25 bp, Homo sapien
ccgtctctctctctgggacctggcg

SEQ ID NO: 8470 - DNA, 25 bp, Homo sapien
ctgtaaatgacactgtgaataaacc

SEQ ID NO: 8471 - DNA, 25 bp, Homo sapien
tgacactgtgaataaacccgttacc

SEQ ID NO: 8472 - DNA, 25 bp, Homo sapien
tctctgggtcctggtggacccttgg

SEQ ID NO: 8473 - DNA, 25 bp, Homo sapien
cacttccgccgcctcgactacttct

SEQ ID NO: 8474 - DNA, 25 bp, Homo sapien
ctgcctgtaaatgacactgtgaata

SEQ ID NO: 8475 - DNA, 25 bp, Homo sapien
aatgacactgtgaataaacccgtta

SEQ ID NO: 8476 - DNA, 25 bp, Homo sapien
gttaccttacctggccttccatgtg

SEQ ID NO: 8477 - DNA, 25 bp, Homo sapien
cccgggacctgctcaagcgcctgga

SEQ ID NO: 8478 - DNA, 25 bp, Homo sapien
ggagatcacctattcctggaagttc

SEQ ID NO: 8479 - DNA, 25 bp, Homo sapien
gctccgtcttcagttcaggatgtga

SEQ ID NO: 8480 - DNA, 25 bp, Homo sapien
cgctccacaggtctccaggagttcg

SEQ ID NO: 8481 - DNA, 25 bp, Homo sapien
tgctactctagggtctgcgacctcc

SEQ ID NO: 8482 - DNA, 25 bp, Homo sapien
agcgagtgaaccctgctccgtcttc

SEQ ID NO: 8483 - DNA, 25 bp, Homo sapien
atcgtaaacttccagctgccaaagg

SEQ ID NO: 8484 - DNA, 25 bp, Homo sapien
tagacgggcgagttagccttcacta

SEQ ID NO: 8485 - DNA, 25 bp, Homo sapien
aggctatgttttcttgcatcgtaaa

SEQ ID NO: 8486 - DNA, 25 bp, Homo sapien
ccgcagctccggactcaggacttgt

SEQ ID NO: 8487 - DNA, 25 bp, Homo sapien
ttgtaggttactcagtggcaagccg

SEQ ID NO: 8488 - DNA, 25 bp, Homo sapien
caggacttgtcctatttccgagata

SEQ ID NO: 8489 - DNA, 25 bp, Homo sapien
tttccgagatatgccgcgggccgaa

SEQ ID NO: 8490 - DNA, 25 bp, Homo sapien
ggacgttctcctgcgtgatcaagca

SEQ ID NO: 8491 - DNA, 25 bp, Homo sapien
tggcccggctctacttctttcttaa

SEQ ID NO: 8492 - DNA, 25 bp, Homo sapien
agacagagttgcaggcctcgttccg

SEQ ID NO: 8493 - DNA, 25 bp, Homo sapien
ggctctgacgcccagcaatctgttc

SEQ ID NO: 8494 - DNA, 25 bp, Homo sapien
agcgcgttgtacagccactcacgga

SEQ ID NO: 8495 - DNA, 25 bp, Homo sapien
tcacggaagtacgacttggaccagc

SEQ ID NO: 8496 - DNA, 25 bp, Homo sapien
tcgtaggtcatccacgcatggtgcc

SEQ ID NO: 8497 - DNA, 25 bp, Homo sapien
cagccactctggttcatggtgacta

SEQ ID NO: 8498 - DNA, 25 bp, Homo sapien
atggccacccagtagcccacgtagg

SEQ ID NO: 8499 - DNA, 25 bp, Homo sapien
gtacagcgtcaacatggccacccag

SEQ ID NO: 8500 - DNA, 25 bp, Homo sapien
tggactcacacctggacgcggtagc

SEQ ID NO: 8501 - DNA, 25 bp, Homo sapien
accagcgtgtctgctggctcagcca

SEQ ID NO: 8502 - DNA, 25 bp, Homo sapien
ctccgagcgccttgaaggctgtgta

SEQ ID NO: 8503 - DNA, 25 bp, Homo sapien
tagttgccgtcccacacgtacgtgg

SEQ ID NO: 8504 - DNA, 25 bp, Homo sapien
tcctcgtcagcgaagacctcgcgga

SEQ ID NO: 8505 - DNA, 25 bp, Homo sapien
gacctcgcggaacatgtcgaccatg

SEQ ID NO: 8506 - DNA, 25 bp, Homo sapien
tgtcgaccatgtagaggtcctcggc

SEQ ID NO: 8507 - DNA, 25 bp, Homo sapien
ctccaggtacgcgaagaggctctgc

SEQ ID NO: 8508 - DNA, 25 bp, Homo sapien
caccaggtgcgctgaaaggaaggcc

SEQ ID NO: 8509 - DNA, 25 bp, Homo sapien
tgcacgtagtccaccgaatctccga

SEQ ID NO: 8510 - DNA, 25 bp, Homo sapien
gacctcccaagcactggttccaatg

SEQ ID NO: 8511 - DNA, 25 bp, Homo sapien
ggagcagccattttcaaccctactg

SEQ ID NO: 8512 - DNA, 25 bp, Homo sapien
atgcaatatgtctgcgcccagggga

SEQ ID NO: 8513 - DNA, 25 bp, Homo sapien
ccagccgtccctttatgatgcaata

SEQ ID NO: 8514 - DNA, 25 bp, Homo sapien
gggccatactgcgtctttccggaga

SEQ ID NO: 8515 - DNA, 25 bp, Homo sapien
ctgggaactccaacacgactgcgaa

SEQ ID NO: 8516 - DNA, 25 bp, Homo sapien
ccctagcgctactgtgcaacgaaga

SEQ ID NO: 8517 - DNA, 25 bp, Homo sapien
gaccgatgacctgtctccactgctg

SEQ ID NO: 8518 - DNA, 25 bp, Homo sapien
gtcagacgccgagggccctcgaagt

SEQ ID NO: 8519 - DNA, 25 bp, Homo sapien
aacggctggtttcgcggtcagacgc

SEQ ID NO: 8520 - DNA, 25 bp, Homo sapien
gaattctgtcgtctgggaacggctg

SEQ ID NO: 8521 - DNA, 25 bp, Homo sapien
tacgtcacaatacgaggccgaggga

SEQ ID NO: 8522 - DNA, 25 bp, Homo sapien
ggcgtggccatgatacgtcacaata

SEQ ID NO: 8523 - DNA, 25 bp, Homo sapien
aggctcagtgtttggtcccagcgtt

SEQ ID NO: 8524 - DNA, 25 bp, Homo sapien
cgaagtccctagcaacggctgcgga

SEQ ID NO: 8525 - DNA, 25 bp, Homo sapien
gtaagtcgttttggacgcaggctca

SEQ ID NO: 8526 - DNA, 25 bp, Homo sapien
cgtgcacagaaacctaataccgtgt

SEQ ID NO: 8527 - DNA, 25 bp, Homo sapien
taccgtgtggatgacgcagtaccta

SEQ ID NO: 8528 - DNA, 25 bp, Homo sapien
ctaataccgtgtggatgacgcagta

SEQ ID NO: 8529 - DNA, 25 bp, Homo sapien
tgtggatgacgcagtacctataccc

SEQ ID NO: 8530 - DNA, 25 bp, Homo sapien
gtggatgacgcagtacctatatccc

SEQ ID NO: 8531 - DNA, 25 bp, Homo sapien
tggatgacgcagtacctatatccca

SEQ ID NO: 8532 - DNA, 25 bp, Homo sapien
aaacctaataccgtgtggatgacgc

SEQ ID NO: 8533 - DNA, 25 bp, Homo sapien
caccgtgtggatgacgcagtaccta

SEQ ID NO: 8534 - DNA, 25 bp, Homo sapien
cccgcatatgcctcgtgagtgcacg

SEQ ID NO: 8535 - DNA, 25 bp, Homo sapien
ggagcgtctctgctgtgcaatctca

SEQ ID NO: 8536 - DNA, 25 bp, Homo sapien
gtcttcgtcgactgaaaggcggcct

SEQ ID NO: 8537 - DNA, 25 bp, Homo sapien
cggttgcagtcttcgtcgactgaaa

SEQ ID NO: 8538 - DNA, 25 bp, Homo sapien
ccggcaggagccgtcactctgctaa

SEQ ID NO: 8539 - DNA, 25 bp, Homo sapien
cctgtatctgctgttcggctacgga

SEQ ID NO: 8540 - DNA, 25 bp, Homo sapien
gcaatctcatcggatttgtgtaccc

SEQ ID NO: 8541 - DNA, 25 bp, Homo sapien
cgtcactctgctaagcctgtatctg

SEQ ID NO: 8542 - DNA, 25 bp, Homo sapien
caagccagccttgaccgttgcaata

SEQ ID NO: 8543 - DNA, 25 bp, Homo sapien
tctgcaaatgtcacccaagagggtg

SEQ ID NO: 8544 - DNA, 25 bp, Homo sapien
ggatttcctgcctcggcgagtcagc

SEQ ID NO: 8545 - DNA, 25 bp, Homo sapien
tgagcaaactgtccgagttggcccg

SEQ ID NO: 8546 - DNA, 25 bp, Homo sapien
ctgtgaaatggatccacggccagca

SEQ ID NO: 8547 - DNA, 25 bp, Homo sapien
cggccagcagtcaccgttcttatta

SEQ ID NO: 8548 - DNA, 25 bp, Homo sapien
tattaccgcggaacaaattattgtc

SEQ ID NO: 8549 - DNA, 25 bp, Homo sapien
cgagccgccctagttcggcgactta

SEQ ID NO: 8550 - DNA, 25 bp, Homo sapien
tcctcagtgcctgacggcgactatc

SEQ ID NO: 8551 - DNA, 25 bp, Homo sapien
ggccgccatctttgagtatctgacg

SEQ ID NO: 8552 - DNA, 25 bp, Homo sapien
cgttcccagcgtttgcgcagatgca

SEQ ID NO: 8553 - DNA, 25 bp, Homo sapien
tggcgccgacagataccagtccatc

SEQ ID NO: 8554 - DNA, 25 bp, Homo sapien
tcctgaaagaattccactggcgtcg

SEQ ID NO: 8555 - DNA, 25 bp, Homo sapien
ggacccacgctaagctcctgaaaga

SEQ ID NO: 8556 - DNA, 25 bp, Homo sapien
agcgaccacccagtgactgaactta

SEQ ID NO: 8557 - DNA, 25 bp, Homo sapien
cgtacacaaggcaaagggcgcgttt

SEQ ID NO: 8558 - DNA, 25 bp, Homo sapien
cggactcgtcgctgatttcctcaga

SEQ ID NO: 8559 - DNA, 25 bp, Homo sapien
cctacagccaaaggacccgtcatta

SEQ ID NO: 8560 - DNA, 25 bp, Homo sapien
cttcctcagcgactgcgttcaaata

SEQ ID NO: 8561 - DNA, 25 bp, Homo sapien
aggccgcgagtccatgcccagaact

SEQ ID NO: 8562 - DNA, 25 bp, Homo sapien
actggcagcgacaaaacgccgcatc

SEQ ID NO: 8563 - DNA, 25 bp, Homo sapien
tccgggaagctgagcggtaaagacc

SEQ ID NO: 8564 - DNA, 25 bp, Homo sapien
ccgctctatgaggtcacagggctgc

SEQ ID NO: 8565 - DNA, 25 bp, Homo sapien
tgcgcccatcgcagcgtttctgaca

SEQ ID NO: 8566 - DNA, 25 bp, Homo sapien
cggccatctttgagtacgtgacgta

SEQ ID NO: 8567 - DNA, 25 bp, Homo sapien
atcgccgcgacctcttaaaagctga

SEQ ID NO: 8568 - DNA, 25 bp, Homo sapien
tatagcgccaccaacaacgcagacg

SEQ ID NO: 8569 - DNA, 25 bp, Homo sapien
actgacctgactctccttggaatcg

SEQ ID NO: 8570 - DNA, 25 bp, Homo sapien
aaacctccagagacggtcagccgcg

SEQ ID NO: 8571 - DNA, 25 bp, Homo sapien
cgcgtttccatggagagcggaatgc

SEQ ID NO: 8572 - DNA, 25 bp, Homo sapien
cgtgacgtacagaaggcacagcggc

SEQ ID NO: 8573 - DNA, 25 bp, Homo sapien
gcggaatgcggccttccggcttttc

SEQ ID NO: 8574 - DNA, 25 bp, Homo sapien
gcaaacgtttaatccaggtagactg

SEQ ID NO: 8575 - DNA, 25 bp, Homo sapien
cacactcatagcgacgtggcctttc

SEQ ID NO: 8576 - DNA, 25 bp, Homo sapien
gcgcggagaacgatgtctcacgaca

SEQ ID NO: 8577 - DNA, 25 bp, Homo sapien
ccaggtcacgggtatggagaaccga

SEQ ID NO: 8578 - DNA, 25 bp, Homo sapien
ctacttacttgggacgaaggggctg

SEQ ID NO: 8579 - DNA, 25 bp, Homo sapien
gggaagcaattctcctacttacttg

SEQ ID NO: 8580 - DNA, 25 bp, Homo sapien
gggcgctagtccacatcccgaatga

SEQ ID NO: 8581 - DNA, 25 bp, Homo sapien
ttggctggaccgaaaactgggatga

SEQ ID NO: 8582 - DNA, 25 bp, Homo sapien
acctcgcgagggaggacttgacttc

SEQ ID NO: 8583 - DNA, 25 bp, Homo sapien
cgcgagggaggacttgacttcgccc

SEQ ID NO: 8584 - DNA, 25 bp, Homo sapien
gtgaggaggacactaggtggcgcgc

SEQ ID NO: 8585 - DNA, 25 bp, Homo sapien
ccctccaggcgtcgacaagggcgaa

SEQ ID NO: 8586 - DNA, 25 bp, Homo sapien
ccaggcgtcgacaagggcgaagctc

SEQ ID NO: 8587 - DNA, 25 bp, Homo sapien
gggtctcgactggtgggaatccacc

SEQ ID NO: 8588 - DNA, 25 bp, Homo sapien
ctcgactggtgggaatccacctcgc

SEQ ID NO: 8589 - DNA, 25 bp, Homo sapien
tccacctcgcgagggaggacttgac

SEQ ID NO: 8590 - DNA, 25 bp, Homo sapien
agcgataaggcctttccctggcgca

SEQ ID NO: 8591 - DNA, 25 bp, Homo sapien
cttccgggagtgacggaaactgcta

SEQ ID NO: 8592 - DNA, 25 bp, Homo sapien
agaagtgaggactgcaaagtgcacg

SEQ ID NO: 8593 - DNA, 25 bp, Homo sapien
gtaatgtttaatccacgtagactga

SEQ ID NO: 8594 - DNA, 25 bp, Homo sapien
ggcagacggagcgaagtaatgttta

SEQ ID NO: 8595 - DNA, 25 bp, Homo sapien
tgcacgtttaatccaggcagacgga

SEQ ID NO: 8596 - DNA, 25 bp, Homo sapien
cccagatcactggtacggagaagtg

SEQ ID NO: 8597 - DNA, 25 bp, Homo sapien
actgctagcggagagaaaaaactgg

SEQ ID NO: 8598 - DNA, 25 bp, Homo sapien
tgacgcgcagcgctgtgatcttttc

SEQ ID NO: 8599 - DNA, 25 bp, Homo sapien
gtgtgcaggaagctacacgccctga

SEQ ID NO: 8600 - DNA, 25 bp, Homo sapien
ccgaagcagaggtcagtaagggttt

SEQ ID NO: 8601 - DNA, 25 bp, Homo sapien
ttatcagacttacttggggcgaagg

SEQ ID NO: 8602 - DNA, 25 bp, Homo sapien
agggaagactgccaagtgcacgttc

SEQ ID NO: 8603 - DNA, 25 bp, Homo sapien
tgcacgttcgattcaggcagacggg

SEQ ID NO: 8604 - DNA, 25 bp, Homo sapien
cggggcgaagcaaatgtttagtcca

SEQ ID NO: 8605 - DNA, 25 bp, Homo sapien
tccaggtagacggaaactgacgcgc

SEQ ID NO: 8606 - DNA, 25 bp, Homo sapien
cctcattggctagaaactactgctc

SEQ ID NO: 8607 - DNA, 25 bp, Homo sapien
tggtcgctaggacacggctaacttc

SEQ ID NO: 8608 - DNA, 25 bp, Homo sapien
gtattaccaccgacgcacgcgcaga

SEQ ID NO: 8609 - DNA, 25 bp, Homo sapien
actccgcaatgaggacgttcaggtc

SEQ ID NO: 8610 - DNA, 25 bp, Homo sapien
ccctcgcggagaagactcagcgttc

SEQ ID NO: 8611 - DNA, 25 bp, Homo sapien
catcgcggtgctcatagacgaactc

SEQ ID NO: 8612 - DNA, 25 bp, Homo sapien
tccggaccaaagaaacgcgagctta

SEQ ID NO: 8613 - DNA, 25 bp, Homo sapien
ctactgctcgtctcggtcgttgtta

SEQ ID NO: 8614 - DNA, 25 bp, Homo sapien
attaagtgttcgcttagcggtgccc

SEQ ID NO: 8615 - DNA, 25 bp, Homo sapien
ttagcggtgccctcacgcttctgta

SEQ ID NO: 8616 - DNA, 25 bp, Homo sapien
cccgagtaaattcatgcgtcccgtc

SEQ ID NO: 8617 - DNA, 25 bp, Homo sapien
tgcgtcccgtcagagtgttaaaatc

SEQ ID NO: 8618 - DNA, 25 bp, Homo sapien
gagtgttaaaatcgccctagggctg

SEQ ID NO: 8619 - DNA, 25 bp, Homo sapien
tctgtctccggtcgttctgccgtag

SEQ ID NO: 8620 - DNA, 25 bp, Homo sapien
taggcagctgctttcgcgccgtttt

SEQ ID NO: 8621 - DNA, 25 bp, Homo sapien
ccgagacacgcccagagataggagg

SEQ ID NO: 8622 - DNA, 25 bp, Homo sapien
caatctcaatccaggagaagccgcg

SEQ ID NO: 8623 - DNA, 25 bp, Homo sapien
ggagcacagcgctccaatctcaatc

SEQ ID NO: 8624 - DNA, 25 bp, Homo sapien
ctcgcctttgttggccctggagcac

SEQ ID NO: 8625 - DNA, 25 bp, Homo sapien
ccgctaggcggattccggtctatgc

SEQ ID NO: 8626 - DNA, 25 bp, Homo sapien
caagtccttcagtgatgcttacatc

SEQ ID NO: 8627 - DNA, 25 bp, Homo sapien
cgtccttctgccacagggccatgta

SEQ ID NO: 8628 - DNA, 25 bp, Homo sapien
tgtgtaaattaatctgcgcttccca

SEQ ID NO: 8629 - DNA, 25 bp, Homo sapien
tgtcgcggagttttcctgtttcaag

SEQ ID NO: 8630 - DNA, 25 bp, Homo sapien
acagggtctctcctctttgggcggc

SEQ ID NO: 8631 - DNA, 25 bp, Homo sapien
ctcatctgacggtgccgggattcct

SEQ ID NO: 8632 - DNA, 25 bp, Homo sapien
gggattcctaatctgcccggaagta

SEQ ID NO: 8633 - DNA, 25 bp, Homo sapien
gcccggaagtaacgcaaatgctctg

SEQ ID NO: 8634 - DNA, 25 bp, Homo sapien
aatgctctgtgaatgttgactccgc

SEQ ID NO: 8635 - DNA, 25 bp, Homo sapien
ccagagattgcttggcgtgatgtgc

SEQ ID NO: 8636 - DNA, 25 bp, Homo sapien
tggtgatggatgcaaaccctctgcg

SEQ ID NO: 8637 - DNA, 25 bp, Homo sapien
actccgctgcggttagccagagatt

SEQ ID NO: 8638 - DNA, 25 bp, Homo sapien
cgcgtcgtgcgtccgctgttcctaa

SEQ ID NO: 8639 - DNA, 25 bp, Homo sapien
cctggaagctgaccgtacgtaaccg

SEQ ID NO: 8640 - DNA, 25 bp, Homo sapien
ccagtcttgcaggtcctggcccgta

SEQ ID NO: 8641 - DNA, 25 bp, Homo sapien
acgcttccgggaaccagtcttgcag

SEQ ID NO: 8642 - DNA, 25 bp, Homo sapien
accttgcctccctttctgactttgg

SEQ ID NO: 8643 - DNA, 25 bp, Homo sapien
tcatgaacgacctcagcgggcgagc

SEQ ID NO: 8644 - DNA, 25 bp, Homo sapien
acggggccgtagacagaatcatgaa

SEQ ID NO: 8645 - DNA, 25 bp, Homo sapien
ctgttcctaaggcaccacggggccg

SEQ ID NO: 8646 - DNA, 25 bp, Homo sapien
gctctctatgctgcgcgcgcgcagt

SEQ ID NO: 8647 - DNA, 25 bp, Homo sapien
aactctttactgacccaacgtcctg

SEQ ID NO: 8648 - DNA, 25 bp, Homo sapien
gattttcgagactcctttccgctta

SEQ ID NO: 8649 - DNA, 25 bp, Homo sapien
gccaggtaaacacggattttcgaga

SEQ ID NO: 8650 - DNA, 25 bp, Homo sapien
gcagcgcgtcagtttccctttgttt

SEQ ID NO: 8651 - DNA, 25 bp, Homo sapien
tgggtagaaggtcacaccgcagcgc

SEQ ID NO: 8652 - DNA, 25 bp, Homo sapien
atcgcgtgggtagaaggtcacaccg

SEQ ID NO: 8653 - DNA, 25 bp, Homo sapien
cgcgcgcgcagttttttgcagaccc

SEQ ID NO: 8654 - DNA, 25 bp, Homo sapien
cccgcgagatggatccacgtctttc

SEQ ID NO: 8655 - DNA, 25 bp, Homo sapien
tgtcgcggagtttgcctgcttcaaa

SEQ ID NO: 8656 - DNA, 25 bp, Homo sapien
cggtctttcaccacagggccatgta

SEQ ID NO: 8657 - DNA, 25 bp, Homo sapien
ttctaatgagagtctggcggtcgct

SEQ ID NO: 8658 - DNA, 25 bp, Homo sapien
ccgactaaactcagacgttctaatg

SEQ ID NO: 8659 - DNA, 25 bp, Homo sapien
ttctgtacccggcatctcaggggtc

SEQ ID NO: 8660 - DNA, 25 bp, Homo sapien
tggagacccggaagcagattacgtg

SEQ ID NO: 8661 - DNA, 25 bp, Homo sapien
ggcccgcgctgcgtaaagttctcac

SEQ ID NO: 8662 - DNA, 25 bp, Homo sapien
cggaagccgattgcagggagaaact

SEQ ID NO: 8663 - DNA, 25 bp, Homo sapien
gcgcaatttcgtgcaaacccggaag

SEQ ID NO: 8664 - DNA, 25 bp, Homo sapien
cgcagccagtcaagcgaacggaagc

SEQ ID NO: 8665 - DNA, 25 bp, Homo sapien
ggcctctaggatgcgcgcgcaattt

SEQ ID NO: 8666 - DNA, 25 bp, Homo sapien
ggcgaacgcctagagcgcagtttcc

SEQ ID NO: 8667 - DNA, 25 bp, Homo sapien
ctagagcgcagtttccggtagaccc

SEQ ID NO: 8668 - DNA, 25 bp, Homo sapien
ggagaaactgttttcgcagcagtgc

SEQ ID NO: 8669 - DNA, 25 bp, Homo sapien
agccagtccggcctctaggatgcgc

SEQ ID NO: 8670 - DNA, 25 bp, Homo sapien
agcgttggccgcctgagcagaggct

SEQ ID NO: 8671 - DNA, 25 bp, Homo sapien
ttctgcttcgcttggcgatgcaaaa

SEQ ID NO: 8672 - DNA, 25 bp, Homo sapien
gtgctgaggagccaaccggcccaaa

SEQ ID NO: 8673 - DNA, 25 bp, Homo sapien
ctgaggagccaaccggcccaaactt

SEQ ID NO: 8674 - DNA, 25 bp, Homo sapien
aggctgccgcggagctaagacaccc

SEQ ID NO: 8675 - DNA, 25 bp, Homo sapien
ggagctaagacacccgccgtttcac

SEQ ID NO: 8676 - DNA, 25 bp, Homo sapien
acccgccgtttcacccagccagcgg

SEQ ID NO: 8677 - DNA, 25 bp, Homo sapien
cttccgtttctgcttcgcttggcga

SEQ ID NO: 8678 - DNA, 25 bp, Homo sapien
aatcatggggcgtgaactcgcaagc

SEQ ID NO: 8679 - DNA, 25 bp, Homo sapien
actcgcaagcgcagtttcctgaaga

SEQ ID NO: 8680 - DNA, 25 bp, Homo sapien
tagatccgcttccagcgcttctgta

SEQ ID NO: 8681 - DNA, 25 bp, Homo sapien
tcgggccacgtagacgcttttcgtc

SEQ ID NO: 8682 - DNA, 25 bp, Homo sapien
ttcggtcccgcgtcatgtaaaagcc

SEQ ID NO: 8683 - DNA, 25 bp, Homo sapien
cctggaaacccggaagtgaatcatg

SEQ ID NO: 8684 - DNA, 25 bp, Homo sapien
cacccatgaggtgtattcacgccca

SEQ ID NO: 8685 - DNA, 25 bp, Homo sapien
ggtcccgcagtctcgatgcatcagc

SEQ ID NO: 8686 - DNA, 25 bp, Homo sapien
aaccaggtggcgtatcgcttggagt

SEQ ID NO: 8687 - DNA, 25 bp, Homo sapien
ttctatagcgtaattttcctgctca

SEQ ID NO: 8688 - DNA, 25 bp, Homo sapien
cagtgtatacacttctatagcgtaa

SEQ ID NO: 8689 - DNA, 25 bp, Homo sapien
gtcttcattcacatagagcaaattg

SEQ ID NO: 8690 - DNA, 25 bp, Homo sapien
gaaattctcgcttgtcttcattcac

SEQ ID NO: 8691 - DNA, 25 bp, Homo sapien
agtgaaggtcctaccgcggcatgtg

SEQ ID NO: 8692 - DNA, 25 bp, Homo sapien
tgcgcgcgcaaaccaggtggcgtat

SEQ ID NO: 8693 - DNA, 25 bp, Homo sapien
tcctaccgcggcatgtgagtttcgc

SEQ ID NO: 8694 - DNA, 25 bp, Homo sapien
acccacgaggtggattcttgcccgg

SEQ ID NO: 8695 - DNA, 25 bp, Homo sapien
tcctcgcgctatttaaagtcttcac

SEQ ID NO: 8696 - DNA, 25 bp, Homo sapien
tccctcctcgcgctatttaaagtct

SEQ ID NO: 8697 - DNA, 25 bp, Homo sapien
ttctattgcgtagtttttctgctca

SEQ ID NO: 8698 - DNA, 25 bp, Homo sapien
agaggccgggtgtcgcttcctttcg

SEQ ID NO: 8699 - DNA, 25 bp, Homo sapien
gttgcattaagtctccgcttcccag

SEQ ID NO: 8700 - DNA, 25 bp, Homo sapien
ctgtgttgcattaagtctccgcttc

SEQ ID NO: 8701 - DNA, 25 bp, Homo sapien
gtgaaggtcacgtcgccatggtgag

SEQ ID NO: 8702 - DNA, 25 bp, Homo sapien
caaaaccctgtgctgactccaccca

SEQ ID NO: 8703 - DNA, 25 bp, Homo sapien
tggagcgaagcgctgtgtccccagt

SEQ ID NO: 8704 - DNA, 25 bp, Homo sapien
cccaattcttcccttcgcagtcacc

SEQ ID NO: 8705 - DNA, 25 bp, Homo sapien
aaccagcgtagggcaggtcccagcg

SEQ ID NO: 8706 - DNA, 25 bp, Homo sapien
ggtcccagcggcttgtcctatgaca

SEQ ID NO: 8707 - DNA, 25 bp, Homo sapien
gtcccagcggcttgtcctatgacac

SEQ ID NO: 8708 - DNA, 25 bp, Homo sapien
cgcaaaccccgaggcggatcgcgtg

SEQ ID NO: 8709 - DNA, 25 bp, Homo sapien
tcttcggcccctggagcgaagcgct

SEQ ID NO: 8710 - DNA, 25 bp, Homo sapien
ccgcggctctttgtcgcttccgagg

SEQ ID NO: 8711 - DNA, 25 bp, Homo sapien
atcctgtcgcggctcgaaaggaatg

SEQ ID NO: 8712 - DNA, 25 bp, Homo sapien
atgaacttgcgtcccgcgtccgggc

SEQ ID NO: 8713 - DNA, 25 bp, Homo sapien
tcgcggcggcttctgcttcttggat

SEQ ID NO: 8714 - DNA, 25 bp, Homo sapien
cagggaagcccaggggtcactgtct

SEQ ID NO: 8715 - DNA, 25 bp, Homo sapien
cccaccaagcgcgaggagaagtacg

SEQ ID NO: 8716 - DNA, 25 bp, Homo sapien
aaatggcggcctagacgcggagttt

SEQ ID NO: 8717 - DNA, 25 bp, Homo sapien
ctcgaaaggaatggaaaatggcggc

SEQ ID NO: 8718 - DNA, 25 bp, Homo sapien
cctgggaatccggaagtcgcttcct

SEQ ID NO: 8719 - DNA, 25 bp, Homo sapien
gcaaacgtcgcgatcccagtctcag

SEQ ID NO: 8720 - DNA, 25 bp, Homo sapien
tctcaacctttaggcgcctgaagcg

SEQ ID NO: 8721 - DNA, 25 bp, Homo sapien
acccgagatgtgtatttccgcctgg

SEQ ID NO: 8722 - DNA, 25 bp, Homo sapien
cctatcgcgtagtttctgtgctcaa

SEQ ID NO: 8723 - DNA, 25 bp, Homo sapien
aggctgttcccgtctccagtctttc

SEQ ID NO: 8724 - DNA, 25 bp, Homo sapien
ctggctttagtcctgtgcgcacaca

SEQ ID NO: 8725 - DNA, 25 bp, Homo sapien
agtctttctgctacagggcgctgta

SEQ ID NO: 8726 - DNA, 25 bp, Homo sapien
gctaaagcgcaaatctggagactgt

SEQ ID NO: 8727 - DNA, 25 bp, Homo sapien
attgccgatggttacgtggttctca

SEQ ID NO: 8728 - DNA, 25 bp, Homo sapien
ggttctcactggaaacaatgttgtc

SEQ ID NO: 8729 - DNA, 25 bp, Homo sapien
tcattttcaaatcacgctggggtcc

SEQ ID NO: 8730 - DNA, 25 bp, Homo sapien
ggtcctctcgcccacgcaggaatgg

SEQ ID NO: 8731 - DNA, 25 bp, Homo sapien
tcgcttgtcggctttaaagctaaag

SEQ ID NO: 8732 - DNA, 25 bp, Homo sapien
ccctagggtaactgtctgagatcca

SEQ ID NO: 8733 - DNA, 25 bp, Homo sapien
tggggtccctgttgaggaaactctc

SEQ ID NO: 8734 - DNA, 25 bp, Homo sapien
cagcgagttggactctcgccctggg

SEQ ID NO: 8735 - DNA, 25 bp, Homo sapien
gctcctcatcggcgcctggagggca

SEQ ID NO: 8736 - DNA, 25 bp, Homo sapien
tcctcaccagcgagttggactctcg

SEQ ID NO: 8737 - DNA, 25 bp, Homo sapien
gtttcaggtcctcaccagcgagttg

SEQ ID NO: 8738 - DNA, 25 bp, Homo sapien
ctcctgtagcgaaactttccttctc

SEQ ID NO: 8739 - DNA, 25 bp, Homo sapien
gtcttttctgcagtagggccgtgca

SEQ ID NO: 8740 - DNA, 25 bp, Homo sapien
ccgtcccggtcttttctgcagtagg

SEQ ID NO: 8741 - DNA, 25 bp, Homo sapien
tccgaaggcgccatcgcccaccacc

SEQ ID NO: 8742 - DNA, 25 bp, Homo sapien
tgggtttaaaatcgccttgaagctg

SEQ ID NO: 8743 - DNA, 25 bp, Homo sapien
tcgccttgaagctggtgcggtctct

SEQ ID NO: 8744 - DNA, 25 bp, Homo sapien
agtccttacaggtgaggtggattcc

SEQ ID NO: 8745 - DNA, 25 bp, Homo sapien
tctggtcttgctgctatagggcaat

SEQ ID NO: 8746 - DNA, 25 bp, Homo sapien
atcagcgcgaacctggaagcggaga

SEQ ID NO: 8747 - DNA, 25 bp, Homo sapien
tctgtcctgcgcgagcagatcagcg

SEQ ID NO: 8748 - DNA, 25 bp, Homo sapien
cgctgggctcaagactgactctgtc

SEQ ID NO: 8749 - DNA, 25 bp, Homo sapien
tgagacttccctttgagagtccggg

SEQ ID NO: 8750 - DNA, 25 bp, Homo sapien
acctggtaagcgcagacttaataga

SEQ ID NO: 8751 - DNA, 25 bp, Homo sapien
atccggactctcatggggacgtctc

SEQ ID NO: 8752 - DNA, 25 bp, Homo sapien
cttaatagaagagcgaaactcaccg

SEQ ID NO: 8753 - DNA, 25 bp, Homo sapien
gccacggtgtaactttcactccaca

SEQ ID NO: 8754 - DNA, 25 bp, Homo sapien
catgtgcgcgcgcagtacagaagcc

SEQ ID NO: 8755 - DNA, 25 bp, Homo sapien
gtgagtctctcagcatcgttcccag

SEQ ID NO: 8756 - DNA, 25 bp, Homo sapien
cgttcccagcgcagaggcatttttc

SEQ ID NO: 8757 - DNA, 25 bp, Homo sapien
ctgcgctccagtggcctacgaaggc

SEQ ID NO: 8758 - DNA, 25 bp, Homo sapien
gcgggaggagtctgaaaatgatttt

SEQ ID NO: 8759 - DNA, 25 bp, Homo sapien
agatttgcgagaatctgcgcgcgca

SEQ ID NO: 8760 - DNA, 25 bp, Homo sapien
gtgtgtctcacatcctggctcccag

SEQ ID NO: 8761 - DNA, 25 bp, Homo sapien
aagttccagatctgtggggacccta

SEQ ID NO: 8762 - DNA, 25 bp, Homo sapien
cgaagcagagagactttgcggttta

SEQ ID NO: 8763 - DNA, 25 bp, Homo sapien
ttcagaggccgacaagggcaaggct

SEQ ID NO: 8764 - DNA, 25 bp, Homo sapien
ctaggtccgagggacagaaacgctg

SEQ ID NO: 8765 - DNA, 25 bp, Homo sapien
acgcgatccgcttccagatttgcga

SEQ ID NO: 8766 - DNA, 25 bp, Homo sapien
taggacctttactccacgtgatcca

SEQ ID NO: 8767 - DNA, 25 bp, Homo sapien
ccacgtgatccacttccgggtttgc

SEQ ID NO: 8768 - DNA, 25 bp, Homo sapien
gccgggaccagacctgtgcatctct

SEQ ID NO: 8769 - DNA, 25 bp, Homo sapien
cgtgatccacttccgggtttgctgc

SEQ ID NO: 8770 - DNA, 25 bp, Homo sapien
ctcggtaggacctttactccacgtg

SEQ ID NO: 8771 - DNA, 25 bp, Homo sapien
gcgcctcggtaggacctttactcca

SEQ ID NO: 8772 - DNA, 25 bp, Homo sapien
cggtaggacctttactccacgtgat

SEQ ID NO: 8773 - DNA, 25 bp, Homo sapien
gacctttactccacgtgatccactt

SEQ ID NO: 8774 - DNA, 25 bp, Homo sapien
cgctcccagcgtctctgttttcagg

SEQ ID NO: 8775 - DNA, 25 bp, Homo sapien
cagcgtctctgttttcaggttttgg

SEQ ID NO: 8776 - DNA, 25 bp, Homo sapien
tcaccgcggcgatatgacctacact

SEQ ID NO: 8777 - DNA, 25 bp, Homo sapien
gggaacctagttagcgcagacttaa

SEQ ID NO: 8778 - DNA, 25 bp, Homo sapien
gacagaagccctgggaacctagtta

SEQ ID NO: 8779 - DNA, 25 bp, Homo sapien
gaagacgccggagaatttccaggtc

SEQ ID NO: 8780 - DNA, 25 bp, Homo sapien
tgggcaagaatccacatcgcgggtg

SEQ ID NO: 8781 - DNA, 25 bp, Homo sapien
ggcgccctgggcaagaatccacatc

SEQ ID NO: 8782 - DNA, 25 bp, Homo sapien
cctgtgcttctcagcctcgcactca

SEQ ID NO: 8783 - DNA, 25 bp, Homo sapien
ttttcgagtttttggaggcgacagc

SEQ ID NO: 8784 - DNA, 25 bp, Homo sapien
agactcttaccgggacgtctcaatt

SEQ ID NO: 8785 - DNA, 25 bp, Homo sapien
tttcgagtttttggaggcgacagcg

SEQ ID NO: 8786 - DNA, 25 bp, Homo sapien
ttccagactcttaccgggacgtctc

SEQ ID NO: 8787 - DNA, 25 bp, Homo sapien
cttccagactcttaccgggacgtct

SEQ ID NO: 8788 - DNA, 25 bp, Homo sapien
cgggaatagtcagaaaaatgttttg

SEQ ID NO: 8789 - DNA, 25 bp, Homo sapien
tccagactcttaccgggacgtctca

SEQ ID NO: 8790 - DNA, 25 bp, Homo sapien
ggatcccaggaccacagaacgcagc

SEQ ID NO: 8791 - DNA, 25 bp, Homo sapien
aggaccacagaacgcagccttcccg

SEQ ID NO: 8792 - DNA, 25 bp, Homo sapien
gcgctgtgctccaggaacccaggag

SEQ ID NO: 8793 - DNA, 25 bp, Homo sapien
aggagagtaaggctgggaggcgcac

SEQ ID NO: 8794 - DNA, 25 bp, Homo sapien
cgcacagggtgggaatacacctcta

SEQ ID NO: 8795 - DNA, 25 bp, Homo sapien
taaaaagagccgtgcggaaggagtc

SEQ ID NO: 8796 - DNA, 25 bp, Homo sapien
gagccgtgcggaaggagtcaaaaaa

SEQ ID NO: 8797 - DNA, 25 bp, Homo sapien
tgggaatacacctctagggtgagga

SEQ ID NO: 8798 - DNA, 25 bp, Homo sapien
tcactggcactgacccgctgatagc

SEQ ID NO: 8799 - DNA, 25 bp, Homo sapien
gctgccggcttttcacggggaagcc

SEQ ID NO: 8800 - DNA, 25 bp, Homo sapien
tctcttaccaaacagacaggacgga

SEQ ID NO: 8801 - DNA, 25 bp, Homo sapien
ctttggatacgacgaagaggcttcc

SEQ ID NO: 8802 - DNA, 25 bp, Homo sapien
tggttgtggagaccttctttggata

SEQ ID NO: 8803 - DNA, 25 bp, Homo sapien
cattttggtcacaagccggtggttg

SEQ ID NO: 8804 - DNA, 25 bp, Homo sapien
tgaactgacacgtcgcattttggtc

SEQ ID NO: 8805 - DNA, 25 bp, Homo sapien
tgcctgggtctggtttgaactgaca

SEQ ID NO: 8806 - DNA, 25 bp, Homo sapien
gtcaggccatgtgcgtgcactggca

SEQ ID NO: 8807 - DNA, 25 bp, Homo sapien
gacacacccggctccagtgtccgtc

SEQ ID NO: 8808 - DNA, 25 bp, Homo sapien
agtgtccgtccaccgtgagcccgtg

SEQ ID NO: 8809 - DNA, 25 bp, Homo sapien
ttaccgtgttctccctgccgcttgg

SEQ ID NO: 8810 - DNA, 25 bp, Homo sapien
ttcagccgcagatatgccgctgcag

SEQ ID NO: 8811 - DNA, 25 bp, Homo sapien
tggctccctttcagccgcagatatg

SEQ ID NO: 8812 - DNA, 25 bp, Homo sapien
ccgctgcagccactgtgtcggctgg

SEQ ID NO: 8813 - DNA, 25 bp, Homo sapien
cttcaagttaccgtgttctccctgc

SEQ ID NO: 8814 - DNA, 25 bp, Homo sapien
accacttccgtatgaggcacgattc

SEQ ID NO: 8815 - DNA, 25 bp, Homo sapien
cccgttgagatgtgtggctctcctc

SEQ ID NO: 8816 - DNA, 25 bp, Homo sapien
ctgcagagtctgacaaaccaggctc

SEQ ID NO: 8817 - DNA, 25 bp, Homo sapien
caggtgcgtaaacggtggcaacctc

SEQ ID NO: 8818 - DNA, 25 bp, Homo sapien
cgagcagctggtaatcgggctcttc

SEQ ID NO: 8819 - DNA, 25 bp, Homo sapien
gcttctccatagctgagcggctccg

SEQ ID NO: 8820 - DNA, 25 bp, Homo sapien
tgcgacggctgctcactacattcgg

SEQ ID NO: 8821 - DNA, 25 bp, Homo sapien
gcacgattcgttggcattcttcacc

SEQ ID NO: 8822 - DNA, 25 bp, Homo sapien
cacaggacagtatagaaatcttctc

SEQ ID NO: 8823 - DNA, 25 bp, Homo sapien
tggcccacaggacagtatagaaatc

SEQ ID NO: 8824 - DNA, 25 bp, Homo sapien
gctgatggcccacaggacagtatag

SEQ ID NO: 8825 - DNA, 25 bp, Homo sapien
tttctgggcggaacgtaggatttca

SEQ ID NO: 8826 - DNA, 25 bp, Homo sapien
atagtctggaaggaggatgcaaact

SEQ ID NO: 8827 - DNA, 25 bp, Homo sapien
ccctggaatagtctggaaggaggat

SEQ ID NO: 8828 - DNA, 25 bp, Homo sapien
gaaggcagacggataattcaaaagc

SEQ ID NO: 8829 - DNA, 25 bp, Homo sapien
cagacggataattcaaaagccctgg

SEQ ID NO: 8830 - DNA, 25 bp, Homo sapien
tgggtcctgagctttcctccatctc

SEQ ID NO: 8831 - DNA, 25 bp, Homo sapien
cgctgtggtgtgaccttcagtccct

SEQ ID NO: 8832 - DNA, 25 bp, Homo sapien
ccacaggactgggaagcacacataa

SEQ ID NO: 8833 - DNA, 25 bp, Homo sapien
aattccgcgataggaggtgtctgca

SEQ ID NO: 8834 - DNA, 25 bp, Homo sapien
tgcctcagggccactttaaactcga

SEQ ID NO: 8835 - DNA, 25 bp, Homo sapien
taaactcgaagggactcacggactc

SEQ ID NO: 8836 - DNA, 25 bp, Homo sapien
ccggtatagcagcaccacaggactg

SEQ ID NO: 8837 - DNA, 25 bp, Homo sapien
tgggaagcacacataaaacagagcg

SEQ ID NO: 8838 - DNA, 25 bp, Homo sapien
cagcgcgtgctgcagacatcaatca

SEQ ID NO: 8839 - DNA, 25 bp, Homo sapien
cgtccaatgggaagcgagtgcccac

SEQ ID NO: 8840 - DNA, 25 bp, Homo sapien
ggagtcccttcatgtcccgtcctgc

SEQ ID NO: 8841 - DNA, 25 bp, Homo sapien
tgctgcagacatcaatcacagaagg

SEQ ID NO: 8842 - DNA, 25 bp, Homo sapien
catcaatcacagaaggcaccacgtc

SEQ ID NO: 8843 - DNA, 25 bp, Homo sapien
cacgtcactgaagcgccaggcctgg

SEQ ID NO: 8844 - DNA, 25 bp, Homo sapien
ggcacctggggccacaagccacgag

SEQ ID NO: 8845 - DNA, 25 bp, Homo sapien
agaaggcaccacgtcactgaagcgc

SEQ ID NO: 8846 - DNA, 25 bp, Homo sapien
ccagagcagggatccacctctcggg

SEQ ID NO: 8847 - DNA, 25 bp, Homo sapien
gagcagggatccacctctcgggtga

SEQ ID NO: 8848 - DNA, 25 bp, Homo sapien
tccctgggactgtggtgtcagcgct

SEQ ID NO: 8849 - DNA, 25 bp, Homo sapien
ctccctgggactgtggtgtcagcgc

SEQ ID NO: 8850 - DNA, 25 bp, Homo sapien
accaccgggcagagaacgcggcctc

SEQ ID NO: 8851 - DNA, 25 bp, Homo sapien
aggatcccaccaccgggcagagaac

SEQ ID NO: 8852 - DNA, 25 bp, Homo sapien
gcaggatcccaccaccgggcagaga

SEQ ID NO: 8853 - DNA, 25 bp, Homo sapien
aggagtcaacaaacggttgtgaacg

SEQ ID NO: 8854 - DNA, 25 bp, Homo sapien
tttgtgcgaatctgctctctgggga

SEQ ID NO: 8855 - DNA, 25 bp, Homo sapien
gctcaggagaaacggtgattacgga

SEQ ID NO: 8856 - DNA, 25 bp, Homo sapien
ttccgggtttgtgcgaatctgctct

SEQ ID NO: 8857 - DNA, 25 bp, Homo sapien
ccgggtttgtgcgaatctgctctct

SEQ ID NO: 8858 - DNA, 25 bp, Homo sapien
gggtttgtgcgaatctgctctctgg

SEQ ID NO: 8859 - DNA, 25 bp, Homo sapien
aatctgctctctggggacagaagcc

SEQ ID NO: 8860 - DNA, 25 bp, Homo sapien
gcgaatctgctctctggggacagaa

SEQ ID NO: 8861 - DNA, 25 bp, Homo sapien
tgtgcgaatctgctctctggggaca

SEQ ID NO: 8862 - DNA, 25 bp, Homo sapien
acagaagcgggacctgggccagatc

SEQ ID NO: 8863 - DNA, 25 bp, Homo sapien
actaggaaacgcacacgccgccgtg

SEQ ID NO: 8864 - DNA, 25 bp, Homo sapien
atatagcagcaccagacaactagga

SEQ ID NO: 8865 - DNA, 25 bp, Homo sapien
tgctaaggaaagtttcgcgacagga

SEQ ID NO: 8866 - DNA, 25 bp, Homo sapien
ggacgcgtcagaaagggttttgcta

SEQ ID NO: 8867 - DNA, 25 bp, Homo sapien
cggggcctgagcttttctccatctc

SEQ ID NO: 8868 - DNA, 25 bp, Homo sapien
ggaagcgctcttgcccagggcaaga

SEQ ID NO: 8869 - DNA, 25 bp, Homo sapien
gcaagaatccagctccgggtgagga

SEQ ID NO: 8870 - DNA, 25 bp, Homo sapien
ctaaactgggcgctcgggacagaag

SEQ ID NO: 8871 - DNA, 25 bp, Homo sapien
tgcggtgactttcactccacgcgat

SEQ ID NO: 8872 - DNA, 25 bp, Homo sapien
gcgatccgcttcccggtttacgcta

SEQ ID NO: 8873 - DNA, 25 bp, Homo sapien
cggtttacgctaaactgggcgctcg

SEQ ID NO: 8874 - DNA, 25 bp, Homo sapien
tttacgctaaactgggcgctcggga

SEQ ID NO: 8875 - DNA, 25 bp, Homo sapien
ttacgctaaactgggcgctcgggac

SEQ ID NO: 8876 - DNA, 25 bp, Homo sapien
aaactgggcgctcgggacagaagcc

SEQ ID NO: 8877 - DNA, 25 bp, Homo sapien
cgctcgggacagaagccaggtctcg

SEQ ID NO: 8878 - DNA, 25 bp, Homo sapien
aactaagcgcagagcggaatcctgg

SEQ ID NO: 8879 - DNA, 25 bp, Homo sapien
gcgaagcccaagtttaatcttaata

SEQ ID NO: 8880 - DNA, 25 bp, Homo sapien
gagggaaatccacgcgccgccatac

SEQ ID NO: 8881 - DNA, 25 bp, Homo sapien
taccaggttcactccgcgcgatctg

SEQ ID NO: 8882 - DNA, 25 bp, Homo sapien
cccaagagtctcatagcgatgtgtg

SEQ ID NO: 8883 - DNA, 25 bp, Homo sapien
cctgaaggcagaaacaccggcgacg

SEQ ID NO: 8884 - DNA, 25 bp, Homo sapien
gcgatgtgtgacttactagcagtga

SEQ ID NO: 8885 - DNA, 25 bp, Homo sapien
tcaggcgtgtacgaacctccaaatc

SEQ ID NO: 8886 - DNA, 25 bp, Homo sapien
tgctcggcggtgtcaccttcacaca

SEQ ID NO: 8887 - DNA, 25 bp, Homo sapien
gggacggcgaatcgaaggcttaatc

SEQ ID NO: 8888 - DNA, 25 bp, Homo sapien
acctaggcacactcttgctcggcgg

SEQ ID NO: 8889 - DNA, 25 bp, Homo sapien
cgaaggcttaatctacacctaggca

SEQ ID NO: 8890 - DNA, 25 bp, Homo sapien
tcagagcgagttttacccacatggc

SEQ ID NO: 8891 - DNA, 25 bp, Homo sapien
cccacatggcgaggtccgtatttac

SEQ ID NO: 8892 - DNA, 25 bp, Homo sapien
tatttacctcgggtgaagggcgcga

SEQ ID NO: 8893 - DNA, 25 bp, Homo sapien
actccaagaaactgcacgtgcgcgc

SEQ ID NO: 8894 - DNA, 25 bp, Homo sapien
tacgccatggtgtgatgcttgctcc

SEQ ID NO: 8895 - DNA, 25 bp, Homo sapien
ccacttccgggtctgtgggcaactg

SEQ ID NO: 8896 - DNA, 25 bp, Homo sapien
ttacttggcccaaggcagaaagacc

SEQ ID NO: 8897 - DNA, 25 bp, Homo sapien
aaggaagcgtctccgggcccacaca

SEQ ID NO: 8898 - DNA, 25 bp, Homo sapien
gcaaggcctatttacctgaggtgga

SEQ ID NO: 8899 - DNA, 25 bp, Homo sapien
caggttgagtctacacagaggaaca

SEQ ID NO: 8900 - DNA, 25 bp, Homo sapien
caactgcgcgaaggaaagcgaccga

SEQ ID NO: 8901 - DNA, 25 bp, Homo sapien
agaggaacactcatacgccatggtg

SEQ ID NO: 8902 - DNA, 25 bp, Homo sapien
cagatctcccagttttgcctggcta

SEQ ID NO: 8903 - DNA, 25 bp, Homo sapien
gggaagtcctttccgctgctccagg

SEQ ID NO: 8904 - DNA, 25 bp, Homo sapien
ctgcaattgtcttcggcgagatctc

SEQ ID NO: 8905 - DNA, 25 bp, Homo sapien
gctcctccgatgtcctcatttactg

SEQ ID NO: 8906 - DNA, 25 bp, Homo sapien
gcttaccttccgctgcttacagata

SEQ ID NO: 8907 - DNA, 25 bp, Homo sapien
ggtcgcgccagatgcagttgcataa

SEQ ID NO: 8908 - DNA, 25 bp, Homo sapien
ggcgtctgtctggaacccacatcgc

SEQ ID NO: 8909 - DNA, 25 bp, Homo sapien
ccctgacgtcgccaaagttgccaga

SEQ ID NO: 8910 - DNA, 25 bp, Homo sapien
acccaggacgggaatacacctcttg

SEQ ID NO: 8911 - DNA, 25 bp, Homo sapien
cgcgacagcgccttcagacaggggt

SEQ ID NO: 8912 - DNA, 25 bp, Homo sapien
acagagggtcactcacgctcgacgc

SEQ ID NO: 8913 - DNA, 25 bp, Homo sapien
acagggagcgcaggtttaatctaca

SEQ ID NO: 8914 - DNA, 25 bp, Homo sapien
acatcggctgtggaaatgggaaaca

SEQ ID NO: 8915 - DNA, 25 bp, Homo sapien
aagggccgtatcgaccctggacatc

SEQ ID NO: 8916 - DNA, 25 bp, Homo sapien
acccacactgcgaggcctgtattca

SEQ ID NO: 8917 - DNA, 25 bp, Homo sapien
caacgcgatccgtttccgggcctgt

SEQ ID NO: 8918 - DNA, 25 bp, Homo sapien
cagagctacttcaacccaaagagaa

SEQ ID NO: 8919 - DNA, 25 bp, Homo sapien
tcagagctacttcaacccaaagaga

SEQ ID NO: 8920 - DNA, 25 bp, Homo sapien
gagctacttcaacccaaagagaagc

SEQ ID NO: 8921 - DNA, 25 bp, Homo sapien
cgactccgaacccacaccgcgagtc

SEQ ID NO: 8922 - DNA, 25 bp, Homo sapien
gaagcctcagagctacttcaaccca

SEQ ID NO: 8923 - DNA, 25 bp, Homo sapien
aagcctcagagctacttcaacccaa

SEQ ID NO: 8924 - DNA, 25 bp, Homo sapien
agaagcctcagagctacttcaaccc

SEQ ID NO: 8925 - DNA, 25 bp, Homo sapien
cctcagagctacttcaacccaaaga

SEQ ID NO: 8926 - DNA, 25 bp, Homo sapien
ttccctcagcctgcctagcccgcag

SEQ ID NO: 8927 - DNA, 25 bp, Homo sapien
gagtgttcactatgtccccgggagc

SEQ ID NO: 8928 - DNA, 25 bp, Homo sapien
aacgctggagtgttcactatgtccc

SEQ ID NO: 8929 - DNA, 25 bp, Homo sapien
tagaaacgctggagtgttcactatg

SEQ ID NO: 8930 - DNA, 25 bp, Homo sapien
agcccgcagtctcatttttcccggt

SEQ ID NO: 8931 - DNA, 25 bp, Homo sapien
tgcctagcccgcagtctcatttttc

SEQ ID NO: 8932 - DNA, 25 bp, Homo sapien
tctgcggacgaaacgctggggcgga

SEQ ID NO: 8933 - DNA, 25 bp, Homo sapien
tagcccgcagtctcatttttcccgg

SEQ ID NO: 8934 - DNA, 25 bp, Homo sapien
aacacgatccgcttccggaactgca

SEQ ID NO: 8935 - DNA, 25 bp, Homo sapien
gcgcggaaaagagcccgggcactct

SEQ ID NO: 8936 - DNA, 25 bp, Homo sapien
ccgcttccggaactgcagaaaactg

SEQ ID NO: 8937 - DNA, 25 bp, Homo sapien
ggcacggcggttcgcaagtttaatc

SEQ ID NO: 8938 - DNA, 25 bp, Homo sapien
catactgagggacactcacgctcgg

SEQ ID NO: 8939 - DNA, 25 bp, Homo sapien
gtttaatccatactgagggacactc

SEQ ID NO: 8940 - DNA, 25 bp, Homo sapien
cggcggttcgcaagtttaatccata

SEQ ID NO: 8941 - DNA, 25 bp, Homo sapien
ctgcagaaaactgcgcgtgcgcgga

SEQ ID NO: 8942 - DNA, 25 bp, Homo sapien
agacgagctggatgcgcacctcata

SEQ ID NO: 8943 - DNA, 25 bp, Homo sapien
cggttcttgtagacgagctggatgc

SEQ ID NO: 8944 - DNA, 25 bp, Homo sapien
aggcgtatgcggctgtcctccgcag

SEQ ID NO: 8945 - DNA, 25 bp, Homo sapien
caagacgctggacagccatcaggta

SEQ ID NO: 8946 - DNA, 25 bp, Homo sapien
gacagccatcaggtagtcccggtgg

SEQ ID NO: 8947 - DNA, 25 bp, Homo sapien
acacgtactcgcgtgcccgcagtgg

SEQ ID NO: 8948 - DNA, 25 bp, Homo sapien
cccgcagtggcgagcggttcttgta

SEQ ID NO: 8949 - DNA, 25 bp, Homo sapien
gcagtcaggcgtatgcggctgtcct

SEQ ID NO: 8950 - DNA, 25 bp, Homo sapien
gcctgtgtgattttaacccaaagcg

SEQ ID NO: 8951 - DNA, 25 bp, Homo sapien
gtctcgcggcaaagtctgaatttac

SEQ ID NO: 8952 - DNA, 25 bp, Homo sapien
tgcggggactttaagggctatacga

SEQ ID NO: 8953 - DNA, 25 bp, Homo sapien
gccttcactccaagagatctgcttc

SEQ ID NO: 8954 - DNA, 25 bp, Homo sapien
gggtttgcaagaaactgcccgcgca

SEQ ID NO: 8955 - DNA, 25 bp, Homo sapien
cacccacttcgcagatgaggacttc

SEQ ID NO: 8956 - DNA, 25 bp, Homo sapien
gcggcgctaacgctccagtagctga

SEQ ID NO: 8957 - DNA, 25 bp, Homo sapien
tctgcatggtctgaaggccgaaaga

SEQ ID NO: 8958 - DNA, 25 bp, Homo sapien
gactgggaacgtcttagggccacgc

SEQ ID NO: 8959 - DNA, 25 bp, Homo sapien
tcggtgtccacactgacctaaagca

SEQ ID NO: 8960 - DNA, 25 bp, Homo sapien
cccacttcagaacgattttaatccg

SEQ ID NO: 8961 - DNA, 25 bp, Homo sapien
tctctagaccctctcggagcgacgg

SEQ ID NO: 8962 - DNA, 25 bp, Homo sapien
caaaacccgacagcggagcgtggga

SEQ ID NO: 8963 - DNA, 25 bp, Homo sapien
cgcaggcttgaacccgaaagacgga

SEQ ID NO: 8964 - DNA, 25 bp, Homo sapien
gagactcacccgagagcgccagtag

SEQ ID NO: 8965 - DNA, 25 bp, Homo sapien
cgaaatggacgcagatctctagacc

SEQ ID NO: 8966 - DNA, 25 bp, Homo sapien
ggagccgccaaggtgcagccacttc

SEQ ID NO: 8967 - DNA, 25 bp, Homo sapien
caggcgatcggccttgtcccaacgg

SEQ ID NO: 8968 - DNA, 25 bp, Homo sapien
acccaggctgacgacccacgattag

SEQ ID NO: 8969 - DNA, 25 bp, Homo sapien
tcccagagctccgaagggtcagcaa

SEQ ID NO: 8970 - DNA, 25 bp, Homo sapien
agaggaagccacgaacgctcccagc

SEQ ID NO: 8971 - DNA, 25 bp, Homo sapien
gcctccagctggaaaccacgcggtg

SEQ ID NO: 8972 - DNA, 25 bp, Homo sapien
tctcgcgccaggatagcggctccaa

SEQ ID NO: 8973 - DNA, 25 bp, Homo sapien
ggaaatgccaaaccctgccctaagc

SEQ ID NO: 8974 - DNA, 25 bp, Homo sapien
tcctggctgcttcccagcgtggatt

SEQ ID NO: 8975 - DNA, 25 bp, Homo sapien
gtctcccggcagtactgagccacgt

SEQ ID NO: 8976 - DNA, 25 bp, Homo sapien
gcgcgggtctgcttagatgtcctaa

SEQ ID NO: 8977 - DNA, 25 bp, Homo sapien
aagcaacttcttgcaccaggcgccg

SEQ ID NO: 8978 - DNA, 25 bp, Homo sapien
ccgccaatgaggagttcggtggatt

SEQ ID NO: 8979 - DNA, 25 bp, Homo sapien
catttcaccgagagcggagtcccgc

SEQ ID NO: 8980 - DNA, 25 bp, Homo sapien
cgtggatttgcacccggtcgatttc

SEQ ID NO: 8981 - DNA, 25 bp, Homo sapien
tcggtggatttctaaccaagtccca

SEQ ID NO: 8982 - DNA, 25 bp, Homo sapien
accctggctggtctcgcaatggaga

SEQ ID NO: 8983 - DNA, 25 bp, Homo sapien
cgggtctgcgggcaatccctctcat

SEQ ID NO: 8984 - DNA, 25 bp, Homo sapien
tgcgggcaatccctctcatggcagg

SEQ ID NO: 8985 - DNA, 25 bp, Homo sapien
ggcaatccctctcatggcagggcgg

SEQ ID NO: 8986 - DNA, 25 bp, Homo sapien
agcgcctagaccctggctggtctcg

SEQ ID NO: 8987 - DNA, 25 bp, Homo sapien
gcgtgacctctccatccgcttccgg

SEQ ID NO: 8988 - DNA, 25 bp, Homo sapien
gtctcgcaatggagagggctggatc

SEQ ID NO: 8989 - DNA, 25 bp, Homo sapien
gagcctggccttcctagtttcgccc

SEQ ID NO: 8990 - DNA, 25 bp, Homo sapien
gatcgcatggagtgatggtcccacc

SEQ ID NO: 8991 - DNA, 25 bp, Homo sapien
tgaggatggtcccttcccgaatctt

SEQ ID NO: 8992 - DNA, 25 bp, Homo sapien
acccgtgttccttcacctagagcaa

SEQ ID NO: 8993 - DNA, 25 bp, Homo sapien
tagagcaaatttagacgtcctcgtc

SEQ ID NO: 8994 - DNA, 25 bp, Homo sapien
tcctcgtcagagtccaggggtcgct

SEQ ID NO: 8995 - DNA, 25 bp, Homo sapien
tctgccaattctaaaggggaaggtc

SEQ ID NO: 8996 - DNA, 25 bp, Homo sapien
agctcgaaaacaagaggcgctggga

SEQ ID NO: 8997 - DNA, 25 bp, Homo sapien
gtctcgcctccaaagctcgaaaaca

SEQ ID NO: 8998 - DNA, 25 bp, Homo sapien
gttacacgggcagcgactcctatgt

SEQ ID NO: 8999 - DNA, 25 bp, Homo sapien
tctgagcatgagttacacgggcggc

SEQ ID NO: 9000 - DNA, 25 bp, Homo sapien
ggcagcgtctcctgtgatctgagca

SEQ ID NO: 9001 - DNA, 25 bp, Homo sapien
tctgagcatgagttacacgggcagc

SEQ ID NO: 9002 - DNA, 25 bp, Homo sapien
cggtgtctcctatgtgatctgagca

SEQ ID NO: 9003 - DNA, 25 bp, Homo sapien
acgggcagcgactcctatgtgatct

SEQ ID NO: 9004 - DNA, 25 bp, Homo sapien
cggcgactcctatgtgatctgagca

SEQ ID NO: 9005 - DNA, 25 bp, Homo sapien
gcgactcctatgtgatctgagcatg

SEQ ID NO: 9006 - DNA, 25 bp, Homo sapien
ctccatcttgtatgaagtctgctct

SEQ ID NO: 9007 - DNA, 25 bp, Homo sapien
tggagtgaaggtccctcagcggcgc

SEQ ID NO: 9008 - DNA, 25 bp, Homo sapien
aggtccctcagcggcgcgtgagttt

SEQ ID NO: 9009 - DNA, 25 bp, Homo sapien
gtgagtttcgctccatcttgtatga

SEQ ID NO: 9010 - DNA, 25 bp, Homo sapien
tcgctccatcttgtatgaagtctgc

SEQ ID NO: 9011 - DNA, 25 bp, Homo sapien
cgcagcgtcgcagctccggtcccgg

SEQ ID NO: 9012 - DNA, 25 bp, Homo sapien
tgcctgtcctgggatcctacaaacc

SEQ ID NO: 9013 - DNA, 25 bp, Homo sapien
gtttcgctccatcttgtatgaagtc

SEQ ID NO: 9014 - DNA, 25 bp, Homo sapien
cagtctcgccctcgttggcagctgg

SEQ ID NO: 9015 - DNA, 25 bp, Homo sapien
tctcgccctcgttggcagctggacg

SEQ ID NO: 9016 - DNA, 25 bp, Homo sapien
tctaaagggtaaagtctctctgccc

SEQ ID NO: 9017 - DNA, 25 bp, Homo sapien
caccgccgcgggtgagtttcgctct

SEQ ID NO: 9018 - DNA, 25 bp, Homo sapien
gtggagtgactatcccaccgccgcg

SEQ ID NO: 9019 - DNA, 25 bp, Homo sapien
gacggcgtggagtgactatcccacc

SEQ ID NO: 9020 - DNA, 25 bp, Homo sapien
cctcgttggcagctggacgcagcgc

SEQ ID NO: 9021 - DNA, 25 bp, Homo sapien
gtgactatcccaccgccgcgggtga

SEQ ID NO: 9022 - DNA, 25 bp, Homo sapien
gagtccatgcgtcagccttcctggg

SEQ ID NO: 9023 - DNA, 25 bp, Homo sapien
cagggcttttgagtccatgcgtcag

SEQ ID NO: 9024 - DNA, 25 bp, Homo sapien
gcttttgagtccatgcgtcagcctt

SEQ ID NO: 9025 - DNA, 25 bp, Homo sapien
agggcttttgagtccatgcgtcagc

SEQ ID NO: 9026 - DNA, 25 bp, Homo sapien
ttgagtccatgcgtcagccttcctg

SEQ ID NO: 9027 - DNA, 25 bp, Homo sapien
cttcctgggcggtctcaccttcacc

SEQ ID NO: 9028 - DNA, 25 bp, Homo sapien
cctgggcggtctcaccttcaccacc

SEQ ID NO: 9029 - DNA, 25 bp, Homo sapien
ttttgagtccatgcgtcagccttcc

SEQ ID NO: 9030 - DNA, 25 bp, Homo sapien
gtttcgcctccacaatcaccgcttc

SEQ ID NO: 9031 - DNA, 25 bp, Homo sapien
gctccacgggtttcgcctccacaat

SEQ ID NO: 9032 - DNA, 25 bp, Homo sapien
cctcacctgagaggtggattctcgc

SEQ ID NO: 9033 - DNA, 25 bp, Homo sapien
ccctgctgctccacgggtttcgcct

SEQ ID NO: 9034 - DNA, 25 bp, Homo sapien
acccttgccttaaggtgctgtcgcc

SEQ ID NO: 9035 - DNA, 25 bp, Homo sapien
ttctcgcctttgtcggcccctggag

SEQ ID NO: 9036 - DNA, 25 bp, Homo sapien
agaggtggattctcgcctttgtcgg

SEQ ID NO: 9037 - DNA, 25 bp, Homo sapien
cctgagaggtggattctcgcctttg

SEQ ID NO: 9038 - DNA, 25 bp, Homo sapien
ccggcgctctaaagggtgaaggaca

SEQ ID NO: 9039 - DNA, 25 bp, Homo sapien
cgcgctgcacgaaaaggcacgagtc

SEQ ID NO: 9040 - DNA, 25 bp, Homo sapien
aaaggcacgagtcgttggcgcctcc

SEQ ID NO: 9041 - DNA, 25 bp, Homo sapien
tgcttccgggccacggctcgttaaa

SEQ ID NO: 9042 - DNA, 25 bp, Homo sapien
cggctcgttaaagggcccactctga

SEQ ID NO: 9043 - DNA, 25 bp, Homo sapien
gcccactctgacgtgtgtgcaggga

SEQ ID NO: 9044 - DNA, 25 bp, Homo sapien
ggcaggtagtcaccggcgtcacgaa

SEQ ID NO: 9045 - DNA, 25 bp, Homo sapien
ggcgtcacgaaacacgcgctgcacg

SEQ ID NO: 9046 - DNA, 25 bp, Homo sapien
ccacttcggccggtggagcgcagaa

SEQ ID NO: 9047 - DNA, 25 bp, Homo sapien
aaccctaaaacaggcgctggagcga

SEQ ID NO: 9048 - DNA, 25 bp, Homo sapien
gagggtgacggactcacaggtccca

SEQ ID NO: 9049 - DNA, 25 bp, Homo sapien
tcctgcgcgcagattcgcgaaaacc

SEQ ID NO: 9050 - DNA, 25 bp, Homo sapien
tcacccaaggggtggattctcgccc

SEQ ID NO: 9051 - DNA, 25 bp, Homo sapien
attctcgcccacttcggccggtgga

SEQ ID NO: 9052 - DNA, 25 bp, Homo sapien
ctccaaaaccctaaaacaggcgctg

SEQ ID NO: 9053 - DNA, 25 bp, Homo sapien
caaggggtggattctcgcccacttc

SEQ ID NO: 9054 - DNA, 25 bp, Homo sapien
catggctccattagggccgtgtgca

SEQ ID NO: 9055 - DNA, 25 bp, Homo sapien
aaaagcattctgacggccgcgcttc

SEQ ID NO: 9056 - DNA, 25 bp, Homo sapien
ttccagcgctaaggattcccgcgta

SEQ ID NO: 9057 - DNA, 25 bp, Homo sapien
tcccgcgtagtgagcatttcccaga

SEQ ID NO: 9058 - DNA, 25 bp, Homo sapien
ctgcagggaaacactgatgggcgcc

SEQ ID NO: 9059 - DNA, 25 bp, Homo sapien
ggcgcccttccagatacgtcgattc

SEQ ID NO: 9060 - DNA, 25 bp, Homo sapien
agccgcttccaactctgtggatttc

SEQ ID NO: 9061 - DNA, 25 bp, Homo sapien
cgattcccgggttatgagctacatt

SEQ ID NO: 9062 - DNA, 25 bp, Homo sapien
gataattgtcttcgtctgtggggta

SEQ ID NO: 9063 - DNA, 25 bp, Homo sapien
cctccgttctgtgcgaggtcaatgc

SEQ ID NO: 9064 - DNA, 25 bp, Homo sapien
gggctgtgtctctgcacctccgttc

SEQ ID NO: 9065 - DNA, 25 bp, Homo sapien
tgtgtagacgtctatgagggccata

SEQ ID NO: 9066 - DNA, 25 bp, Homo sapien
cccataaactgtgacacaggtgtgt

SEQ ID NO: 9067 - DNA, 25 bp, Homo sapien
tctgtggggtaatgcgaacaagccc

SEQ ID NO: 9068 - DNA, 25 bp, Homo sapien
gcccagtgactgagataattgtctt

SEQ ID NO: 9069 - DNA, 25 bp, Homo sapien
cctaagccgtgatgcatgcggggtt

SEQ ID NO: 9070 - DNA, 25 bp, Homo sapien
acgctcacatacgtgtcggggtctg

SEQ ID NO: 9071 - DNA, 25 bp, Homo sapien
ttcccagagaccatccaggagtacg

SEQ ID NO: 9072 - DNA, 25 bp, Homo sapien
tacgccgtgctgcatgctggaacac

SEQ ID NO: 9073 - DNA, 25 bp, Homo sapien
cacgtgtcagtgtgtccgcgtgtca

SEQ ID NO: 9074 - DNA, 25 bp, Homo sapien
ggcacgtcaacagctgagcacgcta

SEQ ID NO: 9075 - DNA, 25 bp, Homo sapien
gtctgggtacgtgcacatacgtgta

SEQ ID NO: 9076 - DNA, 25 bp, Homo sapien
gctccagaggctttgggtcaacgca

SEQ ID NO: 9077 - DNA, 25 bp, Homo sapien
tcgggctctgttgtgtctgcacatg

SEQ ID NO: 9078 - DNA, 25 bp, Homo sapien
tcgcacatgcggatcaaggtctggc

SEQ ID NO: 9079 - DNA, 25 bp, Homo sapien
catgcgtgtcaggatctgtgtgcac

SEQ ID NO: 9080 - DNA, 25 bp, Homo sapien
ggcggctctatctcccgtaactgtg

SEQ ID NO: 9081 - DNA, 25 bp, Homo sapien
accggtgacgcaaccgctgtgtctc

SEQ ID NO: 9082 - DNA, 25 bp, Homo sapien
cacggagcttctagcggtgacgcac

SEQ ID NO: 9083 - DNA, 25 bp, Homo sapien
cacctgtgaacctcggcagtgcgtc

SEQ ID NO: 9084 - DNA, 25 bp, Homo sapien
tggcccacggatgtgcctttgcact

SEQ ID NO: 9085 - DNA, 25 bp, Homo sapien
gtcagcgtctgtgcacgcgcacatg

SEQ ID NO: 9086 - DNA, 25 bp, Homo sapien
tggacatggccacctactgcgacga

SEQ ID NO: 9087 - DNA, 25 bp, Homo sapien
ggctctcaatctctgtgcgctcctt

SEQ ID NO: 9088 - DNA, 25 bp, Homo sapien
ggcctcagtgccctacctggtaaaa

SEQ ID NO: 9089 - DNA, 25 bp, Homo sapien
ttgggcatggacaggttctcagaca

SEQ ID NO: 9090 - DNA, 25 bp, Homo sapien
gacaacctaatttctccctgcgcgg

SEQ ID NO: 9091 - DNA, 25 bp, Homo sapien
gggtgggagcaccttagacaaccta

SEQ ID NO: 9092 - DNA, 25 bp, Homo sapien
gtgaccttgggagtgactcaacttc

SEQ ID NO: 9093 - DNA, 25 bp, Homo sapien
cagtacgtggctggtaacttccctt

SEQ ID NO: 9094 - DNA, 25 bp, Homo sapien
cagggcgcccattaagaggggtcca

SEQ ID NO: 9095 - DNA, 25 bp, Homo sapien
tggttcgcatcagggcgcccattaa

SEQ ID NO: 9096 - DNA, 25 bp, Homo sapien
gtcgttcgcattagagcacccatta

SEQ ID NO: 9097 - DNA, 25 bp, Homo sapien
tcagggcacccattaagaggggtcc

SEQ ID NO: 9098 - DNA, 25 bp, Homo sapien
tcagggcgcccattaagaggggtcc

SEQ ID NO: 9099 - DNA, 25 bp, Homo sapien
gtggttcgcatcagggcgcccatta

SEQ ID NO: 9100 - DNA, 25 bp, Homo sapien
atcagggcgcccattaagaggggtc

SEQ ID NO: 9101 - DNA, 25 bp, Homo sapien
gcgcccattaagaggggtccaggcc

SEQ ID NO: 9102 - DNA, 25 bp, Homo sapien
gtcccttaggagtttccgtgcgcca

SEQ ID NO: 9103 - DNA, 25 bp, Homo sapien
gcgacacctttctttgccacctgga

SEQ ID NO: 9104 - DNA, 25 bp, Homo sapien
ttgccacctggaaccaacatcttgg

SEQ ID NO: 9105 - DNA, 25 bp, Homo sapien
cccttttgagggatcagaacttgtt

SEQ ID NO: 9106 - DNA, 25 bp, Homo sapien
ctgcgacaatcttccggtgccaacg

SEQ ID NO: 9107 - DNA, 25 bp, Homo sapien
caacgcggcaggtcagtatgtatcc

SEQ ID NO: 9108 - DNA, 25 bp, Homo sapien
cacggcgtcagagcacccattaaga

SEQ ID NO: 9109 - DNA, 25 bp, Homo sapien
gctgcctggaagtatcgccacctcg

SEQ ID NO: 9110 - DNA, 25 bp, Homo sapien
ccttggcggcccctatggcggagct

SEQ ID NO: 9111 - DNA, 25 bp, Homo sapien
cgtgcgatctcctcgtgggctcttc

SEQ ID NO: 9112 - DNA, 25 bp, Homo sapien
gcggagctaacctgcctcttgggca

SEQ ID NO: 9113 - DNA, 25 bp, Homo sapien
cgatctcctcgtgggctcttccttg

SEQ ID NO: 9114 - DNA, 25 bp, Homo sapien
tatggcggagctaacctgcctcttg

SEQ ID NO: 9115 - DNA, 25 bp, Homo sapien
gctaacctgcctcttgggcatcctg

SEQ ID NO: 9116 - DNA, 25 bp, Homo sapien
aacctgcctcttgggcatcctggtg

SEQ ID NO: 9117 - DNA, 25 bp, Homo sapien
gctgccgagagccttggcgaagctg

SEQ ID NO: 9118 - DNA, 25 bp, Homo sapien
cagtccgttttagggccgcagagcc

SEQ ID NO: 9119 - DNA, 25 bp, Homo sapien
tggctccggcagtccgttttagggc

SEQ ID NO: 9120 - DNA, 25 bp, Homo sapien
gctcagcgtcgctgagcatccgcag

SEQ ID NO: 9121 - DNA, 25 bp, Homo sapien
cccgttagctcagcgtcgctgagca

SEQ ID NO: 9122 - DNA, 25 bp, Homo sapien
gcctcaaagcctcctcagttgtcgg

SEQ ID NO: 9123 - DNA, 25 bp, Homo sapien
gggcttggcctcaaagcctcctcag

SEQ ID NO: 9124 - DNA, 25 bp, Homo sapien
gcggcttccactcctggactcggcc

SEQ ID NO: 9125 - DNA, 25 bp, Homo sapien
tccgtagggcacgtagacccggatc

SEQ ID NO: 9126 - DNA, 25 bp, Homo sapien
ctgcccactccggtcttagagatgc

SEQ ID NO: 9127 - DNA, 25 bp, Homo sapien
acagaatgagtgacgccctcgctcg

SEQ ID NO: 9128 - DNA, 25 bp, Homo sapien
attcctgagctctgatctcgggcga

SEQ ID NO: 9129 - DNA, 25 bp, Homo sapien
agtcccgatttccttctccttcgag

SEQ ID NO: 9130 - DNA, 25 bp, Homo sapien
ggctctcagcccatgtttataggga

SEQ ID NO: 9131 - DNA, 25 bp, Homo sapien
ggccgactcgaagcccttataaggc

SEQ ID NO: 9132 - DNA, 25 bp, Homo sapien
cgccgcagcccaaacagttaactga

SEQ ID NO: 9133 - DNA, 25 bp, Homo sapien
gcagtagcccgccttctagagcacg

SEQ ID NO: 9134 - DNA, 25 bp, Homo sapien
ttcttctcctgcatcgcgtgtgtgg

SEQ ID NO: 9135 - DNA, 25 bp, Homo sapien
cctgcatcgcgtgtgtggcttacgc

SEQ ID NO: 9136 - DNA, 25 bp, Homo sapien
cgagatcactggctatatggccacc

SEQ ID NO: 9137 - DNA, 25 bp, Homo sapien
atatggccaccgtacccgggctgct

SEQ ID NO: 9138 - DNA, 25 bp, Homo sapien
cctgcatcatcttcgcgttcatcag

SEQ ID NO: 9139 - DNA, 25 bp, Homo sapien
atcatcttcgcgttcatcagcgacc

SEQ ID NO: 9140 - DNA, 25 bp, Homo sapien
tacgccatctgcttcatcctagcgg

SEQ ID NO: 9141 - DNA, 25 bp, Homo sapien
ggtgtacgccatctgcttcatccta

SEQ ID NO: 9142 - DNA, 25 bp, Homo sapien
gcagggcttactggcaactggcaga

SEQ ID NO: 9143 - DNA, 25 bp, Homo sapien
tgcgcacagagacgccacgcccgca

SEQ ID NO: 9144 - DNA, 25 bp, Homo sapien
ttaaagggcacagcatgtgtgggca

SEQ ID NO: 9145 - DNA, 25 bp, Homo sapien
gagacagagtgtggcgagaaccccc

SEQ ID NO: 9146 - DNA, 25 bp, Homo sapien
gaggcggtactcatgggagtctccc

SEQ ID NO: 9147 - DNA, 25 bp, Homo sapien
ggcaactggcagaggcggtactcat

SEQ ID NO: 9148 - DNA, 25 bp, Homo sapien
ccggaccctacttggggagacagag

SEQ ID NO: 9149 - DNA, 25 bp, Homo sapien
acagaggcacggtcagccttgtagg

SEQ ID NO: 9150 - DNA, 25 bp, Homo sapien
cggagttctcggtcgtgtcccgaga

SEQ ID NO: 9151 - DNA, 25 bp, Homo sapien
agttctcggtcgtgtcccgagagtg

SEQ ID NO: 9152 - DNA, 25 bp, Homo sapien
tctcggtcgtgtcccgagagtggct

SEQ ID NO: 9153 - DNA, 25 bp, Homo sapien
tgtcccgagagtggctggtccgcag

SEQ ID NO: 9154 - DNA, 25 bp, Homo sapien
ggtccgcaggctcggactaccagtc

SEQ ID NO: 9155 - DNA, 25 bp, Homo sapien
gactgggaagcgctcccgagccggg

SEQ ID NO: 9156 - DNA, 25 bp, Homo sapien
gacgcgggtagagcgaccaagaggt

SEQ ID NO: 9157 - DNA, 25 bp, Homo sapien
agagcgaccaagaggtgtggaggcc

SEQ ID NO: 9158 - DNA, 25 bp, Homo sapien
catttgtcccgtgtctccgggaggg

SEQ ID NO: 9159 - DNA, 25 bp, Homo sapien
cggggctcccacatttcagcaggtg

SEQ ID NO: 9160 - DNA, 25 bp, Homo sapien
ggggctcccacatttcagcaggtgc

SEQ ID NO: 9161 - DNA, 25 bp, Homo sapien
gacatttgtcccgtgtctccgggag

SEQ ID NO: 9162 - DNA, 25 bp, Homo sapien
gaggacatttgtcccgtgtctccgg

SEQ ID NO: 9163 - DNA, 25 bp, Homo sapien
agggaggacatttgtcccgtgtctc

SEQ ID NO: 9164 - DNA, 25 bp, Homo sapien
ccggggctcccacatttcagcaggt

SEQ ID NO: 9165 - DNA, 25 bp, Homo sapien
cccgccctctcggtcgtcctggcaa

SEQ ID NO: 9166 - DNA, 25 bp, Homo sapien
tccctgtgcggtgtggaccacaccg

SEQ ID NO: 9167 - DNA, 25 bp, Homo sapien
tgagatccacgtaactggtgaggcc

SEQ ID NO: 9168 - DNA, 25 bp, Homo sapien
ctgcagctggagatccgggctccca

SEQ ID NO: 9169 - DNA, 25 bp, Homo sapien
gctgtgtgcgtagcgtgccctccct

SEQ ID NO: 9170 - DNA, 25 bp, Homo sapien
agatgaacgtgcaccggcgctgtgt

SEQ ID NO: 9171 - DNA, 25 bp, Homo sapien
ctccaggctgcgagatgaacgtgca

SEQ ID NO: 9172 - DNA, 25 bp, Homo sapien
gcctgaggtgctacccgcagctttc

SEQ ID NO: 9173 - DNA, 25 bp, Homo sapien
ccgggctcccacagcagatgagatc

SEQ ID NO: 9174 - DNA, 25 bp, Homo sapien
gcgtatccaggcaggtagattcttc

SEQ ID NO: 9175 - DNA, 25 bp, Homo sapien
cgtggtcaggcggatgaaatctttg

SEQ ID NO: 9176 - DNA, 25 bp, Homo sapien
tgagctctacgccatcaagatcttg

SEQ ID NO: 9177 - DNA, 25 bp, Homo sapien
ggccctgccttatccagttctggac

SEQ ID NO: 9178 - DNA, 25 bp, Homo sapien
aactttgtgctctctgagtgggcga

SEQ ID NO: 9179 - DNA, 25 bp, Homo sapien
gctttgtcaggcgatgggatcatta

SEQ ID NO: 9180 - DNA, 25 bp, Homo sapien
ggccaggcagacgagattatgaatg

SEQ ID NO: 9181 - DNA, 25 bp, Homo sapien
ctggacatctgcgttgggattctga

SEQ ID NO: 9182 - DNA, 25 bp, Homo sapien
gagcggcttcaggaacccacggcct

SEQ ID NO: 9183 - DNA, 25 bp, Homo sapien
ggccggccggacaaatttcctgcta

SEQ ID NO: 9184 - DNA, 25 bp, Homo sapien
tgcagcgcgatctgcgcgaccagac

SEQ ID NO: 9185 - DNA, 25 bp, Homo sapien
tcacgctccctctcggtaaacagga

SEQ ID NO: 9186 - DNA, 25 bp, Homo sapien
aaagtggctcgagttgtgccaactc

SEQ ID NO: 9187 - DNA, 25 bp, Homo sapien
gcgatttgcagggtcgacgacctca

SEQ ID NO: 9188 - DNA, 25 bp, Homo sapien
ccaacttggcgaccacagtggcagt

SEQ ID NO: 9189 - DNA, 25 bp, Homo sapien
aatttcctgctaggctgcggacagc

SEQ ID NO: 9190 - DNA, 25 bp, Homo sapien
ccgacttcgtgcacccggatgcccg

SEQ ID NO: 9191 - DNA, 25 bp, Homo sapien
cgcagcggcgagaactttgacaagt

SEQ ID NO: 9192 - DNA, 25 bp, Homo sapien
ttccagggcttcacctacgtgaacc

SEQ ID NO: 9193 - DNA, 25 bp, Homo sapien
accaggccgatttccagggcttcac

SEQ ID NO: 9194 - DNA, 25 bp, Homo sapien
accgcctagtcctggccagcatcga

SEQ ID NO: 9195 - DNA, 25 bp, Homo sapien
ttgacaagttcttcacgcgggcggc

SEQ ID NO: 9196 - DNA, 25 bp, Homo sapien
tgtgcccgtcatgtaatctcacccg

SEQ ID NO: 9197 - DNA, 25 bp, Homo sapien
gcctgtgcccgtcatgtaatctcac

SEQ ID NO: 9198 - DNA, 25 bp, Homo sapien
ctaggaatcggcgacggaggcacac

SEQ ID NO: 9199 - DNA, 25 bp, Homo sapien
ccctgcagtctcctgggtttccatg

SEQ ID NO: 9200 - DNA, 25 bp, Homo sapien
aaagcttcgcagtcttccttgcgga

SEQ ID NO: 9201 - DNA, 25 bp, Homo sapien
ccagaccagtggagcggtgtgcctt

SEQ ID NO: 9202 - DNA, 25 bp, Homo sapien
gaaatgtagtctccggtcagggcca

SEQ ID NO: 9203 - DNA, 25 bp, Homo sapien
gggaccgtgcagatggactacattt

SEQ ID NO: 9204 - DNA, 25 bp, Homo sapien
ttcccttgacccacttgagagtctg

SEQ ID NO: 9205 - DNA, 25 bp, Homo sapien
acacggcaggcagacgcgccttctg

SEQ ID NO: 9206 - DNA, 25 bp, Homo sapien
ggacgcccgaattcgagcggctatg

SEQ ID NO: 9207 - DNA, 25 bp, Homo sapien
gaaactgcactcctcgcgtccgagt

SEQ ID NO: 9208 - DNA, 25 bp, Homo sapien
gtcccggagtgggaaactgcactcc

SEQ ID NO: 9209 - DNA, 25 bp, Homo sapien
acgcccgaattcgagcggctatggg

SEQ ID NO: 9210 - DNA, 25 bp, Homo sapien
aacaagggacccgagtggctccagg

SEQ ID NO: 9211 - DNA, 25 bp, Homo sapien
agtgggaaactgcactcctcgcgtc

SEQ ID NO: 9212 - DNA, 25 bp, Homo sapien
acacctgggcctggcgatcccggag

SEQ ID NO: 9213 - DNA, 25 bp, Homo sapien
ctcgcgtccgagtcgcagcgagcgt

SEQ ID NO: 9214 - DNA, 25 bp, Homo sapien
ggactctgaccttgccttgccgcag

SEQ ID NO: 9215 - DNA, 25 bp, Homo sapien
agactcccttatttcaatggccgcg

SEQ ID NO: 9216 - DNA, 25 bp, Homo sapien
atccaaatgacgcagaactaccctc

SEQ ID NO: 9217 - DNA, 25 bp, Homo sapien
ctccagcgacgtgtccatccaaatg

SEQ ID NO: 9218 - DNA, 25 bp, Homo sapien
tcagcgactgctccgactactcggg

SEQ ID NO: 9219 - DNA, 25 bp, Homo sapien
aggaggagatgtaccgtccacaccc

SEQ ID NO: 9220 - DNA, 25 bp, Homo sapien
acctgttcaccaagcgctacgcgga

SEQ ID NO: 9221 - DNA, 25 bp, Homo sapien
gcgtgatgtccgtgtacctgttcac

SEQ ID NO: 9222 - DNA, 25 bp, Homo sapien
tgaccatcgccatcagcactgacta

SEQ ID NO: 9223 - DNA, 25 bp, Homo sapien
atcagcactgactactggctctaca

SEQ ID NO: 9224 - DNA, 25 bp, Homo sapien
ccgtggtcaaactggagtcgctgaa

SEQ ID NO: 9225 - DNA, 25 bp, Homo sapien
ccgccttcggcctcatgaccatcgc

SEQ ID NO: 9226 - DNA, 25 bp, Homo sapien
actgactactggctctacacgcgcg

SEQ ID NO: 9227 - DNA, 25 bp, Homo sapien
ggtcaaactggagtcgctgaagcgc

SEQ ID NO: 9228 - DNA, 25 bp, Homo sapien
cccggctgcccgtggtcaaactgga

SEQ ID NO: 9229 - DNA, 25 bp, Homo sapien
acgcgcgccctcatctgcaacacca

SEQ ID NO: 9230 - DNA, 25 bp, Homo sapien
ccgagaacgcggcaaatcctaaatg

SEQ ID NO: 9231 - DNA, 25 bp, Homo sapien
gcggcctcagccaggttccgaaatc

SEQ ID NO: 9232 - DNA, 25 bp, Homo sapien
cgtctgcgtgaagatcaatcatttc

SEQ ID NO: 9233 - DNA, 25 bp, Homo sapien
cacttggatcgacacgccgaggtta

SEQ ID NO: 9234 - DNA, 25 bp, Homo sapien
tccgagtccagatagtgagatcctc

SEQ ID NO: 9235 - DNA, 25 bp, Homo sapien
cccgattggctgactgatctcgttc

SEQ ID NO: 9236 - DNA, 25 bp, Homo sapien
gggaaagcctgtattgccattggta

SEQ ID NO: 9237 - DNA, 25 bp, Homo sapien
atcctgggcgctaattggccgcttt

SEQ ID NO: 9238 - DNA, 25 bp, Homo sapien
gaatgtgcgcgaaccgaggtcaccc

SEQ ID NO: 9239 - DNA, 25 bp, Homo sapien
cgtgcccacccacgcagggatgaga

SEQ ID NO: 9240 - DNA, 25 bp, Homo sapien
gaatccggctctgcgcggaccggca

SEQ ID NO: 9241 - DNA, 25 bp, Homo sapien
ggcagggatctccaccgcgaacctt

SEQ ID NO: 9242 - DNA, 25 bp, Homo sapien
ggcttcagagccagacccgggtcca

SEQ ID NO: 9243 - DNA, 25 bp, Homo sapien
agctggcgcattcccgggcgctgct

SEQ ID NO: 9244 - DNA, 25 bp, Homo sapien
ccacgcagggatgagaccaggccct

SEQ ID NO: 9245 - DNA, 25 bp, Homo sapien
cgacctgctcgtggatggggaccct

SEQ ID NO: 9246 - DNA, 25 bp, Homo sapien
aggaacatcattctgggcgcaggga

SEQ ID NO: 9247 - DNA, 25 bp, Homo sapien
cgcagggatcctgttcgtggcagca

SEQ ID NO: 9248 - DNA, 25 bp, Homo sapien
tgtagttctcgcgtcgccttcggag

SEQ ID NO: 9249 - DNA, 25 bp, Homo sapien
tcgccttcggaggagtaaaccgaca

SEQ ID NO: 9250 - DNA, 25 bp, Homo sapien
acacaggcaggtgtctggcgcgtaa

SEQ ID NO: 9251 - DNA, 25 bp, Homo sapien
agacgccgggcgcttaggatcccaa

SEQ ID NO: 9252 - DNA, 25 bp, Homo sapien
ctcccgcgtctacaagtccaagagg

SEQ ID NO: 9253 - DNA, 25 bp, Homo sapien
ttcgtgtgtctgcaaagccaccttg

SEQ ID NO: 9254 - DNA, 25 bp, Homo sapien
cagtctcgctcggacctgctcaagg

SEQ ID NO: 9255 - DNA, 25 bp, Homo sapien
tcatcggcgtgatcgtgtacatctc

SEQ ID NO: 9256 - DNA, 25 bp, Homo sapien
cctgagcaacatcatcggcgtgatc

SEQ ID NO: 9257 - DNA, 25 bp, Homo sapien
accactactcgtacggctggtcctt

SEQ ID NO: 9258 - DNA, 25 bp, Homo sapien
gtccttctacttcggcgggctgtcg

SEQ ID NO: 9259 - DNA, 25 bp, Homo sapien
cgtgctggccgtcaacatctacatc

SEQ ID NO: 9260 - DNA, 25 bp, Homo sapien
tcaacatctacatcgagcgcagccg

SEQ ID NO: 9261 - DNA, 25 bp, Homo sapien
atcgtgtacatctccgccaacgcgg

SEQ ID NO: 9262 - DNA, 25 bp, Homo sapien
tgcgggtgttatttacgggtcaagc

SEQ ID NO: 9263 - DNA, 25 bp, Homo sapien
taaaacacccgggatccctatggca

SEQ ID NO: 9264 - DNA, 25 bp, Homo sapien
cacccgggatccctatggcaacagg

SEQ ID NO: 9265 - DNA, 25 bp, Homo sapien
aacacccgggatccctatggcaaca

SEQ ID NO: 9266 - DNA, 25 bp, Homo sapien
agtcccatcaggctcggccccttcc

SEQ ID NO: 9267 - DNA, 25 bp, Homo sapien
cccttagtgaaatgaaagtcccatc

SEQ ID NO: 9268 - DNA, 25 bp, Homo sapien
ctgctgcccgggagactgcggagct

SEQ ID NO: 9269 - DNA, 25 bp, Homo sapien
gtctcctgctgcccgggagactgcg

SEQ ID NO: 9270 - DNA, 25 bp, Homo sapien
taaccaggcgtctcgtgggccacat

SEQ ID NO: 9271 - DNA, 25 bp, Homo sapien
gagccactcacgcatccggaggaaa

SEQ ID NO: 9272 - DNA, 25 bp, Homo sapien
gattcaaattctggcgctaagcgct

SEQ ID NO: 9273 - DNA, 25 bp, Homo sapien
tctagcggctcccaccgagtcgagt

SEQ ID NO: 9274 - DNA, 25 bp, Homo sapien
cagaagcgcacaccgcagctagcta

SEQ ID NO: 9275 - DNA, 25 bp, Homo sapien
cgtgggccacattttctaaacagta

SEQ ID NO: 9276 - DNA, 25 bp, Homo sapien
cccgctccttttgatagtaaccagg

SEQ ID NO: 9277 - DNA, 25 bp, Homo sapien
cgagttactctgatagcaaaggagc

SEQ ID NO: 9278 - DNA, 25 bp, Homo sapien
gtggagctcaacacctacaaggcca

SEQ ID NO: 9279 - DNA, 25 bp, Homo sapien
gcttgcctcgcagtaagcgccagtg

SEQ ID NO: 9280 - DNA, 25 bp, Homo sapien
aggagacagcttgcctcgcagtaag

SEQ ID NO: 9281 - DNA, 25 bp, Homo sapien
agcgcagggcttgcgtcccacggac

SEQ ID NO: 9282 - DNA, 25 bp, Homo sapien
tcaacacctacaaggccaacggcag

SEQ ID NO: 9283 - DNA, 25 bp, Homo sapien
gcagtaagcgccagtgcccacttcg

SEQ ID NO: 9284 - DNA, 25 bp, Homo sapien
ccgagttctgggtggagctcaacac

SEQ ID NO: 9285 - DNA, 25 bp, Homo sapien
acgtgcccgtggacagggacacctg

SEQ ID NO: 9286 - DNA, 25 bp, Homo sapien
agggccctgctgcagagagtcagcc

SEQ ID NO: 9287 - DNA, 25 bp, Homo sapien
acgcctcacctacgagtactcctgg

SEQ ID NO: 9288 - DNA, 25 bp, Homo sapien
cggatggcggagatgttcagacaca

SEQ ID NO: 9289 - DNA, 25 bp, Homo sapien
tgttccggcattccgtgagggccct

SEQ ID NO: 9290 - DNA, 25 bp, Homo sapien
ctcttggtgagcctggaggtgttcc

SEQ ID NO: 9291 - DNA, 25 bp, Homo sapien
cctctctcccgcaggcctgctgctc

SEQ ID NO: 9292 - DNA, 25 bp, Homo sapien
cgtctgactgcgagctgtcctctct

SEQ ID NO: 9293 - DNA, 25 bp, Homo sapien
tggcggagatgttcagacacagctg

SEQ ID NO: 9294 - DNA, 25 bp, Homo sapien
tcctctgcagagacggggtgagagt

SEQ ID NO: 9295 - DNA, 25 bp, Homo sapien
tcacgttggcgccaggacccaccac

SEQ ID NO: 9296 - DNA, 25 bp, Homo sapien
cacgaagctcatgttccgcaggcgg

SEQ ID NO: 9297 - DNA, 25 bp, Homo sapien
gcggtacagcacgaagctcatgttc

SEQ ID NO: 9298 - DNA, 25 bp, Homo sapien
ctcgcggtacagcacgaagctcatg

SEQ ID NO: 9299 - DNA, 25 bp, Homo sapien
gcccagcagcgtgaagtcggcccag

SEQ ID NO: 9300 - DNA, 25 bp, Homo sapien
agggcgtgtgatagtagcagctgta

SEQ ID NO: 9301 - DNA, 25 bp, Homo sapien
ctgcgctgcgacagcacgtagggcg

SEQ ID NO: 9302 - DNA, 25 bp, Homo sapien
gcagctacttgcaggggtgacgctt

SEQ ID NO: 9303 - DNA, 25 bp, Homo sapien
gcgtccttgctttcgcctctacttg

SEQ ID NO: 9304 - DNA, 25 bp, Homo sapien
gcctctacttgtgctccagggcgca

SEQ ID NO: 9305 - DNA, 25 bp, Homo sapien
ccgccgcggagacaaagatggctgc

SEQ ID NO: 9306 - DNA, 25 bp, Homo sapien
gccgtcgcacagagggaccacaact

SEQ ID NO: 9307 - DNA, 25 bp, Homo sapien
gccttcctcaagaatgcctgggaca

SEQ ID NO: 9308 - DNA, 25 bp, Homo sapien
tgctccaggcgcaaacttgcatcgt

SEQ ID NO: 9309 - DNA, 25 bp, Homo sapien
ttctcgcgcatagggaccacaactc

SEQ ID NO: 9310 - DNA, 25 bp, Homo sapien
cggggaccaatcagagagtagcttt

SEQ ID NO: 9311 - DNA, 25 bp, Homo sapien
caatctgtaggttaagccgttcgca

SEQ ID NO: 9312 - DNA, 25 bp, Homo sapien
cccgaatccctgcttaaaggccttg

SEQ ID NO: 9313 - DNA, 25 bp, Homo sapien
gagcttccgacctcttcaatctgta

SEQ ID NO: 9314 - DNA, 25 bp, Homo sapien
tccggccacagcgattctctgctta

SEQ ID NO: 9315 - DNA, 25 bp, Homo sapien
ctctgcttagcaggatcggtccaca

SEQ ID NO: 9316 - DNA, 25 bp, Homo sapien
ccgcctagtgccaggtgctaataaa

SEQ ID NO: 9317 - DNA, 25 bp, Homo sapien
gctttgcctctataacggcgcgaga

SEQ ID NO: 9318 - DNA, 25 bp, Homo sapien
tgactggcctatattcgggactcgg

SEQ ID NO: 9319 - DNA, 25 bp, Homo sapien
tgtcgcgatacgctcctcagcggcg

SEQ ID NO: 9320 - DNA, 25 bp, Homo sapien
ggagcgatcacccaatccgcgaaag

SEQ ID NO: 9321 - DNA, 25 bp, Homo sapien
gcgacgttcagcaggagcaatgact

SEQ ID NO: 9322 - DNA, 25 bp, Homo sapien
cctccaagggtcaggagcgacgttc

SEQ ID NO: 9323 - DNA, 25 bp, Homo sapien
tccctgccaggaaccaatagaaagc

SEQ ID NO: 9324 - DNA, 25 bp, Homo sapien
tgagccaatcctagcagcctgcgcg

SEQ ID NO: 9325 - DNA, 25 bp, Homo sapien
gccagctcctgtggtgagagcgtca

SEQ ID NO: 9326 - DNA, 25 bp, Homo sapien
cccgtacatttgattggctcctgcc

SEQ ID NO: 9327 - DNA, 25 bp, Homo sapien
agcgcgctcagcaacctcggctgta

SEQ ID NO: 9328 - DNA, 25 bp, Homo sapien
tttcacacggggcacattgagcctg

SEQ ID NO: 9329 - DNA, 25 bp, Homo sapien
gagcttacctcttgctgagccagca

SEQ ID NO: 9330 - DNA, 25 bp, Homo sapien
ttgtccctacttcgaccgcggattg

SEQ ID NO: 9331 - DNA, 25 bp, Homo sapien
gagacgccctttatcacagcgaatg

SEQ ID NO: 9332 - DNA, 25 bp, Homo sapien
ttggccgacatgaccgacaagtctc

SEQ ID NO: 9333 - DNA, 25 bp, Homo sapien
agagcgctctgcaccgacaaacatg

SEQ ID NO: 9334 - DNA, 25 bp, Homo sapien
cgtcgaggctcatacctcaagcgca

SEQ ID NO: 9335 - DNA, 25 bp, Homo sapien
ctcgggatgcgacgctgtgttgccc

SEQ ID NO: 9336 - DNA, 25 bp, Homo sapien
atcctgcgcggtctacgcggcgcgt

SEQ ID NO: 9337 - DNA, 25 bp, Homo sapien
gcgcgctctggtccgtggaacttcc

SEQ ID NO: 9338 - DNA, 25 bp, Homo sapien
aaagcgggcgtatcagcggttccca

SEQ ID NO: 9339 - DNA, 25 bp, Homo sapien
cccgctcggtaaagcgggcgtatca

SEQ ID NO: 9340 - DNA, 25 bp, Homo sapien
ctcagtttcccgctcggtaaagcgg

SEQ ID NO: 9341 - DNA, 25 bp, Homo sapien
ctcatacctcaagcgcactgtgggg

SEQ ID NO: 9342 - DNA, 25 bp, Homo sapien
cccgccaataggaagcatgcgtatt

SEQ ID NO: 9343 - DNA, 25 bp, Homo sapien
cgggactttcaggactccacgtgga

SEQ ID NO: 9344 - DNA, 25 bp, Homo sapien
tcctgaggactagaagggacccaga

SEQ ID NO: 9345 - DNA, 25 bp, Homo sapien
aagggacccagatgtcgccgccgtc

SEQ ID NO: 9346 - DNA, 25 bp, Homo sapien
gagatctgcggacctagggcaagca

SEQ ID NO: 9347 - DNA, 25 bp, Homo sapien
tctgcggacctagggcaagcaaagg

SEQ ID NO: 9348 - DNA, 25 bp, Homo sapien
cgcgatggggcacggcctcgtccta

SEQ ID NO: 9349 - DNA, 25 bp, Homo sapien
tgcgcggtgaaaagaacagcgcgat

SEQ ID NO: 9350 - DNA, 25 bp, Homo sapien
cagtagacgccatagaaggctgccc

SEQ ID NO: 9351 - DNA, 25 bp, Homo sapien
gcaggttgagcagcacccgcaccaa

SEQ ID NO: 9352 - DNA, 25 bp, Homo sapien
cagctccacctgaaggcaggagaga

SEQ ID NO: 9353 - DNA, 25 bp, Homo sapien
gagatgcccgcttggactccatttc

SEQ ID NO: 9354 - DNA, 25 bp, Homo sapien
cccgtagcccagtagacgccataga

SEQ ID NO: 9355 - DNA, 25 bp, Homo sapien
tcctccttaacgtgaactgatgcag

SEQ ID NO: 9356 - DNA, 25 bp, Homo sapien
aacgtgaactgatgcagccgtctcc

SEQ ID NO: 9357 - DNA, 25 bp, Homo sapien
tccaggaaaccagcggccctttaca

SEQ ID NO: 9358 - DNA, 25 bp, Homo sapien
ttctcagagtcaggaaaaggggcga

SEQ ID NO: 9359 - DNA, 25 bp, Homo sapien
gggcgagaggccacatgtctccctc

SEQ ID NO: 9360 - DNA, 25 bp, Homo sapien
ggctaaggtcgccagcatcccgcat

SEQ ID NO: 9361 - DNA, 25 bp, Homo sapien
ggctccggccacattctcagagtca

SEQ ID NO: 9362 - DNA, 25 bp, Homo sapien
ttggttccatttcctactccgcctg

SEQ ID NO: 9363 - DNA, 25 bp, Homo sapien
ctgcgtcccagaaacccagcgggga

SEQ ID NO: 9364 - DNA, 25 bp, Homo sapien
ctctcgcccaactgaaaacgaaacg

SEQ ID NO: 9365 - DNA, 25 bp, Homo sapien
gggacccggcacctctagccaggga

SEQ ID NO: 9366 - DNA, 25 bp, Homo sapien
aggccacgtagaagcgcatgcggaa

SEQ ID NO: 9367 - DNA, 25 bp, Homo sapien
cggcggcaatgcagccgcactcggc

SEQ ID NO: 9368 - DNA, 25 bp, Homo sapien
gcaatccaggccacgtagaagcgca

SEQ ID NO: 9369 - DNA, 25 bp, Homo sapien
atccaggccacgtagaagcgcatgc

SEQ ID NO: 9370 - DNA, 25 bp, Homo sapien
cgtagaaggcgtcctcgcgcacggc

SEQ ID NO: 9371 - DNA, 25 bp, Homo sapien
agcgcatgcggaaggcgaagaagac

SEQ ID NO: 9372 - DNA, 25 bp, Homo sapien
aagaagacggggatcatgtagaaga

SEQ ID NO: 9373 - DNA, 25 bp, Homo sapien
tgcggtagcggaagaacgggcctgt

SEQ ID NO: 9374 - DNA, 25 bp, Homo sapien
gaacacccgaacgtcaaattgctgg

SEQ ID NO: 9375 - DNA, 25 bp, Homo sapien
atgacgcccgaacgccgaacctatt

SEQ ID NO: 9376 - DNA, 25 bp, Homo sapien
gtccgaaagccgaatcacagtcgtt

SEQ ID NO: 9377 - DNA, 25 bp, Homo sapien
gtggctccacctcgactgcgaatta

SEQ ID NO: 9378 - DNA, 25 bp, Homo sapien
caggttcgccagatacccatgagta

SEQ ID NO: 9379 - DNA, 25 bp, Homo sapien
actcgctggttctatcggtggacag

SEQ ID NO: 9380 - DNA, 25 bp, Homo sapien
gcgaaagcgacttgccctcaaaggg

SEQ ID NO: 9381 - DNA, 25 bp, Homo sapien
ggccagggtgacgatcctcaagttc

SEQ ID NO: 9382 - DNA, 25 bp, Homo sapien
gccagccaacgcctcttctgattgg

SEQ ID NO: 9383 - DNA, 25 bp, Homo sapien
gcgccgtttggagcccttacgctca

SEQ ID NO: 9384 - DNA, 25 bp, Homo sapien
cgttggaggttattctcgcgagatc

SEQ ID NO: 9385 - DNA, 25 bp, Homo sapien
ggcagatactgactatgagagcgtt

SEQ ID NO: 9386 - DNA, 25 bp, Homo sapien
gggccttccgagtttccatgagtaa

SEQ ID NO: 9387 - DNA, 25 bp, Homo sapien
cggtgtgctttttctctagggtttg

SEQ ID NO: 9388 - DNA, 25 bp, Homo sapien
cgttactataagagcgcagccgtgg

SEQ ID NO: 9389 - DNA, 25 bp, Homo sapien
gcttgcgcgcctctttctcagtgac

SEQ ID NO: 9390 - DNA, 25 bp, Homo sapien
cgcacgtaggatcaggtgcaccctt

SEQ ID NO: 9391 - DNA, 25 bp, Homo sapien
accttgtcgcttcttccagggtccg

SEQ ID NO: 9392 - DNA, 25 bp, Homo sapien
tagctggggttagcgtccgtttctc

SEQ ID NO: 9393 - DNA, 25 bp, Homo sapien
gtgtctgcagccgtggcggcctcac

SEQ ID NO: 9394 - DNA, 25 bp, Homo sapien
gcagcgccttggtgtctgcagccgt

SEQ ID NO: 9395 - DNA, 25 bp, Homo sapien
ttctcctccagtccacctcaccttg

SEQ ID NO: 9396 - DNA, 25 bp, Homo sapien
ggatcaggtgcacccttcctgcagc

SEQ ID NO: 9397 - DNA, 25 bp, Homo sapien
ttcctgcagcgccttggtgtctgca

SEQ ID NO: 9398 - DNA, 25 bp, Homo sapien
tgagtgctgtgttctgagctatttg

SEQ ID NO: 9399 - DNA, 25 bp, Homo sapien
agctatttgggtcacggctggcaca

SEQ ID NO: 9400 - DNA, 25 bp, Homo sapien
tgggtcacggctggcacagccctga

SEQ ID NO: 9401 - DNA, 25 bp, Homo sapien
cagggacgcgaccaccgtgggtaca

SEQ ID NO: 9402 - DNA, 25 bp, Homo sapien
ctcactggcatatgcacagcacaca

SEQ ID NO: 9403 - DNA, 25 bp, Homo sapien
agctgcagacacagccagggcctca

SEQ ID NO: 9404 - DNA, 25 bp, Homo sapien
gctccgtcttgggttgctcctggga

SEQ ID NO: 9405 - DNA, 25 bp, Homo sapien
caccgtgggtacagctgcagacaca

SEQ ID NO: 9406 - DNA, 25 bp, Homo sapien
gcggggatagcatctccttttggtc

SEQ ID NO: 9407 - DNA, 25 bp, Homo sapien
aatgttcatgcgtaagtgcgtgggc

SEQ ID NO: 9408 - DNA, 25 bp, Homo sapien
cagctcgtggcgttcattggctgtg

SEQ ID NO: 9409 - DNA, 25 bp, Homo sapien
gcgtgtccctgcagcgaaggatcct

SEQ ID NO: 9410 - DNA, 25 bp, Homo sapien
tgcgccgtcgtcttctactttccgt

SEQ ID NO: 9411 - DNA, 25 bp, Homo sapien
cctcactcgccgttgaccgggtgtt

SEQ ID NO: 9412 - DNA, 25 bp, Homo sapien
tccggtctgccttaaaatgttcatg

SEQ ID NO: 9413 - DNA, 25 bp, Homo sapien
gtcaggacgtcgaagccaaagaaga

SEQ ID NO: 9414 - DNA, 25 bp, Homo sapien
ctccagcatcgactgccgcctcagc

SEQ ID NO: 9415 - DNA, 25 bp, Homo sapien
aactccagcatcgactgccgcctca

SEQ ID NO: 9416 - DNA, 25 bp, Homo sapien
tctcctcttgtctccatagcttccg

SEQ ID NO: 9417 - DNA, 25 bp, Homo sapien
ttgtctccatagcttccgccctgcg

SEQ ID NO: 9418 - DNA, 25 bp, Homo sapien
ctgccgggccttcctagagcccctg

SEQ ID NO: 9419 - DNA, 25 bp, Homo sapien
gcctggcctacacgggcccggacaa

SEQ ID NO: 9420 - DNA, 25 bp, Homo sapien
tacacgggcccggacaactccagca

SEQ ID NO: 9421 - DNA, 25 bp, Homo sapien
cgggcccggacaactccagcatcga

SEQ ID NO: 9422 - DNA, 25 bp, Homo sapien
acagactcttgttcccagccccttg

SEQ ID NO: 9423 - DNA, 25 bp, Homo sapien
caccgcactgaggacacgccggccg

SEQ ID NO: 9424 - DNA, 25 bp, Homo sapien
ctccgccgccacaccgcactgagga

SEQ ID NO: 9425 - DNA, 25 bp, Homo sapien
cccaccctgaagtgccagcaccacc

SEQ ID NO: 9426 - DNA, 25 bp, Homo sapien
cttagagactgtgcccgtcctcggc

SEQ ID NO: 9427 - DNA, 25 bp, Homo sapien
ctgcttagagactgtgcccgtcctc

SEQ ID NO: 9428 - DNA, 25 bp, Homo sapien
agctgcttagagactgtgcccgtcc

SEQ ID NO: 9429 - DNA, 25 bp, Homo sapien
ggagctgcttagagactgtgcccgt

SEQ ID NO: 9430 - DNA, 25 bp, Homo sapien
ccacgtgtacatggtgctggagtac

SEQ ID NO: 9431 - DNA, 25 bp, Homo sapien
atcgtggctttccacggacactttg

SEQ ID NO: 9432 - DNA, 25 bp, Homo sapien
tgagattgccctgcatagccgcctg

SEQ ID NO: 9433 - DNA, 25 bp, Homo sapien
tctgtacgcgctgccagcttgcaca

SEQ ID NO: 9434 - DNA, 25 bp, Homo sapien
gattcatgtcagctgtgcccgtctc

SEQ ID NO: 9435 - DNA, 25 bp, Homo sapien
tgtccattcgccagcgcttcttacg

SEQ ID NO: 9436 - DNA, 25 bp, Homo sapien
ggacactttgctgaccgcgaccacg

SEQ ID NO: 9437 - DNA, 25 bp, Homo sapien
agccgctgctacaagctgacagaca

SEQ ID NO: 9438 - DNA, 25 bp, Homo sapien
ccctttcgggatgattacgtgtgcc

SEQ ID NO: 9439 - DNA, 25 bp, Homo sapien
ttcccggtgattgatgtgtgctgcc

SEQ ID NO: 9440 - DNA, 25 bp, Homo sapien
tctgggaaacttacgagaacctggc

SEQ ID NO: 9441 - DNA, 25 bp, Homo sapien
gcccatgaggggacgtctttaaaga

SEQ ID NO: 9442 - DNA, 25 bp, Homo sapien
ccgggtgatttacctgtgtcccatc

SEQ ID NO: 9443 - DNA, 25 bp, Homo sapien
tacatgtgtgccctgtccgttttaa

SEQ ID NO: 9444 - DNA, 25 bp, Homo sapien
tggccctttcccagtgatacttttg

SEQ ID NO: 9445 - DNA, 25 bp, Homo sapien
tacgtgtgcctcgacctttaggtga

SEQ ID NO: 9446 - DNA, 25 bp, Homo sapien
tcccgaggccgtttcccaaggatgc

SEQ ID NO: 9447 - DNA, 25 bp, Homo sapien
ctacctggagtctgggaatggcgaa

SEQ ID NO: 9448 - DNA, 25 bp, Homo sapien
gaatcccactcgcagcggacacagg

SEQ ID NO: 9449 - DNA, 25 bp, Homo sapien
cgcggtgcagcgttcgcttaccaaa

SEQ ID NO: 9450 - DNA, 25 bp, Homo sapien
gcctttcaactgtttctggacgcca

SEQ ID NO: 9451 - DNA, 25 bp, Homo sapien
ccggcgttaccctgttgagccattc

SEQ ID NO: 9452 - DNA, 25 bp, Homo sapien
tatctgcccaatcagccactctgtg

SEQ ID NO: 9453 - DNA, 25 bp, Homo sapien
atcaggtcaccttcgcaggcccaga

SEQ ID NO: 9454 - DNA, 25 bp, Homo sapien
cgcgcgctcacgactccagctctag

SEQ ID NO: 9455 - DNA, 25 bp, Homo sapien
gagtccgcctccgtctcctaatccc

SEQ ID NO: 9456 - DNA, 25 bp, Homo sapien
gagggcttcactgcgcgcttcctgc

SEQ ID NO: 9457 - DNA, 25 bp, Homo sapien
caactggttctcagacccgtgggaa

SEQ ID NO: 9458 - DNA, 25 bp, Homo sapien
aataacaacccactctagatccggc

SEQ ID NO: 9459 - DNA, 25 bp, Homo sapien
gcgggcacagctggttcacctctgt

SEQ ID NO: 9460 - DNA, 25 bp, Homo sapien
caggacggaaataacaacccactct

SEQ ID NO: 9461 - DNA, 25 bp, Homo sapien
agatccggcccaactggttctcaga

SEQ ID NO: 9462 - DNA, 25 bp, Homo sapien
ggaagacccgtcctctcgcgagatc

SEQ ID NO: 9463 - DNA, 25 bp, Homo sapien
gaaggagacccgtcctctcgcaaga

SEQ ID NO: 9464 - DNA, 25 bp, Homo sapien
tatcgcgagatcttcacccaactca

SEQ ID NO: 9465 - DNA, 25 bp, Homo sapien
catgagattccctcctatcgcgaga

SEQ ID NO: 9466 - DNA, 25 bp, Homo sapien
gacccgtcgtctcgcgaaatcttca

SEQ ID NO: 9467 - DNA, 25 bp, Homo sapien
gacaggtcctctcgcgagatcatca

SEQ ID NO: 9468 - DNA, 25 bp, Homo sapien
cccacgtaggagacaggtcctctcg

SEQ ID NO: 9469 - DNA, 25 bp, Homo sapien
tcccgagatcttcaaggcacgcgga

SEQ ID NO: 9470 - DNA, 25 bp, Homo sapien
tccaggtcctctcggtggaacacgg

SEQ ID NO: 9471 - DNA, 25 bp, Homo sapien
aggtcctctcggtggaacacggaca

SEQ ID NO: 9472 - DNA, 25 bp, Homo sapien
tcctctcggtggaacacggacatct

SEQ ID NO: 9473 - DNA, 25 bp, Homo sapien
ctctcggtggaacacggacatctgc

SEQ ID NO: 9474 - DNA, 25 bp, Homo sapien
ctcggtggaacacggacatctgcgc

SEQ ID NO: 9475 - DNA, 25 bp, Homo sapien
ggtggaacacggacatctgcgccca

SEQ ID NO: 9476 - DNA, 25 bp, Homo sapien
gaacacggacatctgcgcccacagg

SEQ ID NO: 9477 - DNA, 25 bp, Homo sapien
tggaacacggacatctgcgcccaca

SEQ ID NO: 9478 - DNA, 25 bp, Homo sapien
gaggatgtctccgtccaggaacaga

SEQ ID NO: 9479 - DNA, 25 bp, Homo sapien
ggatgtctccgtccaggaacagacg

SEQ ID NO: 9480 - DNA, 25 bp, Homo sapien
tccaggaacagacggaggtcggact

SEQ ID NO: 9481 - DNA, 25 bp, Homo sapien
caggaacagacggaggtcggactcc

SEQ ID NO: 9482 - DNA, 25 bp, Homo sapien
ctgcagaggaaacgcaggaacagcc

SEQ ID NO: 9483 - DNA, 25 bp, Homo sapien
catctgcagcttcagagtcgtgcac

SEQ ID NO: 9484 - DNA, 25 bp, Homo sapien
tctgcagcttcagagtcgtgcacac

SEQ ID NO: 9485 - DNA, 25 bp, Homo sapien
cggaggatgtctccgtccaggaaca

SEQ ID NO: 9486 - DNA, 25 bp, Homo sapien
atcttgttcgtgattgacggctttg

SEQ ID NO: 9487 - DNA, 25 bp, Homo sapien
acctccggatcctggcggaggagcc

SEQ ID NO: 9488 - DNA, 25 bp, Homo sapien
gccctgagggacctccggatcctgg

SEQ ID NO: 9489 - DNA, 25 bp, Homo sapien
ggtgatgttacccaaggccgccctg

SEQ ID NO: 9490 - DNA, 25 bp, Homo sapien
gaacagggtgatgttacccaaggcc

SEQ ID NO: 9491 - DNA, 25 bp, Homo sapien
cgtgattgacggctttgatgagctg

SEQ ID NO: 9492 - DNA, 25 bp, Homo sapien
cggaaaatcttgttcgtgattgacg

SEQ ID NO: 9493 - DNA, 25 bp, Homo sapien
ctttgatgagctgggagccgcacct

SEQ ID NO: 9494 - DNA, 25 bp, Homo sapien
gtgcacgactctgaagctgcagatg

SEQ ID NO: 9495 - DNA, 25 bp, Homo sapien
gcctcacccgcacggggctgttcct

SEQ ID NO: 9496 - DNA, 25 bp, Homo sapien
ggctgttcctgcgtttcctctgcag

SEQ ID NO: 9497 - DNA, 25 bp, Homo sapien
ggagtccgacctccgtctgttcctg

SEQ ID NO: 9498 - DNA, 25 bp, Homo sapien
cgacctccgtctgttcctggacgga

SEQ ID NO: 9499 - DNA, 25 bp, Homo sapien
tctgttcctggacggagacatcctc

SEQ ID NO: 9500 - DNA, 25 bp, Homo sapien
tgttcctggacggagacatcctccg

SEQ ID NO: 9501 - DNA, 25 bp, Homo sapien
gtgtgcacgactctgaagctgcaga

SEQ ID NO: 9502 - DNA, 25 bp, Homo sapien
tggactcgttcgtgttgtgttagac

SEQ ID NO: 9503 - DNA, 25 bp, Homo sapien
ggctcgttcgtgttgtgttagacac

SEQ ID NO: 9504 - DNA, 25 bp, Homo sapien
gggctcgttcgtgttgtgttagaca

SEQ ID NO: 9505 - DNA, 25 bp, Homo sapien
gactcgttcgtgttgtgttagacac

SEQ ID NO: 9506 - DNA, 25 bp, Homo sapien
acggtggactcgttcgtgttagaca

SEQ ID NO: 9507 - DNA, 25 bp, Homo sapien
ggactcgttcgtgttgtgttagaca

SEQ ID NO: 9508 - DNA, 25 bp, Homo sapien
ggtggactcgttcgtgttagacacg

SEQ ID NO: 9509 - DNA, 25 bp, Homo sapien
cacggtggactcgttcgtgttagac

SEQ ID NO: 9510 - DNA, 25 bp, Homo sapien
gtactcacttgagcagcacggcggc

SEQ ID NO: 9511 - DNA, 25 bp, Homo sapien
cagccgcctgggtagctccgaggaa

SEQ ID NO: 9512 - DNA, 25 bp, Homo sapien
cctagggacgggacctatgagcatc

SEQ ID NO: 9513 - DNA, 25 bp, Homo sapien
cgggacctatgagcatcggtcctga

SEQ ID NO: 9514 - DNA, 25 bp, Homo sapien
tggtttgttcgaatgacgtcacact

SEQ ID NO: 9515 - DNA, 25 bp, Homo sapien
ttcgaatgacgtcacacttgccgca

SEQ ID NO: 9516 - DNA, 25 bp, Homo sapien
cacacttgccgcagcgtataaggcg

SEQ ID NO: 9517 - DNA, 25 bp, Homo sapien
acgcggggctagaatgtactcactt

SEQ ID NO: 9518 - DNA, 25 bp, Homo sapien
tttagtagtaccatcatttcggggc

SEQ ID NO: 9519 - DNA, 25 bp, Homo sapien
agcccgacgtgcacttcttccaggg

SEQ ID NO: 9520 - DNA, 25 bp, Homo sapien
ctcgtgtgccaggaacccgagcgcg

SEQ ID NO: 9521 - DNA, 25 bp, Homo sapien
tgtgacgcggtgatgccacccggca

SEQ ID NO: 9522 - DNA, 25 bp, Homo sapien
ccatcgtgcgctgtgacgcggtgat

SEQ ID NO: 9523 - DNA, 25 bp, Homo sapien
gtaccatcatttcggggcctcagtt

SEQ ID NO: 9524 - DNA, 25 bp, Homo sapien
cgtcgccatttagtagtaccatcat

SEQ ID NO: 9525 - DNA, 25 bp, Homo sapien
aggagctggagtcgtacccactggg

SEQ ID NO: 9526 - DNA, 25 bp, Homo sapien
tataggtgctcaggttcagggcttc

SEQ ID NO: 9527 - DNA, 25 bp, Homo sapien
ttgaacttgttcactccctttgagc

SEQ ID NO: 9528 - DNA, 25 bp, Homo sapien
cctttgagccttttgagcctgtgtg

SEQ ID NO: 9529 - DNA, 25 bp, Homo sapien
tcggatttctccctacctcgttgaa

SEQ ID NO: 9530 - DNA, 25 bp, Homo sapien
tccgcgcagtgatcagcaccgtaga

SEQ ID NO: 9531 - DNA, 25 bp, Homo sapien
ctaggacatcctgaaccacgtgttc

SEQ ID NO: 9532 - DNA, 25 bp, Homo sapien
tcgacgacgtagagagctttgtatc

SEQ ID NO: 9533 - DNA, 25 bp, Homo sapien
cctcagtggacccagtcttggtgtc

SEQ ID NO: 9534 - DNA, 25 bp, Homo sapien
gtctccgcctgacgcgaaggagatg

SEQ ID NO: 9535 - DNA, 25 bp, Homo sapien
tccgcctgacgcgaaggagatggac

SEQ ID NO: 9536 - DNA, 25 bp, Homo sapien
acgcgaaggagatggacggcatgtg

SEQ ID NO: 9537 - DNA, 25 bp, Homo sapien
catgtggtggttggcgatgacctgt

SEQ ID NO: 9538 - DNA, 25 bp, Homo sapien
gcggcaggaggcacacgcggtcatg

SEQ ID NO: 9539 - DNA, 25 bp, Homo sapien
ccgtgtctccgcctgacgcgaagga

SEQ ID NO: 9540 - DNA, 25 bp, Homo sapien
tggcctcaccgtgtctccgcctgac

SEQ ID NO: 9541 - DNA, 25 bp, Homo sapien
ggaaggatgagagggtctcgcggcc

SEQ ID NO: 9542 - DNA, 25 bp, Homo sapien
tctgctcccactagagcgggccagg

SEQ ID NO: 9543 - DNA, 25 bp, Homo sapien
tcatggaaccttagcgaggcccagg

SEQ ID NO: 9544 - DNA, 25 bp, Homo sapien
gggaagcgcagaattcgcacctttc

SEQ ID NO: 9545 - DNA, 25 bp, Homo sapien
cagggacagccttggagcagcagct

SEQ ID NO: 9546 - DNA, 25 bp, Homo sapien
ctcagcctgaagagcaggacctgtc

SEQ ID NO: 9547 - DNA, 25 bp, Homo sapien
gggtgatgcccacactctcagcctg

SEQ ID NO: 9548 - DNA, 25 bp, Homo sapien
gagcgctgcgcttctctgcgagcac

SEQ ID NO: 9549 - DNA, 25 bp, Homo sapien
ctgggttccgtttctcaagcacaca

SEQ ID NO: 9550 - DNA, 25 bp, Homo sapien
ggccgctggtcacccacagtctttg

SEQ ID NO: 9551 - DNA, 25 bp, Homo sapien
gcggcagatcctgacggagccagaa

SEQ ID NO: 9552 - DNA, 25 bp, Homo sapien
ggagccagaagtgcgcgactacctg

SEQ ID NO: 9553 - DNA, 25 bp, Homo sapien
tggtcagcggcctgcgctacctgca

SEQ ID NO: 9554 - DNA, 25 bp, Homo sapien
agtctttggcccacgtgctgagggc

SEQ ID NO: 9555 - DNA, 25 bp, Homo sapien
gcgacctgaagctcagtgagtgcca

SEQ ID NO: 9556 - DNA, 25 bp, Homo sapien
gtgcatcctgcaccgcgacctgaag

SEQ ID NO: 9557 - DNA, 25 bp, Homo sapien
tgcgctacctgcaccagcggtgcat

SEQ ID NO: 9558 - DNA, 25 bp, Homo sapien
acagctacagcacgagcggaggcgc

SEQ ID NO: 9559 - DNA, 25 bp, Homo sapien
cccaggtcgctgtcaatgggtgagt

SEQ ID NO: 9560 - DNA, 25 bp, Homo sapien
ccgcctgacccgactgtcttacttc

SEQ ID NO: 9561 - DNA, 25 bp, Homo sapien
gccggcaggtgacccaagcgacaca

SEQ ID NO: 9562 - DNA, 25 bp, Homo sapien
tgggaggacccagttgagaaacagc

SEQ ID NO: 9563 - DNA, 25 bp, Homo sapien
gtcttacttcctacagcaaagcgcc

SEQ ID NO: 9564 - DNA, 25 bp, Homo sapien
acccaagcgacacagcagggccgag

SEQ ID NO: 9565 - DNA, 25 bp, Homo sapien
gctgtcaatgggtgagtgtccgccc

SEQ ID NO: 9566 - DNA, 25 bp, Homo sapien
tcagactccgactggattccttagg

SEQ ID NO: 9567 - DNA, 25 bp, Homo sapien
gtgtgtacagccaggtcaccgtgca

SEQ ID NO: 9568 - DNA, 25 bp, Homo sapien
gggcgcagcttttctcgctgcagaa

SEQ ID NO: 9569 - DNA, 25 bp, Homo sapien
atgctgttctgattggaccatcgcc

SEQ ID NO: 9570 - DNA, 25 bp, Homo sapien
gtctgtctggtagcaacacccaatg

SEQ ID NO: 9571 - DNA, 25 bp, Homo sapien
taccctttgaaagcaggatgcggcc

SEQ ID NO: 9572 - DNA, 25 bp, Homo sapien
ccggtttcccgcctgcagagaaatt

SEQ ID NO: 9573 - DNA, 25 bp, Homo sapien
tcggacgccaggacaaagcgatttc

SEQ ID NO: 9574 - DNA, 25 bp, Homo sapien
gcgcagttcaccaccgtcttcacac

SEQ ID NO: 9575 - DNA, 25 bp, Homo sapien
cccgcgcagttcaccaccgtcttca

SEQ ID NO: 9576 - DNA, 25 bp, Homo sapien
agttcgcagttcaccaccgtcttca

SEQ ID NO: 9577 - DNA, 25 bp, Homo sapien
tccgcgcagttcaccaccgtcttca

SEQ ID NO: 9578 - DNA, 25 bp, Homo sapien
cccgcgcagttcaccaccgtcttcg

SEQ ID NO: 9579 - DNA, 25 bp, Homo sapien
cgcgcagttcgcagttcaccaccgt

SEQ ID NO: 9580 - DNA, 25 bp, Homo sapien
cgcgcagttcaccaccgtcttcacc

SEQ ID NO: 9581 - DNA, 25 bp, Homo sapien
cgcgcagttcaccaccgtcttcaca

SEQ ID NO: 9582 - DNA, 25 bp, Homo sapien
cgcgcagcatcagacgcgcctcgtc

SEQ ID NO: 9583 - DNA, 25 bp, Homo sapien
cggatcgagactggcaacggggaag

SEQ ID NO: 9584 - DNA, 25 bp, Homo sapien
cgtcggcgttggtggagtccagcac

SEQ ID NO: 9585 - DNA, 25 bp, Homo sapien
atcagacgcgcctcgtccaggtcgc

SEQ ID NO: 9586 - DNA, 25 bp, Homo sapien
cgggccatcctctccggacatcgca

SEQ ID NO: 9587 - DNA, 25 bp, Homo sapien
ctctccggacatcgcaccgcccgcc

SEQ ID NO: 9588 - DNA, 25 bp, Homo sapien
acgtcacggcgctgccccagggtgt

SEQ ID NO: 9589 - DNA, 25 bp, Homo sapien
tgcagggcgctgataccgtcggcgt

SEQ ID NO: 9590 - DNA, 25 bp, Homo sapien
ggctgctgtcaccaatccgagcatg

SEQ ID NO: 9591 - DNA, 25 bp, Homo sapien
gactagaaacctcgcatccttggga

SEQ ID NO: 9592 - DNA, 25 bp, Homo sapien
tcgctccagctcttgctttgcaatc

SEQ ID NO: 9593 - DNA, 25 bp, Homo sapien
cccggggcttcaggataaagaccag

SEQ ID NO: 9594 - DNA, 25 bp, Homo sapien
ttcagctgcaattttctcgaggcgg

SEQ ID NO: 9595 - DNA, 25 bp, Homo sapien
ctcgaggcggagatcttagattttt

SEQ ID NO: 9596 - DNA, 25 bp, Homo sapien
ttcctttggataggcacttcccatc

SEQ ID NO: 9597 - DNA, 25 bp, Homo sapien
acgtccaacttgagccctgagtcta

SEQ ID NO: 9598 - DNA, 25 bp, Homo sapien
aggcagtggacacgcacgtagctca

SEQ ID NO: 9599 - DNA, 25 bp, Homo sapien
acatgataggcgctggagtccctga

SEQ ID NO: 9600 - DNA, 25 bp, Homo sapien
tccctgagttcaaaggcgacgcctg

SEQ ID NO: 9601 - DNA, 25 bp, Homo sapien
tctaacagtagaaggggcgtggcca

SEQ ID NO: 9602 - DNA, 25 bp, Homo sapien
gcctgttctctgaatggagtcgttc

SEQ ID NO: 9603 - DNA, 25 bp, Homo sapien
tccaggactagaactcccgcagctg

SEQ ID NO: 9604 - DNA, 25 bp, Homo sapien
gccctcagtgaaccgagcgtggaga

SEQ ID NO: 9605 - DNA, 25 bp, Homo sapien
tggagtcgttcccaccaagcgacgg

SEQ ID NO: 9606 - DNA, 25 bp, Homo sapien
cttccaggaaggtctcgcttcgctc

SEQ ID NO: 9607 - DNA, 25 bp, Homo sapien
ccaggaaggtctcgcttcgctctac

SEQ ID NO: 9608 - DNA, 25 bp, Homo sapien
gcggccacccgatcccagatggagg

SEQ ID NO: 9609 - DNA, 25 bp, Homo sapien
acccgatcccagatggaggccgggc

SEQ ID NO: 9610 - DNA, 25 bp, Homo sapien
ctgttcctccaggcggtcgggctcg

SEQ ID NO: 9611 - DNA, 25 bp, Homo sapien
tgcgccagcaggtcggcctgggcac

SEQ ID NO: 9612 - DNA, 25 bp, Homo sapien
ctgggcacgcacgaaggcggccact

SEQ ID NO: 9613 - DNA, 25 bp, Homo sapien
acacttccaggaaggtctcgcttcg

SEQ ID NO: 9614 - DNA, 25 bp, Homo sapien
tcaccctgcggaaaagacattctgg

SEQ ID NO: 9615 - DNA, 25 bp, Homo sapien
tcagaccttgcgtgctgggactcac

SEQ ID NO: 9616 - DNA, 25 bp, Homo sapien
ccgacgctgggactacgagctctaa

SEQ ID NO: 9617 - DNA, 25 bp, Homo sapien
aggcagacggtgtatcagaccttgc

SEQ ID NO: 9618 - DNA, 25 bp, Homo sapien
tgggactcactttcagcctgcaggt

SEQ ID NO: 9619 - DNA, 25 bp, Homo sapien
tgggaccacagcgagcaactgacca

SEQ ID NO: 9620 - DNA, 25 bp, Homo sapien
cgagctctaaaaggccgtctgctca

SEQ ID NO: 9621 - DNA, 25 bp, Homo sapien
cattctgggaatcgcacacattgcc

SEQ ID NO: 9622 - DNA, 25 bp, Homo sapien
atggcctcgttcttgcccagcttgt

SEQ ID NO: 9623 - DNA, 25 bp, Homo sapien
aaccctcaggactcggttgcggagc

SEQ ID NO: 9624 - DNA, 25 bp, Homo sapien
tttctaaggaaatgaaccctcagga

SEQ ID NO: 9625 - DNA, 25 bp, Homo sapien
gttggccagcatgtccgcccagtgc

SEQ ID NO: 9626 - DNA, 25 bp, Homo sapien
agcttgtcgtagtccagcacggtca

SEQ ID NO: 9627 - DNA, 25 bp, Homo sapien
gttttcacggctgagggtacctctc

SEQ ID NO: 9628 - DNA, 25 bp, Homo sapien
tcctgcgcagccaggtttctaagga

SEQ ID NO: 9629 - DNA, 25 bp, Homo sapien
gccgcagcgagtgccactgggcaat

SEQ ID NO: 9630 - DNA, 25 bp, Homo sapien
attattataatgcattggctccagc

SEQ ID NO: 9631 - DNA, 25 bp, Homo sapien
cttctggaggaaccgccgaccatag

SEQ ID NO: 9632 - DNA, 25 bp, Homo sapien
tcccatcttctggaggaaccgccga

SEQ ID NO: 9633 - DNA, 25 bp, Homo sapien
cgtatgctcgcgctgttttacctaa

SEQ ID NO: 9634 - DNA, 25 bp, Homo sapien
attggctccagcagcggacctgcgc

SEQ ID NO: 9635 - DNA, 25 bp, Homo sapien
cgcgctgttttacctaatattatta

SEQ ID NO: 9636 - DNA, 25 bp, Homo sapien
gctcgcgctgttttacctaatatta

SEQ ID NO: 9637 - DNA, 25 bp, Homo sapien
tcggcctctttttcccatcttctgg

SEQ ID NO: 9638 - DNA, 25 bp, Homo sapien
ttggtctctccacgcatccgtgctg

SEQ ID NO: 9639 - DNA, 25 bp, Homo sapien
gggtgtccaggacctagttccatcc

SEQ ID NO: 9640 - DNA, 25 bp, Homo sapien
atccttcttggcctgttggtctctc

SEQ ID NO: 9641 - DNA, 25 bp, Homo sapien
acataggcgtcttccctgtgtctgc

SEQ ID NO: 9642 - DNA, 25 bp, Homo sapien
ttgtcttctccatacctgtctcgcg

SEQ ID NO: 9643 - DNA, 25 bp, Homo sapien
aaccggacagccaccgcgagtcatg

SEQ ID NO: 9644 - DNA, 25 bp, Homo sapien
ctcccatgaggcctttgcgcgaaca

SEQ ID NO: 9645 - DNA, 25 bp, Homo sapien
gagcaaagctggttgcccgggcaac

SEQ ID NO: 9646 - DNA, 25 bp, Homo sapien
ctcgcagccacgagcgaagggacct

SEQ ID NO: 9647 - DNA, 25 bp, Homo sapien
cgttctggtccagcctggcggctgt

SEQ ID NO: 9648 - DNA, 25 bp, Homo sapien
aacgtgccgttctggtccagcctgg

SEQ ID NO: 9649 - DNA, 25 bp, Homo sapien
gtggcgacagagaacgtgccgttct

SEQ ID NO: 9650 - DNA, 25 bp, Homo sapien
tcatgtgcggcgctggccacacggt

SEQ ID NO: 9651 - DNA, 25 bp, Homo sapien
cctgtgtctccactttggacaaatc

SEQ ID NO: 9652 - DNA, 25 bp, Homo sapien
acgagcgaagggacctgtgtctcca

SEQ ID NO: 9653 - DNA, 25 bp, Homo sapien
gggacctgtgtctccactttggaca

SEQ ID NO: 9654 - DNA, 25 bp, Homo sapien
ggtgcggctcccgatggaaaagccc

SEQ ID NO: 9655 - DNA, 25 bp, Homo sapien
gtagtgctcactgggcgtctgtgta

SEQ ID NO: 9656 - DNA, 25 bp, Homo sapien
ggcacgtagtgctcactgggcgtct

SEQ ID NO: 9657 - DNA, 25 bp, Homo sapien
gactcgggagagaacacgccaccgt

SEQ ID NO: 9658 - DNA, 25 bp, Homo sapien
cacaaagcagactcgggagagaaca

SEQ ID NO: 9659 - DNA, 25 bp, Homo sapien
aggctccagggcacgacggtccttc

SEQ ID NO: 9660 - DNA, 25 bp, Homo sapien
ttctcagccacatctggggctccgt

SEQ ID NO: 9661 - DNA, 25 bp, Homo sapien
ccttggtgctgacgcggttctggaa

SEQ ID NO: 9662 - DNA, 25 bp, Homo sapien
ggatccgaagcagaaaagacccgcg

SEQ ID NO: 9663 - DNA, 25 bp, Homo sapien
cgcagacgcgcttgcgcccgttggt

SEQ ID NO: 9664 - DNA, 25 bp, Homo sapien
ctcgcgcgccgggtcctgcagagtt

SEQ ID NO: 9665 - DNA, 25 bp, Homo sapien
ggcgtcactagtccgcgtaggcacc

SEQ ID NO: 9666 - DNA, 25 bp, Homo sapien
tccgcggtccaaacgggccgcagag

SEQ ID NO: 9667 - DNA, 25 bp, Homo sapien
cgaccgacggaagccgaggcctact

SEQ ID NO: 9668 - DNA, 25 bp, Homo sapien
aaagccgctcaatctccgggctctg

SEQ ID NO: 9669 - DNA, 25 bp, Homo sapien
tgcgcccgttggtgccaacggtctg

SEQ ID NO: 9670 - DNA, 25 bp, Homo sapien
agctctggcgtcctgatgggtcgat

SEQ ID NO: 9671 - DNA, 25 bp, Homo sapien
ccctgaagagcaaccctgggaggcc

SEQ ID NO: 9672 - DNA, 25 bp, Homo sapien
cccttgagccttcgtctgacatggg

SEQ ID NO: 9673 - DNA, 25 bp, Homo sapien
ttcgtctgacatgggccgtttgtga

SEQ ID NO: 9674 - DNA, 25 bp, Homo sapien
gtggtcaccgctgaagcagctctgg

SEQ ID NO: 9675 - DNA, 25 bp, Homo sapien
cctgatgggtcgattcttgagggtc

SEQ ID NO: 9676 - DNA, 25 bp, Homo sapien
attcttgagggtctgctgagaaggc

SEQ ID NO: 9677 - DNA, 25 bp, Homo sapien
ccgtttgtgaagaagggaagaatgt

SEQ ID NO: 9678 - DNA, 25 bp, Homo sapien
gctcaagtagctggtcaaagccctg

SEQ ID NO: 9679 - DNA, 25 bp, Homo sapien
agttttcgcacctcagcgagtcccg

SEQ ID NO: 9680 - DNA, 25 bp, Homo sapien
gcccagttttcgcacctcagcgagt

SEQ ID NO: 9681 - DNA, 25 bp, Homo sapien
caagtagctggtcaaagccctgccc

SEQ ID NO: 9682 - DNA, 25 bp, Homo sapien
tcacgctcaagtagctggtcaaagc

SEQ ID NO: 9683 - DNA, 25 bp, Homo sapien
cccttcacgctcaagtagctggtca

SEQ ID NO: 9684 - DNA, 25 bp, Homo sapien
cccgatacttttgcaagctccaccc

SEQ ID NO: 9685 - DNA, 25 bp, Homo sapien
tggcccagttttcgcacctcagcga

SEQ ID NO: 9686 - DNA, 25 bp, Homo sapien
tcctctccgaagaggggcgccggaa

SEQ ID NO: 9687 - DNA, 25 bp, Homo sapien
ggtctccttagcaacaagtcttctc

SEQ ID NO: 9688 - DNA, 25 bp, Homo sapien
cacccaacttcgtgccgtggttgcg

SEQ ID NO: 9689 - DNA, 25 bp, Homo sapien
ctgaagctgcttgcccgactcttat

SEQ ID NO: 9690 - DNA, 25 bp, Homo sapien
ctcacctggcgggatactgcactcg

SEQ ID NO: 9691 - DNA, 25 bp, Homo sapien
cggaataaggcggatctcacctccc

SEQ ID NO: 9692 - DNA, 25 bp, Homo sapien
atacgcacggtttcacccggaagtg

SEQ ID NO: 9693 - DNA, 25 bp, Homo sapien
gccgctgctcctacagacaaagtcg

SEQ ID NO: 9694 - DNA, 25 bp, Homo sapien
agcacgcccaatatgtgggccccta

SEQ ID NO: 9695 - DNA, 25 bp, Homo sapien
cgggaccaagggcaccatgtcgtcc

SEQ ID NO: 9696 - DNA, 25 bp, Homo sapien
gaccaagggcaccatgtcgtccggg

SEQ ID NO: 9697 - DNA, 25 bp, Homo sapien
atgtgggcccctatcggctggagaa

SEQ ID NO: 9698 - DNA, 25 bp, Homo sapien
ccggagtccccggatggtgatgtca

SEQ ID NO: 9699 - DNA, 25 bp, Homo sapien
acagacaggtgagcctagcagaagg

SEQ ID NO: 9700 - DNA, 25 bp, Homo sapien
gcaaaggacagacaggtgagcctag

SEQ ID NO: 9701 - DNA, 25 bp, Homo sapien
gcaccatgtcgtccggggccaagga

SEQ ID NO: 9702 - DNA, 25 bp, Homo sapien
atgtcctcaagctccacgacgtcta

SEQ ID NO: 9703 - DNA, 25 bp, Homo sapien
actgcatcacgggtcagaaggtcgc

SEQ ID NO: 9704 - DNA, 25 bp, Homo sapien
tcagaaggtcgccatcaagatcgtg

SEQ ID NO: 9705 - DNA, 25 bp, Homo sapien
tcaagatcgtgaaccgggagaagct

SEQ ID NO: 9706 - DNA, 25 bp, Homo sapien
ctcttgaccctcaggtggagcggga

SEQ ID NO: 9707 - DNA, 25 bp, Homo sapien
cgggagatcgccatcctgaagctca

SEQ ID NO: 9708 - DNA, 25 bp, Homo sapien
ctgaagctcatcgaacacccacatg

SEQ ID NO: 9709 - DNA, 25 bp, Homo sapien
gttaaactcggggtccactgcatca

SEQ ID NO: 9710 - DNA, 25 bp, Homo sapien
ccgacgtcctagagagcatggcatc

SEQ ID NO: 9711 - DNA, 25 bp, Homo sapien
gcctgccatccaacggagagctgga

SEQ ID NO: 9712 - DNA, 25 bp, Homo sapien
agctgcgcagtgaggagtaagaccc

SEQ ID NO: 9713 - DNA, 25 bp, Homo sapien
tgcacccgtgtacccacgtggggcg

SEQ ID NO: 9714 - DNA, 25 bp, Homo sapien
tagccatgcggagcctgccatccaa

SEQ ID NO: 9715 - DNA, 25 bp, Homo sapien
gagccagacccgtgcctggagccag

SEQ ID NO: 9716 - DNA, 25 bp, Homo sapien
cgggaaacacgagccagacccgtgc

SEQ ID NO: 9717 - DNA, 25 bp, Homo sapien
catggcatcactgggctgcttcagg

SEQ ID NO: 9718 - DNA, 25 bp, Homo sapien
actccatccgcaacagcttcctggg

SEQ ID NO: 9719 - DNA, 25 bp, Homo sapien
cccgacttccaaaacgcagacgctg

SEQ ID NO: 9720 - DNA, 25 bp, Homo sapien
ccttgcactcgcctctgcacacgcc

SEQ ID NO: 9721 - DNA, 25 bp, Homo sapien
agccgcctggaggagtcgtctcaac

SEQ ID NO: 9722 - DNA, 25 bp, Homo sapien
cgcctggaggagtcgtctcaactcc

SEQ ID NO: 9723 - DNA, 25 bp, Homo sapien
ctggaggagtcgtctcaactccatc

SEQ ID NO: 9724 - DNA, 25 bp, Homo sapien
ggagtcgtctcaactccatccgcaa

SEQ ID NO: 9725 - DNA, 25 bp, Homo sapien
atccgcaacagcttcctgggctccc

SEQ ID NO: 9726 - DNA, 25 bp, Homo sapien
aggagccactgtccacgtaacctgc

SEQ ID NO: 9727 - DNA, 25 bp, Homo sapien
cgtaacctgcgtctctttctttcaa

SEQ ID NO: 9728 - DNA, 25 bp, Homo sapien
ccacctcggtgtcggatgtggactc

SEQ ID NO: 9729 - DNA, 25 bp, Homo sapien
cggacgcactgtcacggggaaactt

SEQ ID NO: 9730 - DNA, 25 bp, Homo sapien
tcggcctcagaggtccgtaaaagcc

SEQ ID NO: 9731 - DNA, 25 bp, Homo sapien
agtgacccgactggccaggtccaaa

SEQ ID NO: 9732 - DNA, 25 bp, Homo sapien
gcgccttctacgaggccgactgctt

SEQ ID NO: 9733 - DNA, 25 bp, Homo sapien
ggggccgacgtccacaactacgtga

SEQ ID NO: 9734 - DNA, 25 bp, Homo sapien
gcaggacgctgcctcagacgtcttc

SEQ ID NO: 9735 - DNA, 25 bp, Homo sapien
tcagacgtcttcatgctcggcaaga

SEQ ID NO: 9736 - DNA, 25 bp, Homo sapien
gcagtcctttctgttgcctgcctcg

SEQ ID NO: 9737 - DNA, 25 bp, Homo sapien
cagagacagctcgtgaccgccgcag

SEQ ID NO: 9738 - DNA, 25 bp, Homo sapien
gccaggcagtaggagtccagagaca

SEQ ID NO: 9739 - DNA, 25 bp, Homo sapien
cctagtatttctgcgtttggagatg

SEQ ID NO: 9740 - DNA, 25 bp, Homo sapien
gctctgctcgcctcattctcatgta

SEQ ID NO: 9741 - DNA, 25 bp, Homo sapien
tgctcggcaagagcctgacaccggg

SEQ ID NO: 9742 - DNA, 25 bp, Homo sapien
gggcctcgccttggtctccgatgct

SEQ ID NO: 9743 - DNA, 25 bp, Homo sapien
cggagaagtcaacggctaagagacc

SEQ ID NO: 9744 - DNA, 25 bp, Homo sapien
gtagctcctcacagacggggcctcg

SEQ ID NO: 9745 - DNA, 25 bp, Homo sapien
agggccacactgctaccgtgacaga

SEQ ID NO: 9746 - DNA, 25 bp, Homo sapien
caggcgtggaggacgatcactgccc

SEQ ID NO: 9747 - DNA, 25 bp, Homo sapien
ccgcagagacgctacgcagcgagca

SEQ ID NO: 9748 - DNA, 25 bp, Homo sapien
agcgcgaacagcagcatggccacga

SEQ ID NO: 9749 - DNA, 25 bp, Homo sapien
taagagaccgaagagcgcgaacagc

SEQ ID NO: 9750 - DNA, 25 bp, Homo sapien
tggatactcccaaaacgcaacggtg

SEQ ID NO: 9751 - DNA, 25 bp, Homo sapien
caggcagagctgtcaataaagtttc

SEQ ID NO: 9752 - DNA, 25 bp, Homo sapien
ggccgaagctttcctcggagaaata

SEQ ID NO: 9753 - DNA, 25 bp, Homo sapien
aggccgcgactctatggtgatggac

SEQ ID NO: 9754 - DNA, 25 bp, Homo sapien
ttacccaatggaaagaggagctgtc

SEQ ID NO: 9755 - DNA, 25 bp, Homo sapien
agactgcgctttcggccaatgagtg

SEQ ID NO: 9756 - DNA, 25 bp, Homo sapien
gaggagccctttgtagccaggcaga

SEQ ID NO: 9757 - DNA, 25 bp, Homo sapien
actgacaacagttcgcggcgtttga

SEQ ID NO: 9758 - DNA, 25 bp, Homo sapien
ccggccggcgagaaaagtcaaatca

SEQ ID NO: 9759 - DNA, 25 bp, Homo sapien
cgcacggttgatgtacaaaagcata

SEQ ID NO: 9760 - DNA, 25 bp, Homo sapien
gtacaaaagcataaatggttagccc

SEQ ID NO: 9761 - DNA, 25 bp, Homo sapien
gagtaaaaatgtcaccctcctcctc

SEQ ID NO: 9762 - DNA, 25 bp, Homo sapien
ctcctcctctggaacgtctgtgcgg

SEQ ID NO: 9763 - DNA, 25 bp, Homo sapien
tcaaatcagaaaacggcttcggacg

SEQ ID NO: 9764 - DNA, 25 bp, Homo sapien
cggccgcgcacggttgatgtacaaa

SEQ ID NO: 9765 - DNA, 25 bp, Homo sapien
cgaaaggaaaaaacgctgagcgctg

SEQ ID NO: 9766 - DNA, 25 bp, Homo sapien
taccagctgcgtgagaccaagcggc

SEQ ID NO: 9767 - DNA, 25 bp, Homo sapien
gagctttccgaaccaggcctaggga

SEQ ID NO: 9768 - DNA, 25 bp, Homo sapien
tcccaggaaaggtgaaggagctttc

SEQ ID NO: 9769 - DNA, 25 bp, Homo sapien
ctcgggacccatccctgagtgtgtc

SEQ ID NO: 9770 - DNA, 25 bp, Homo sapien
ttgagcccagaaacgcaccctcggg

SEQ ID NO: 9771 - DNA, 25 bp, Homo sapien
gagcactgtgaatgccacacctgtg

SEQ ID NO: 9772 - DNA, 25 bp, Homo sapien
acgaggtgacatgcttctacggcga

SEQ ID NO: 9773 - DNA, 25 bp, Homo sapien
cttcggcgagaagaatgagcactgt

SEQ ID NO: 9774 - DNA, 25 bp, Homo sapien
ggtgagcctgatgcattggagaact

SEQ ID NO: 9775 - DNA, 25 bp, Homo sapien
tgagcaggctgctacgcctggctgt

SEQ ID NO: 9776 - DNA, 25 bp, Homo sapien
cattggagaactgagcaggctgcta

SEQ ID NO: 9777 - DNA, 25 bp, Homo sapien
ccggaatgcggttccgtgttactgc

SEQ ID NO: 9778 - DNA, 25 bp, Homo sapien
tgcggttccgtgttactgccgggat

SEQ ID NO: 9779 - DNA, 25 bp, Homo sapien
gaatgattccgagggagctctgagc

SEQ ID NO: 9780 - DNA, 25 bp, Homo sapien
gtcacaggagaaattgcggcgatgt

SEQ ID NO: 9781 - DNA, 25 bp, Homo sapien
agctctgagcgtcctctgggtgctg

SEQ ID NO: 9782 - DNA, 25 bp, Homo sapien
tcacccagctgatggggcacagcga

SEQ ID NO: 9783 - DNA, 25 bp, Homo sapien
ggcagtcagattttgccggcgaaaa

SEQ ID NO: 9784 - DNA, 25 bp, Homo sapien
gccggcgaaaatcccgttcttgatc

SEQ ID NO: 9785 - DNA, 25 bp, Homo sapien
ttgatctgctcgttccagctctcca

SEQ ID NO: 9786 - DNA, 25 bp, Homo sapien
acagcgagtggtacacgcggaaata

SEQ ID NO: 9787 - DNA, 25 bp, Homo sapien
cggaaatagtactcgcagggctgcg

SEQ ID NO: 9788 - DNA, 25 bp, Homo sapien
tgcatcttcagaggaagccgcgctg

SEQ ID NO: 9789 - DNA, 25 bp, Homo sapien
cggggctccgcgagacaaaaagatg

SEQ ID NO: 9790 - DNA, 25 bp, Homo sapien
cgctgagtctcaggctcaagcttta

SEQ ID NO: 9791 - DNA, 25 bp, Homo sapien
ccggattggctaggacgcccgagcc

SEQ ID NO: 9792 - DNA, 25 bp, Homo sapien
cagccaatgggagccgtcgtgcacc

SEQ ID NO: 9793 - DNA, 25 bp, Homo sapien
tcccacccgggtcaggagaaacgca

SEQ ID NO: 9794 - DNA, 25 bp, Homo sapien
ccgaggtgcgactcgctgagtctca

SEQ ID NO: 9795 - DNA, 25 bp, Homo sapien
taatctctgcgaagttgggcggctc

SEQ ID NO: 9796 - DNA, 25 bp, Homo sapien
accagcctgacgttggcggccactg

SEQ ID NO: 9797 - DNA, 25 bp, Homo sapien
cgtgcacacaggcaccgaggtgcga

SEQ ID NO: 9798 - DNA, 25 bp, Homo sapien
cgtcaaaatcgccagggagcttccc

SEQ ID NO: 9799 - DNA, 25 bp, Homo sapien
cgggctcagcgccatctggtattcg

SEQ ID NO: 9800 - DNA, 25 bp, Homo sapien
ttcctgttggcaacacgtcaaaatc

SEQ ID NO: 9801 - DNA, 25 bp, Homo sapien
gacttggcctgagtcgtcatctcca

SEQ ID NO: 9802 - DNA, 25 bp, Homo sapien
ccaggaattcctgttggcaacacgt

SEQ ID NO: 9803 - DNA, 25 bp, Homo sapien
ggtttccctccagactggcttctct

SEQ ID NO: 9804 - DNA, 25 bp, Homo sapien
tgagtcgtcatctccaccacgtctg

SEQ ID NO: 9805 - DNA, 25 bp, Homo sapien
tccagcacggctcttccaggaattc

SEQ ID NO: 9806 - DNA, 25 bp, Homo sapien
ccaggtagtactggcggcccgagac

SEQ ID NO: 9807 - DNA, 25 bp, Homo sapien
gccggctcctgaagcaggttgatga

SEQ ID NO: 9808 - DNA, 25 bp, Homo sapien
cttcaggcgccaggcagagaggtca

SEQ ID NO: 9809 - DNA, 25 bp, Homo sapien
cggacccagcagtggaacaggaagc

SEQ ID NO: 9810 - DNA, 25 bp, Homo sapien
acaggaagcccacctcgttgtcagg

SEQ ID NO: 9811 - DNA, 25 bp, Homo sapien
ccacctcgttgtcaggggcgtccag

SEQ ID NO: 9812 - DNA, 25 bp, Homo sapien
atgcggcacctggtcagcacgaggc

SEQ ID NO: 9813 - DNA, 25 bp, Homo sapien
caggcgcagcttcaggcgccaggca

SEQ ID NO: 9814 - DNA, 25 bp, Homo sapien
agacacggacctctcccacgggaga

SEQ ID NO: 9815 - DNA, 25 bp, Homo sapien
tggaggtcttaagtcccagggtgga

SEQ ID NO: 9816 - DNA, 25 bp, Homo sapien
ggaggcacaggccagaacctgcccc

SEQ ID NO: 9817 - DNA, 25 bp, Homo sapien
ccaggacggagcccgggagacacgg

SEQ ID NO: 9818 - DNA, 25 bp, Homo sapien
ggagacacggacctctcccacggga

SEQ ID NO: 9819 - DNA, 25 bp, Homo sapien
gagacacggacctctcccacgggag

SEQ ID NO: 9820 - DNA, 25 bp, Homo sapien
ctgccccgcccgtcggagcagacgc

SEQ ID NO: 9821 - DNA, 25 bp, Homo sapien
tggactcccggccttagggaggatg

SEQ ID NO: 9822 - DNA, 25 bp, Homo sapien
ggaaaccctcactcctgccgagctc

SEQ ID NO: 9823 - DNA, 25 bp, Homo sapien
tcacgatgcccgctaggagccggcg

SEQ ID NO: 9824 - DNA, 25 bp, Homo sapien
agccaggacccagaccggggcgctc

SEQ ID NO: 9825 - DNA, 25 bp, Homo sapien
cctgcgccctgccgtaactttgggg

SEQ ID NO: 9826 - DNA, 25 bp, Homo sapien
cccaaatccggcaggcctagggctg

SEQ ID NO: 9827 - DNA, 25 bp, Homo sapien
ccaaatccggcaggcctagggctgg

SEQ ID NO: 9828 - DNA, 25 bp, Homo sapien
tggaggcgcggaaaccctcactcct

SEQ ID NO: 9829 - DNA, 25 bp, Homo sapien
cccatccgtggagcctgcgccctgc

SEQ ID NO: 9830 - DNA, 25 bp, Homo sapien
gggtctgctaccaccagcgtccaga

SEQ ID NO: 9831 - DNA, 25 bp, Homo sapien
tgctgctaccgcaatggggtctgct

SEQ ID NO: 9832 - DNA, 25 bp, Homo sapien
tgcctcccttgtccagaaaacgtgc

SEQ ID NO: 9833 - DNA, 25 bp, Homo sapien
cgtgctgcatatgcccggtttcctg

SEQ ID NO: 9834 - DNA, 25 bp, Homo sapien
gggtccgtgtgacatgtccaagtcc

SEQ ID NO: 9835 - DNA, 25 bp, Homo sapien
atgtccaagtccgtctcgctgctct

SEQ ID NO: 9836 - DNA, 25 bp, Homo sapien
agcaccgagggaccaagaagacgcc

SEQ ID NO: 9837 - DNA, 25 bp, Homo sapien
cagcatctgcttgttctggcgagtg

SEQ ID NO: 9838 - DNA, 25 bp, Homo sapien
ggtggccctgacaacggatcataac

SEQ ID NO: 9839 - DNA, 25 bp, Homo sapien
ttcccgagcgttgagcgaattttcg

SEQ ID NO: 9840 - DNA, 25 bp, Homo sapien
gggtcccaggacctctcgaattgga

SEQ ID NO: 9841 - DNA, 25 bp, Homo sapien
gttgagcgcccatcatatgccaatc

SEQ ID NO: 9842 - DNA, 25 bp, Homo sapien
gccggggctaggcttatatagttca

SEQ ID NO: 9843 - DNA, 25 bp, Homo sapien
ctgccaggattagccgagggattcc

SEQ ID NO: 9844 - DNA, 25 bp, Homo sapien
gcaccctcattccttttgttcagta

SEQ ID NO: 9845 - DNA, 25 bp, Homo sapien
ccatcaccgcgagggcttacgaaga

SEQ ID NO: 9846 - DNA, 25 bp, Homo sapien
tcgccagcatgcttcttggccatgg

SEQ ID NO: 9847 - DNA, 25 bp, Homo sapien
cccgtggatctctgtgagcagacgg

SEQ ID NO: 9848 - DNA, 25 bp, Homo sapien
ggccgccagcttcttatcgcgctcg

SEQ ID NO: 9849 - DNA, 25 bp, Homo sapien
tatcgcgctcgccagcatgcttctt

SEQ ID NO: 9850 - DNA, 25 bp, Homo sapien
cgcctcctcgttgagtgcagactcg

SEQ ID NO: 9851 - DNA, 25 bp, Homo sapien
agcgcccgcttcttgtccgtctttt

SEQ ID NO: 9852 - DNA, 25 bp, Homo sapien
atgcttcttggccatgggaccctca

SEQ ID NO: 9853 - DNA, 25 bp, Homo sapien
atctctgtgagcagacgggcccgag

SEQ ID NO: 9854 - DNA, 25 bp, Homo sapien
gcatcccagtgaccgcgaacaccgg

SEQ ID NO: 9855 - DNA, 25 bp, Homo sapien
ggtccacgttctcgggcatcccagt

SEQ ID NO: 9856 - DNA, 25 bp, Homo sapien
cgcagcgtgatgtgcgcctcgatct

SEQ ID NO: 9857 - DNA, 25 bp, Homo sapien
cccgagcaggtccaggcagacgtcg

SEQ ID NO: 9858 - DNA, 25 bp, Homo sapien
tcgaagccgaagtcgcagtcgtcgg

SEQ ID NO: 9859 - DNA, 25 bp, Homo sapien
agcgccaggaagtcgaagtcgaagc

SEQ ID NO: 9860 - DNA, 25 bp, Homo sapien
gcacggtcaggtccagcgccaggaa

SEQ ID NO: 9861 - DNA, 25 bp, Homo sapien
cccggtagggcacgcgcacctggat

SEQ ID NO: 9862 - DNA, 25 bp, Homo sapien
gccgctgattggaccgtttgaatga

SEQ ID NO: 9863 - DNA, 25 bp, Homo sapien
cgtttgaatgagacgccgccacggc

SEQ ID NO: 9864 - DNA, 25 bp, Homo sapien
gtcgcgcacgcgactaacggtcttc

SEQ ID NO: 9865 - DNA, 25 bp, Homo sapien
tttaaacgcgtgatggaaggcgctc

SEQ ID NO: 9866 - DNA, 25 bp, Homo sapien
catgggccaatgactgatagagacc

SEQ ID NO: 9867 - DNA, 25 bp, Homo sapien
gggcgacccagtttcgtgcagatca

SEQ ID NO: 9868 - DNA, 25 bp, Homo sapien
cgctgccagccaacgaaatccgttg

SEQ ID NO: 9869 - DNA, 25 bp, Homo sapien
agcgcgcacgttccttggttttcga

SEQ ID NO: 9870 - DNA, 25 bp, Homo sapien
tgctcctgggacatgacccgccggg

SEQ ID NO: 9871 - DNA, 25 bp, Homo sapien
cccaggcctccatgcgatagccgcc

SEQ ID NO: 9872 - DNA, 25 bp, Homo sapien
cccagcaggtgctcctgggacatga

SEQ ID NO: 9873 - DNA, 25 bp, Homo sapien
aactcgtagcgcgaacggccaccat

SEQ ID NO: 9874 - DNA, 25 bp, Homo sapien
cggcagcgtgaactcgtagcgcgaa

SEQ ID NO: 9875 - DNA, 25 bp, Homo sapien
cagacagtcacctcgttcttgctgg

SEQ ID NO: 9876 - DNA, 25 bp, Homo sapien
tggcctcagacagtcacctcgttct

SEQ ID NO: 9877 - DNA, 25 bp, Homo sapien
ggcgacagcaggtgctcgcgactct

SEQ ID NO: 9878 - DNA, 25 bp, Homo sapien
cttcacggtgttgtagaggttcttg

SEQ ID NO: 9879 - DNA, 25 bp, Homo sapien
acccggcagtgcaaggcgggcgtag

SEQ ID NO: 9880 - DNA, 25 bp, Homo sapien
gcggggctacatgatgaaggggcgt

SEQ ID NO: 9881 - DNA, 25 bp, Homo sapien
ggatcccacgttccactcaccgagg

SEQ ID NO: 9882 - DNA, 25 bp, Homo sapien
tgttgtagaggttcttgggcgtcct

SEQ ID NO: 9883 - DNA, 25 bp, Homo sapien
gcatgctgtcgggaccgccgatccc

SEQ ID NO: 9884 - DNA, 25 bp, Homo sapien
ccgtccgcctttcgcagggcaggac

SEQ ID NO: 9885 - DNA, 25 bp, Homo sapien
agacggaggctgcgccggatcccac

SEQ ID NO: 9886 - DNA, 25 bp, Homo sapien
gtggcgtcgtactggcccatgacat

SEQ ID NO: 9887 - DNA, 25 bp, Homo sapien
agagtaatggaaacgcgcccgggca

SEQ ID NO: 9888 - DNA, 25 bp, Homo sapien
cacgcacctgggcacgttgatatcc

SEQ ID NO: 9889 - DNA, 25 bp, Homo sapien
gcacgggacgccttgctgaaggcca

SEQ ID NO: 9890 - DNA, 25 bp, Homo sapien
ccgcacacgacgtaggctgtgctgc

SEQ ID NO: 9891 - DNA, 25 bp, Homo sapien
tgccacagcagaagcggtaggagcc

SEQ ID NO: 9892 - DNA, 25 bp, Homo sapien
cccatgacatcgtagtagccgtggc

SEQ ID NO: 9893 - DNA, 25 bp, Homo sapien
ccaggcgcatgtgacggtgctcaca

SEQ ID NO: 9894 - DNA, 25 bp, Homo sapien
gcaagggctgcaaatctggaacgga

SEQ ID NO: 9895 - DNA, 25 bp, Homo sapien
tctctgggtctctgcatcttcgcgt

SEQ ID NO: 9896 - DNA, 25 bp, Homo sapien
ggtttgctgtcgtctgatctctgtc

SEQ ID NO: 9897 - DNA, 25 bp, Homo sapien
cactcccattcaggcccgggttggt

SEQ ID NO: 9898 - DNA, 25 bp, Homo sapien
tgtgtgttcccagcgcaaaatagac

SEQ ID NO: 9899 - DNA, 25 bp, Homo sapien
ctgactgacagctctgacgccggtg

SEQ ID NO: 9900 - DNA, 25 bp, Homo sapien
ggggtctgcagattccaactcctag

SEQ ID NO: 9901 - DNA, 25 bp, Homo sapien
aaaatagactctcgttgccatggcg

SEQ ID NO: 9902 - DNA, 25 bp, Homo sapien
ccaatccgcatatgcagctgctttg

SEQ ID NO: 9903 - DNA, 25 bp, Homo sapien
tggagtcctccttctggtcctgtga

SEQ ID NO: 9904 - DNA, 25 bp, Homo sapien
tctccgaaggctcagactctggctg

SEQ ID NO: 9905 - DNA, 25 bp, Homo sapien
cgttctgccaatggagagccgtaga

SEQ ID NO: 9906 - DNA, 25 bp, Homo sapien
tgattagctcgcaaaggcgccgtgg

SEQ ID NO: 9907 - DNA, 25 bp, Homo sapien
ggtcggtctccaaatagcgccagca

SEQ ID NO: 9908 - DNA, 25 bp, Homo sapien
ccagcagcgagagaggacttacccg

SEQ ID NO: 9909 - DNA, 25 bp, Homo sapien
agccgtccaatcgacactcatcatg

SEQ ID NO: 9910 - DNA, 25 bp, Homo sapien
atgtgcataaccttcgctgtctcgc

SEQ ID NO: 9911 - DNA, 25 bp, Homo sapien
ttgttttttaagtgcgcggaggcgc

SEQ ID NO: 9912 - DNA, 25 bp, Homo sapien
aggcgcaggcgaaactcggagtttc

SEQ ID NO: 9913 - DNA, 25 bp, Homo sapien
ccaactcgttgcttattttgcaaag

SEQ ID NO: 9914 - DNA, 25 bp, Homo sapien
accggcagcctctggttcctgttgt

SEQ ID NO: 9915 - DNA, 25 bp, Homo sapien
ctgtctcgctaaaggtcagcgcgcc

SEQ ID NO: 9916 - DNA, 25 bp, Homo sapien
gggcactctgatgccggggatttcc

SEQ ID NO: 9917 - DNA, 25 bp, Homo sapien
ctcggagtttccaactcgttgctta

SEQ ID NO: 9918 - DNA, 25 bp, Homo sapien
gaccacaactgggagaactacaact

SEQ ID NO: 9919 - DNA, 25 bp, Homo sapien
actcggagtacgtgcgttgtgacgc

SEQ ID NO: 9920 - DNA, 25 bp, Homo sapien
tctggatgagcgtgcacgaagcaca

SEQ ID NO: 9921 - DNA, 25 bp, Homo sapien
ctgacaactggagtccgcgaccaca

SEQ ID NO: 9922 - DNA, 25 bp, Homo sapien
gggatttttgtacaaccgtggtgca

SEQ ID NO: 9923 - DNA, 25 bp, Homo sapien
tcccgctggagcgattacaccctgg

SEQ ID NO: 9924 - DNA, 25 bp, Homo sapien
acgcccgaaaatcctgagcacgtgg

SEQ ID NO: 9925 - DNA, 25 bp, Homo sapien
ccgccgataaaggttgggtgcctcg

SEQ ID NO: 9926 - DNA, 25 bp, Homo sapien
agtcttaagtcttgcgtcctgggtc

SEQ ID NO: 9927 - DNA, 25 bp, Homo sapien
ccggggagcttagcaacggttgcta

SEQ ID NO: 9928 - DNA, 25 bp, Homo sapien
agggtcacagctcggttcctcccag

SEQ ID NO: 9929 - DNA, 25 bp, Homo sapien
cccgttgctccttctctagggatag

SEQ ID NO: 9930 - DNA, 25 bp, Homo sapien
cggcgctcaggttgctcagcaacga

SEQ ID NO: 9931 - DNA, 25 bp, Homo sapien
ccttatgcggaagggttctgcgacc

SEQ ID NO: 9932 - DNA, 25 bp, Homo sapien
tcccgggagactttagcaaggtcgc

SEQ ID NO: 9933 - DNA, 25 bp, Homo sapien
gactccagggagtgctacttgttca

SEQ ID NO: 9934 - DNA, 25 bp, Homo sapien
tgcctgagctctttttggcggcggc

SEQ ID NO: 9935 - DNA, 25 bp, Homo sapien
caagtcattccggtggtcgtcccgg

SEQ ID NO: 9936 - DNA, 25 bp, Homo sapien
tctgctgcagatccaccgtagcgtg

SEQ ID NO: 9937 - DNA, 25 bp, Homo sapien
cactaccagtaccacttaaggcagc

SEQ ID NO: 9938 - DNA, 25 bp, Homo sapien
cttaaggcagcacacaggcgagcgc

SEQ ID NO: 9939 - DNA, 25 bp, Homo sapien
ggctttcaaaggctcctcggccctg

SEQ ID NO: 9940 - DNA, 25 bp, Homo sapien
ttcaagaactcgtccagcctgcggc

SEQ ID NO: 9941 - DNA, 25 bp, Homo sapien
caaggtcttcgtgtgcgacgcctac

SEQ ID NO: 9942 - DNA, 25 bp, Homo sapien
gggcagagcctcatcgttctgcaga

SEQ ID NO: 9943 - DNA, 25 bp, Homo sapien
cgttatggccgcctatctgcagcgg

SEQ ID NO: 9944 - DNA, 25 bp, Homo sapien
atctgcagcggcacctgaggacgca

SEQ ID NO: 9945 - DNA, 25 bp, Homo sapien
ttcctcctggtgcaaactgcccagg

SEQ ID NO: 9946 - DNA, 25 bp, Homo sapien
cctcatcgttctgcagaatgtgggg

SEQ ID NO: 9947 - DNA, 25 bp, Homo sapien
tgtggctactgaggcacccaacctg

SEQ ID NO: 9948 - DNA, 25 bp, Homo sapien
gcacccaacctgctggttgttcaga

SEQ ID NO: 9949 - DNA, 25 bp, Homo sapien
actctcagacgttcctcctggtgca

SEQ ID NO: 9950 - DNA, 25 bp, Homo sapien
ccgcctgtctgtctctcgctggcac

SEQ ID NO: 9951 - DNA, 25 bp, Homo sapien
ctgtggccgccgtgaagctgggcct

SEQ ID NO: 9952 - DNA, 25 bp, Homo sapien
tgaaggacacggaaaaccgcgtggc

SEQ ID NO: 9953 - DNA, 25 bp, Homo sapien
aaccgcgtggccctccatgccttga

SEQ ID NO: 9954 - DNA, 25 bp, Homo sapien
tccatgccttgacacggccgccggc

SEQ ID NO: 9955 - DNA, 25 bp, Homo sapien
gcctgcgctttgtcctggcttcctt

SEQ ID NO: 9956 - DNA, 25 bp, Homo sapien
gctccggtgacgtgtgtggggtcct

SEQ ID NO: 9957 - DNA, 25 bp, Homo sapien
cagcggcctgcgctttgtcctggct

SEQ ID NO: 9958 - DNA, 25 bp, Homo sapien
tctgccaccaccggggctggaaggc

SEQ ID NO: 9959 - DNA, 25 bp, Homo sapien
tcagcgagctggcttgccggggcaa

SEQ ID NO: 9960 - DNA, 25 bp, Homo sapien
cagggcctgtgtggctcagcgagct

SEQ ID NO: 9961 - DNA, 25 bp, Homo sapien
cgatgccgccgtggcctgccggcag

SEQ ID NO: 9962 - DNA, 25 bp, Homo sapien
catctgctcccacgaggaggacgcg

SEQ ID NO: 9963 - DNA, 25 bp, Homo sapien
cacatctgctcccacgaggaggacg

SEQ ID NO: 9964 - DNA, 25 bp, Homo sapien
gggctggaaggcccacatctgctcc

SEQ ID NO: 9965 - DNA, 25 bp, Homo sapien
cttgccggggcaacgaggggcagct

SEQ ID NO: 9966 - DNA, 25 bp, Homo sapien
cccgagcgccgacagctggtccagc

SEQ ID NO: 9967 - DNA, 25 bp, Homo sapien
atcacgctcatctggtcggccagca

SEQ ID NO: 9968 - DNA, 25 bp, Homo sapien
ggctgccgatcacgctcatctggtc

SEQ ID NO: 9969 - DNA, 25 bp, Homo sapien
gacgcttttcttgcggctgccgatc

SEQ ID NO: 9970 - DNA, 25 bp, Homo sapien
gtcatgttgacgcttttcttgcggc

SEQ ID NO: 9971 - DNA, 25 bp, Homo sapien
gggccactcaccctggcgacccacg

SEQ ID NO: 9972 - DNA, 25 bp, Homo sapien
gctgcaggacaaaggcgcaaaggca

SEQ ID NO: 9973 - DNA, 25 bp, Homo sapien
cgctcatctggtcggccagcagcgt

SEQ ID NO: 9974 - DNA, 25 bp, Homo sapien
tggggccggagcaactgtgaccaca

SEQ ID NO: 9975 - DNA, 25 bp, Homo sapien
aactgtgaccacagcgaggatgcgg

SEQ ID NO: 9976 - DNA, 25 bp, Homo sapien
tgcgcgacgctgctgtagcctgccg

SEQ ID NO: 9977 - DNA, 25 bp, Homo sapien
cgctgctgtagcctgccgggaactg

SEQ ID NO: 9978 - DNA, 25 bp, Homo sapien
ggagaacaggccctccgagactgcc

SEQ ID NO: 9979 - DNA, 25 bp, Homo sapien
cgctggggcaccgtatgtgacgatg

SEQ ID NO: 9980 - DNA, 25 bp, Homo sapien
ggagcaactgtgaccacagcgagga

SEQ ID NO: 9981 - DNA, 25 bp, Homo sapien
cggtgccagattcgggcctggtgca

SEQ ID NO: 9982 - DNA, 25 bp, Homo sapien
gggaggggtctggacccatcatcct

SEQ ID NO: 9983 - DNA, 25 bp, Homo sapien
gggtctggacccatcatcctggacg

SEQ ID NO: 9984 - DNA, 25 bp, Homo sapien
aaacgagacggccttacgattctgc

SEQ ID NO: 9985 - DNA, 25 bp, Homo sapien
gagacggccttacgattctgcccag

SEQ ID NO: 9986 - DNA, 25 bp, Homo sapien
ctggggccagcatgactgtcaccac

SEQ ID NO: 9987 - DNA, 25 bp, Homo sapien
agcatgactgtcaccaccgcgagga

SEQ ID NO: 9988 - DNA, 25 bp, Homo sapien
atgactgtcaccaccgcgaggacgc

SEQ ID NO: 9989 - DNA, 25 bp, Homo sapien
cctgggacctgcgagacgccgctgt

SEQ ID NO: 9990 - DNA, 25 bp, Homo sapien
tggcgctcagcacgcatgcgcaggc

SEQ ID NO: 9991 - DNA, 25 bp, Homo sapien
ggggcaggcgttcatctgcctcgca

SEQ ID NO: 9992 - DNA, 25 bp, Homo sapien
gcgggctcctctgtccgtttctcac

SEQ ID NO: 9993 - DNA, 25 bp, Homo sapien
ttttttctggcgctcagcacgcatg

SEQ ID NO: 9994 - DNA, 25 bp, Homo sapien
agagtctcgccgcaagcgtcctttc

SEQ ID NO: 9995 - DNA, 25 bp, Homo sapien
tcccgcaggagagtctcgccgcaag

SEQ ID NO: 9996 - DNA, 25 bp, Homo sapien
gcagtcgctgtttctccgtcttctc

SEQ ID NO: 9997 - DNA, 25 bp, Homo sapien
atctgcctcgcacctcgtgacgtca

SEQ ID NO: 9998 - DNA, 25 bp, Homo sapien
ctgacctctgactccagtcgagagc

SEQ ID NO: 9999 - DNA, 25 bp, Homo sapien
cttgacgtccgaggcgacctctgac

SEQ ID NO: 10000 - DNA, 25 bp, Homo sapien
gtatgctgcacgcttctgagcactc

SEQ ID NO: 10001 - DNA, 25 bp, Homo sapien
aagtctgccggtgacccatgacgtc

SEQ ID NO: 10002 - DNA, 25 bp, Homo sapien
acccatgacgtctcgaggctctgtg

SEQ ID NO: 10003 - DNA, 25 bp, Homo sapien
aggctctgtgcctttccattggtcg

SEQ ID NO: 10004 - DNA, 25 bp, Homo sapien
ctttccattggtcggctcctcgagg

SEQ ID NO: 10005 - DNA, 25 bp, Homo sapien
ggttgacctcagaccgtccgtctgt

SEQ ID NO: 10006 - DNA, 25 bp, Homo sapien
tcccgcgaggcctcgtgtggccgaa

SEQ ID NO: 10007 - DNA, 25 bp, Homo sapien
agaagagcaggacgcccagcgccca

SEQ ID NO: 10008 - DNA, 25 bp, Homo sapien
cccaggtgctccctgatggcgatca

SEQ ID NO: 10009 - DNA, 25 bp, Homo sapien
ccgaagtcggtcagcttgaagcgcc

SEQ ID NO: 10010 - DNA, 25 bp, Homo sapien
ggtcgcacaccaggacgttctccgg

SEQ ID NO: 10011 - DNA, 25 bp, Homo sapien
ttctccggcttcaggtcccggtaca

SEQ ID NO: 10012 - DNA, 25 bp, Homo sapien
tgatggcgatcacagcgctcctcct

SEQ ID NO: 10013 - DNA, 25 bp, Homo sapien
ccgacgcctgccagatgaggaagtc

SEQ ID NO: 10014 - DNA, 25 bp, Homo sapien
tctgacaccgcgtcgaccagatcgg

SEQ ID NO: 10015 - DNA, 25 bp, Homo sapien
tgtaaattcatgaccggcagtgcgc

SEQ ID NO: 10016 - DNA, 25 bp, Homo sapien
aggcggctgaatatcatgtaaattc

SEQ ID NO: 10017 - DNA, 25 bp, Homo sapien
gcagaggcggctgaatatcatgtaa

SEQ ID NO: 10018 - DNA, 25 bp, Homo sapien
gccgctgcgtgaattaagtggcaga

SEQ ID NO: 10019 - DNA, 25 bp, Homo sapien
tccaaggccgctgcgtgaattaagt

SEQ ID NO: 10020 - DNA, 25 bp, Homo sapien
cgcgtcgaccagatcggctctggtc

SEQ ID NO: 10021 - DNA, 25 bp, Homo sapien
attcatgaccggcagtgcgcgtcct

SEQ ID NO: 10022 - DNA, 25 bp, Homo sapien
caccttgggctggatgaaggccatg

SEQ ID NO: 10023 - DNA, 25 bp, Homo sapien
ctcgtacaggaagccacggagggac

SEQ ID NO: 10024 - DNA, 25 bp, Homo sapien
cccacacagaactcgtacaggaagc

SEQ ID NO: 10025 - DNA, 25 bp, Homo sapien
ccgtaggccgtcacgatggctgagt

SEQ ID NO: 10026 - DNA, 25 bp, Homo sapien
tgccgactcgatgccaatgccgtag

SEQ ID NO: 10027 - DNA, 25 bp, Homo sapien
ctccgtcaggaagctgtaggagtgt

SEQ ID NO: 10028 - DNA, 25 bp, Homo sapien
gtctgcctacgcaccttgggctgga

SEQ ID NO: 10029 - DNA, 25 bp, Homo sapien
aagctgtaggagtgtgccgactcga

SEQ ID NO: 10030 - DNA, 25 bp, Homo sapien
ccctgctggagctcctctaatgtca

SEQ ID NO: 10031 - DNA, 25 bp, Homo sapien
tgaccagaaggacgcggccatagca

SEQ ID NO: 10032 - DNA, 25 bp, Homo sapien
tgagcactcagcgtcatcatgtcct

SEQ ID NO: 10033 - DNA, 25 bp, Homo sapien
gctcggaccagggtctgagcactca

SEQ ID NO: 10034 - DNA, 25 bp, Homo sapien
tagagctcgtccacctcggctcgga

SEQ ID NO: 10035 - DNA, 25 bp, Homo sapien
aggacgcggccatagcaaccctggc

SEQ ID NO: 10036 - DNA, 25 bp, Homo sapien
ttcctcagactgtttgccgggcatc

SEQ ID NO: 10037 - DNA, 25 bp, Homo sapien
ggagctcctctaatgtcaggccgcc

SEQ ID NO: 10038 - DNA, 25 bp, Homo sapien
gagctcctccactggagacccgggg

SEQ ID NO: 10039 - DNA, 25 bp, Homo sapien
ggtcacccggagtgacctcggcacg

SEQ ID NO: 10040 - DNA, 25 bp, Homo sapien
ttagtaacgccgctctgcggggtca

SEQ ID NO: 10041 - DNA, 25 bp, Homo sapien
cccatttagtaacgccgctctgcgg

SEQ ID NO: 10042 - DNA, 25 bp, Homo sapien
tgatccgaagagctttgcacctccc

SEQ ID NO: 10043 - DNA, 25 bp, Homo sapien
agcgcatctgctaccctagagccgg

SEQ ID NO: 10044 - DNA, 25 bp, Homo sapien
aggcaagcgcatctgctaccctaga

SEQ ID NO: 10045 - DNA, 25 bp, Homo sapien
ctgtgcgccgacaggcaagcgcatc

SEQ ID NO: 10046 - DNA, 25 bp, Homo sapien
tctcgaaggctgagtggtcttggct

SEQ ID NO: 10047 - DNA, 25 bp, Homo sapien
tccttaatgtttgcgaggggcagcg

SEQ ID NO: 10048 - DNA, 25 bp, Homo sapien
ggcggctcttccttaatgtttgcga

SEQ ID NO: 10049 - DNA, 25 bp, Homo sapien
tcttggctgtcgaaacaggaggcgc

SEQ ID NO: 10050 - DNA, 25 bp, Homo sapien
ctcctccatctcgaaggctgagtgg

SEQ ID NO: 10051 - DNA, 25 bp, Homo sapien
ggtgagccttgctgtctacctcttc

SEQ ID NO: 10052 - DNA, 25 bp, Homo sapien
cagcccgcgcaggtgagccttgctg

SEQ ID NO: 10053 - DNA, 25 bp, Homo sapien
agggcggctcttccttaatgtttgc

SEQ ID NO: 10054 - DNA, 25 bp, Homo sapien
tgctcctgagccaggtggcgcctga

SEQ ID NO: 10055 - DNA, 25 bp, Homo sapien
tgggttcggccgtctccttggccac

SEQ ID NO: 10056 - DNA, 25 bp, Homo sapien
aaggccttgaggcagatggagcact

SEQ ID NO: 10057 - DNA, 25 bp, Homo sapien
ttcctgttcgccctcggggcgcaga

SEQ ID NO: 10058 - DNA, 25 bp, Homo sapien
cgcagacacgggtgcgccttgagct

SEQ ID NO: 10059 - DNA, 25 bp, Homo sapien
ggcagcgcagacacagcagcgtcca

SEQ ID NO: 10060 - DNA, 25 bp, Homo sapien
agcagcgtccagtctgcctggagca

SEQ ID NO: 10061 - DNA, 25 bp, Homo sapien
ctggagcaggacctgtttctcctcc

SEQ ID NO: 10062 - DNA, 25 bp, Homo sapien
gctggctttagcgactccacgggac

SEQ ID NO: 10063 - DNA, 25 bp, Homo sapien
ccgtcatcccaagcacatctgtgtt

SEQ ID NO: 10064 - DNA, 25 bp, Homo sapien
tcttctagggagatgggaagctctt

SEQ ID NO: 10065 - DNA, 25 bp, Homo sapien
cccaaaggtcgtagggagccaggca

SEQ ID NO: 10066 - DNA, 25 bp, Homo sapien
agaaaccctcccagctgtcagcaag

SEQ ID NO: 10067 - DNA, 25 bp, Homo sapien
accaccagccgcatggcagggcaga

SEQ ID NO: 10068 - DNA, 25 bp, Homo sapien
tgccactcaggcacggtgaggctct

SEQ ID NO: 10069 - DNA, 25 bp, Homo sapien
gatgacgtgcctcgactgtgttaca

SEQ ID NO: 10070 - DNA, 25 bp, Homo sapien
agactcccgctcaggcaagcgtgca

SEQ ID NO: 10071 - DNA, 25 bp, Homo sapien
ctattcattactccctggccggcgg

SEQ ID NO: 10072 - DNA, 25 bp, Homo sapien
agcctcgcgaggtccctattcatta

SEQ ID NO: 10073 - DNA, 25 bp, Homo sapien
atgggatgggtccttctcgttaccg

SEQ ID NO: 10074 - DNA, 25 bp, Homo sapien
cggttgagatcgtcctcagggtaaa

SEQ ID NO: 10075 - DNA, 25 bp, Homo sapien
ccggcgtctggctagtaattaatgt

SEQ ID NO: 10076 - DNA, 25 bp, Homo sapien
tcagcctgtctctaagccggtctcg

SEQ ID NO: 10077 - DNA, 25 bp, Homo sapien
ctccaaggtctgcacgcaggaatca

SEQ ID NO: 10078 - DNA, 25 bp, Homo sapien
ttgctgagcgtgatgaagcccttgc

SEQ ID NO: 10079 - DNA, 25 bp, Homo sapien
ggaacagcttctcgcactcggagca

SEQ ID NO: 10080 - DNA, 25 bp, Homo sapien
ctcggagcagccgaagatcttcttg

SEQ ID NO: 10081 - DNA, 25 bp, Homo sapien
cgcaaagaaggtcccgcagtcgcac

SEQ ID NO: 10082 - DNA, 25 bp, Homo sapien
agtcgcactggtacagggtgtcttc

SEQ ID NO: 10083 - DNA, 25 bp, Homo sapien
tgcgtcagcttgtgccgctccagca

SEQ ID NO: 10084 - DNA, 25 bp, Homo sapien
ttgccgcactccaggcacgggaacg

SEQ ID NO: 10085 - DNA, 25 bp, Homo sapien
ggtagcactcgtggcggaagaactt

SEQ ID NO: 10086 - DNA, 25 bp, Homo sapien
ctcttgccacattcactgcagtgaa

SEQ ID NO: 10087 - DNA, 25 bp, Homo sapien
caggtctgagcggtagcggaagctc

SEQ ID NO: 10088 - DNA, 25 bp, Homo sapien
cttgaaacccttgccgcagcgcgga

SEQ ID NO: 10089 - DNA, 25 bp, Homo sapien
ctgtgcttgaaacccttgccgcagc

SEQ ID NO: 10090 - DNA, 25 bp, Homo sapien
tgaagctgtgcttgaaacccttgcc

SEQ ID NO: 10091 - DNA, 25 bp, Homo sapien
ttcactgcagtgaaacgggaccctg

SEQ ID NO: 10092 - DNA, 25 bp, Homo sapien
cactgcagtgaaacgggaccctggg

SEQ ID NO: 10093 - DNA, 25 bp, Homo sapien
ttggctaggttgaagctgtgcttga

SEQ ID NO: 10094 - DNA, 25 bp, Homo sapien
ccgatgggcgcgtcagtaccggggc

SEQ ID NO: 10095 - DNA, 25 bp, Homo sapien
aacacctgttcctgctcccgcgctc

SEQ ID NO: 10096 - DNA, 25 bp, Homo sapien
cgcgcctccaacacctgttcctgct

SEQ ID NO: 10097 - DNA, 25 bp, Homo sapien
atgcaaatgaggtacccgagaggcg

SEQ ID NO: 10098 - DNA, 25 bp, Homo sapien
catgcaaatgaggtacccgagaggc

SEQ ID NO: 10099 - DNA, 25 bp, Homo sapien
gcgagccccggcgacatgcaaatga

SEQ ID NO: 10100 - DNA, 25 bp, Homo sapien
gcgaccggtcgttaggacccagcga

SEQ ID NO: 10101 - DNA, 25 bp, Homo sapien
cccgcgcttgggcttcgcagctcgg

SEQ ID NO: 10102 - DNA, 25 bp, Homo sapien
ctgtgacaggaaaaggtacgggcca

SEQ ID NO: 10103 - DNA, 25 bp, Homo sapien
cccgcggactatccctgtgacagga

SEQ ID NO: 10104 - DNA, 25 bp, Homo sapien
tcgctcccggaagagtgcggagctc

SEQ ID NO: 10105 - DNA, 25 bp, Homo sapien
tacgggccatttggcaaactaaggc

SEQ ID NO: 10106 - DNA, 25 bp, Homo sapien
tctcttgcttttctcaggtcctcgg

SEQ ID NO: 10107 - DNA, 25 bp, Homo sapien
caccgtttgcgacttggtgagtgtc

SEQ ID NO: 10108 - DNA, 25 bp, Homo sapien
agcaggaccgggattctcactaagc

SEQ ID NO: 10109 - DNA, 25 bp, Homo sapien
cgctttcaggaccactcgggcacgt

SEQ ID NO: 10110 - DNA, 25 bp, Homo sapien
cacagcatctcgcactcagagctga

SEQ ID NO: 10111 - DNA, 25 bp, Homo sapien
cagtgcaaggtttgcggcaagacct

SEQ ID NO: 10112 - DNA, 25 bp, Homo sapien
tgcggcggcactgcaacatccatgc

SEQ ID NO: 10113 - DNA, 25 bp, Homo sapien
ccatctgccggctgcgctttacaga

SEQ ID NO: 10114 - DNA, 25 bp, Homo sapien
actcagagctgaagccgcaccagtg

SEQ ID NO: 10115 - DNA, 25 bp, Homo sapien
atccagggtctgaaccgccgtggga

SEQ ID NO: 10116 - DNA, 25 bp, Homo sapien
gctccggcgccatgcgaagcgcaag

SEQ ID NO: 10117 - DNA, 25 bp, Homo sapien
gctgcgctttacagaggccaacacg

SEQ ID NO: 10118 - DNA, 25 bp, Homo sapien
tggcttaaccggacgcccagagcgt

SEQ ID NO: 10119 - DNA, 25 bp, Homo sapien
taaccggacgcccagagcgtgtcgc

SEQ ID NO: 10120 - DNA, 25 bp, Homo sapien
agaagaggcgggcattcaaagcgca

SEQ ID NO: 10121 - DNA, 25 bp, Homo sapien
gcgcaggcgcacctggctcagttcg

SEQ ID NO: 10122 - DNA, 25 bp, Homo sapien
gctcagttcgcccaccggaatcggc

SEQ ID NO: 10123 - DNA, 25 bp, Homo sapien
ccggaatcggcccgggctttcactg

SEQ ID NO: 10124 - DNA, 25 bp, Homo sapien
tctttccgatcctccacgccggcgc

SEQ ID NO: 10125 - DNA, 25 bp, Homo sapien
gaggtgtggcttaaccggacgccca

SEQ ID NO: 10126 - DNA, 25 bp, Homo sapien
cgcgagaccctgaagcgccatgagc

SEQ ID NO: 10127 - DNA, 25 bp, Homo sapien
atcgagaacctcatgtggcacaagc

SEQ ID NO: 10128 - DNA, 25 bp, Homo sapien
aagaccttcggcttcatcgagaacc

SEQ ID NO: 10129 - DNA, 25 bp, Homo sapien
gtcatgagtcacaaggaggtccaca

SEQ ID NO: 10130 - DNA, 25 bp, Homo sapien
ttcccggatctctttcacgtcatga

SEQ ID NO: 10131 - DNA, 25 bp, Homo sapien
ttccgcgaatccttccacttgagca

SEQ ID NO: 10132 - DNA, 25 bp, Homo sapien
ggcaagtcctactcggctccgcaga

SEQ ID NO: 10133 - DNA, 25 bp, Homo sapien
acttgagcaagcatcacgtggtgca

SEQ ID NO: 10134 - DNA, 25 bp, Homo sapien
aactaacccatgtccctggtctgca

SEQ ID NO: 10135 - DNA, 25 bp, Homo sapien
gcctctgttctgcaacggccgctgt

SEQ ID NO: 10136 - DNA, 25 bp, Homo sapien
ggcttggcgcagaacctgcaggcaa

SEQ ID NO: 10137 - DNA, 25 bp, Homo sapien
ctcgtggtctcgcatgtctgaggag

SEQ ID NO: 10138 - DNA, 25 bp, Homo sapien
ccgcaatggtatggccgctcgccag

SEQ ID NO: 10139 - DNA, 25 bp, Homo sapien
gacgagcccagctggcctccagagt

SEQ ID NO: 10140 - DNA, 25 bp, Homo sapien
gccaagtggccatgttcgtggaaca

SEQ ID NO: 10141 - DNA, 25 bp, Homo sapien
tggtctgcagcctactggtcggcct

SEQ ID NO: 10142 - DNA, 25 bp, Homo sapien
cccgcaccaggtccagtggctcctg

SEQ ID NO: 10143 - DNA, 25 bp, Homo sapien
tcctgggatcgcgactccggagtcg

SEQ ID NO: 10144 - DNA, 25 bp, Homo sapien
gcgcagcggccatcttgtgcccaag

SEQ ID NO: 10145 - DNA, 25 bp, Homo sapien
cccaaggccaatgttcgctctgaaa

SEQ ID NO: 10146 - DNA, 25 bp, Homo sapien
aaggccaatgttcgctctgaaaggg

SEQ ID NO: 10147 - DNA, 25 bp, Homo sapien
ctcgaactggcgtaagagctactgc

SEQ ID NO: 10148 - DNA, 25 bp, Homo sapien
cttccttgcccgcaccaggtccagt

SEQ ID NO: 10149 - DNA, 25 bp, Homo sapien
cggagtcggtgagctccgactctgg

SEQ ID NO: 10150 - DNA, 25 bp, Homo sapien
ctttgcttagtctcggtttattggc

SEQ ID NO: 10151 - DNA, 25 bp, Homo sapien
cggtgtcgccacatgccttctggaa

SEQ ID NO: 10152 - DNA, 25 bp, Homo sapien
cccatttgctgggtggagaatcacg

SEQ ID NO: 10153 - DNA, 25 bp, Homo sapien
agccaatggctggtctctggacctc

SEQ ID NO: 10154 - DNA, 25 bp, Homo sapien
ggacctcggtctccacatttgctca

SEQ ID NO: 10155 - DNA, 25 bp, Homo sapien
aactatctggcagcgtctggccttc

SEQ ID NO: 10156 - DNA, 25 bp, Homo sapien
cgatctcttgtcaagcggcggaatc

SEQ ID NO: 10157 - DNA, 25 bp, Homo sapien
ccagtggaaagaggacaaacccttg

SEQ ID NO: 10158 - DNA, 25 bp, Homo sapien
tgcactgaacgtgaaaggtcccgtc

SEQ ID NO: 10159 - DNA, 25 bp, Homo sapien
ggccttgcgtccactctgcacactg

SEQ ID NO: 10160 - DNA, 25 bp, Homo sapien
ttccagagtttcctgcaggcgcctc

SEQ ID NO: 10161 - DNA, 25 bp, Homo sapien
gtgaaaggtcccgtcttcgctccag

SEQ ID NO: 10162 - DNA, 25 bp, Homo sapien
ccgtgtgctgcactgaacgtgaaag

SEQ ID NO: 10163 - DNA, 25 bp, Homo sapien
tttccttcctctgacctaagccgtg

SEQ ID NO: 10164 - DNA, 25 bp, Homo sapien
ttcgctccagcacttccagagtttc

SEQ ID NO: 10165 - DNA, 25 bp, Homo sapien
tgacctaagccgtgtgctgcactga

SEQ ID NO: 10166 - DNA, 25 bp, Homo sapien
acctgtcgcggcatcgcgccacgca

SEQ ID NO: 10167 - DNA, 25 bp, Homo sapien
caagggctacagctgcccggagtgc

SEQ ID NO: 10168 - DNA, 25 bp, Homo sapien
gagtgcgcccgtgtctttgccagcc

SEQ ID NO: 10169 - DNA, 25 bp, Homo sapien
agagccaccgcgtgtcgcactcgga

SEQ ID NO: 10170 - DNA, 25 bp, Homo sapien
tgtcgcactcggacctcaagccctt

SEQ ID NO: 10171 - DNA, 25 bp, Homo sapien
tcaagcccttcacgtgcggcgcctg

SEQ ID NO: 10172 - DNA, 25 bp, Homo sapien
ctcgcaagggctacagctgcccgga

SEQ ID NO: 10173 - DNA, 25 bp, Homo sapien
tggggtcccctacacatacacggtg

SEQ ID NO: 10174 - DNA, 25 bp, Homo sapien
tttctggccggagccgtttcgcgac

SEQ ID NO: 10175 - DNA, 25 bp, Homo sapien
tcctctcggtgtgtgtttctggccg

SEQ ID NO: 10176 - DNA, 25 bp, Homo sapien
actttcctctcggtgtgtgtttctg

SEQ ID NO: 10177 - DNA, 25 bp, Homo sapien
ttgggtactttcctctcggtgtgtg

SEQ ID NO: 10178 - DNA, 25 bp, Homo sapien
tcgcttgggtactttcctctcggtg

SEQ ID NO: 10179 - DNA, 25 bp, Homo sapien
tcttcctcgcttgggtactttcctc

SEQ ID NO: 10180 - DNA, 25 bp, Homo sapien
ggatcttcctcgcttgggtactttc

SEQ ID NO: 10181 - DNA, 25 bp, Homo sapien
ccggcgccgccagttcctggggcac

SEQ ID NO: 10182 - DNA, 25 bp, Homo sapien
cactctggggaacgcccgtttcagt

SEQ ID NO: 10183 - DNA, 25 bp, Homo sapien
attccattcacctggcgggtggtgg

SEQ ID NO: 10184 - DNA, 25 bp, Homo sapien
tgccctcgccgctttatggagcaga

SEQ ID NO: 10185 - DNA, 25 bp, Homo sapien
tggagcagaacacactgcagaaaca

SEQ ID NO: 10186 - DNA, 25 bp, Homo sapien
tgcagaaacacacgcggtggaagca

SEQ ID NO: 10187 - DNA, 25 bp, Homo sapien
tggaagcatccatgagccgggctgc

SEQ ID NO: 10188 - DNA, 25 bp, Homo sapien
ggcaccattccattcacctggcggg

SEQ ID NO: 10189 - DNA, 25 bp, Homo sapien
acttggcacggcaccattccattca

SEQ ID NO: 10190 - DNA, 25 bp, Homo sapien
gtgcatccgcgtcggcgctgaattc

SEQ ID NO: 10191 - DNA, 25 bp, Homo sapien
tcagtgtgacttaagaccaagggcc

SEQ ID NO: 10192 - DNA, 25 bp, Homo sapien
ctgacttcagaacgccaagacggtc

SEQ ID NO: 10193 - DNA, 25 bp, Homo sapien
tagcgcagggctgcacaccgcttac

SEQ ID NO: 10194 - DNA, 25 bp, Homo sapien
cccgtgtggtcgtttatgtcgagga

SEQ ID NO: 10195 - DNA, 25 bp, Homo sapien
tcgaggactgtatgctctgaccacg

SEQ ID NO: 10196 - DNA, 25 bp, Homo sapien
tgctctgaccacgatgccacgtgac

SEQ ID NO: 10197 - DNA, 25 bp, Homo sapien
aacccacgtctggacctcagtgtga

SEQ ID NO: 10198 - DNA, 25 bp, Homo sapien
gccctagtgcatgttcccgctggaa

SEQ ID NO: 10199 - DNA, 25 bp, Homo sapien
tgttcccgctggaatcgttccacga

SEQ ID NO: 10200 - DNA, 25 bp, Homo sapien
gactcttcaacgaggggcgctagcc

SEQ ID NO: 10201 - DNA, 25 bp, Homo sapien
tgcttctgccgcaaacggcgggcct

SEQ ID NO: 10202 - DNA, 25 bp, Homo sapien
tatcgcgcaagtgcagaccctctgc

SEQ ID NO: 10203 - DNA, 25 bp, Homo sapien
tgctgtaaggggctatcgcgcaagt

SEQ ID NO: 10204 - DNA, 25 bp, Homo sapien
ccaggatgggaatttcgtgatgttc

SEQ ID NO: 10205 - DNA, 25 bp, Homo sapien
agactcgccagctctccaggatggg

SEQ ID NO: 10206 - DNA, 25 bp, Homo sapien
ctcccggaagtaatgccagatgatc

SEQ ID NO: 10207 - DNA, 25 bp, Homo sapien
ccaggccaagtctggaggatacttc

SEQ ID NO: 10208 - DNA, 25 bp, Homo sapien
cacggactcgagcttaatcccagga

SEQ ID NO: 10209 - DNA, 25 bp, Homo sapien
agagcgcgccacagaacgactttta

SEQ ID NO: 10210 - DNA, 25 bp, Homo sapien
cgcgcaatggggactgaaacctggt

SEQ ID NO: 10211 - DNA, 25 bp, Homo sapien
acggctggggattaagcactttcac

SEQ ID NO: 10212 - DNA, 25 bp, Homo sapien
ccagatcatctgtctcccggaagta

SEQ ID NO: 10213 - DNA, 25 bp, Homo sapien
tcaccgttgtaagggaaatctcgcg

SEQ ID NO: 10214 - DNA, 25 bp, Homo sapien
accggcatcggaagcgcagccacag

SEQ ID NO: 10215 - DNA, 25 bp, Homo sapien
cagccacagccgctctcggagccgg

SEQ ID NO: 10216 - DNA, 25 bp, Homo sapien
gagccgggaccgcaaacgccggagc

SEQ ID NO: 10217 - DNA, 25 bp, Homo sapien
aaccggcatcggaagcgcagccaca

SEQ ID NO: 10218 - DNA, 25 bp, Homo sapien
cgcgaccggcgcaaccgggaccagc

SEQ ID NO: 10219 - DNA, 25 bp, Homo sapien
aaggagaaccggcatcggaagcgca

SEQ ID NO: 10220 - DNA, 25 bp, Homo sapien
cccagagcgggacaaggagaaccgg

SEQ ID NO: 10221 - DNA, 25 bp, Homo sapien
atccttactccgcttatcccgtgcc

SEQ ID NO: 10222 - DNA, 25 bp, Homo sapien
ggcgctgtcctaagtgccctccatg

SEQ ID NO: 10223 - DNA, 25 bp, Homo sapien
ccatggacggcagttctacgacaca

SEQ ID NO: 10224 - DNA, 25 bp, Homo sapien
gcacggcagttctacgacacaggga

SEQ ID NO: 10225 - DNA, 25 bp, Homo sapien
cgctgtcctaagtgccctccatgga

SEQ ID NO: 10226 - DNA, 25 bp, Homo sapien
cggcagttctacgacacagggattg

SEQ ID NO: 10227 - DNA, 25 bp, Homo sapien
tccatggacggcagttctacgacac

SEQ ID NO: 10228 - DNA, 25 bp, Homo sapien
ctccatggacggcagttctacgaca

SEQ ID NO: 10229 - DNA, 25 bp, Homo sapien
acggcagttctacgacacagggatt

SEQ ID NO: 10230 - DNA, 25 bp, Homo sapien
gactctcggcgttccgtgagcaccg

SEQ ID NO: 10231 - DNA, 25 bp, Homo sapien
tgcggccctccttgcgttcgtgcgt

SEQ ID NO: 10232 - DNA, 25 bp, Homo sapien
cttctgttgcttcccgtctcctcgg

SEQ ID NO: 10233 - DNA, 25 bp, Homo sapien
cggggagcgcggcaatttccgcttc

SEQ ID NO: 10234 - DNA, 25 bp, Homo sapien
atgccttccaggttggcttggctgc

SEQ ID NO: 10235 - DNA, 25 bp, Homo sapien
gcgcgccggaagtgatgccttccag

SEQ ID NO: 10236 - DNA, 25 bp, Homo sapien
tagaggcgcctagcaacggggccca

SEQ ID NO: 10237 - DNA, 25 bp, Homo sapien
aagtgacgtagaggcgcctagcaac

SEQ ID NO: 10238 - DNA, 25 bp, Homo sapien
gaccaaggaaaagctggcacagacc

SEQ ID NO: 10239 - DNA, 25 bp, Homo sapien
ggcgcacgcgctcaagaccaaggaa

SEQ ID NO: 10240 - DNA, 25 bp, Homo sapien
tgaacgtgcgtgagaaagctaagca

SEQ ID NO: 10241 - DNA, 25 bp, Homo sapien
ctgaaggacttccagtacgtggacc

SEQ ID NO: 10242 - DNA, 25 bp, Homo sapien
aacatgtacgccgtgcagacgctga

SEQ ID NO: 10243 - DNA, 25 bp, Homo sapien
cgcagcagtgcaaggagaacatgta

SEQ ID NO: 10244 - DNA, 25 bp, Homo sapien
agtacctcatcaagaccggctcgga

SEQ ID NO: 10245 - DNA, 25 bp, Homo sapien
cgcaggccatgacgctgatggagta

SEQ ID NO: 10246 - DNA, 25 bp, Homo sapien
ctgcgtttcggctgctggcccagca

SEQ ID NO: 10247 - DNA, 25 bp, Homo sapien
agttcctccgtttccaggcttctcg

SEQ ID NO: 10248 - DNA, 25 bp, Homo sapien
ggcttctcgcccacacggagacagt

SEQ ID NO: 10249 - DNA, 25 bp, Homo sapien
tatcaaccgaggtattcagtccctc

SEQ ID NO: 10250 - DNA, 25 bp, Homo sapien
ggagacagtcgctctcacacgtacc

SEQ ID NO: 10251 - DNA, 25 bp, Homo sapien
tcgcgggctcttactcgtggtcccg

SEQ ID NO: 10252 - DNA, 25 bp, Homo sapien
cagcgcgcacactagacggcacgtg

SEQ ID NO: 10253 - DNA, 25 bp, Homo sapien
ggccagcgcgcagactatcaaccga

SEQ ID NO: 10254 - DNA, 25 bp, Homo sapien
cggcttgctgcggaacttcttcccg

SEQ ID NO: 10255 - DNA, 25 bp, Homo sapien
ggtaatcttggtcaccggctgcttg

SEQ ID NO: 10256 - DNA, 25 bp, Homo sapien
tcaccttgacctggttggaggagtc

SEQ ID NO: 10257 - DNA, 25 bp, Homo sapien
cggctcttgttcatcttgctcatca

SEQ ID NO: 10258 - DNA, 25 bp, Homo sapien
ctcatcagcatcttgcccgtgcgga

SEQ ID NO: 10259 - DNA, 25 bp, Homo sapien
cggaagtcgaaggtgctcaggtcca

SEQ ID NO: 10260 - DNA, 25 bp, Homo sapien
cttgaagatggacgccgtctggcgc

SEQ ID NO: 10261 - DNA, 25 bp, Homo sapien
tctgcgggtcgctcttgaccttgtt

SEQ ID NO: 10262 - DNA, 25 bp, Homo sapien
atgtccgtggctgcggtgtaattta

SEQ ID NO: 10263 - DNA, 25 bp, Homo sapien
tacgaggctgcggtgtaatttacga

SEQ ID NO: 10264 - DNA, 25 bp, Homo sapien
tccgtggctgcggtgtaatttacga

SEQ ID NO: 10265 - DNA, 25 bp, Homo sapien
tccgtggctgcggtgtaatttccgt

SEQ ID NO: 10266 - DNA, 25 bp, Homo sapien
ccgaggctgcggtgtaatttccgag

SEQ ID NO: 10267 - DNA, 25 bp, Homo sapien
ccgtggctgcggtgtaatttccgag

SEQ ID NO: 10268 - DNA, 25 bp, Homo sapien
atgtccgtggctgcggtgtaatttc

SEQ ID NO: 10269 - DNA, 25 bp, Homo sapien
ccgaggctgcggtgtaatttacgag

SEQ ID NO: 10270 - DNA, 25 bp, Homo sapien
gcggcttgaacgaacccgattcgga

SEQ ID NO: 10271 - DNA, 25 bp, Homo sapien
tccgggatcaggtgacgatctcaga

SEQ ID NO: 10272 - DNA, 25 bp, Homo sapien
tcaaacccgtgtgcccgaaggagct

SEQ ID NO: 10273 - DNA, 25 bp, Homo sapien
tgctcatcgctatcaaacccgtgtg

SEQ ID NO: 10274 - DNA, 25 bp, Homo sapien
gtttgctgaggaagaagatgctccc

SEQ ID NO: 10275 - DNA, 25 bp, Homo sapien
ccgattcggatctgtgtggtgactt

SEQ ID NO: 10276 - DNA, 25 bp, Homo sapien
gagagactcttgttcgtcatcgaca

SEQ ID NO: 10277 - DNA, 25 bp, Homo sapien
acttgatggagaaacggccggtgca

SEQ ID NO: 10278 - DNA, 25 bp, Homo sapien
cacacagagacgtctgcggcgctgc

SEQ ID NO: 10279 - DNA, 25 bp, Homo sapien
ggcggcggtagaaattaatctgctc

SEQ ID NO: 10280 - DNA, 25 bp, Homo sapien
atctgctcagattttccaactaatg

SEQ ID NO: 10281 - DNA, 25 bp, Homo sapien
cccaggaccgaaggggccacacaga

SEQ ID NO: 10282 - DNA, 25 bp, Homo sapien
gcacccaggaacctgtccttcagga

SEQ ID NO: 10283 - DNA, 25 bp, Homo sapien
gcgctgcttcccattcgcgcagatg

SEQ ID NO: 10284 - DNA, 25 bp, Homo sapien
ttcgcgcagatgcacacggattccg

SEQ ID NO: 10285 - DNA, 25 bp, Homo sapien
actaatgaagtattcccaggaccga

SEQ ID NO: 10286 - DNA, 25 bp, Homo sapien
ctcgcaggccgataacttaggaagg

SEQ ID NO: 10287 - DNA, 25 bp, Homo sapien
tctcttggtcttgcacgtcgtcgct

SEQ ID NO: 10288 - DNA, 25 bp, Homo sapien
ggggacatttggatagtgccgttta

SEQ ID NO: 10289 - DNA, 25 bp, Homo sapien
ggcctctgcagttctctccattgtc

SEQ ID NO: 10290 - DNA, 25 bp, Homo sapien
ggcctggtttctccattcctcgcag

SEQ ID NO: 10291 - DNA, 25 bp, Homo sapien
cgactcgagctctaaggatgggacc

SEQ ID NO: 10292 - DNA, 25 bp, Homo sapien
agtgccgtttattgttccagcaccc

SEQ ID NO: 10293 - DNA, 25 bp, Homo sapien
cccaccgcgtggatcttcttgtgtc

SEQ ID NO: 10294 - DNA, 25 bp, Homo sapien
gggaaacgccgtgctgtgaacttca

SEQ ID NO: 10295 - DNA, 25 bp, Homo sapien
aggcacggcgcgagggatcaactac

SEQ ID NO: 10296 - DNA, 25 bp, Homo sapien
ttatctggctgtgttcctgcgtgca

SEQ ID NO: 10297 - DNA, 25 bp, Homo sapien
gctgctagcacaggaagaactgttc

SEQ ID NO: 10298 - DNA, 25 bp, Homo sapien
ggaaacacccgcacgtgctgctagc

SEQ ID NO: 10299 - DNA, 25 bp, Homo sapien
gcctcagcccggcaggcagtaggat

SEQ ID NO: 10300 - DNA, 25 bp, Homo sapien
cgtgctacacgtgggaaacgccgtg

SEQ ID NO: 10301 - DNA, 25 bp, Homo sapien
cggcggccagcatgtaaatgaaacg

SEQ ID NO: 10302 - DNA, 25 bp, Homo sapien
atgccgcccgggtgattacggccgc

SEQ ID NO: 10303 - DNA, 25 bp, Homo sapien
caccaggtgattacggccgcagggt

SEQ ID NO: 10304 - DNA, 25 bp, Homo sapien
attacggccgcagggtgatgccgcc

SEQ ID NO: 10305 - DNA, 25 bp, Homo sapien
gatacagccgcagggtgatgccacc

SEQ ID NO: 10306 - DNA, 25 bp, Homo sapien
tgatggagcctaggtgatacggcca

SEQ ID NO: 10307 - DNA, 25 bp, Homo sapien
gatacggccaccaggtgattacggc

SEQ ID NO: 10308 - DNA, 25 bp, Homo sapien
tacagccgcagggtgatgccaccag

SEQ ID NO: 10309 - DNA, 25 bp, Homo sapien
gatggagcctaggtgatacggccac

SEQ ID NO: 10310 - DNA, 25 bp, Homo sapien
cactgtcacataggagggacgcacg

SEQ ID NO: 10311 - DNA, 25 bp, Homo sapien
ccacctacgatgtctgtcactgtca

SEQ ID NO: 10312 - DNA, 25 bp, Homo sapien
acgatgtctgtcactgtcacatagg

SEQ ID NO: 10313 - DNA, 25 bp, Homo sapien
ctacgatgtctgtcactgtcacata

SEQ ID NO: 10314 - DNA, 25 bp, Homo sapien
ctgtcacataggagggacgcatgta

SEQ ID NO: 10315 - DNA, 25 bp, Homo sapien
ctgtcacataggagggacgcacgta

SEQ ID NO: 10316 - DNA, 25 bp, Homo sapien
taggcgggactccacacgccatggc

SEQ ID NO: 10317 - DNA, 25 bp, Homo sapien
gtctgtcactgtcacataggaggga

SEQ ID NO: 10318 - DNA, 25 bp, Homo sapien
accaggaaggtctctacgcacacca

SEQ ID NO: 10319 - DNA, 25 bp, Homo sapien
tgatccgtgccacgcaccaggaagg

SEQ ID NO: 10320 - DNA, 25 bp, Homo sapien
agggtctctacacacgccactgatc

SEQ ID NO: 10321 - DNA, 25 bp, Homo sapien
gtgagggtctctgcgcacgacacca

SEQ ID NO: 10322 - DNA, 25 bp, Homo sapien
cacacaccgtgagggtctctgcgca

SEQ ID NO: 10323 - DNA, 25 bp, Homo sapien
gtgccacacaccgtgagggtctctg

SEQ ID NO: 10324 - DNA, 25 bp, Homo sapien
aacccgtgccacacaccgtgagggt

SEQ ID NO: 10325 - DNA, 25 bp, Homo sapien
cagtgagggtctctacacacgccac

SEQ ID NO: 10326 - DNA, 25 bp, Homo sapien
ctctaggaaggcgagcccgctatcc

SEQ ID NO: 10327 - DNA, 25 bp, Homo sapien
gcaggtcctccgtccatgctctatg

SEQ ID NO: 10328 - DNA, 25 bp, Homo sapien
ggtcctccgtccatgctctatggcg

SEQ ID NO: 10329 - DNA, 25 bp, Homo sapien
cacgaccggcggagttggaacttcg

SEQ ID NO: 10330 - DNA, 25 bp, Homo sapien
ccaccctgtcctcgccgctctagga

SEQ ID NO: 10331 - DNA, 25 bp, Homo sapien
gcgcctgagggagccacttccggaa

SEQ ID NO: 10332 - DNA, 25 bp, Homo sapien
cacttccggaagtgtctaggacgca

SEQ ID NO: 10333 - DNA, 25 bp, Homo sapien
gaagtgtctaggacgcaggtcctcc

SEQ ID NO: 10334 - DNA, 25 bp, Homo sapien
ggaagcctcctcgtgcattctggga

SEQ ID NO: 10335 - DNA, 25 bp, Homo sapien
tagtccaaagcctgtcgcgctcaga

SEQ ID NO: 10336 - DNA, 25 bp, Homo sapien
tttgcgccgtcaaggccaaataggc

SEQ ID NO: 10337 - DNA, 25 bp, Homo sapien
caaataggctgcagacgacgctttc

SEQ ID NO: 10338 - DNA, 25 bp, Homo sapien
cgacgctttcgcgtatcttgggaaa

SEQ ID NO: 10339 - DNA, 25 bp, Homo sapien
tagttccagtgttggcgaagacgcc

SEQ ID NO: 10340 - DNA, 25 bp, Homo sapien
gccacgcggtgacaaacaggagtaa

SEQ ID NO: 10341 - DNA, 25 bp, Homo sapien
ttttcccggcacttctgcgcatgtc

SEQ ID NO: 10342 - DNA, 25 bp, Homo sapien
aagagcgttggtcccattgtgagtc

SEQ ID NO: 10343 - DNA, 25 bp, Homo sapien
tggtcccattgtgagtctgggcacc

SEQ ID NO: 10344 - DNA, 25 bp, Homo sapien
cccattgtgagtctgggcaccgcgg

SEQ ID NO: 10345 - DNA, 25 bp, Homo sapien
gcaggggtctcaccggcttgttccc

SEQ ID NO: 10346 - DNA, 25 bp, Homo sapien
gggtctcaccggcttgttccctgca

SEQ ID NO: 10347 - DNA, 25 bp, Homo sapien
cctggcgggactgcaagcggggaag

SEQ ID NO: 10348 - DNA, 25 bp, Homo sapien
aaaaaagagcgttggtcccattgtg

SEQ ID NO: 10349 - DNA, 25 bp, Homo sapien
agcgttggtcccattgtgagtctgg

SEQ ID NO: 10350 - DNA, 25 bp, Homo sapien
tctgcccctccttggctcgtggaaa

SEQ ID NO: 10351 - DNA, 25 bp, Homo sapien
cgaagtgcacagtggacggagcggt

SEQ ID NO: 10352 - DNA, 25 bp, Homo sapien
gcacagtggacggagcggtcgttct

SEQ ID NO: 10353 - DNA, 25 bp, Homo sapien
gttctgcccctccttggctcgtgga

SEQ ID NO: 10354 - DNA, 25 bp, Homo sapien
cgtggaaaccacccgccctcacctg

SEQ ID NO: 10355 - DNA, 25 bp, Homo sapien
ggctcgtggaaaccacccgccctca

SEQ ID NO: 10356 - DNA, 25 bp, Homo sapien
tccttggctcgtggaaaccacccgc

SEQ ID NO: 10357 - DNA, 25 bp, Homo sapien
acagtggacggagcggtcgttctgc

SEQ ID NO: 10358 - DNA, 25 bp, Homo sapien
cctttacccaggtgctcggcacatg

SEQ ID NO: 10359 - DNA, 25 bp, Homo sapien
cacgaccccgagctgtgggaaaaag

SEQ ID NO: 10360 - DNA, 25 bp, Homo sapien
ctttacccaggtgctcggcacatgg

SEQ ID NO: 10361 - DNA, 25 bp, Homo sapien
tttacccaggtgctcggcacatggc

SEQ ID NO: 10362 - DNA, 25 bp, Homo sapien
ttacccaggtgctcggcacatggca

SEQ ID NO: 10363 - DNA, 25 bp, Homo sapien
tacccaggtgctcggcacatggcag

SEQ ID NO: 10364 - DNA, 25 bp, Homo sapien
tgctcggcacatggcaggcgtcctc

SEQ ID NO: 10365 - DNA, 25 bp, Homo sapien
acatggcaggcgtcctccgctttcc

SEQ ID NO: 10366 - DNA, 25 bp, Homo sapien
ccgagtgcggcaaaacgtccctgaa

SEQ ID NO: 10367 - DNA, 25 bp, Homo sapien
accgcaagacgcactcgggagcgcg

SEQ ID NO: 10368 - DNA, 25 bp, Homo sapien
gagcacctggtgcgccaccgcaaga

SEQ ID NO: 10369 - DNA, 25 bp, Homo sapien
aagaccttctactggcgcgagcacc

SEQ ID NO: 10370 - DNA, 25 bp, Homo sapien
tgcgagtgtggcaagaccttctact

SEQ ID NO: 10371 - DNA, 25 bp, Homo sapien
ggcaaaacgtccctgaaaccagctc

SEQ ID NO: 10372 - DNA, 25 bp, Homo sapien
cctttgcctgctgggagtgtggcaa

SEQ ID NO: 10373 - DNA, 25 bp, Homo sapien
gcctttcggcgcaaggagcacctgc

SEQ ID NO: 10374 - DNA, 25 bp, Homo sapien
ccggtctcctcactggcggtgtcat

SEQ ID NO: 10375 - DNA, 25 bp, Homo sapien
ccgtctggtcatcccggagctcgga

SEQ ID NO: 10376 - DNA, 25 bp, Homo sapien
gacgaggtgtccgtctggtcatccc

SEQ ID NO: 10377 - DNA, 25 bp, Homo sapien
ctccgccgacgaggtgtccgtctgg

SEQ ID NO: 10378 - DNA, 25 bp, Homo sapien
agccgctccgcagggtgacggccct

SEQ ID NO: 10379 - DNA, 25 bp, Homo sapien
cccttcgtgtcctctctgggggtgg

SEQ ID NO: 10380 - DNA, 25 bp, Homo sapien
cggtgtcatcgtccatggcgtcagc

SEQ ID NO: 10381 - DNA, 25 bp, Homo sapien
tcctcactggcggtgtcatcgtcca

SEQ ID NO: 10382 - DNA, 25 bp, Homo sapien
aaaccccacagccatcgccgctgga

SEQ ID NO: 10383 - DNA, 25 bp, Homo sapien
ctccgaaaccccacagccatcgccg

SEQ ID NO: 10384 - DNA, 25 bp, Homo sapien
tccgaaaccccacagccatcgccgc

SEQ ID NO: 10385 - DNA, 25 bp, Homo sapien
ccgaaaccccacagccatcgccgct

SEQ ID NO: 10386 - DNA, 25 bp, Homo sapien
cgaaaccccacagccatcgccgctg

SEQ ID NO: 10387 - DNA, 25 bp, Homo sapien
cagctccgaaaccccacagccatcg

SEQ ID NO: 10388 - DNA, 25 bp, Homo sapien
gctccgaaaccccacagccatcgcc

SEQ ID NO: 10389 - DNA, 25 bp, Homo sapien
ccagctccgaaaccccacagccatc

SEQ ID NO: 10390 - DNA, 25 bp, Homo sapien
tcggatccgcagaaatgccggcgtc

SEQ ID NO: 10391 - DNA, 25 bp, Homo sapien
cccggtccaatgctgtctgcgaaga

SEQ ID NO: 10392 - DNA, 25 bp, Homo sapien
atccatgcccgcgttggcggcagcg

SEQ ID NO: 10393 - DNA, 25 bp, Homo sapien
cttcgagatcgtgccgttccggctg

SEQ ID NO: 10394 - DNA, 25 bp, Homo sapien
ctaggcattccggttgggcatgacc

SEQ ID NO: 10395 - DNA, 25 bp, Homo sapien
cagctttctccttctaggcattccg

SEQ ID NO: 10396 - DNA, 25 bp, Homo sapien
ctcctcgatgatgactccagctttc

SEQ ID NO: 10397 - DNA, 25 bp, Homo sapien
gtcctgtcagccgagcggccagttt

SEQ ID NO: 10398 - DNA, 25 bp, Homo sapien
tgccagctcctaaacccgacagaca

SEQ ID NO: 10399 - DNA, 25 bp, Homo sapien
ccagctcctaaacccgacagacatc

SEQ ID NO: 10400 - DNA, 25 bp, Homo sapien
aaacccgacagacatccccgctgga

SEQ ID NO: 10401 - DNA, 25 bp, Homo sapien
agggccatagagtccattttacgta

SEQ ID NO: 10402 - DNA, 25 bp, Homo sapien
gggccatagagtccattttacgtaa

SEQ ID NO: 10403 - DNA, 25 bp, Homo sapien
ggccatagagtccattttacgtaat

SEQ ID NO: 10404 - DNA, 25 bp, Homo sapien
gccatagagtccattttacgtaatc

SEQ ID NO: 10405 - DNA, 25 bp, Homo sapien
ccgacatgccagctcctaaacccga

SEQ ID NO: 10406 - DNA, 25 bp, Homo sapien
cgaccttctcggtctgggatgcgct

SEQ ID NO: 10407 - DNA, 25 bp, Homo sapien
agcgggactccaggccgcgtttccg

SEQ ID NO: 10408 - DNA, 25 bp, Homo sapien
tctatttatggagaagcgggactcc

SEQ ID NO: 10409 - DNA, 25 bp, Homo sapien
gagctgaactgcgtctatttatgga

SEQ ID NO: 10410 - DNA, 25 bp, Homo sapien
cctggagctgaactgcgtctattta

SEQ ID NO: 10411 - DNA, 25 bp, Homo sapien
gtctgggatgcgctctccaaccggc

SEQ ID NO: 10412 - DNA, 25 bp, Homo sapien
tgcctccgaccttctcggtctggga

SEQ ID NO: 10413 - DNA, 25 bp, Homo sapien
tccaaccggcctggagctgaactgc

SEQ ID NO: 10414 - DNA, 25 bp, Homo sapien
cagggcgcctgcacgcatattatta

SEQ ID NO: 10415 - DNA, 25 bp, Homo sapien
aaacgtgctcttgtcgctctgaacc

SEQ ID NO: 10416 - DNA, 25 bp, Homo sapien
ctgcgtccgtgaagcctagagattc

SEQ ID NO: 10417 - DNA, 25 bp, Homo sapien
cccttgctcagagggctgaactaga

SEQ ID NO: 10418 - DNA, 25 bp, Homo sapien
ttcacattggctgctaggaggcctc

SEQ ID NO: 10419 - DNA, 25 bp, Homo sapien
cctggatcgggaacttgtcgcattc

SEQ ID NO: 10420 - DNA, 25 bp, Homo sapien
tggtgaccgcgacacactcagaaac

SEQ ID NO: 10421 - DNA, 25 bp, Homo sapien
ttccgattggtgaagaggccacatg

SEQ ID NO: 10422 - DNA, 25 bp, Homo sapien
ggctgtagccgcatttagcaatatg

SEQ ID NO: 10423 - DNA, 25 bp, Homo sapien
caatatgtgaaggagcggctgtagc

SEQ ID NO: 10424 - DNA, 25 bp, Homo sapien
tgtagccgcatttagcaatatgtga

SEQ ID NO: 10425 - DNA, 25 bp, Homo sapien
cggctgtagccgcatttagcaatat

SEQ ID NO: 10426 - DNA, 25 bp, Homo sapien
ctgtagccgcatttagcaatatgtg

SEQ ID NO: 10427 - DNA, 25 bp, Homo sapien
gctgtagccgcatttagcaatatgt

SEQ ID NO: 10428 - DNA, 25 bp, Homo sapien
ggttgtagccgcatttagcaatatg

SEQ ID NO: 10429 - DNA, 25 bp, Homo sapien
ttgtagccgcatttagcaatatgtg

SEQ ID NO: 10430 - DNA, 25 bp, Homo sapien
acgcacgcgtactttgtgtcccagg

SEQ ID NO: 10431 - DNA, 25 bp, Homo sapien
tacgtactcagtcaccagcggaacc

SEQ ID NO: 10432 - DNA, 25 bp, Homo sapien
gtgtcccaggtagctcgtctcttag

SEQ ID NO: 10433 - DNA, 25 bp, Homo sapien
gtctcttagccatgtacgcctctgc

SEQ ID NO: 10434 - DNA, 25 bp, Homo sapien
tacgcctctgcattccggtcactgg

SEQ ID NO: 10435 - DNA, 25 bp, Homo sapien
agcgtcgccgtttctcctttcttgg

SEQ ID NO: 10436 - DNA, 25 bp, Homo sapien
ggcagtatttttcccagcgccacgc

SEQ ID NO: 10437 - DNA, 25 bp, Homo sapien
tggcgggtgccttacaagaatgctc

SEQ ID NO: 10438 - DNA, 25 bp, Homo sapien
tgcggctgtggaagattgcctcatc

SEQ ID NO: 10439 - DNA, 25 bp, Homo sapien
agcacaccgatgctgcgccatgata

SEQ ID NO: 10440 - DNA, 25 bp, Homo sapien
gccgcagtgtcttccgggaaacata

SEQ ID NO: 10441 - DNA, 25 bp, Homo sapien
atctcgcgatgtttcagggtgagcc

SEQ ID NO: 10442 - DNA, 25 bp, Homo sapien
ccgcgtgggtcgttgaatgtatgac

SEQ ID NO: 10443 - DNA, 25 bp, Homo sapien
ccgtttagcggtggatacacaactg

SEQ ID NO: 10444 - DNA, 25 bp, Homo sapien
aggcgagacgtctgcgttcttctca

SEQ ID NO: 10445 - DNA, 25 bp, Homo sapien
ggaaatgtagtctcacgccggtaaa

SEQ ID NO: 10446 - DNA, 25 bp, Homo sapien
acccgcaactgagcggcgggatctg

SEQ ID NO: 10447 - DNA, 25 bp, Homo sapien
ctggcagcctttggggacctgaacc

SEQ ID NO: 10448 - DNA, 25 bp, Homo sapien
gggacctgaaccagctgcgcctgcg

SEQ ID NO: 10449 - DNA, 25 bp, Homo sapien
tcgaacggcctgagagggctcagct

SEQ ID NO: 10450 - DNA, 25 bp, Homo sapien
gcgcagcagtaactacccgcaactg

SEQ ID NO: 10451 - DNA, 25 bp, Homo sapien
ggccctcggccaacatcccagcatc

SEQ ID NO: 10452 - DNA, 25 bp, Homo sapien
ctccaaggaccgcgccgaaggaggt

SEQ ID NO: 10453 - DNA, 25 bp, Homo sapien
gaaaggggcgcagcagtaactaccc

SEQ ID NO: 10454 - DNA, 25 bp, Homo sapien
ttggccaacagtggggactcacctg

SEQ ID NO: 10455 - DNA, 25 bp, Homo sapien
ctgaggcccttcctcgagctcttta

SEQ ID NO: 10456 - DNA, 25 bp, Homo sapien
cacgttcccgtgtgagggcttattg

SEQ ID NO: 10457 - DNA, 25 bp, Homo sapien
acattcacgaggtttggagccggcc

SEQ ID NO: 10458 - DNA, 25 bp, Homo sapien
tggaaagtcccacccagaacgtgag

SEQ ID NO: 10459 - DNA, 25 bp, Homo sapien
cctctcaggagatcacgtgtggaca

SEQ ID NO: 10460 - DNA, 25 bp, Homo sapien
tgcacgttttgcgaagaggcccaca

SEQ ID NO: 10461 - DNA, 25 bp, Homo sapien
ggagggatgtttcttttggccaaca

SEQ ID NO: 10462 - DNA, 25 bp, Homo sapien
tgccttgcgagctgccagtgcccag

SEQ ID NO: 10463 - DNA, 25 bp, Homo sapien
tctcacgggaaccaaagggacagcc

SEQ ID NO: 10464 - DNA, 25 bp, Homo sapien
cgcgcacgaacaaaggccgcagtcg

SEQ ID NO: 10465 - DNA, 25 bp, Homo sapien
aaaggccgcagtcgccgtccggcag

SEQ ID NO: 10466 - DNA, 25 bp, Homo sapien
gccgaaagccatgcggcccaacaag

SEQ ID NO: 10467 - DNA, 25 bp, Homo sapien
cgcgctcattcacctatagtaaaag

SEQ ID NO: 10468 - DNA, 25 bp, Homo sapien
taaaagacatccctgtggccggccg

SEQ ID NO: 10469 - DNA, 25 bp, Homo sapien
gtccgcgcggctccttttactgtgc

SEQ ID NO: 10470 - DNA, 25 bp, Homo sapien
aggtgccgtctttcagccggcccga

SEQ ID NO: 10471 - DNA, 25 bp, Homo sapien
gcctgggcgtcccttcatacgctaa

SEQ ID NO: 10472 - DNA, 25 bp, Homo sapien
gcccgctgatggcacgcaggccagt

SEQ ID NO: 10473 - DNA, 25 bp, Homo sapien
gcctctgcaacgaccctggtgtggt

SEQ ID NO: 10474 - DNA, 25 bp, Homo sapien
aagccctgtgcgtacacaccgcgta

SEQ ID NO: 10475 - DNA, 25 bp, Homo sapien
ctttacggtttggaagccctgtgcg

SEQ ID NO: 10476 - DNA, 25 bp, Homo sapien
cgaccctggtgtggtgcccgctgat

SEQ ID NO: 10477 - DNA, 25 bp, Homo sapien
tgtgcgtacacaccgcgtaggaggt

SEQ ID NO: 10478 - DNA, 25 bp, Homo sapien
cagagtcacaacacggtcggggttc

SEQ ID NO: 10479 - DNA, 25 bp, Homo sapien
ctagtaactagggacgcttctggtc

SEQ ID NO: 10480 - DNA, 25 bp, Homo sapien
acgcgtactcacaccgaaggctcag

SEQ ID NO: 10481 - DNA, 25 bp, Homo sapien
gacatcgcgatcacagaggcacaga

SEQ ID NO: 10482 - DNA, 25 bp, Homo sapien
cagaaggccgcgctccgaatgacat

SEQ ID NO: 10483 - DNA, 25 bp, Homo sapien
aagataatgacactcccacggactg

SEQ ID NO: 10484 - DNA, 25 bp, Homo sapien
ctcgtcgctgtcttattccaaaata

SEQ ID NO: 10485 - DNA, 25 bp, Homo sapien
tcacggagtccttcggatgagagcg

SEQ ID NO: 10486 - DNA, 25 bp, Homo sapien
tgtcacagccaagcacccttttact

SEQ ID NO: 10487 - DNA, 25 bp, Homo sapien
tatcttgcaacctgagctccgaggg

SEQ ID NO: 10488 - DNA, 25 bp, Homo sapien
ggccaaaccgtatcttgcaacctga

SEQ ID NO: 10489 - DNA, 25 bp, Homo sapien
cgactgtagggactccagccacctt

SEQ ID NO: 10490 - DNA, 25 bp, Homo sapien
gtccagggacaagtgagagcgaccc

SEQ ID NO: 10491 - DNA, 25 bp, Homo sapien
ttggccaccacttatgcggcggctg

SEQ ID NO: 10492 - DNA, 25 bp, Homo sapien
cgcgctcaaggaatggcctcgcatc

SEQ ID NO: 10493 - DNA, 25 bp, Homo sapien
gagcggacagggacgaattcatctc

SEQ ID NO: 10494 - DNA, 25 bp, Homo sapien
tctgaacactcggagcctggcgatg

SEQ ID NO: 10495 - DNA, 25 bp, Homo sapien
tggaagccagttctctgcgtcctga

SEQ ID NO: 10496 - DNA, 25 bp, Homo sapien
tgagcctggcagctgcatctgaaca

SEQ ID NO: 10497 - DNA, 25 bp, Homo sapien
cgcttcagtgaaggggcctgtactt

SEQ ID NO: 10498 - DNA, 25 bp, Homo sapien
acttcccaggggctattgcagcgga

SEQ ID NO: 10499 - DNA, 25 bp, Homo sapien
ccctgtatcgactgcgtagagccca

SEQ ID NO: 10500 - DNA, 25 bp, Homo sapien
acgccttaccgactgcgtttcagtg

SEQ ID NO: 10501 - DNA, 25 bp, Homo sapien
tgagaggcctcctaatccaaccagg

SEQ ID NO: 10502 - DNA, 25 bp, Homo sapien
gcatgaacacgagggccatcctggg

SEQ ID NO: 10503 - DNA, 25 bp, Homo sapien
gcgcccaccctctacctgtgccggg

SEQ ID NO: 10504 - DNA, 25 bp, Homo sapien
ttggccgcggagtcctctgtgagat

SEQ ID NO: 10505 - DNA, 25 bp, Homo sapien
atggaggagctcagttggctccgct

SEQ ID NO: 10506 - DNA, 25 bp, Homo sapien
gcctagcgggcgcggtcattgtcct

SEQ ID NO: 10507 - DNA, 25 bp, Homo sapien
ggaaagttgcatgaacacgagggcc

SEQ ID NO: 10508 - DNA, 25 bp, Homo sapien
ttgcatgaacacgagggccatcctg

SEQ ID NO: 10509 - DNA, 25 bp, Homo sapien
agcgtagtccggcgcagtccgcgca

SEQ ID NO: 10510 - DNA, 25 bp, Homo sapien
accagcgcttccacatcggcgtgaa

SEQ ID NO: 10511 - DNA, 25 bp, Homo sapien
tggcaaggccttccggaagacttcc

SEQ ID NO: 10512 - DNA, 25 bp, Homo sapien
tgcaagaagcacttcacggggcgct

SEQ ID NO: 10513 - DNA, 25 bp, Homo sapien
ttcagccagcgcatgaacctcactg

SEQ ID NO: 10514 - DNA, 25 bp, Homo sapien
gaagccgtacgcctgcaaggagtgc

SEQ ID NO: 10515 - DNA, 25 bp, Homo sapien
tgcaccagaggaaccacaccggcga

SEQ ID NO: 10516 - DNA, 25 bp, Homo sapien
tacgagtgctacatctgcaagaagc

SEQ ID NO: 10517 - DNA, 25 bp, Homo sapien
gcgggaagtccttcatcaagaactc

SEQ ID NO: 10518 - DNA, 25 bp, Homo sapien
aatggtttagaactgcggacagctc

SEQ ID NO: 10519 - DNA, 25 bp, Homo sapien
agtggttcagcaccacggatagccc

SEQ ID NO: 10520 - DNA, 25 bp, Homo sapien
tgaatggttcagcaccgcagacagc

SEQ ID NO: 10521 - DNA, 25 bp, Homo sapien
cccaaggcagctcgtgatgtgaatg

SEQ ID NO: 10522 - DNA, 25 bp, Homo sapien
gtcagcaccaccgaacgctaatgct

SEQ ID NO: 10523 - DNA, 25 bp, Homo sapien
gcggacagctcacgccagacagatt

SEQ ID NO: 10524 - DNA, 25 bp, Homo sapien
cgaacgctaatgcttgaatggttta

SEQ ID NO: 10525 - DNA, 25 bp, Homo sapien
cgccagacagattcagcaccacgga

SEQ ID NO: 10526 - DNA, 25 bp, Homo sapien
ctcccggtttgcagactggagaacc

SEQ ID NO: 10527 - DNA, 25 bp, Homo sapien
ttcagcgcacctgcccgagtgtgca

SEQ ID NO: 10528 - DNA, 25 bp, Homo sapien
cacagacctgtgtaccctcgtgggg

SEQ ID NO: 10529 - DNA, 25 bp, Homo sapien
gttgcaggtgaattccagcctcctc

SEQ ID NO: 10530 - DNA, 25 bp, Homo sapien
cagaaccgctccagggatagggtcc

SEQ ID NO: 10531 - DNA, 25 bp, Homo sapien
agagatggaccagctcggtaccaca

SEQ ID NO: 10532 - DNA, 25 bp, Homo sapien
cctacgtgctcatcagctagagatg

SEQ ID NO: 10533 - DNA, 25 bp, Homo sapien
tctgtcgcagggtacctcgaacata

SEQ ID NO: 10534 - DNA, 25 bp, Homo sapien
gatgcgctggtgctctatcagggac

SEQ ID NO: 10535 - DNA, 25 bp, Homo sapien
cgctggtgctctatcagggacgagc

SEQ ID NO: 10536 - DNA, 25 bp, Homo sapien
acgccaggtacgagccctggctgaa

SEQ ID NO: 10537 - DNA, 25 bp, Homo sapien
tggattctctggtgtaagatgaacg

SEQ ID NO: 10538 - DNA, 25 bp, Homo sapien
taagatgaacgctgaacagtagctg

SEQ ID NO: 10539 - DNA, 25 bp, Homo sapien
gaacgctgaacagtagctgaaggcc

SEQ ID NO: 10540 - DNA, 25 bp, Homo sapien
ggatcttctggtgctctataagcga

SEQ ID NO: 10541 - DNA, 25 bp, Homo sapien
ctctataagcgaggacacgtggctg

SEQ ID NO: 10542 - DNA, 25 bp, Homo sapien
gccggcaccgcgactaaagcttgca

SEQ ID NO: 10543 - DNA, 25 bp, Homo sapien
gcctggttcttaggaactacgactc

SEQ ID NO: 10544 - DNA, 25 bp, Homo sapien
tcaagacttctgctgctgcggagga

SEQ ID NO: 10545 - DNA, 25 bp, Homo sapien
ggtgcctccttccttagacgagcta

SEQ ID NO: 10546 - DNA, 25 bp, Homo sapien
tctactcagtctcgggtcctcctgg

SEQ ID NO: 10547 - DNA, 25 bp, Homo sapien
gcctgggtcatcgaaactacaactc

SEQ ID NO: 10548 - DNA, 25 bp, Homo sapien
acgcggtcacacacctgcaggaaca

SEQ ID NO: 10549 - DNA, 25 bp, Homo sapien
cggtatcaccttcgaacgcgctggc

SEQ ID NO: 10550 - DNA, 25 bp, Homo sapien
cgagtgtgtacaggtgagtttgtcc

SEQ ID NO: 10551 - DNA, 25 bp, Homo sapien
gatgtagtgcgcctgcacgccgtct

SEQ ID NO: 10552 - DNA, 25 bp, Homo sapien
ttttagcgggagatccgagcgtctc

SEQ ID NO: 10553 - DNA, 25 bp, Homo sapien
gtgagtttgtccgtacgcgtgatta

SEQ ID NO: 10554 - DNA, 25 bp, Homo sapien
gtgttgcgtgagcaaacctgtgaga

SEQ ID NO: 10555 - DNA, 25 bp, Homo sapien
tgagcgagtgcgaatgtccctacaa

SEQ ID NO: 10556 - DNA, 25 bp, Homo sapien
gtgcgaatgtccctacaagtgtggg

SEQ ID NO: 10557 - DNA, 25 bp, Homo sapien
tccgtacgcgtgattaagtgtgtgc

SEQ ID NO: 10558 - DNA, 25 bp, Homo sapien
gcgctcttctgtttcactgcggaga

SEQ ID NO: 10559 - DNA, 25 bp, Homo sapien
acatgacatgcgtctggctcggcca

SEQ ID NO: 10560 - DNA, 25 bp, Homo sapien
gggcacgaaaacaaaacatgacatg

SEQ ID NO: 10561 - DNA, 25 bp, Homo sapien
cgagagggcaccaaaggcctcgcct

SEQ ID NO: 10562 - DNA, 25 bp, Homo sapien
cagcgccacggcgagagggcaccaa

SEQ ID NO: 10563 - DNA, 25 bp, Homo sapien
aaagcaaacacggtcagcacgcgcg

SEQ ID NO: 10564 - DNA, 25 bp, Homo sapien
tggacggcactactgcaacaaagca

SEQ ID NO: 10565 - DNA, 25 bp, Homo sapien
gccgtgtgtgctgctacagtttgaa

SEQ ID NO: 10566 - DNA, 25 bp, Homo sapien
cgaccggcgtgttctttccatctta

SEQ ID NO: 10567 - DNA, 25 bp, Homo sapien
gtgcggggacttgcccagcaccctg

SEQ ID NO: 10568 - DNA, 25 bp, Homo sapien
ctgcgtgcgcgtgttaaagtccagg

SEQ ID NO: 10569 - DNA, 25 bp, Homo sapien
cagcaccctgtgagcgaccggcgtg

SEQ ID NO: 10570 - DNA, 25 bp, Homo sapien
tccatcttagaggatcgaggtctgc

SEQ ID NO: 10571 - DNA, 25 bp, Homo sapien
ggctgtcggagagcccatcgctgcc

SEQ ID NO: 10572 - DNA, 25 bp, Homo sapien
cagggttggaggctcacctggtcac

SEQ ID NO: 10573 - DNA, 25 bp, Homo sapien
aggctcacctggtcacctgcgtgcg

SEQ ID NO: 10574 - DNA, 25 bp, Homo sapien
gctgaagctttcacgctccttgtta

SEQ ID NO: 10575 - DNA, 25 bp, Homo sapien
ggcgtcctcaccagttcttgaccag

SEQ ID NO: 10576 - DNA, 25 bp, Homo sapien
aggatgaccctgtccagctgacccg

SEQ ID NO: 10577 - DNA, 25 bp, Homo sapien
cacaaatacggaacgcagcggcgcg

SEQ ID NO: 10578 - DNA, 25 bp, Homo sapien
gcagacccggaagccacttacagta

SEQ ID NO: 10579 - DNA, 25 bp, Homo sapien
cacttacagtaacttccggcgaggg

SEQ ID NO: 10580 - DNA, 25 bp, Homo sapien
ctctgtcaccgggaacaacaaggga

SEQ ID NO: 10581 - DNA, 25 bp, Homo sapien
ttcttgaccagctcccggtagcgtg

SEQ ID NO: 10582 - DNA, 25 bp, Homo sapien
aagtgccctgtgagacacgaggata

SEQ ID NO: 10583 - DNA, 25 bp, Homo sapien
ccctgtgagacacgaggatagggtt

SEQ ID NO: 10584 - DNA, 25 bp, Homo sapien
gctgaggaaccacagccgctcctgg

SEQ ID NO: 10585 - DNA, 25 bp, Homo sapien
ctgaccaaaaccagcagcgcatgcg

SEQ ID NO: 10586 - DNA, 25 bp, Homo sapien
gctgaacgtctccacgccctgacca

SEQ ID NO: 10587 - DNA, 25 bp, Homo sapien
tcttgcgccctcaagtccactgggg

SEQ ID NO: 10588 - DNA, 25 bp, Homo sapien
ggagtcttcctcacgaagccgcgcg

SEQ ID NO: 10589 - DNA, 25 bp, Homo sapien
gctggatgcctcttgcgccctcaag

SEQ ID NO: 10590 - DNA, 25 bp, Homo sapien
ttccatcaccgcaaggcaggcaagc

SEQ ID NO: 10591 - DNA, 25 bp, Homo sapien
gtcaccctgtccttaagcataaatg

SEQ ID NO: 10592 - DNA, 25 bp, Homo sapien
cgcggccgctaaggcaaactcttta

SEQ ID NO: 10593 - DNA, 25 bp, Homo sapien
aactctttaggcacgtctcccggct

SEQ ID NO: 10594 - DNA, 25 bp, Homo sapien
aaggagcgcggcactccacagcttt

SEQ ID NO: 10595 - DNA, 25 bp, Homo sapien
cccgatcaaagatggcacccaggtg

SEQ ID NO: 10596 - DNA, 25 bp, Homo sapien
ttgtctcgcccaaccaactaggaca

SEQ ID NO: 10597 - DNA, 25 bp, Homo sapien
tggcaaaacagcctggcgaccagca

SEQ ID NO: 10598 - DNA, 25 bp, Homo sapien
cttatttaagataccgcccgagagg

SEQ ID NO: 10599 - DNA, 25 bp, Homo sapien
tccgccgtggcaacagggatagcat

SEQ ID NO: 10600 - DNA, 25 bp, Homo sapien
cattggtgtcgaccttgctggactt

SEQ ID NO: 10601 - DNA, 25 bp, Homo sapien
cgagagccgcattccgccgtggcaa

SEQ ID NO: 10602 - DNA, 25 bp, Homo sapien
cgaggccgatggcaccccgcaggaa

SEQ ID NO: 10603 - DNA, 25 bp, Homo sapien
gcctcagccgcccttatttaagata

SEQ ID NO: 10604 - DNA, 25 bp, Homo sapien
aacagggatagcattggtgtcgacc

SEQ ID NO: 10605 - DNA, 25 bp, Homo sapien
cccgcaggaaggggcattttcgcag

SEQ ID NO: 10606 - DNA, 25 bp, Homo sapien
tgcaccgaggtgcagctcgacgcct

SEQ ID NO: 10607 - DNA, 25 bp, Homo sapien
cacagcaacagtttggcgcgaaggc

SEQ ID NO: 10608 - DNA, 25 bp, Homo sapien
caatcaggctgcggttgccacagca

SEQ ID NO: 10609 - DNA, 25 bp, Homo sapien
gccctgtgacgtgccaatcaggctg

SEQ ID NO: 10610 - DNA, 25 bp, Homo sapien
cacagccctgtgacgtgccaatcag

SEQ ID NO: 10611 - DNA, 25 bp, Homo sapien
gcttctgtgctagccaatcagcagc

SEQ ID NO: 10612 - DNA, 25 bp, Homo sapien
tcgacgcctccttgtcagggcttct

SEQ ID NO: 10613 - DNA, 25 bp, Homo sapien
gcggggcttctgtgctagccaatca

SEQ ID NO: 10614 - DNA, 25 bp, Homo sapien
cctgggaaaccttgcgagaagtgac

SEQ ID NO: 10615 - DNA, 25 bp, Homo sapien
gtcagtagaaccatggcctccattg

SEQ ID NO: 10616 - DNA, 25 bp, Homo sapien
ggcctccattgactacgtcctcaga

SEQ ID NO: 10617 - DNA, 25 bp, Homo sapien
gaatctagcctgttcgccgttgtgg

SEQ ID NO: 10618 - DNA, 25 bp, Homo sapien
tcagtcgagctccagtcacagagga

SEQ ID NO: 10619 - DNA, 25 bp, Homo sapien
tgagacccaggcagaagtatttccg

SEQ ID NO: 10620 - DNA, 25 bp, Homo sapien
agtatttccggtcaacgaggtcgcg

SEQ ID NO: 10621 - DNA, 25 bp, Homo sapien
ttgtcctcccggttcctctgaagga

SEQ ID NO: 10622 - DNA, 25 bp, Homo sapien
ggagcaccgaccatgatcacaaatc

SEQ ID NO: 10623 - DNA, 25 bp, Homo sapien
caggaacgcggcctagctgcttcag

SEQ ID NO: 10624 - DNA, 25 bp, Homo sapien
cgttgtctgttcttcggagcaccga

SEQ ID NO: 10625 - DNA, 25 bp, Homo sapien
cacgcctcgttgtctgttcttcgga

SEQ ID NO: 10626 - DNA, 25 bp, Homo sapien
tgaggagccttccaggatcgcaccc

SEQ ID NO: 10627 - DNA, 25 bp, Homo sapien
ccagcgagatgtcacctcctctgag

SEQ ID NO: 10628 - DNA, 25 bp, Homo sapien
agctgcttcagccacgttctcgcgg

SEQ ID NO: 10629 - DNA, 25 bp, Homo sapien
tcagctcgctcgctgtgtttcctgc

SEQ ID NO: 10630 - DNA, 25 bp, Homo sapien
aaacgtcttcgccatcggttccctg

SEQ ID NO: 10631 - DNA, 25 bp, Homo sapien
ctggattctagcctgcaggacgcga

SEQ ID NO: 10632 - DNA, 25 bp, Homo sapien
tagcctgcaggacgcgaaaacggcc

SEQ ID NO: 10633 - DNA, 25 bp, Homo sapien
ccctgaagcagcgaaggggcgtcac

SEQ ID NO: 10634 - DNA, 25 bp, Homo sapien
tcctgcctgggtagccagctcctgg

SEQ ID NO: 10635 - DNA, 25 bp, Homo sapien
caggactgcctggtcgccctggagc

SEQ ID NO: 10636 - DNA, 25 bp, Homo sapien
gtcactggcgcgctgttaaacgtct

SEQ ID NO: 10637 - DNA, 25 bp, Homo sapien
cgctgttaaacgtcttcgccatcgg

SEQ ID NO: 10638 - DNA, 25 bp, Homo sapien
acgacgtcacccgtgaggtcccgcg

SEQ ID NO: 10639 - DNA, 25 bp, Homo sapien
taagcgcgcccaaagcgaccctctg

SEQ ID NO: 10640 - DNA, 25 bp, Homo sapien
aaatgactgcacctgggcttcgctg

SEQ ID NO: 10641 - DNA, 25 bp, Homo sapien
gggccacaaatgactgcacctgggc

SEQ ID NO: 10642 - DNA, 25 bp, Homo sapien
ggacgcagttgctaccgcgcggacc

SEQ ID NO: 10643 - DNA, 25 bp, Homo sapien
ctggcaggacgcagttgctaccgcg

SEQ ID NO: 10644 - DNA, 25 bp, Homo sapien
ccggcctgcagacctgactctggca

SEQ ID NO: 10645 - DNA, 25 bp, Homo sapien
ctcctaaagctcggctgggaaaccg

SEQ ID NO: 10646 - DNA, 25 bp, Homo sapien
acagcctcacgtttctcttggagga

SEQ ID NO: 10647 - DNA, 25 bp, Homo sapien
cccgacggacatcgagtctgactgt

SEQ ID NO: 10648 - DNA, 25 bp, Homo sapien
gtcctcctcatggagtccgcctgtg

SEQ ID NO: 10649 - DNA, 25 bp, Homo sapien
taaaacaagcgtggctcccagagtc

SEQ ID NO: 10650 - DNA, 25 bp, Homo sapien
ccgcgtctcctgctgttaaaacaag

SEQ ID NO: 10651 - DNA, 25 bp, Homo sapien
gagctactgtgtctctttcaaaaca

SEQ ID NO: 10652 - DNA, 25 bp, Homo sapien
aactcatggtgtccagcagggagca

SEQ ID NO: 10653 - DNA, 25 bp, Homo sapien
ggagacagactttcacatccgcagc

SEQ ID NO: 10654 - DNA, 25 bp, Homo sapien
aagctgaccgagtccgcgggcttac

SEQ ID NO: 10655 - DNA, 25 bp, Homo sapien
ctccaggcggcacgcaaagggcaac

SEQ ID NO: 10656 - DNA, 25 bp, Homo sapien
acagagaaggcagaccttagagccc

SEQ ID NO: 10657 - DNA, 25 bp, Homo sapien
ggagtggctgctcacacaagacaga

SEQ ID NO: 10658 - DNA, 25 bp, Homo sapien
cgccaattatgatgacggtggcacc

SEQ ID NO: 10659 - DNA, 25 bp, Homo sapien
cccgtcaaagaagttgtcgccaatt

SEQ ID NO: 10660 - DNA, 25 bp, Homo sapien
ttccgaatacaacttgcagcccgtc

SEQ ID NO: 10661 - DNA, 25 bp, Homo sapien
ctccacaccaacatagttccgaata

SEQ ID NO: 10662 - DNA, 25 bp, Homo sapien
cctcccgcggctgttagcgctgcgt

SEQ ID NO: 10663 - DNA, 25 bp, Homo sapien
cagagcaaggtagggtcctgtattt

SEQ ID NO: 10664 - DNA, 25 bp, Homo sapien
ctgtatttggggaccgctgacgttt

SEQ ID NO: 10665 - DNA, 25 bp, Homo sapien
gattaaggctgctttccggagggcc

SEQ ID NO: 10666 - DNA, 25 bp, Homo sapien
tggtcgccctgccagagcggttgat

SEQ ID NO: 10667 - DNA, 25 bp, Homo sapien
ctgccagagcggttgatgtcaggca

SEQ ID NO: 10668 - DNA, 25 bp, Homo sapien
ggtcctgtatttggggaccgctgac

SEQ ID NO: 10669 - DNA, 25 bp, Homo sapien
tctccgcggcgctcagtggcagcag

SEQ ID NO: 10670 - DNA, 25 bp, Homo sapien
tttgttcctgggtcgccgtcaagct

SEQ ID NO: 10671 - DNA, 25 bp, Homo sapien
ccctggatttgtcttcgcagtcgtc

SEQ ID NO: 10672 - DNA, 25 bp, Homo sapien
gcacttctgtctggagaggtctgta

SEQ ID NO: 10673 - DNA, 25 bp, Homo sapien
gtgaagcgttcctcccgttgttgaa

SEQ ID NO: 10674 - DNA, 25 bp, Homo sapien
ccgctttgcaggtccctagtcagga

SEQ ID NO: 10675 - DNA, 25 bp, Homo sapien
cggacgccattttcttctgcacttc

SEQ ID NO: 10676 - DNA, 25 bp, Homo sapien
cttagaaggctgtgcattatgcgta

SEQ ID NO: 10677 - DNA, 25 bp, Homo sapien
ccgttgttgaacacatgaggaaaac

SEQ ID NO: 10678 - DNA, 25 bp, Homo sapien
ctcggaaaccttagagctgagggga

SEQ ID NO: 10679 - DNA, 25 bp, Homo sapien
cggctgcagagactcggaaacctta

SEQ ID NO: 10680 - DNA, 25 bp, Homo sapien
acacacggctgcagagactcggaaa

SEQ ID NO: 10681 - DNA, 25 bp, Homo sapien
gaggaaacgccctgaggttgcagcc

SEQ ID NO: 10682 - DNA, 25 bp, Homo sapien
aaacgccctgaggttgcagcccagc

SEQ ID NO: 10683 - DNA, 25 bp, Homo sapien
aaccttagagctgaggggatagcgt

SEQ ID NO: 10684 - DNA, 25 bp, Homo sapien
gcgaggcgtgccacacacggctgca

SEQ ID NO: 10685 - DNA, 25 bp, Homo sapien
gtctggtttcttcccgcaagccctg

SEQ ID NO: 10686 - DNA, 25 bp, Homo sapien
ccaggaagtacctctctgagcggtt

SEQ ID NO: 10687 - DNA, 25 bp, Homo sapien
ctctctcctagttgacgcatgcaca

SEQ ID NO: 10688 - DNA, 25 bp, Homo sapien
cctgaatcggacgtgaccttgaagc

SEQ ID NO: 10689 - DNA, 25 bp, Homo sapien
ggtgtatgcgttgttcattcccaca

SEQ ID NO: 10690 - DNA, 25 bp, Homo sapien
ctgtcctttctattgggcgcacttc

SEQ ID NO: 10691 - DNA, 25 bp, Homo sapien
tccgatggcgtcaggaatttcagcc

SEQ ID NO: 10692 - DNA, 25 bp, Homo sapien
tttcagccaataggagccagccagg

SEQ ID NO: 10693 - DNA, 25 bp, Homo sapien
gggcgtctgttcattcccacgtgca

SEQ ID NO: 10694 - DNA, 25 bp, Homo sapien
cgtttcctgtgggttgcgaagcttg

SEQ ID NO: 10695 - DNA, 25 bp, Homo sapien
ttgactgtcagccaaggtcaccggg

SEQ ID NO: 10696 - DNA, 25 bp, Homo sapien
ccggcatttggatgggacgtaattt

SEQ ID NO: 10697 - DNA, 25 bp, Homo sapien
ctccgcgtctcggagcgaaccgtga

SEQ ID NO: 10698 - DNA, 25 bp, Homo sapien
cccgtaacgagagagtttgactgtc

SEQ ID NO: 10699 - DNA, 25 bp, Homo sapien
cgctagggccacagggtcccggtat

SEQ ID NO: 10700 - DNA, 25 bp, Homo sapien
ctggggccaatgatggtccaggaca

SEQ ID NO: 10701 - DNA, 25 bp, Homo sapien
gtatggcgatggctttgacggaccc

SEQ ID NO: 10702 - DNA, 25 bp, Homo sapien
cctgaaacagtgtggggcctagagc

SEQ ID NO: 10703 - DNA, 25 bp, Homo sapien
cctccgacttgtgcctatactaagg

SEQ ID NO: 10704 - DNA, 25 bp, Homo sapien
agcacctttgttcggggtctgaatc

SEQ ID NO: 10705 - DNA, 25 bp, Homo sapien
ttctggtgcgcacttacgtgcagtc

SEQ ID NO: 10706 - DNA, 25 bp, Homo sapien
cggactctgggccattgacgaccca

SEQ ID NO: 10707 - DNA, 25 bp, Homo sapien
gacgacccaggacaggagagttttc

SEQ ID NO: 10708 - DNA, 25 bp, Homo sapien
tactaaggcggtggccctaagacga

SEQ ID NO: 10709 - DNA, 25 bp, Homo sapien
cgggacttccgcttcttcgtgtgac

SEQ ID NO: 10710 - DNA, 25 bp, Homo sapien
cgccaacgacaggagcctctgtgcg

SEQ ID NO: 10711 - DNA, 25 bp, Homo sapien
ctgcccgtggcagccggggcagaag

SEQ ID NO: 10712 - DNA, 25 bp, Homo sapien
gggcgccaacgacaggagcctctgt

SEQ ID NO: 10713 - DNA, 25 bp, Homo sapien
gcgccaacgacaggagcctctgtgc

SEQ ID NO: 10714 - DNA, 25 bp, Homo sapien
ccaacgacaggagcctctgtgcgga

SEQ ID NO: 10715 - DNA, 25 bp, Homo sapien
acgacaggagcctctgtgcggacag

SEQ ID NO: 10716 - DNA, 25 bp, Homo sapien
tctgtgcggacagggccggacagct

SEQ ID NO: 10717 - DNA, 25 bp, Homo sapien
aacgacaggagcctctgtgcggaca

SEQ ID NO: 10718 - DNA, 25 bp, Homo sapien
tgcccatagtaaagcggcggcccta

SEQ ID NO: 10719 - DNA, 25 bp, Homo sapien
tgtgcgcatttttctctggggaaac

SEQ ID NO: 10720 - DNA, 25 bp, Homo sapien
gttacgcgccttctccgcatcttgg

SEQ ID NO: 10721 - DNA, 25 bp, Homo sapien
gacgtcatctccgtgagcaggattg

SEQ ID NO: 10722 - DNA, 25 bp, Homo sapien
tgggacttccgcttcgtcgcgtgac

SEQ ID NO: 10723 - DNA, 25 bp, Homo sapien
gccgcggactctaggccaatgacgg

SEQ ID NO: 10724 - DNA, 25 bp, Homo sapien
tgtgagggaaaaactgccttactca

SEQ ID NO: 10725 - DNA, 25 bp, Homo sapien
tccttgtgcgcacttaaatggagtc

SEQ ID NO: 10726 - DNA, 25 bp, Homo sapien
gttcgctctcatcgcgcacttcagg

SEQ ID NO: 10727 - DNA, 25 bp, Homo sapien
ctcttggcagacatccgggagaacc

SEQ ID NO: 10728 - DNA, 25 bp, Homo sapien
cgtgacgtatttttcctatgcccgg

SEQ ID NO: 10729 - DNA, 25 bp, Homo sapien
ccggtccgtgcattctggttgtgaa

SEQ ID NO: 10730 - DNA, 25 bp, Homo sapien
agttctagagatcgggtcggctttc

SEQ ID NO: 10731 - DNA, 25 bp, Homo sapien
cggctctcgtggaacctagcaaaga

SEQ ID NO: 10732 - DNA, 25 bp, Homo sapien
aagcagccgccttagtcttgtgagc

SEQ ID NO: 10733 - DNA, 25 bp, Homo sapien
agggtgctcactccgtcgcattatg

SEQ ID NO: 10734 - DNA, 25 bp, Homo sapien
agttccggcctttggcgctctatga

SEQ ID NO: 10735 - DNA, 25 bp, Homo sapien
cgtcctcttgccgtggttgatttga

SEQ ID NO: 10736 - DNA, 25 bp, Homo sapien
ttccctggctggacttgcggagtcc

SEQ ID NO: 10737 - DNA, 25 bp, Homo sapien
gaagcggcttggttccttgtacgca

SEQ ID NO: 10738 - DNA, 25 bp, Homo sapien
cttgtacgcagaggcggtagtgaca

SEQ ID NO: 10739 - DNA, 25 bp, Homo sapien
tgacacaggcacaactgacagtggc

SEQ ID NO: 10740 - DNA, 25 bp, Homo sapien
tggcagaagctcagctgacaaggac

SEQ ID NO: 10741 - DNA, 25 bp, Homo sapien
tctggtgttttcactagttccggcc

SEQ ID NO: 10742 - DNA, 25 bp, Homo sapien
ctggcgcgtcgaagttgctttcctc

SEQ ID NO: 10743 - DNA, 25 bp, Homo sapien
tcacatggtcccagtcaacagactg

SEQ ID NO: 10744 - DNA, 25 bp, Homo sapien
gccttctggacctgaacctcacatg

SEQ ID NO: 10745 - DNA, 25 bp, Homo sapien
ccattttcctgtcggggagcagcac

SEQ ID NO: 10746 - DNA, 25 bp, Homo sapien
cctccgcgtgattttccattttcct

SEQ ID NO: 10747 - DNA, 25 bp, Homo sapien
agttgcagcgagcatgcgtcacgcc

SEQ ID NO: 10748 - DNA, 25 bp, Homo sapien
ctccaggaaggagttgcagcgagca

SEQ ID NO: 10749 - DNA, 25 bp, Homo sapien
ttgcgtccttagatccaaactggcg

SEQ ID NO: 10750 - DNA, 25 bp, Homo sapien
ggcctatggctctgtctgacgtcac

SEQ ID NO: 10751 - DNA, 25 bp, Homo sapien
agaagacactgcagctctcggcggc

SEQ ID NO: 10752 - DNA, 25 bp, Homo sapien
aggccttgctgatgaacctgactga

SEQ ID NO: 10753 - DNA, 25 bp, Homo sapien
ggacagtggcgtccttgtcttgcct

SEQ ID NO: 10754 - DNA, 25 bp, Homo sapien
gcgagaagcggctcggttcccacca

SEQ ID NO: 10755 - DNA, 25 bp, Homo sapien
ggtgtttcaccaacttcggcctatg

SEQ ID NO: 10756 - DNA, 25 bp, Homo sapien
tcggcggcacgacttacccaataaa

SEQ ID NO: 10757 - DNA, 25 bp, Homo sapien
agtcaactgacaagcgctggggaca

SEQ ID NO: 10758 - DNA, 25 bp, Homo sapien
cccgttgtacagaggctagagtgag

SEQ ID NO: 10759 - DNA, 25 bp, Homo sapien
gcctctgtcagcgtccaggtcactg

SEQ ID NO: 10760 - DNA, 25 bp, Homo sapien
tcaccttcaggctgagtcgagactg

SEQ ID NO: 10761 - DNA, 25 bp, Homo sapien
ctgcgttgggatctgttcaccttca

SEQ ID NO: 10762 - DNA, 25 bp, Homo sapien
acgcctcctggggttgtcaatatgg

SEQ ID NO: 10763 - DNA, 25 bp, Homo sapien
gaaggcctagcagagcggcgtctac

SEQ ID NO: 10764 - DNA, 25 bp, Homo sapien
agcgagtgtagccaatgaaggccta

SEQ ID NO: 10765 - DNA, 25 bp, Homo sapien
tttgtctccacggagctgagggtga

SEQ ID NO: 10766 - DNA, 25 bp, Homo sapien
cgcgagaagcggtgttccttctaca

SEQ ID NO: 10767 - DNA, 25 bp, Homo sapien
tgtagccattggtctagcagagaga

SEQ ID NO: 10768 - DNA, 25 bp, Homo sapien
gcgccctcatggttgcgttagcatg

SEQ ID NO: 10769 - DNA, 25 bp, Homo sapien
ctgttcactgatttagagggtccca

SEQ ID NO: 10770 - DNA, 25 bp, Homo sapien
ctacacagaggctagagtgcggatc

SEQ ID NO: 10771 - DNA, 25 bp, Homo sapien
tcccagtgctgaagtcccaaggagc

SEQ ID NO: 10772 - DNA, 25 bp, Homo sapien
ccctgcaggttaggcccttgtgtct

SEQ ID NO: 10773 - DNA, 25 bp, Homo sapien
tggctacctagggatctgttcactg

SEQ ID NO: 10774 - DNA, 25 bp, Homo sapien
gcctcgttgatgtcacggacccgca

SEQ ID NO: 10775 - DNA, 25 bp, Homo sapien
tcgttgatgtcacggacccgcagcc

SEQ ID NO: 10776 - DNA, 25 bp, Homo sapien
tcctcgtcctcgtctgggctatggg

SEQ ID NO: 10777 - DNA, 25 bp, Homo sapien
tggcctgtgcacatgtgcgtcctga

SEQ ID NO: 10778 - DNA, 25 bp, Homo sapien
ctgtgcacatgtgcgtcctgatggg

SEQ ID NO: 10779 - DNA, 25 bp, Homo sapien
cctccgagtggtcagccgctgacgt

SEQ ID NO: 10780 - DNA, 25 bp, Homo sapien
cccagctccttaaaggcctcgttga

SEQ ID NO: 10781 - DNA, 25 bp, Homo sapien
cagcctggtgcaggatgagcagttt

SEQ ID NO: 10782 - DNA, 25 bp, Homo sapien
tcgcgactcaggtgaactaacctgc

SEQ ID NO: 10783 - DNA, 25 bp, Homo sapien
tcacgctgttctcgccgctcagagg

SEQ ID NO: 10784 - DNA, 25 bp, Homo sapien
ctaacctgcgagaagctggttgtgc

SEQ ID NO: 10785 - DNA, 25 bp, Homo sapien
ttggtattcactttcgcgactcagg

SEQ ID NO: 10786 - DNA, 25 bp, Homo sapien
cttccggcgtctcgtttggtattca

SEQ ID NO: 10787 - DNA, 25 bp, Homo sapien
ctgcccgagcgtgcgacacgcaatg

SEQ ID NO: 10788 - DNA, 25 bp, Homo sapien
ggcggcgatccctgaccaatgaaaa

SEQ ID NO: 10789 - DNA, 25 bp, Homo sapien
cacggtggcgactcacgctgttctc

SEQ ID NO: 10790 - DNA, 25 bp, Homo sapien
gctgtgttctcgcagctcagaggcg

SEQ ID NO: 10791 - DNA, 25 bp, Homo sapien
tcagcttgccggaagctggttgttc

SEQ ID NO: 10792 - DNA, 25 bp, Homo sapien
tgccctcaagagaactcagcttgcc

SEQ ID NO: 10793 - DNA, 25 bp, Homo sapien
ggttgctttcgctgccctcaagaga

SEQ ID NO: 10794 - DNA, 25 bp, Homo sapien
tctacccgagagtgcgacgcgcaat

SEQ ID NO: 10795 - DNA, 25 bp, Homo sapien
tcggtcgttgtctcaccgccacagg

SEQ ID NO: 10796 - DNA, 25 bp, Homo sapien
ttggagccacgcgaactacactgcc

SEQ ID NO: 10797 - DNA, 25 bp, Homo sapien
ccgtgagccgcgatgcttggccaat

SEQ ID NO: 10798 - DNA, 25 bp, Homo sapien
cacctgcgtgggtctctgcagttca

SEQ ID NO: 10799 - DNA, 25 bp, Homo sapien
ctgcggcgtggtaggaactacacca

SEQ ID NO: 10800 - DNA, 25 bp, Homo sapien
tgcagttcaggcctcttctccagga

SEQ ID NO: 10801 - DNA, 25 bp, Homo sapien
gccggggccttagaccaatcattgc

SEQ ID NO: 10802 - DNA, 25 bp, Homo sapien
ggggcacctccgtaagtgcgcaata

SEQ ID NO: 10803 - DNA, 25 bp, Homo sapien
tgcgcaatacgccagaatcttccgg

SEQ ID NO: 10804 - DNA, 25 bp, Homo sapien
cctaaagtcccatggccgaggcagc

SEQ ID NO: 10805 - DNA, 25 bp, Homo sapien
ccgaggcagcgctagtgattacgcc

SEQ ID NO: 10806 - DNA, 25 bp, Homo sapien
gactgcactgaggacgaccctgaaa

SEQ ID NO: 10807 - DNA, 25 bp, Homo sapien
acagttctgagagcgcggaccaaca

SEQ ID NO: 10808 - DNA, 25 bp, Homo sapien
ctctaagaagcaacggcagggactg

SEQ ID NO: 10809 - DNA, 25 bp, Homo sapien
gacttgttcaaggtcgcaggcccga

SEQ ID NO: 10810 - DNA, 25 bp, Homo sapien
cgaggacagtaacgggacttgttca

SEQ ID NO: 10811 - DNA, 25 bp, Homo sapien
aaatatttctactttgcgcgcgcaa

SEQ ID NO: 10812 - DNA, 25 bp, Homo sapien
atcacccagggagccgttcaagctt

SEQ ID NO: 10813 - DNA, 25 bp, Homo sapien
cgtgctgtgcactgagacggacaca

SEQ ID NO: 10814 - DNA, 25 bp, Homo sapien
ttcctgaacgttgattggctccgcg

SEQ ID NO: 10815 - DNA, 25 bp, Homo sapien
gcccacgacaccaggcttgtaaatg

SEQ ID NO: 10816 - DNA, 25 bp, Homo sapien
gagggcctcatagtcctggactcta

SEQ ID NO: 10817 - DNA, 25 bp, Homo sapien
ggaagtcccgccttaccgtatgcaa

SEQ ID NO: 10818 - DNA, 25 bp, Homo sapien
gggcgtgaacgttactggctcaatc

SEQ ID NO: 10819 - DNA, 25 bp, Homo sapien
gtagttctcagaagcccagggttcc

SEQ ID NO: 10820 - DNA, 25 bp, Homo sapien
cgagacagggacttgctgctcctta

SEQ ID NO: 10821 - DNA, 25 bp, Homo sapien
cggaggcagcgtttctaactcaggc

SEQ ID NO: 10822 - DNA, 25 bp, Homo sapien
cctctgggtacagtcaaagggctca

SEQ ID NO: 10823 - DNA, 25 bp, Homo sapien
ggtgcatccagaccgtcagagcttt

SEQ ID NO: 10824 - DNA, 25 bp, Homo sapien
cccgcaggagcgtcgaatacgtatg

SEQ ID NO: 10825 - DNA, 25 bp, Homo sapien
atgcttctaatcacgtgggcgctca

SEQ ID NO: 10826 - DNA, 25 bp, Homo sapien
ccagcggcctgtttaaggagcgaca

SEQ ID NO: 10827 - DNA, 25 bp, Homo sapien
tctcctgcattgtggcgacgccatt

SEQ ID NO: 10828 - DNA, 25 bp, Homo sapien
tccgcgctgagaaaagggtcgtttc

SEQ ID NO: 10829 - DNA, 25 bp, Homo sapien
agggacttccggtatcacttcagtg

SEQ ID NO: 10830 - DNA, 25 bp, Homo sapien
tgggaagattcacttattctacttg

SEQ ID NO: 10831 - DNA, 25 bp, Homo sapien
ggcctcagtggtcatagcagccacc

SEQ ID NO: 10832 - DNA, 25 bp, Homo sapien
cattcccttttgttgtctcagagaa

SEQ ID NO: 10833 - DNA, 25 bp, Homo sapien
ctgacctcgccggtgcctttgtctt

SEQ ID NO: 10834 - DNA, 25 bp, Homo sapien
agggactgaatgaagccaagcaaca

SEQ ID NO: 10835 - DNA, 25 bp, Homo sapien
tgaatgcacattaaaagagggactg

SEQ ID NO: 10836 - DNA, 25 bp, Homo sapien
aaaacaagcccgagctcagctggtg

SEQ ID NO: 10837 - DNA, 25 bp, Homo sapien
aactcctgagagctggtgacacgcc

SEQ ID NO: 10838 - DNA, 25 bp, Homo sapien
ttgctcttgtctccgcccggatcgt

SEQ ID NO: 10839 - DNA, 25 bp, Homo sapien
tccaacttgtcggagcggaacttcc

SEQ ID NO: 10840 - DNA, 25 bp, Homo sapien
ttggcttgtgtcagttccatccgcg

SEQ ID NO: 10841 - DNA, 25 bp, Homo sapien
aggcgcgaggagagtcgttttctca

SEQ ID NO: 10842 - DNA, 25 bp, Homo sapien
cccacccgaaactgagggacgcgtg

SEQ ID NO: 10843 - DNA, 25 bp, Homo sapien
acgcgtgaagggttttctgcagccc

SEQ ID NO: 10844 - DNA, 25 bp, Homo sapien
ggatctcgtttctggtagtgtggca

SEQ ID NO: 10845 - DNA, 25 bp, Homo sapien
ccggatctggacctaggtgctgaca

SEQ ID NO: 10846 - DNA, 25 bp, Homo sapien
gcggcactcttaggggcgtctccct

SEQ ID NO: 10847 - DNA, 25 bp, Homo sapien
gtctccctgcggacggaagctctct

SEQ ID NO: 10848 - DNA, 25 bp, Homo sapien
tccggtatcttcctcgcggtggaca

SEQ ID NO: 10849 - DNA, 25 bp, Homo sapien
gcggtggacatcttgtcggctctta

SEQ ID NO: 10850 - DNA, 25 bp, Homo sapien
tcggctcttaggtggaaccatcgga

SEQ ID NO: 10851 - DNA, 25 bp, Homo sapien
gagaagtcgctgttcgctctgcgga

SEQ ID NO: 10852 - DNA, 25 bp, Homo sapien
ctccgggtggtctacgaactgtgat

SEQ ID NO: 10853 - DNA, 25 bp, Homo sapien
gggtgctgcctttcccagactttcg

SEQ ID NO: 10854 - DNA, 25 bp, Homo sapien
cgagcggcagtactttgatccaatg

SEQ ID NO: 10855 - DNA, 25 bp, Homo sapien
tctctgtagcacagggtcggggaca

SEQ ID NO: 10856 - DNA, 25 bp, Homo sapien
aggcagcagacgcagcttcctagcg

SEQ ID NO: 10857 - DNA, 25 bp, Homo sapien
ggcgtcttcgcagcggtcattttgg

SEQ ID NO: 10858 - DNA, 25 bp, Homo sapien
tctgtcagccgctttggtacgctgc

SEQ ID NO: 10859 - DNA, 25 bp, Homo sapien
tgcatcgggatcgaagtgacggacc

SEQ ID NO: 10860 - DNA, 25 bp, Homo sapien
tcttaagtcccaagtgagaggcacc

SEQ ID NO: 10861 - DNA, 25 bp, Homo sapien
gaggcaccagctcacgtctctgtag

SEQ ID NO: 10862 - DNA, 25 bp, Homo sapien
tttgggattcgaattcagtggggca

SEQ ID NO: 10863 - DNA, 25 bp, Homo sapien
cgctcaacaagcgagaaggttttgg

SEQ ID NO: 10864 - DNA, 25 bp, Homo sapien
tctcctgcggagaattccaatttcc

SEQ ID NO: 10865 - DNA, 25 bp, Homo sapien
atggcatgccgtctcctgcggagaa

SEQ ID NO: 10866 - DNA, 25 bp, Homo sapien
cggcttcatctgactccagggctgg

SEQ ID NO: 10867 - DNA, 25 bp, Homo sapien
gctcagcggtaaagacggcttcatc

SEQ ID NO: 10868 - DNA, 25 bp, Homo sapien
ccaggtcagggaatccttggtgttc

SEQ ID NO: 10869 - DNA, 25 bp, Homo sapien
tctaggcgctgtggccgctcagcgt

SEQ ID NO: 10870 - DNA, 25 bp, Homo sapien
gccggtgaaacctgaggccagcgcc

SEQ ID NO: 10871 - DNA, 25 bp, Homo sapien
cagcagcgtgtgcatgtcgccggct

SEQ ID NO: 10872 - DNA, 25 bp, Homo sapien
cccagtgacatggggccggtgaaac

SEQ ID NO: 10873 - DNA, 25 bp, Homo sapien
tgccgcccgcccagtgacatggggc

SEQ ID NO: 10874 - DNA, 25 bp, Homo sapien
tgcctccaacctgcaggcgtgggga

SEQ ID NO: 10875 - DNA, 25 bp, Homo sapien
gtggctgcctccaacctgcaggcgt

SEQ ID NO: 10876 - DNA, 25 bp, Homo sapien
ctggtgctgcctgcgaggccgtcct

SEQ ID NO: 10877 - DNA, 25 bp, Homo sapien
cgtggttgtgcatgaggctggtgct

SEQ ID NO: 10878 - DNA, 25 bp, Homo sapien
tgacagcccaggatagcaacacttc

SEQ ID NO: 10879 - DNA, 25 bp, Homo sapien
gtcattttggcctctgtcctgtttg

SEQ ID NO: 10880 - DNA, 25 bp, Homo sapien
tcctgtttgtccagcccgccagttt

SEQ ID NO: 10881 - DNA, 25 bp, Homo sapien
ccagtttctgcagtggaggtcgcga

SEQ ID NO: 10882 - DNA, 25 bp, Homo sapien
aggttctgcgacaccacctcgggtg

SEQ ID NO: 10883 - DNA, 25 bp, Homo sapien
gactgttgtgttcgaatgcccgccc

SEQ ID NO: 10884 - DNA, 25 bp, Homo sapien
cggcggagttgagccaatgacagcc

SEQ ID NO: 10885 - DNA, 25 bp, Homo sapien
ctcctcgtggcggtcattttggcct

SEQ ID NO: 10886 - DNA, 25 bp, Homo sapien
cctcgtcacacgcagtgtcaaaaaa

SEQ ID NO: 10887 - DNA, 25 bp, Homo sapien
cctcactgatggctttagaacgtgg

SEQ ID NO: 10888 - DNA, 25 bp, Homo sapien
ctttcgtgcaggagggacgacgact

SEQ ID NO: 10889 - DNA, 25 bp, Homo sapien
ccgctgccatcagactctgcgggta

SEQ ID NO: 10890 - DNA, 25 bp, Homo sapien
ggtccctatcccaggcctgacgtgg

SEQ ID NO: 10891 - DNA, 25 bp, Homo sapien
ctgagttggcgtcctcagagtggcc

SEQ ID NO: 10892 - DNA, 25 bp, Homo sapien
tcgccaaggcttagacgctttcgtg

SEQ ID NO: 10893 - DNA, 25 bp, Homo sapien
aggacgggaagacgccgcactcacc

SEQ ID NO: 10894 - DNA, 25 bp, Homo sapien
aaatgtccgctacaaggaggagccg

SEQ ID NO: 10895 - DNA, 25 bp, Homo sapien
tccctgcagagcatcagacgcgtct

SEQ ID NO: 10896 - DNA, 25 bp, Homo sapien
ggctgcaggcactttacgattcgga

SEQ ID NO: 10897 - DNA, 25 bp, Homo sapien
atcggggacgcaggcacttccgtcc

SEQ ID NO: 10898 - DNA, 25 bp, Homo sapien
gacactggggacaacatctcctccg

SEQ ID NO: 10899 - DNA, 25 bp, Homo sapien
gcggcccacacaagcgttacagaac

SEQ ID NO: 10900 - DNA, 25 bp, Homo sapien
cggccagggacagcctgacagaaac

SEQ ID NO: 10901 - DNA, 25 bp, Homo sapien
cgcggagtccgttagctccgccata

SEQ ID NO: 10902 - DNA, 25 bp, Homo sapien
cgtcctctactagtggccattttga

SEQ ID NO: 10903 - DNA, 25 bp, Homo sapien
gacgagacgttgtcccgactgcaca

SEQ ID NO: 10904 - DNA, 25 bp, Homo sapien
ggctgctctgcagctccttaaaggc

SEQ ID NO: 10905 - DNA, 25 bp, Homo sapien
tccttaaaggcgctaggcgtgaccc

SEQ ID NO: 10906 - DNA, 25 bp, Homo sapien
aagcggcgcctgctcaaggttttac

SEQ ID NO: 10907 - DNA, 25 bp, Homo sapien
ccgtttttgacacccgcgggatgcg

SEQ ID NO: 10908 - DNA, 25 bp, Homo sapien
tgggtcgtgtagaagtgactgaacc

SEQ ID NO: 10909 - DNA, 25 bp, Homo sapien
ttttccagtgagagaccgcggagtg

SEQ ID NO: 10910 - DNA, 25 bp, Homo sapien
cctgtcaggtccatccggcgatgct

SEQ ID NO: 10911 - DNA, 25 bp, Homo sapien
ggcagccattttggcctgtcaggtc

SEQ ID NO: 10912 - DNA, 25 bp, Homo sapien
gcgtcctagccgtggcagccatttt

SEQ ID NO: 10913 - DNA, 25 bp, Homo sapien
ttgccggggcacgtaaagtcaagcc

SEQ ID NO: 10914 - DNA, 25 bp, Homo sapien
gccaatgaagcttcagagaagccgt

SEQ ID NO: 10915 - DNA, 25 bp, Homo sapien
ccgggacaggacaacgacaggaaca

SEQ ID NO: 10916 - DNA, 25 bp, Homo sapien
acacccagttgatgcggtcggcaga

SEQ ID NO: 10917 - DNA, 25 bp, Homo sapien
ccctgcgaaatggtaacgtggctga

SEQ ID NO: 10918 - DNA, 25 bp, Homo sapien
cggctattaattttgcatcctcgga

SEQ ID NO: 10919 - DNA, 25 bp, Homo sapien
agccttgaatcggagctgcttatca

SEQ ID NO: 10920 - DNA, 25 bp, Homo sapien
ggctcccgttcagcatctgtcactg

SEQ ID NO: 10921 - DNA, 25 bp, Homo sapien
ttccacacggctacacgtcggagcg

SEQ ID NO: 10922 - DNA, 25 bp, Homo sapien
tcgagacagattttccacacggcta

SEQ ID NO: 10923 - DNA, 25 bp, Homo sapien
ggtgtctgatctgtaaaaagttctc

SEQ ID NO: 10924 - DNA, 25 bp, Homo sapien
agtgtcagaaatccgcgctgccttc

SEQ ID NO: 10925 - DNA, 25 bp, Homo sapien
atcctcggataacgtgcagcctcga

SEQ ID NO: 10926 - DNA, 25 bp, Homo sapien
gccattttggcttgtcgggaccatc

SEQ ID NO: 10927 - DNA, 25 bp, Homo sapien
ccttcttccgaaagtcaggttggag

SEQ ID NO: 10928 - DNA, 25 bp, Homo sapien
ccgcgcgtctctcggaacttaaata

SEQ ID NO: 10929 - DNA, 25 bp, Homo sapien
tacccggaatcgtctctgtgaattg

SEQ ID NO: 10930 - DNA, 25 bp, Homo sapien
gcacgtaacgtcaagcagggacttc

SEQ ID NO: 10931 - DNA, 25 bp, Homo sapien
ggaccatccacctatgctgcgtctg

SEQ ID NO: 10932 - DNA, 25 bp, Homo sapien
gctgcgtctgtacctctttgtcagg

SEQ ID NO: 10933 - DNA, 25 bp, Homo sapien
ggaaagcccattgaagcctcagaga

SEQ ID NO: 10934 - DNA, 25 bp, Homo sapien
ggatccgtccatctccaggccattg

SEQ ID NO: 10935 - DNA, 25 bp, Homo sapien
cccacgggtgtctgaaacagggatc

SEQ ID NO: 10936 - DNA, 25 bp, Homo sapien
ttgcagagccgtaaacaggtgccgc

SEQ ID NO: 10937 - DNA, 25 bp, Homo sapien
cgctgctttaggacttgtgtgacta

SEQ ID NO: 10938 - DNA, 25 bp, Homo sapien
gaagaacgactctcgacctcctgga

SEQ ID NO: 10939 - DNA, 25 bp, Homo sapien
tccaaggactccctaacgccaatgg

SEQ ID NO: 10940 - DNA, 25 bp, Homo sapien
ctctaccttacttgcgcacacggaa

SEQ ID NO: 10941 - DNA, 25 bp, Homo sapien
cgccaatggaaatggtcgctactaa

SEQ ID NO: 10942 - DNA, 25 bp, Homo sapien
tagcggccacgttgatctgcgatac

SEQ ID NO: 10943 - DNA, 25 bp, Homo sapien
gcgcctaatgtagggccgagacttc

SEQ ID NO: 10944 - DNA, 25 bp, Homo sapien
cgttgaatgaatgccgtcagagcca

SEQ ID NO: 10945 - DNA, 25 bp, Homo sapien
gaagcatttccgtgtgtgcgcctaa

SEQ ID NO: 10946 - DNA, 25 bp, Homo sapien
gagacttccggggtcctcttgtagc

SEQ ID NO: 10947 - DNA, 25 bp, Homo sapien
agaggaaccgttctcggtgcacaga

SEQ ID NO: 10948 - DNA, 25 bp, Homo sapien
ctgcggtgaatgaacccagaaggtg

SEQ ID NO: 10949 - DNA, 25 bp, Homo sapien
ctgcgatacgcgtgtttgcccagtg

SEQ ID NO: 10950 - DNA, 25 bp, Homo sapien
cggaaagaaggcatttccacgtgtg

SEQ ID NO: 10951 - DNA, 25 bp, Homo sapien
gaggaatcgtcctcggtgcccagag

SEQ ID NO: 10952 - DNA, 25 bp, Homo sapien
tggagaggaatcgtcctcggtgccc

SEQ ID NO: 10953 - DNA, 25 bp, Homo sapien
ttccccagtttgtggcccctgagtg

SEQ ID NO: 10954 - DNA, 25 bp, Homo sapien
agacttccggggtctctagtagcgg

SEQ ID NO: 10955 - DNA, 25 bp, Homo sapien
tccacgtgtgcacgtaacgtaaggc

SEQ ID NO: 10956 - DNA, 25 bp, Homo sapien
gaaggcatttccacgtgtgcacgta

SEQ ID NO: 10957 - DNA, 25 bp, Homo sapien
cccgtgacggcgaccactgctcccg

SEQ ID NO: 10958 - DNA, 25 bp, Homo sapien
agatatgggcacgacggtccgtatc

SEQ ID NO: 10959 - DNA, 25 bp, Homo sapien
tcccacgggtgtcagaaatggggcc

SEQ ID NO: 10960 - DNA, 25 bp, Homo sapien
cagagccgtgaacaggcgctgctac

SEQ ID NO: 10961 - DNA, 25 bp, Homo sapien
aacaggcgctgctacctcgctgctt

SEQ ID NO: 10962 - DNA, 25 bp, Homo sapien
cctcgctgcttttgggtgacgatga

SEQ ID NO: 10963 - DNA, 25 bp, Homo sapien
tacctgagcggagagcctcagcgta

SEQ ID NO: 10964 - DNA, 25 bp, Homo sapien
cacgtggttttaagcagagtcggga

SEQ ID NO: 10965 - DNA, 25 bp, Homo sapien
cggcagccatcgaaccacgtggttt

SEQ ID NO: 10966 - DNA, 25 bp, Homo sapien
ctgcagacagcggacaatgagaact

SEQ ID NO: 10967 - DNA, 25 bp, Homo sapien
cctcggagaggccgcatcccaggga

SEQ ID NO: 10968 - DNA, 25 bp, Homo sapien
gcgcctcccgtggagtcctcgccac

SEQ ID NO: 10969 - DNA, 25 bp, Homo sapien
aactgacaacaacccgctctcaggg

SEQ ID NO: 10970 - DNA, 25 bp, Homo sapien
caatgagaactgacaacaacccgct

SEQ ID NO: 10971 - DNA, 25 bp, Homo sapien
cagcggacaatgagaactgacaaca

SEQ ID NO: 10972 - DNA, 25 bp, Homo sapien
ctggagcccagtgtcccctcggaga

SEQ ID NO: 10973 - DNA, 25 bp, Homo sapien
gcaggccctgcagacagcggacaat

SEQ ID NO: 10974 - DNA, 25 bp, Homo sapien
gggcaccgaggacgattcctctcca

SEQ ID NO: 10975 - DNA, 25 bp, Homo sapien
cgtgcacacgtggaaatgccttctt

SEQ ID NO: 10976 - DNA, 25 bp, Homo sapien
ccgctactagagaccccggaagtct

SEQ ID NO: 10977 - DNA, 25 bp, Homo sapien
gcactcaggggccacaaactgggga

SEQ ID NO: 10978 - DNA, 25 bp, Homo sapien
tctgggcaccgaggacgattcctct

SEQ ID NO: 10979 - DNA, 25 bp, Homo sapien
gccttacgttacgtgcacacgtgga

SEQ ID NO: 10980 - DNA, 25 bp, Homo sapien
tcaggggccacaaactggggaaaca

SEQ ID NO: 10981 - DNA, 25 bp, Homo sapien
cacacgtggaaatgccttctttccg

SEQ ID NO: 10982 - DNA, 25 bp, Homo sapien
catcccacaggtgtcagaaacaagg

SEQ ID NO: 10983 - DNA, 25 bp, Homo sapien
ccactacgttacgtgcgcacacaga

SEQ ID NO: 10984 - DNA, 25 bp, Homo sapien
gagaacgctgagaatcccgccacta

SEQ ID NO: 10985 - DNA, 25 bp, Homo sapien
cagacaccgcggttcggacccatag

SEQ ID NO: 10986 - DNA, 25 bp, Homo sapien
aaggactcttcaccttctgggttca

SEQ ID NO: 10987 - DNA, 25 bp, Homo sapien
ctctgtgcagcaagaaggactcttc

SEQ ID NO: 10988 - DNA, 25 bp, Homo sapien
ttacggggcctaagatctgcctctg

SEQ ID NO: 10989 - DNA, 25 bp, Homo sapien
gacctgtgaacagtcgccgctctct

SEQ ID NO: 10990 - DNA, 25 bp, Homo sapien
tccggggctttctaccaagtaatca

SEQ ID NO: 10991 - DNA, 25 bp, Homo sapien
ccttctcagtcagtcacggatgatg

SEQ ID NO: 10992 - DNA, 25 bp, Homo sapien
ggtaatgttcccacaggcgcacggc

SEQ ID NO: 10993 - DNA, 25 bp, Homo sapien
tgcgcttacggaaacaccacctttc

SEQ ID NO: 10994 - DNA, 25 bp, Homo sapien
gcctcattggctgaaggtcgccgtc

SEQ ID NO: 10995 - DNA, 25 bp, Homo sapien
acgcaggccattctgggtaatgttc

SEQ ID NO: 10996 - DNA, 25 bp, Homo sapien
agaggatgtccttattccgggccgg

SEQ ID NO: 10997 - DNA, 25 bp, Homo sapien
ggggaagactcctctcgcgccttct

SEQ ID NO: 10998 - DNA, 25 bp, Homo sapien
ggtctgacgtccttcacagtgcttt

SEQ ID NO: 10999 - DNA, 25 bp, Homo sapien
ctgcaaaaaggcctgggtaagtcgc

SEQ ID NO: 11000 - DNA, 25 bp, Homo sapien
ccgccgtcactgcatgtttaaggga

SEQ ID NO: 11001 - DNA, 25 bp, Homo sapien
cggggttattcgtcccatcaatggc

SEQ ID NO: 11002 - DNA, 25 bp, Homo sapien
aatttcctcctcaagaccgacgcgg

SEQ ID NO: 11003 - DNA, 25 bp, Homo sapien
ggccgcgacgctgcaaaagctcgtc

SEQ ID NO: 11004 - DNA, 25 bp, Homo sapien
tggactttgttgtcccggtcccaga

SEQ ID NO: 11005 - DNA, 25 bp, Homo sapien
tttgcaacttgacagtgaccgccgc

SEQ ID NO: 11006 - DNA, 25 bp, Homo sapien
ttgtctacaacgagttccaatctgc

SEQ ID NO: 11007 - DNA, 25 bp, Homo sapien
gcgtcctcaggccattgtctacaac

SEQ ID NO: 11008 - DNA, 25 bp, Homo sapien
aaaggcagtctctgcgcgcacgctc

SEQ ID NO: 11009 - DNA, 25 bp, Homo sapien
ttccaatctgcatgttgggagaggc

SEQ ID NO: 11010 - DNA, 25 bp, Homo sapien
ggttcttgtcctggccctcgtagac

SEQ ID NO: 11011 - DNA, 25 bp, Homo sapien
gctcctcgccggatgatatttggaa

SEQ ID NO: 11012 - DNA, 25 bp, Homo sapien
tgctaacagtgatttttctcgggta

SEQ ID NO: 11013 - DNA, 25 bp, Homo sapien
gtgctaatggccaatctggtgttta

SEQ ID NO: 11014 - DNA, 25 bp, Homo sapien
agccgatgacgtaacccgcgcttgc

SEQ ID NO: 11015 - DNA, 25 bp, Homo sapien
ctgacgctgatgctcgtctggctgc

SEQ ID NO: 11016 - DNA, 25 bp, Homo sapien
ggctgcccgttctttggcatcaaaa

SEQ ID NO: 11017 - DNA, 25 bp, Homo sapien
taccagacgatggtggcgcaccctg

SEQ ID NO: 11018 - DNA, 25 bp, Homo sapien
ttcggtcccgcctagaaagaccaga

SEQ ID NO: 11019 - DNA, 25 bp, Homo sapien
ccagaagcctgtcagagcgactaga

SEQ ID NO: 11020 - DNA, 25 bp, Homo sapien
cctcagcgtccacgagggttacctg

SEQ ID NO: 11021 - DNA, 25 bp, Homo sapien
cacggccaaacggattggagactca

SEQ ID NO: 11022 - DNA, 25 bp, Homo sapien
cgttgccaaggcgactggaaccgcg

SEQ ID NO: 11023 - DNA, 25 bp, Homo sapien
acttgtcaccgacgcccggcgtgat

SEQ ID NO: 11024 - DNA, 25 bp, Homo sapien
cccggcgtgatccagcggaccaatg

SEQ ID NO: 11025 - DNA, 25 bp, Homo sapien
cgtgtctggaatgccgtcgttttgc

SEQ ID NO: 11026 - DNA, 25 bp, Homo sapien
atccgcctgtccgtttgaggccgaa

SEQ ID NO: 11027 - DNA, 25 bp, Homo sapien
tgacgctgcgcgacccgttgccaag

SEQ ID NO: 11028 - DNA, 25 bp, Homo sapien
ttccagagcccatcgggagtcctga

SEQ ID NO: 11029 - DNA, 25 bp, Homo sapien
agtcccgcagcggtgacttgtcacc

SEQ ID NO: 11030 - DNA, 25 bp, Homo sapien
gcttccggcagttccagtaccacgt

SEQ ID NO: 11031 - DNA, 25 bp, Homo sapien
ctgacgtctccgaggaccgaactgc

SEQ ID NO: 11032 - DNA, 25 bp, Homo sapien
tcacacagatgtgccagcaggaagg

SEQ ID NO: 11033 - DNA, 25 bp, Homo sapien
agcctggtggaggacctcacacaga

SEQ ID NO: 11034 - DNA, 25 bp, Homo sapien
ccagcaagatgcggacctgggtgca

SEQ ID NO: 11035 - DNA, 25 bp, Homo sapien
ccgaggcgcgctccaaggagcagat

SEQ ID NO: 11036 - DNA, 25 bp, Homo sapien
cagctctggacgctgtgccgccagt

SEQ ID NO: 11037 - DNA, 25 bp, Homo sapien
agttccagtaccacgtggcgagcgg

SEQ ID NO: 11038 - DNA, 25 bp, Homo sapien
gctaacactgcctgaggcacctctg

SEQ ID NO: 11039 - DNA, 25 bp, Homo sapien
cgctgccagggtgctaacactgcct

SEQ ID NO: 11040 - DNA, 25 bp, Homo sapien
cagggtgctaacactgcctgaggca

SEQ ID NO: 11041 - DNA, 25 bp, Homo sapien
actgcctgaggcacctctgcttttg

SEQ ID NO: 11042 - DNA, 25 bp, Homo sapien
cctctgcttttgaagtcgccgggga

SEQ ID NO: 11043 - DNA, 25 bp, Homo sapien
tgcttttgaagtcgccggggattag

SEQ ID NO: 11044 - DNA, 25 bp, Homo sapien
cacgactggcgatcgctgagcgcat

SEQ ID NO: 11045 - DNA, 25 bp, Homo sapien
tggcgatcgctgagcgcatacaacc

SEQ ID NO: 11046 - DNA, 25 bp, Homo sapien
tacggatccacaccaagatcgcagc

SEQ ID NO: 11047 - DNA, 25 bp, Homo sapien
acacacggcgtccatcttaatgagg

SEQ ID NO: 11048 - DNA, 25 bp, Homo sapien
gcagttgctccggttctgtgccgac

SEQ ID NO: 11049 - DNA, 25 bp, Homo sapien
cccgcagagatggtggtgaagtccc

SEQ ID NO: 11050 - DNA, 25 bp, Homo sapien
cctacccgtgcttcagaggcgatca

SEQ ID NO: 11051 - DNA, 25 bp, Homo sapien
gaggagctgcccgaaagtttcattt

SEQ ID NO: 11052 - DNA, 25 bp, Homo sapien
atctcagcttgccagcaccctgggg

SEQ ID NO: 11053 - DNA, 25 bp, Homo sapien
ggggatcctgctcatctcagcttgc

SEQ ID NO: 11054 - DNA, 25 bp, Homo sapien
ccggtgagaatctcggcctccttgc

SEQ ID NO: 11055 - DNA, 25 bp, Homo sapien
ggccgccacctttgttgatggaaga

SEQ ID NO: 11056 - DNA, 25 bp, Homo sapien
ccggcccttgtcactgtagcgttaa

SEQ ID NO: 11057 - DNA, 25 bp, Homo sapien
agcagatatgtgtccgcacccgcca

SEQ ID NO: 11058 - DNA, 25 bp, Homo sapien
acagcaggcgcttaaacgggtacgc

SEQ ID NO: 11059 - DNA, 25 bp, Homo sapien
cagggccagccgttcctgccagaag

SEQ ID NO: 11060 - DNA, 25 bp, Homo sapien
cgcgtctccacagacccggtgagaa

SEQ ID NO: 11061 - DNA, 25 bp, Homo sapien
tttgcggggcatccctagtctgaga

SEQ ID NO: 11062 - DNA, 25 bp, Homo sapien
acctccctttgcaggctccctccca

SEQ ID NO: 11063 - DNA, 25 bp, Homo sapien
agctgcaggaacctcgggaccagag

SEQ ID NO: 11064 - DNA, 25 bp, Homo sapien
ccgtcagctgcaggaacctcgggac

SEQ ID NO: 11065 - DNA, 25 bp, Homo sapien
cgggaccagaggctcgtaggaacct

SEQ ID NO: 11066 - DNA, 25 bp, Homo sapien
agaggctcgtaggaacctctccctg

SEQ ID NO: 11067 - DNA, 25 bp, Homo sapien
cctctggtgccctcagctaacggga

SEQ ID NO: 11068 - DNA, 25 bp, Homo sapien
ggtgccctcagctaacgggaagcct

SEQ ID NO: 11069 - DNA, 25 bp, Homo sapien
cccgctcacctaggctgccgtctgc

SEQ ID NO: 11070 - DNA, 25 bp, Homo sapien
ggacccttctcgttgggagcgctta

SEQ ID NO: 11071 - DNA, 25 bp, Homo sapien
cacaggcagaggacgtccacaaaca

SEQ ID NO: 11072 - DNA, 25 bp, Homo sapien
aggcccaatgcctcgtctgggattc

SEQ ID NO: 11073 - DNA, 25 bp, Homo sapien
tttctccttctcgtgggtcttctgg

SEQ ID NO: 11074 - DNA, 25 bp, Homo sapien
ccaggctgaagtggaaggtcttcca

SEQ ID NO: 11075 - DNA, 25 bp, Homo sapien
cctcttggttcccagtttcgccgtg

SEQ ID NO: 11076 - DNA, 25 bp, Homo sapien
tcccgccttctggaacaaggtcaga

SEQ ID NO: 11077 - DNA, 25 bp, Homo sapien
agcgcttagcctcaggagcggattc

SEQ ID NO: 11078 - DNA, 25 bp, Homo sapien
cccgaaacagagatgtacagagtcg

SEQ ID NO: 11079 - DNA, 25 bp, Homo sapien
gcactccacgcgaagggatgccaga

SEQ ID NO: 11080 - DNA, 25 bp, Homo sapien
gggcaccatggcaacgaagtaaaca

SEQ ID NO: 11081 - DNA, 25 bp, Homo sapien
cgcctgcgtcattttgggcaccatg

SEQ ID NO: 11082 - DNA, 25 bp, Homo sapien
aatcagacgcgagtgtggcctcccg

SEQ ID NO: 11083 - DNA, 25 bp, Homo sapien
gtgacagtgcgcatggccaatcaga

SEQ ID NO: 11084 - DNA, 25 bp, Homo sapien
taccctgttggggtcgctctctgac

SEQ ID NO: 11085 - DNA, 25 bp, Homo sapien
gcatgaaggcccacagacgctcggg

SEQ ID NO: 11086 - DNA, 25 bp, Homo sapien
ctgcggacgagcaccttgtctctca

SEQ ID NO: 11087 - DNA, 25 bp, Homo sapien
gtctctcaggttgaccagccgtata

SEQ ID NO: 11088 - DNA, 25 bp, Homo sapien
ccgtatatccgcttgcgagcctgca

SEQ ID NO: 11089 - DNA, 25 bp, Homo sapien
aggctgctgtgtctccttcctctca

SEQ ID NO: 11090 - DNA, 25 bp, Homo sapien
ctggagtcactcctctacaggggtg

SEQ ID NO: 11091 - DNA, 25 bp, Homo sapien
gccaatggacgctgacaccttcatg

SEQ ID NO: 11092 - DNA, 25 bp, Homo sapien
tgccgcgtaccctcacagacagaaa

SEQ ID NO: 11093 - DNA, 25 bp, Homo sapien
tggtctcggcagaatctcgttcaca

SEQ ID NO: 11094 - DNA, 25 bp, Homo sapien
acgcggggtccttcagctaaatcct

SEQ ID NO: 11095 - DNA, 25 bp, Homo sapien
ccaggcagtgctcgccaggaaccaa

SEQ ID NO: 11096 - DNA, 25 bp, Homo sapien
aagccgtctgtgtggatgagcgcac

SEQ ID NO: 11097 - DNA, 25 bp, Homo sapien
tggacaccacttcgcagggcatctg

SEQ ID NO: 11098 - DNA, 25 bp, Homo sapien
ttcgtgcgcctccttggccaaaaga

SEQ ID NO: 11099 - DNA, 25 bp, Homo sapien
ttacctgtgccgctcactcgacgga

SEQ ID NO: 11100 - DNA, 25 bp, Homo sapien
ccgccacgcgcgaagttcaactttg

SEQ ID NO: 11101 - DNA, 25 bp, Homo sapien
aaagttcactgcgaggccaggcctg

SEQ ID NO: 11102 - DNA, 25 bp, Homo sapien
gcctgcctcccgcttctagaaagag

SEQ ID NO: 11103 - DNA, 25 bp, Homo sapien
cggtgatgtcactttcctgctggaa

SEQ ID NO: 11104 - DNA, 25 bp, Homo sapien
cgaaagcgtttcctcgagcagcggc

SEQ ID NO: 11105 - DNA, 25 bp, Homo sapien
cccgcgcggaatattctcctgaatc

SEQ ID NO: 11106 - DNA, 25 bp, Homo sapien
ggcaggattcctagctcgaagcagc

SEQ ID NO: 11107 - DNA, 25 bp, Homo sapien
ctcggcctcacacatggcaggattc

SEQ ID NO: 11108 - DNA, 25 bp, Homo sapien
ctcgttgtttggctcctgaaagtaa

SEQ ID NO: 11109 - DNA, 25 bp, Homo sapien
aggcacttaccgttgctgtacaata

SEQ ID NO: 11110 - DNA, 25 bp, Homo sapien
cccttcttgatcgaggcttagccca

SEQ ID NO: 11111 - DNA, 25 bp, Homo sapien
tcagatcctccactggtgcctggtg

SEQ ID NO: 11112 - DNA, 25 bp, Homo sapien
catgtcacttggagccttcgggaaa

SEQ ID NO: 11113 - DNA, 25 bp, Homo sapien
gccaatgcacgaaaagccgccagtt

SEQ ID NO: 11114 - DNA, 25 bp, Homo sapien
cctgctcaagcctggggtcagaatc

SEQ ID NO: 11115 - DNA, 25 bp, Homo sapien
cgcacctagaaaatcccgggaactg

SEQ ID NO: 11116 - DNA, 25 bp, Homo sapien
ctgagagcgctccaagttcgtcttg

SEQ ID NO: 11117 - DNA, 25 bp, Homo sapien
gcgcgcgtagagaggaaactttccc

SEQ ID NO: 11118 - DNA, 25 bp, Homo sapien
gctagagatgcgagcgcggaactca

SEQ ID NO: 11119 - DNA, 25 bp, Homo sapien
gcgcggaactcacgggtgacgctaa

SEQ ID NO: 11120 - DNA, 25 bp, Homo sapien
agcgacctcgtcctcagaggagtga

SEQ ID NO: 11121 - DNA, 25 bp, Homo sapien
caagacttccctccgcaggaaacgg

SEQ ID NO: 11122 - DNA, 25 bp, Homo sapien
tcagggatgcgtcggcacttacggt

SEQ ID NO: 11123 - DNA, 25 bp, Homo sapien
caaaacagtctctatgggagggcgg

SEQ ID NO: 11124 - DNA, 25 bp, Homo sapien
acccagcaggcgtggcaaaacagtc

SEQ ID NO: 11125 - DNA, 25 bp, Homo sapien
attcattaccctggcgtggacttgc

SEQ ID NO: 11126 - DNA, 25 bp, Homo sapien
gtttggggagtgcaggtcatcactc

SEQ ID NO: 11127 - DNA, 25 bp, Homo sapien
cgttctatcccgcagtggtttgggg

SEQ ID NO: 11128 - DNA, 25 bp, Homo sapien
cattgcgcatgagcgcccactgcgg

SEQ ID NO: 11129 - DNA, 25 bp, Homo sapien
atacctggcgccgaccttgaaggga

SEQ ID NO: 11130 - DNA, 25 bp, Homo sapien
aagacgcccgtgatgccaaggcttg

SEQ ID NO: 11131 - DNA, 25 bp, Homo sapien
gcagcggacagccaaaatcctgaaa

SEQ ID NO: 11132 - DNA, 25 bp, Homo sapien
cgcggtgctccctgtgattcacttt

SEQ ID NO: 11133 - DNA, 25 bp, Homo sapien
tgctgcgcatgagtgtgcttccacc

SEQ ID NO: 11134 - DNA, 25 bp, Homo sapien
gcgagcgcggcctctgcattttccg

SEQ ID NO: 11135 - DNA, 25 bp, Homo sapien
gcattttccgccgagctcgggtacc

SEQ ID NO: 11136 - DNA, 25 bp, Homo sapien
ttcgtggcagggcacgactctctcc

SEQ ID NO: 11137 - DNA, 25 bp, Homo sapien
agtgccgcgcgaaacctgcgtccgt

SEQ ID NO: 11138 - DNA, 25 bp, Homo sapien
cgccgagggacatcgacgagtatcc

SEQ ID NO: 11139 - DNA, 25 bp, Homo sapien
ccttgcctagctggaccgccgaggg

SEQ ID NO: 11140 - DNA, 25 bp, Homo sapien
cgggtcgccgcccacattagtgtgg

SEQ ID NO: 11141 - DNA, 25 bp, Homo sapien
agaacagatcgcctccggaagcgtg

SEQ ID NO: 11142 - DNA, 25 bp, Homo sapien
cgaccgtttttctgcgctgtaataa

SEQ ID NO: 11143 - DNA, 25 bp, Homo sapien
ggtgggcacctccagccaaacctgt

SEQ ID NO: 11144 - DNA, 25 bp, Homo sapien
gccaaacctgtgcagcgcgcaaacg

SEQ ID NO: 11145 - DNA, 25 bp, Homo sapien
cagaccagggtttgtactcgaggaa

SEQ ID NO: 11146 - DNA, 25 bp, Homo sapien
gttgtaggcgtcgacccatttcgtc

SEQ ID NO: 11147 - DNA, 25 bp, Homo sapien
cctcgcattcctgagtgcgcgatga

SEQ ID NO: 11148 - DNA, 25 bp, Homo sapien
gcttccgggctctgaaagatgcttc

SEQ ID NO: 11149 - DNA, 25 bp, Homo sapien
tcaggtcgtgatctacaattgcgcc

SEQ ID NO: 11150 - DNA, 25 bp, Homo sapien
cggctaagcttcgagcaccaggaca

SEQ ID NO: 11151 - DNA, 25 bp, Homo sapien
accgctgcgatcaagcggcgacaca

SEQ ID NO: 11152 - DNA, 25 bp, Homo sapien
cgggtaagagtcacgctttggcaaa

SEQ ID NO: 11153 - DNA, 25 bp, Homo sapien
cctgcccggttagttccttgtcttg

SEQ ID NO: 11154 - DNA, 25 bp, Homo sapien
ttgtcttgcccaaccagattcttgc

SEQ ID NO: 11155 - DNA, 25 bp, Homo sapien
ataccgctacttgcgtgtgccggtg

SEQ ID NO: 11156 - DNA, 25 bp, Homo sapien
aatcagcgtcttgcgcctcttctcg

SEQ ID NO: 11157 - DNA, 25 bp, Homo sapien
gcccacagtcggcttcacgctggag

SEQ ID NO: 11158 - DNA, 25 bp, Homo sapien
caatgactatgcctgtgggagcaac

SEQ ID NO: 11159 - DNA, 25 bp, Homo sapien
ggaagcaactccctaagccacaatg

SEQ ID NO: 11160 - DNA, 25 bp, Homo sapien
cctcaaggttggctcggaggtttca

SEQ ID NO: 11161 - DNA, 25 bp, Homo sapien
tcgcgaacacaggaaaaagctcatc

SEQ ID NO: 11162 - DNA, 25 bp, Homo sapien
aaggcacccgagatgacagcgccga

SEQ ID NO: 11163 - DNA, 25 bp, Homo sapien
gcctccacagtctcggcttcggttg

SEQ ID NO: 11164 - DNA, 25 bp, Homo sapien
tgagaaccagcgtggcccgtttaag

SEQ ID NO: 11165 - DNA, 25 bp, Homo sapien
agccacaatgctagtcgcgaacaca

SEQ ID NO: 11166 - DNA, 25 bp, Homo sapien
ggcccggcttcaggtaacaataaca

SEQ ID NO: 11167 - DNA, 25 bp, Homo sapien
cccgcgcaagttcccgagaagagca

SEQ ID NO: 11168 - DNA, 25 bp, Homo sapien
aatcagtcatctctcggggtccgcc

SEQ ID NO: 11169 - DNA, 25 bp, Homo sapien
cagccattaggaggagcagacggtc

SEQ ID NO: 11170 - DNA, 25 bp, Homo sapien
ttcccgagagaatcgagcaggccca

SEQ ID NO: 11171 - DNA, 25 bp, Homo sapien
ccgggtgcccagatggcaagaatca

SEQ ID NO: 11172 - DNA, 25 bp, Homo sapien
ggtctgtcctcgtgttgactgataa

SEQ ID NO: 11173 - DNA, 25 bp, Homo sapien
ggccatcggccataatgcttccatt

SEQ ID NO: 11174 - DNA, 25 bp, Homo sapien
agcccgggcacttgcgtattcctgt

SEQ ID NO: 11175 - DNA, 25 bp, Homo sapien
accgcggggctcgatgagtcacccg

SEQ ID NO: 11176 - DNA, 25 bp, Homo sapien
agggcccgagccctagttctgcttc

SEQ ID NO: 11177 - DNA, 25 bp, Homo sapien
agttctgcttctcggatggggagcc

SEQ ID NO: 11178 - DNA, 25 bp, Homo sapien
gcacttgcgtattcctgtctgtaaa

SEQ ID NO: 11179 - DNA, 25 bp, Homo sapien
ctgtaaaatgggcacgtaggccgcg

SEQ ID NO: 11180 - DNA, 25 bp, Homo sapien
ggactgatagggaaacgcgcatctg

SEQ ID NO: 11181 - DNA, 25 bp, Homo sapien
gagccctagttctgcttctcggatg

SEQ ID NO: 11182 - DNA, 25 bp, Homo sapien
aggttctgacgatccgcagctccca

SEQ ID NO: 11183 - DNA, 25 bp, Homo sapien
gcagcgctgtgaactccatttccca

SEQ ID NO: 11184 - DNA, 25 bp, Homo sapien
cagaaggccttgtatcccgtgcatg

SEQ ID NO: 11185 - DNA, 25 bp, Homo sapien
gtatcccgtgcatggccgtttccag

SEQ ID NO: 11186 - DNA, 25 bp, Homo sapien
caccaggcggaagtgcgtaccggaa

SEQ ID NO: 11187 - DNA, 25 bp, Homo sapien
cggcggcagtgtgtaagacgctcac

SEQ ID NO: 11188 - DNA, 25 bp, Homo sapien
acctgccatgtcctgccgggtgtca

SEQ ID NO: 11189 - DNA, 25 bp, Homo sapien
ctgcctgcgcagaaccgagaggttc

SEQ ID NO: 11190 - DNA, 25 bp, Homo sapien
gtacacttgagcttccggaggacgc

SEQ ID NO: 11191 - DNA, 25 bp, Homo sapien
tccgtgctgaccaacgtcaactaca

SEQ ID NO: 11192 - DNA, 25 bp, Homo sapien
accgcgcctgggtacacttgagctt

SEQ ID NO: 11193 - DNA, 25 bp, Homo sapien
ggcgcgcaagttggctagtctctgc

SEQ ID NO: 11194 - DNA, 25 bp, Homo sapien
gttggctagtctctgcggccacctc

SEQ ID NO: 11195 - DNA, 25 bp, Homo sapien
ggggtgttctccgtcctgatccagg

SEQ ID NO: 11196 - DNA, 25 bp, Homo sapien
gcacagcaggtccagaagccgcgaa

SEQ ID NO: 11197 - DNA, 25 bp, Homo sapien
tgaccaacgtcaactacaattccca

SEQ ID NO: 11198 - DNA, 25 bp, Homo sapien
atgacaaagctagcggaagagaagg

SEQ ID NO: 11199 - DNA, 25 bp, Homo sapien
ggcagcgaggttttccaggctcaaa

SEQ ID NO: 11200 - DNA, 25 bp, Homo sapien
tttccaggctcaaaatctccgggcg

SEQ ID NO: 11201 - DNA, 25 bp, Homo sapien
ggctcaaaatctccgggcggctctc

SEQ ID NO: 11202 - DNA, 25 bp, Homo sapien
gttcaccggcgggtctttccgagca

SEQ ID NO: 11203 - DNA, 25 bp, Homo sapien
cgggtctttccgagcacagttgctc

SEQ ID NO: 11204 - DNA, 25 bp, Homo sapien
cacccacgtggctgagcatttcttc

SEQ ID NO: 11205 - DNA, 25 bp, Homo sapien
cccgcctgatatgacaaagctagcg

SEQ ID NO: 11206 - DNA, 25 bp, Homo sapien
gcccaggcaaacatcagcagacgga

SEQ ID NO: 11207 - DNA, 25 bp, Homo sapien
tgcggaccgtcttcacggccttcgt

SEQ ID NO: 11208 - DNA, 25 bp, Homo sapien
ccagcgctaaccaggggtgcccaag

SEQ ID NO: 11209 - DNA, 25 bp, Homo sapien
agggaaacgtcacctgccaccagga

SEQ ID NO: 11210 - DNA, 25 bp, Homo sapien
tccacagggtcgctgagctccgatt

SEQ ID NO: 11211 - DNA, 25 bp, Homo sapien
ccgattcgaaggtgtggggcaccca

SEQ ID NO: 11212 - DNA, 25 bp, Homo sapien
ccacgaagatcagctcgaggttcgc

SEQ ID NO: 11213 - DNA, 25 bp, Homo sapien
gctgggcggttcctcgcccgcaatt

SEQ ID NO: 11214 - DNA, 25 bp, Homo sapien
tgcgtccgtgggaaataagccgaaa

SEQ ID NO: 11215 - DNA, 25 bp, Homo sapien
tcaggtccacgtagacgcagctgta

SEQ ID NO: 11216 - DNA, 25 bp, Homo sapien
gcggagtcagccacggaaatgttgt

SEQ ID NO: 11217 - DNA, 25 bp, Homo sapien
ccagtccttggatatctcacacgca

SEQ ID NO: 11218 - DNA, 25 bp, Homo sapien
cgcaccctttcactgtttcttagta

SEQ ID NO: 11219 - DNA, 25 bp, Homo sapien
gcatggcttgatgcctggtgcacga

SEQ ID NO: 11220 - DNA, 25 bp, Homo sapien
tgccgctcagtagtggatttgctcc

SEQ ID NO: 11221 - DNA, 25 bp, Homo sapien
tacacgtgacctacgggcttgcgtc

SEQ ID NO: 11222 - DNA, 25 bp, Homo sapien
attggagttccagctgaaggccttg

SEQ ID NO: 11223 - DNA, 25 bp, Homo sapien
actgggcgcacgcatgaggcttctc

SEQ ID NO: 11224 - DNA, 25 bp, Homo sapien
gcaccagcgtggtgcttcggccgaa

SEQ ID NO: 11225 - DNA, 25 bp, Homo sapien
agcccatgacgaaagcctggccgca

SEQ ID NO: 11226 - DNA, 25 bp, Homo sapien
ctccgccaggtaggagcccatgacg

SEQ ID NO: 11227 - DNA, 25 bp, Homo sapien
ttgccgcactccctgcaagcgtagg

SEQ ID NO: 11228 - DNA, 25 bp, Homo sapien
acgaacggcctctcgccagagtgca

SEQ ID NO: 11229 - DNA, 25 bp, Homo sapien
cgagctctcgcggaaagcctttccg

SEQ ID NO: 11230 - DNA, 25 bp, Homo sapien
ctggggactgatgaacgaataaatg

SEQ ID NO: 11231 - DNA, 25 bp, Homo sapien
ggcctaggctggacaaacaaatacg

SEQ ID NO: 11232 - DNA, 25 bp, Homo sapien
ctgatcgccataaggctcgcgttca

SEQ ID NO: 11233 - DNA, 25 bp, Homo sapien
ccagcctggtgagctccgaaactac

SEQ ID NO: 11234 - DNA, 25 bp, Homo sapien
ttgtccgaccagtcacgggtacttg

SEQ ID NO: 11235 - DNA, 25 bp, Homo sapien
tgcgtccactaggagcggcctgaaa

SEQ ID NO: 11236 - DNA, 25 bp, Homo sapien
aggcctatctctcggtggtcccaga

SEQ ID NO: 11237 - DNA, 25 bp, Homo sapien
gtccacgctgcgtgccctttctgag

SEQ ID NO: 11238 - DNA, 25 bp, Homo sapien
cctcctcgacgcagggttcgcttgg

SEQ ID NO: 11239 - DNA, 25 bp, Homo sapien
tttggccgcactcaggacacactgg

SEQ ID NO: 11240 - DNA, 25 bp, Homo sapien
ttgccgcactcgtcgcaagcgtaca

SEQ ID NO: 11241 - DNA, 25 bp, Homo sapien
tgctccacgaggtgcgagaacagcc

SEQ ID NO: 11242 - DNA, 25 bp, Homo sapien
actcggagcagccatagggccgctc

SEQ ID NO: 11243 - DNA, 25 bp, Homo sapien
agcagccgcggaaggtctttccgca

SEQ ID NO: 11244 - DNA, 25 bp, Homo sapien
gcaccaggctgcagttgcgcacgaa

SEQ ID NO: 11245 - DNA, 25 bp, Homo sapien
tgaaggccttttcgcacagtgggca

SEQ ID NO: 11246 - DNA, 25 bp, Homo sapien
cagaggccggctacacctaaaaggc

SEQ ID NO: 11247 - DNA, 25 bp, Homo sapien
acgtagtcccgtcatgtcccgcttt

SEQ ID NO: 11248 - DNA, 25 bp, Homo sapien
aggcttgggcttcggttatcataga

SEQ ID NO: 11249 - DNA, 25 bp, Homo sapien
gggcttcaatgacacccagcacgga

SEQ ID NO: 11250 - DNA, 25 bp, Homo sapien
cgtggacctaagtcgtcgccaaaga

SEQ ID NO: 11251 - DNA, 25 bp, Homo sapien
cgcccggaactcaaggtcgcgagtg

SEQ ID NO: 11252 - DNA, 25 bp, Homo sapien
ggtccgcgcagaatgccacttactc

SEQ ID NO: 11253 - DNA, 25 bp, Homo sapien
gtcccgctttgacgctgcggagaaa

SEQ ID NO: 11254 - DNA, 25 bp, Homo sapien
cttccacgggcgagattactgcata

SEQ ID NO: 11255 - DNA, 25 bp, Homo sapien
tctacgccgagtgacagagacgctc

SEQ ID NO: 11256 - DNA, 25 bp, Homo sapien
ggacacgatggccttttacgcaagc

SEQ ID NO: 11257 - DNA, 25 bp, Homo sapien
cctccggattggtctatagggacac

SEQ ID NO: 11258 - DNA, 25 bp, Homo sapien
gctgcgttggtctcacggaaatctc

SEQ ID NO: 11259 - DNA, 25 bp, Homo sapien
cgagcgctggccagacttttttctt

SEQ ID NO: 11260 - DNA, 25 bp, Homo sapien
aactgaactggctactcccgcggca

SEQ ID NO: 11261 - DNA, 25 bp, Homo sapien
tcctagggacggttcatggtctttc

SEQ ID NO: 11262 - DNA, 25 bp, Homo sapien
ttcaagctgcccaagcgcctggact

SEQ ID NO: 11263 - DNA, 25 bp, Homo sapien
tccttcgacggcgtgttcaagctgc

SEQ ID NO: 11264 - DNA, 25 bp, Homo sapien
gtctcgggcgtctacatcttcttcc

SEQ ID NO: 11265 - DNA, 25 bp, Homo sapien
cctgggtcttcaacgctgccgtggc

SEQ ID NO: 11266 - DNA, 25 bp, Homo sapien
tgcctggcgcgcctatcgttggcca

SEQ ID NO: 11267 - DNA, 25 bp, Homo sapien
tcttctgtctcgagtgcctggcgcg

SEQ ID NO: 11268 - DNA, 25 bp, Homo sapien
tggcttctcttggtttccgccgagg

SEQ ID NO: 11269 - DNA, 25 bp, Homo sapien
agtgcctcatctgcgtgtcgtcctt

SEQ ID NO: 11270 - DNA, 25 bp, Homo sapien
tgtcacccgcaggagggaccgcaca

SEQ ID NO: 11271 - DNA, 25 bp, Homo sapien
gggcatttcctgtgtcacccgcagg

SEQ ID NO: 11272 - DNA, 25 bp, Homo sapien
tttcctgtgtcacccgcaggaggga

SEQ ID NO: 11273 - DNA, 25 bp, Homo sapien
agcatgtgaagctcggggcatttcc

SEQ ID NO: 11274 - DNA, 25 bp, Homo sapien
cctgcagcacgggtgagcctgcagc

SEQ ID NO: 11275 - DNA, 25 bp, Homo sapien
aagcgtcggttcgttcccctgcagc

SEQ ID NO: 11276 - DNA, 25 bp, Homo sapien
cagggtgcccttcccaagcgtcggt

SEQ ID NO: 11277 - DNA, 25 bp, Homo sapien
acacgggacactgtcccagtcgcag

SEQ ID NO: 11278 - DNA, 25 bp, Homo sapien
tcaaccgcacgtgctggcatccttg

SEQ ID NO: 11279 - DNA, 25 bp, Homo sapien
cgggactctggtcgccataacaact

SEQ ID NO: 11280 - DNA, 25 bp, Homo sapien
gggagcgtcactgtccagactgaca

SEQ ID NO: 11281 - DNA, 25 bp, Homo sapien
tgccgcagccctattacgtgaggta

SEQ ID NO: 11282 - DNA, 25 bp, Homo sapien
ttgccatgacgaccacgttgcgctg

SEQ ID NO: 11283 - DNA, 25 bp, Homo sapien
cggcaccctcttgtgatcaggcgga

SEQ ID NO: 11284 - DNA, 25 bp, Homo sapien
cgtgcatacgaatctgggtcctgga

SEQ ID NO: 11285 - DNA, 25 bp, Homo sapien
ctggaagcgttctgcaagatccctt

SEQ ID NO: 11286 - DNA, 25 bp, Homo sapien
cccaggaagtctgatggctccggtc

SEQ ID NO: 11287 - DNA, 25 bp, Homo sapien
aaggagccaccttccgagtacgcga

SEQ ID NO: 11288 - DNA, 25 bp, Homo sapien
aatgcatttccttcccgactccgag

SEQ ID NO: 11289 - DNA, 25 bp, Homo sapien
ggtcctgcttccagaacctttggca

SEQ ID NO: 11290 - DNA, 25 bp, Homo sapien
acccgcacaggcgtcaaatgtcttc

SEQ ID NO: 11291 - DNA, 25 bp, Homo sapien
gtcttcggactgaaactagcaggtg

SEQ ID NO: 11292 - DNA, 25 bp, Homo sapien
aggtccgtgtcacctgtggcttcca

SEQ ID NO: 11293 - DNA, 25 bp, Homo sapien
tgcctccagaccttcgttccgggaa

SEQ ID NO: 11294 - DNA, 25 bp, Homo sapien
ggaaatgtagttcacgtcccgcttc

SEQ ID NO: 11295 - DNA, 25 bp, Homo sapien
tcagacttatcgctcgcggacaggc

SEQ ID NO: 11296 - DNA, 25 bp, Homo sapien
ggttccctgtcttcggacgcatttc

SEQ ID NO: 11297 - DNA, 25 bp, Homo sapien
ccttcgttcgtttctgcggaccagc

SEQ ID NO: 11298 - DNA, 25 bp, Homo sapien
aggtcaccggggttcagcaacattc

SEQ ID NO: 11299 - DNA, 25 bp, Homo sapien
attcactgcggctaggacgcgtaca

SEQ ID NO: 11300 - DNA, 25 bp, Homo sapien
tacaggtcactgaggcagaacttcc

SEQ ID NO: 11301 - DNA, 25 bp, Homo sapien
ccacgtcgaggctccttatgggaaa

SEQ ID NO: 11302 - DNA, 25 bp, Homo sapien
ccgtctatgacgctatttccctatg

SEQ ID NO: 11303 - DNA, 25 bp, Homo sapien
tggctccactttcgggaacaccttg

SEQ ID NO: 11304 - DNA, 25 bp, Homo sapien
cgcccttggcgttatgttggcttta

SEQ ID NO: 11305 - DNA, 25 bp, Homo sapien
tgccttagataaagccggcccagtg

SEQ ID NO: 11306 - DNA, 25 bp, Homo sapien
atgcccgtcacgctactgctaggtc

SEQ ID NO: 11307 - DNA, 25 bp, Homo sapien
cttgccactggtccgagctttcatt

SEQ ID NO: 11308 - DNA, 25 bp, Homo sapien
gcctctcaatgacagctcggacttg

SEQ ID NO: 11309 - DNA, 25 bp, Homo sapien
cggagtgtaagacgctggccaatca

SEQ ID NO: 11310 - DNA, 25 bp, Homo sapien
ggaaccacataacccagaaggctgt

SEQ ID NO: 11311 - DNA, 25 bp, Homo sapien
cctccgcgccgaaaaacaggcagga

SEQ ID NO: 11312 - DNA, 25 bp, Homo sapien
cgcattgggcattctgcgcccatga

SEQ ID NO: 11313 - DNA, 25 bp, Homo sapien
cgcgtattggggcaatgtgagctct

SEQ ID NO: 11314 - DNA, 25 bp, Homo sapien
actgtcacttggctgctcgcgtcag

SEQ ID NO: 11315 - DNA, 25 bp, Homo sapien
tcttcgagtatgacgtggtcggccc

SEQ ID NO: 11316 - DNA, 25 bp, Homo sapien
accagtgccacggagcccttggaaa

SEQ ID NO: 11317 - DNA, 25 bp, Homo sapien
gcagctgcgctactccatttccagg

SEQ ID NO: 11318 - DNA, 25 bp, Homo sapien
atcgcagaatgggcgcagcttggca

SEQ ID NO: 11319 - DNA, 25 bp, Homo sapien
cagggatcgcagaatgggcgcagct

SEQ ID NO: 11320 - DNA, 25 bp, Homo sapien
ggaatgcctcggacctgaaggccgc

SEQ ID NO: 11321 - DNA, 25 bp, Homo sapien
aatgcctcggacctgaaggccgcca

SEQ ID NO: 11322 - DNA, 25 bp, Homo sapien
tgcctcggacctgaaggccgccagt

SEQ ID NO: 11323 - DNA, 25 bp, Homo sapien
gcctcggacctgaaggccgccagtg

SEQ ID NO: 11324 - DNA, 25 bp, Homo sapien
ctcggacctgaaggccgccagtggt

SEQ ID NO: 11325 - DNA, 25 bp, Homo sapien
ccagtggtggcagggatcgcagaat

SEQ ID NO: 11326 - DNA, 25 bp, Homo sapien
aagtccttccgctgctccgagtgcg

SEQ ID NO: 11327 - DNA, 25 bp, Homo sapien
ctcatagactcctcggtggccagga

SEQ ID NO: 11328 - DNA, 25 bp, Homo sapien
gccttcagccagacgtcgcacttga

SEQ ID NO: 11329 - DNA, 25 bp, Homo sapien
cagcaaagtgttcgtgaagagctcc

SEQ ID NO: 11330 - DNA, 25 bp, Homo sapien
tccttcgaatgcagggcgtgcagca

SEQ ID NO: 11331 - DNA, 25 bp, Homo sapien
aggctcttcacgctggggagaagtc

SEQ ID NO: 11332 - DNA, 25 bp, Homo sapien
tcgcacctgatccagcacgagcgta

SEQ ID NO: 11333 - DNA, 25 bp, Homo sapien
ggcgtccttatgcttgcgcacagtg

SEQ ID NO: 11334 - DNA, 25 bp, Homo sapien
ttggacgttgccaaggagaccggta

SEQ ID NO: 11335 - DNA, 25 bp, Homo sapien
gctgggtggtccacgcctttcttcc

SEQ ID NO: 11336 - DNA, 25 bp, Homo sapien
cacgtccatgatggccggggagact

SEQ ID NO: 11337 - DNA, 25 bp, Homo sapien
tgggcgttccacgtccatgatggcc

SEQ ID NO: 11338 - DNA, 25 bp, Homo sapien
cctctgtttctcagagtgcgtcgtg

SEQ ID NO: 11339 - DNA, 25 bp, Homo sapien
cgcacgcgtcgtgatcaagggcgcc

SEQ ID NO: 11340 - DNA, 25 bp, Homo sapien
ccaatgagaaccgaagggctggact

SEQ ID NO: 11341 - DNA, 25 bp, Homo sapien
acgtgacccggaaggctgtacgcaa

SEQ ID NO: 11342 - DNA, 25 bp, Homo sapien
cgagaagaccgtccggcgatccagg

SEQ ID NO: 11343 - DNA, 25 bp, Homo sapien
ccggcggtcggggacatcaccgaat

SEQ ID NO: 11344 - DNA, 25 bp, Homo sapien
tcggggacatcaccgaatgggtgca

SEQ ID NO: 11345 - DNA, 25 bp, Homo sapien
atcaccgaatgggtgcagtttggca

SEQ ID NO: 11346 - DNA, 25 bp, Homo sapien
ccaccagaggatccataccggcgag

SEQ ID NO: 11347 - DNA, 25 bp, Homo sapien
cagaggatccataccggcgagaaga

SEQ ID NO: 11348 - DNA, 25 bp, Homo sapien
tccataccggcgagaagaccgtccg

SEQ ID NO: 11349 - DNA, 25 bp, Homo sapien
tccctgggagaacctttgggagcgc

SEQ ID NO: 11350 - DNA, 25 bp, Homo sapien
tcgcacctgatccagcacgagcgta

SEQ ID NO: 11351 - DNA, 25 bp, Homo sapien
ggcgtccttatgcttgcgcacagtg

SEQ ID NO: 11352 - DNA, 25 bp, Homo sapien
aagtccttccgctgctccgagtgcg

SEQ ID NO: 11353 - DNA, 25 bp, Homo sapien
gccttcagccagacgtcgcacttga

SEQ ID NO: 11354 - DNA, 25 bp, Homo sapien
cagcaaagtgttcgtgaagagctcc

SEQ ID NO: 11355 - DNA, 25 bp, Homo sapien
tccttcgaatgcagggcgtgcagca

SEQ ID NO: 11356 - DNA, 25 bp, Homo sapien
ccatgtgcacaggaggtccctggga

SEQ ID NO: 11357 - DNA, 25 bp, Homo sapien
ctcatagactcctcggtggccagga

SEQ ID NO: 11358 - DNA, 25 bp, Homo sapien
ttataacccgggaagagctgctctc

SEQ ID NO: 11359 - DNA, 25 bp, Homo sapien
cttggaagcgagtcccagcgaacta

SEQ ID NO: 11360 - DNA, 25 bp, Homo sapien
ctcttcggaagtcgaggcaacgctc

SEQ ID NO: 11361 - DNA, 25 bp, Homo sapien
acgctcctgaacgttgccacgggaa

SEQ ID NO: 11362 - DNA, 25 bp, Homo sapien
cccactgtacagacgcgcaagttta

SEQ ID NO: 11363 - DNA, 25 bp, Homo sapien
ggactctgccgtacctcctagagga

SEQ ID NO: 11364 - DNA, 25 bp, Homo sapien
tgggcgtctttcactgcagaccttc

SEQ ID NO: 11365 - DNA, 25 bp, Homo sapien
ggcggatatgccctagcgttatcta

SEQ ID NO: 11366 - DNA, 25 bp, Homo sapien
tagccaccggggaaagcacagagaa

SEQ ID NO: 11367 - DNA, 25 bp, Homo sapien
cggcttcgactggaagtcagtgttc

SEQ ID NO: 11368 - DNA, 25 bp, Homo sapien
agtgttcgtcatccaccaccggaca

SEQ ID NO: 11369 - DNA, 25 bp, Homo sapien
gcacagagaagccaccacaagggga

SEQ ID NO: 11370 - DNA, 25 bp, Homo sapien
tgcagcttcagctggaagtcgcagc

SEQ ID NO: 11371 - DNA, 25 bp, Homo sapien
gccagcggcgtcacttctgcagtga

SEQ ID NO: 11372 - DNA, 25 bp, Homo sapien
gccgcgccttcgactggaagtcgca

SEQ ID NO: 11373 - DNA, 25 bp, Homo sapien
aggttccatgagcagccagacagca

SEQ ID NO: 11374 - DNA, 25 bp, Homo sapien
gttgtagtaaacgtcgcccgattgc

SEQ ID NO: 11375 - DNA, 25 bp, Homo sapien
cccgccttcgcgtgagaagtcctga

SEQ ID NO: 11376 - DNA, 25 bp, Homo sapien
gttctcgcccttccatctgcaagga

SEQ ID NO: 11377 - DNA, 25 bp, Homo sapien
tccgccctcttacgacaggaaagtc

SEQ ID NO: 11378 - DNA, 25 bp, Homo sapien
cagcctgactccctctaggatctga

SEQ ID NO: 11379 - DNA, 25 bp, Homo sapien
taggatctgaaagcgtccgtggccc

SEQ ID NO: 11380 - DNA, 25 bp, Homo sapien
gaagccttcgcggtccatggccagt

SEQ ID NO: 11381 - DNA, 25 bp, Homo sapien
agaagtcctgactccaagttccgcc

SEQ ID NO: 11382 - DNA, 25 bp, Homo sapien
tcccaaggcaggtcacacgggcaac

SEQ ID NO: 11383 - DNA, 25 bp, Homo sapien
gacacccacgcccagagtgagaaaa

SEQ ID NO: 11384 - DNA, 25 bp, Homo sapien
ctcaagtgacgctgcaccctggaca

SEQ ID NO: 11385 - DNA, 25 bp, Homo sapien
tgaggactcgcgtgccctcaagtga

SEQ ID NO: 11386 - DNA, 25 bp, Homo sapien
gtgagaaaactccagacgatgaccc

SEQ ID NO: 11387 - DNA, 25 bp, Homo sapien
cggcagctgatttcaggggtcttca

SEQ ID NO: 11388 - DNA, 25 bp, Homo sapien
gcacactgtcttcaacagacccttg

SEQ ID NO: 11389 - DNA, 25 bp, Homo sapien
ggaacctgagactgcgctccatcta

SEQ ID NO: 11390 - DNA, 25 bp, Homo sapien
tccggcggcatcaacaccttgttgt

SEQ ID NO: 11391 - DNA, 25 bp, Homo sapien
accttgttgttctgtgtgcaccacc

SEQ ID NO: 11392 - DNA, 25 bp, Homo sapien
gtgcaaatccgcgatgactacgtca

SEQ ID NO: 11393 - DNA, 25 bp, Homo sapien
tacgtcacaccagaagtcggccctg

SEQ ID NO: 11394 - DNA, 25 bp, Homo sapien
cccgtaaccgcagtagcgcagaagc

SEQ ID NO: 11395 - DNA, 25 bp, Homo sapien
gcagctgcccgcacgtggtaatgat

SEQ ID NO: 11396 - DNA, 25 bp, Homo sapien
tggtaatgatcgtggccacccagta

SEQ ID NO: 11397 - DNA, 25 bp, Homo sapien
tggcggctcgtaaatcgaagccttt

SEQ ID NO: 11398 - DNA, 25 bp, Homo sapien
cgttgagcgagctcttctgcgtgaa

SEQ ID NO: 11399 - DNA, 25 bp, Homo sapien
tagagagaaggatcgccagcacacg

SEQ ID NO: 11400 - DNA, 25 bp, Homo sapien
tagtcgcgtagagagaaggatcgcc

SEQ ID NO: 11401 - DNA, 25 bp, Homo sapien
gcgtgaccatgtgtttgagcaggta

SEQ ID NO: 11402 - DNA, 25 bp, Homo sapien
agcgtggtctagtggcgggaaccac

SEQ ID NO: 11403 - DNA, 25 bp, Homo sapien
catgtgcacgttgagcgagctcttc

SEQ ID NO: 11404 - DNA, 25 bp, Homo sapien
atgtgtttgagcaggtagtcgcgta

SEQ ID NO: 11405 - DNA, 25 bp, Homo sapien
cgcgcacgccggtgtgcgtgaccat

SEQ ID NO: 11406 - DNA, 25 bp, Homo sapien
tcgtcgtgccaagtggatacatagc

SEQ ID NO: 11407 - DNA, 25 bp, Homo sapien
ccatcctcgtcgtgccaagtggata

SEQ ID NO: 11408 - DNA, 25 bp, Homo sapien
cctcgtcgtgccaagtggatacata

SEQ ID NO: 11409 - DNA, 25 bp, Homo sapien
cgtcgtgccaagtggatacatagct

SEQ ID NO: 11410 - DNA, 25 bp, Homo sapien
ccggcaccactgtagtcagcgaggc

SEQ ID NO: 11411 - DNA, 25 bp, Homo sapien
ggcaccactgtagtcagcgaggcca

SEQ ID NO: 11412 - DNA, 25 bp, Homo sapien
cgccatcctcgtcgtgccaagtgga

SEQ ID NO: 11413 - DNA, 25 bp, Homo sapien
tcccggcaccactgtagtcagcgag

SEQ ID NO: 11414 - DNA, 25 bp, Homo sapien
ggaactctaccagctgtcgcactgt

SEQ ID NO: 11415 - DNA, 25 bp, Homo sapien
tgtcgcactgtctgcgcgggcacca

SEQ ID NO: 11416 - DNA, 25 bp, Homo sapien
agctgtcgcactgtctgcgcgggca

SEQ ID NO: 11417 - DNA, 25 bp, Homo sapien
taccagctgtcgcactgtctgcgcg

SEQ ID NO: 11418 - DNA, 25 bp, Homo sapien
tctaccagctgtcgcactgtctgcg

SEQ ID NO: 11419 - DNA, 25 bp, Homo sapien
actctaccagctgtcgcactgtctg

SEQ ID NO: 11420 - DNA, 25 bp, Homo sapien
ttgtcttggaagaagggtgagccgg

SEQ ID NO: 11421 - DNA, 25 bp, Homo sapien
gaactctaccagctgtcgcactgtc

SEQ ID NO: 11422 - DNA, 25 bp, Homo sapien
atcgtcactttcctcgtcatcctcg

SEQ ID NO: 11423 - DNA, 25 bp, Homo sapien
agggcttcaccctgcgccacaacga

SEQ ID NO: 11424 - DNA, 25 bp, Homo sapien
atgcgaagcactgacgcggccgtga

SEQ ID NO: 11425 - DNA, 25 bp, Homo sapien
aactgtctgtatgcgaagcactgac

SEQ ID NO: 11426 - DNA, 25 bp, Homo sapien
tgcttacggctgtgtgcagcaccgg

SEQ ID NO: 11427 - DNA, 25 bp, Homo sapien
ctggcgctgcttacggctgtgtgca

SEQ ID NO: 11428 - DNA, 25 bp, Homo sapien
acagtgaggggtcagcatcaggccc

SEQ ID NO: 11429 - DNA, 25 bp, Homo sapien
tcctcgtcacctcggtcatcagggg

SEQ ID NO: 11430 - DNA, 25 bp, Homo sapien
gccggcctggacacttcagaacaaa

SEQ ID NO: 11431 - DNA, 25 bp, Homo sapien
tggaccagagcactcttccggcgtc

SEQ ID NO: 11432 - DNA, 25 bp, Homo sapien
cttgcgcatcaacccgagagacttg

SEQ ID NO: 11433 - DNA, 25 bp, Homo sapien
cgtcgcgaggaatgtctggaccaga

SEQ ID NO: 11434 - DNA, 25 bp, Homo sapien
tctcctcttagtcggaaccaaagtc

SEQ ID NO: 11435 - DNA, 25 bp, Homo sapien
ccggtatttttatggcgatcagctc

SEQ ID NO: 11436 - DNA, 25 bp, Homo sapien
ctcgcgttctcagcgtgcgcttcta

SEQ ID NO: 11437 - DNA, 25 bp, Homo sapien
gtgctttactccgagcgcgttctcc

SEQ ID NO: 11438 - DNA, 25 bp, Homo sapien
ccaccacgttttcaacgcgctgata

SEQ ID NO: 11439 - DNA, 25 bp, Homo sapien
ttcaacgcgctgatagtccctaggc

SEQ ID NO: 11440 - DNA, 25 bp, Homo sapien
ctgcagccacgtgcggacacctggg

SEQ ID NO: 11441 - DNA, 25 bp, Homo sapien
ggctagccacctttacctgtgcgcg

SEQ ID NO: 11442 - DNA, 25 bp, Homo sapien
cacctttacctgtgcgcgccttggg

SEQ ID NO: 11443 - DNA, 25 bp, Homo sapien
tggcgaatgggtttcatggttgttc

SEQ ID NO: 11444 - DNA, 25 bp, Homo sapien
ccagccgttgtcacctggaccggag

SEQ ID NO: 11445 - DNA, 25 bp, Homo sapien
gtttcatggttgttcgcgccagtcc

SEQ ID NO: 11446 - DNA, 25 bp, Homo sapien
tccgctggcggcgaaaagcgctcca

SEQ ID NO: 11447 - DNA, 25 bp, Homo sapien
tgccctgtttgcactcggcctgtag

SEQ ID NO: 11448 - DNA, 25 bp, Homo sapien
gcgtcggcgccagttatttctgtcc

SEQ ID NO: 11449 - DNA, 25 bp, Homo sapien
cccactggcggattcaattgcggca

SEQ ID NO: 11450 - DNA, 25 bp, Homo sapien
ggggaatcacactctataaaggttc

SEQ ID NO: 11451 - DNA, 25 bp, Homo sapien
acagcggcccgcttctgtgtggtct

SEQ ID NO: 11452 - DNA, 25 bp, Homo sapien
cggattgcccatgcgcttgggcgca

SEQ ID NO: 11453 - DNA, 25 bp, Homo sapien
cagaggctggagacgactctacggc

SEQ ID NO: 11454 - DNA, 25 bp, Homo sapien
ggatgatggagattcggtcgcacta

SEQ ID NO: 11455 - DNA, 25 bp, Homo sapien
tgcgcgtccgagtgtttcatgtttt

SEQ ID NO: 11456 - DNA, 25 bp, Homo sapien
agcgcatgcgcaacagctcccgttt

SEQ ID NO: 11457 - DNA, 25 bp, Homo sapien
gggtcacgcttctctttctgggatc

SEQ ID NO: 11458 - DNA, 25 bp, Homo sapien
cctcgatgttgacgacagggtccca

SEQ ID NO: 11459 - DNA, 25 bp, Homo sapien
cccggcaccaaagcaaggtggtgtt

SEQ ID NO: 11460 - DNA, 25 bp, Homo sapien
ttcatgttttgagtcccgcccgagt

SEQ ID NO: 11461 - DNA, 25 bp, Homo sapien
gtcgcactatacaccgaggacagtc

SEQ ID NO: 11462 - DNA, 25 bp, Homo sapien
ttgcaggtcacttccggcgactttc

SEQ ID NO: 11463 - DNA, 25 bp, Homo sapien
tttccgttcatggagatgacgcttc

SEQ ID NO: 11464 - DNA, 25 bp, Homo sapien
ttttgctcgcggtcacttcatctta

SEQ ID NO: 11465 - DNA, 25 bp, Homo sapien
agtgagactagatgcgttacccaga

SEQ ID NO: 11466 - DNA, 25 bp, Homo sapien
tgggcctcaagttccagcggacacg

SEQ ID NO: 11467 - DNA, 25 bp, Homo sapien
gggtcagcttcccatccaatcacag

SEQ ID NO: 11468 - DNA, 25 bp, Homo sapien
cccgcgttgctcagcgatggagttt

SEQ ID NO: 11469 - DNA, 25 bp, Homo sapien
ggcctgcctttgaccctatgggtca

SEQ ID NO: 11470 - DNA, 25 bp, Homo sapien
ctcgctgcacacgaatggtcgctca

SEQ ID NO: 11471 - DNA, 25 bp, Homo sapien
atcttctggtgcctcagcaggttgc

SEQ ID NO: 11472 - DNA, 25 bp, Homo sapien
tgtgcactctccgatgctcttccag

SEQ ID NO: 11473 - DNA, 25 bp, Homo sapien
ctggccgcactcagcgcaacggaaa

SEQ ID NO: 11474 - DNA, 25 bp, Homo sapien
tctcgcggcactcgctgcacggaaa

SEQ ID NO: 11475 - DNA, 25 bp, Homo sapien
gtcctctgatgacgcgtgagcttga

SEQ ID NO: 11476 - DNA, 25 bp, Homo sapien
actcaccgcagtggtagggcttttc

SEQ ID NO: 11477 - DNA, 25 bp, Homo sapien
tgctgcgttggctgaacaccttgcc

SEQ ID NO: 11478 - DNA, 25 bp, Homo sapien
ggcccgatgctttccggcagatgta

SEQ ID NO: 11479 - DNA, 25 bp, Homo sapien
ccaaagcctgtcgtcgtggcaacga

SEQ ID NO: 11480 - DNA, 25 bp, Homo sapien
gggccctgaacgtctccatggtaac

SEQ ID NO: 11481 - DNA, 25 bp, Homo sapien
gcgcgatgacgttcctctgtgatca

SEQ ID NO: 11482 - DNA, 25 bp, Homo sapien
cggtggtcgcaatgatcaggtcata

SEQ ID NO: 11483 - DNA, 25 bp, Homo sapien
tcggcatgcgcaagcctctcaggta

SEQ ID NO: 11484 - DNA, 25 bp, Homo sapien
gaaggggcctctgctacttcctaga

SEQ ID NO: 11485 - DNA, 25 bp, Homo sapien
tctacgggccttcctgagattagca

SEQ ID NO: 11486 - DNA, 25 bp, Homo sapien
gccgagcgctaagctgtccatgcag

SEQ ID NO: 11487 - DNA, 25 bp, Homo sapien
ccctgtggctggttggctaatagat

SEQ ID NO: 11488 - DNA, 25 bp, Homo sapien
cccgcctcctctgtcttatgattgg

SEQ ID NO: 11489 - DNA, 25 bp, Homo sapien
tcaggatcccgccaaacttttgaca

SEQ ID NO: 11490 - DNA, 25 bp, Homo sapien
ccgtggggctctaaagaaagcattc

SEQ ID NO: 11491 - DNA, 25 bp, Homo sapien
gcttgtcgcttctcccttcacagga

SEQ ID NO: 11492 - DNA, 25 bp, Homo sapien
gacttctactcctccgtaggctgga

SEQ ID NO: 11493 - DNA, 25 bp, Homo sapien
gtcattacttcgcagagaggtccct

SEQ ID NO: 11494 - DNA, 25 bp, Homo sapien
ctcacacgtgcatccgcggctaccc

SEQ ID NO: 11495 - DNA, 25 bp, Homo sapien
ccacgtgcgcgctcacacgtgcatc

SEQ ID NO: 11496 - DNA, 25 bp, Homo sapien
gtctggcgtccaccagggcgcgccc

SEQ ID NO: 11497 - DNA, 25 bp, Homo sapien
ccctccctgtggtccgggggtgcat

SEQ ID NO: 11498 - DNA, 25 bp, Homo sapien
cgcccagaccgagggaggtgggact

SEQ ID NO: 11499 - DNA, 25 bp, Homo sapien
tgggtcttctggtgttgtccccgtc

SEQ ID NO: 11500 - DNA, 25 bp, Homo sapien
aaactcgggcgcgtcatgggaagaa

SEQ ID NO: 11501 - DNA, 25 bp, Homo sapien
gggacacggagcttcgccagactcc

SEQ ID NO: 11502 - DNA, 25 bp, Homo sapien
tgcggcctcgttgccaaactacatt

SEQ ID NO: 11503 - DNA, 25 bp, Homo sapien
gctcggcgtcctccggaaaactgca

SEQ ID NO: 11504 - DNA, 25 bp, Homo sapien
tgtagacccgctacacgggacggta

SEQ ID NO: 11505 - DNA, 25 bp, Homo sapien
acggtacccgcctaagaccatactg

SEQ ID NO: 11506 - DNA, 25 bp, Homo sapien
actgggatatgaggccactgtgtcc

SEQ ID NO: 11507 - DNA, 25 bp, Homo sapien
gaccatactgcgcaggtgctgatct

SEQ ID NO: 11508 - DNA, 25 bp, Homo sapien
gttctttggcccagatctgcgtgga

SEQ ID NO: 11509 - DNA, 25 bp, Homo sapien
gctgatctgagtctgggtccctcct

SEQ ID NO: 11510 - DNA, 25 bp, Homo sapien
tggccaccattcgtgacaacaagga

SEQ ID NO: 11511 - DNA, 25 bp, Homo sapien
acgctcgcgattactgaggcatctg

SEQ ID NO: 11512 - DNA, 25 bp, Homo sapien
gagaaagcccacagcccgttcgaga

SEQ ID NO: 11513 - DNA, 25 bp, Homo sapien
tccagcgttaatgcgcagggtgatc

SEQ ID NO: 11514 - DNA, 25 bp, Homo sapien
tttaaggcgcgccacagcttgagca

SEQ ID NO: 11515 - DNA, 25 bp, Homo sapien
ccctcagtgtggtgctcattcggga

SEQ ID NO: 11516 - DNA, 25 bp, Homo sapien
tcgcaaggccatcaacctacaggtg

SEQ ID NO: 11517 - DNA, 25 bp, Homo sapien
cgcagcgtgcaagaatccagcgtta

SEQ ID NO: 11518 - DNA, 25 bp, Homo sapien
cacgccgtggccacatcatatttca

SEQ ID NO: 11519 - DNA, 25 bp, Homo sapien
ccgtatttcagcgtgtggatggcca

SEQ ID NO: 11520 - DNA, 25 bp, Homo sapien
gtggccacatcatatttcagcgtgt

SEQ ID NO: 11521 - DNA, 25 bp, Homo sapien
ggccataccatagccacgtcatatt

SEQ ID NO: 11522 - DNA, 25 bp, Homo sapien
tttcagcgtgtggatggccatacca

SEQ ID NO: 11523 - DNA, 25 bp, Homo sapien
gccgtggccacatcatatttcagcg

SEQ ID NO: 11524 - DNA, 25 bp, Homo sapien
cgtggccacgtcatatttcagtgtg

SEQ ID NO: 11525 - DNA, 25 bp, Homo sapien
cgccgtggccacgtcatatttcagt

SEQ ID NO: 11526 - DNA, 25 bp, Homo sapien
gaagcgcgccgcttcttgtaaacgg

SEQ ID NO: 11527 - DNA, 25 bp, Homo sapien
gcgcgccgcttcttgtaaacggttc

SEQ ID NO: 11528 - DNA, 25 bp, Homo sapien
cagccttggaaacgcgattagatta

SEQ ID NO: 11529 - DNA, 25 bp, Homo sapien
gattatcccggctgggaacggcagc

SEQ ID NO: 11530 - DNA, 25 bp, Homo sapien
ggggttatcgatcgcagccttggaa

SEQ ID NO: 11531 - DNA, 25 bp, Homo sapien
cgccgcctcggggttatcgatcgca

SEQ ID NO: 11532 - DNA, 25 bp, Homo sapien
ttatcgatcgcagccttggaaacgc

SEQ ID NO: 11533 - DNA, 25 bp, Homo sapien
cgcgattagattatcccggctggga

SEQ ID NO: 11534 - DNA, 25 bp, Homo sapien
gatcaataggtccatcggccgccgg

SEQ ID NO: 11535 - DNA, 25 bp, Homo sapien
tatctcccatggaaggacccagttc

SEQ ID NO: 11536 - DNA, 25 bp, Homo sapien
tggaaggacccagttcctgaattgc

SEQ ID NO: 11537 - DNA, 25 bp, Homo sapien
cggcactcctatctcccatggaagg

SEQ ID NO: 11538 - DNA, 25 bp, Homo sapien
aagcgcggctcatcagggcgcctgc

SEQ ID NO: 11539 - DNA, 25 bp, Homo sapien
cccggaagatgcaccgtggataagg

SEQ ID NO: 11540 - DNA, 25 bp, Homo sapien
cgtggataaggccatgcgatcaata

SEQ ID NO: 11541 - DNA, 25 bp, Homo sapien
aggccatgcgatcaataggtccatc

SEQ ID NO: 11542 - DNA, 25 bp, Homo sapien
ggtttacactgaatccacaaaaatc

SEQ ID NO: 11543 - DNA, 25 bp, Homo sapien
tcgatcgctctctgctgatcggtgc

SEQ ID NO: 11544 - DNA, 25 bp, Homo sapien
agccatcgatcgctctctgctgatc

SEQ ID NO: 11545 - DNA, 25 bp, Homo sapien
cgaagcttgaaaagtgctcaataag

SEQ ID NO: 11546 - DNA, 25 bp, Homo sapien
ggctgcggtttacactgaatccaca

SEQ ID NO: 11547 - DNA, 25 bp, Homo sapien
cccaggctgcggtttacactgaatc

SEQ ID NO: 11548 - DNA, 25 bp, Homo sapien
atcgctctctgctgatcggtgccgc

SEQ ID NO: 11549 - DNA, 25 bp, Homo sapien
aagtgctcaataagccatcgatcgc

SEQ ID NO: 11550 - DNA, 25 bp, Homo sapien
attgacccgtctcttatcttgggga

SEQ ID NO: 11551 - DNA, 25 bp, Homo sapien
gctgccgacgctattgctgccatta

SEQ ID NO: 11552 - DNA, 25 bp, Homo sapien
tgctgccattactattacggagaga

SEQ ID NO: 11553 - DNA, 25 bp, Homo sapien
cccggaagcccttcctgagcttatt

SEQ ID NO: 11554 - DNA, 25 bp, Homo sapien
gcggccacctccaggatacagcgga

SEQ ID NO: 11555 - DNA, 25 bp, Homo sapien
gctggaccatcttggaagaaaactt

SEQ ID NO: 11556 - DNA, 25 bp, Homo sapien
ttatcttggggacgcacggttccag

SEQ ID NO: 11557 - DNA, 25 bp, Homo sapien
gagcttattcagtgcctggggccgc

SEQ ID NO: 11558 - DNA, 25 bp, Homo sapien
ttacggttggcagcatcgacaagca

SEQ ID NO: 11559 - DNA, 25 bp, Homo sapien
agcccggagcttcgcgtttgatccc

SEQ ID NO: 11560 - DNA, 25 bp, Homo sapien
cgatatctgacgaggtgctggcctt

SEQ ID NO: 11561 - DNA, 25 bp, Homo sapien
tggagcagcccattaagcgattttt

SEQ ID NO: 11562 - DNA, 25 bp, Homo sapien
acccacctgagtgagcctggagcag

SEQ ID NO: 11563 - DNA, 25 bp, Homo sapien
agtatcaccgtcctttctcggccag

SEQ ID NO: 11564 - DNA, 25 bp, Homo sapien
cgccgaagggttattagcagatgcc

SEQ ID NO: 11565 - DNA, 25 bp, Homo sapien
gcgagccgcctcgataaactattcc

SEQ ID NO: 11566 - DNA, 25 bp, Homo sapien
agacgattccaacggcgtccagtga

SEQ ID NO: 11567 - DNA, 25 bp, Homo sapien
cccggcgcaaacaagcgcggtgttt

SEQ ID NO: 11568 - DNA, 25 bp, Homo sapien
ctctaattgtgtcccagaactctgg

SEQ ID NO: 11569 - DNA, 25 bp, Homo sapien
cagcgtgttactttctagatgggga

SEQ ID NO: 11570 - DNA, 25 bp, Homo sapien
cgatgaggattcgatggagccgctc

SEQ ID NO: 11571 - DNA, 25 bp, Homo sapien
acgaactggttttctcctgagcgca

SEQ ID NO: 11572 - DNA, 25 bp, Homo sapien
gtggtttaactcagcgccgggatcc

SEQ ID NO: 11573 - DNA, 25 bp, Homo sapien
gggcatagaattccctcctctaatt

SEQ ID NO: 11574 - DNA, 25 bp, Homo sapien
acccgggcgtgcactcacatttaca

SEQ ID NO: 11575 - DNA, 25 bp, Homo sapien
ctcgcaggcaggaactcagactctg

SEQ ID NO: 11576 - DNA, 25 bp, Homo sapien
ctcatgctctatggagcacccaagg

SEQ ID NO: 11577 - DNA, 25 bp, Homo sapien
ttccggagaatcacacccgggcgtg

SEQ ID NO: 11578 - DNA, 25 bp, Homo sapien
ctgtgatcaggacctgcccgtctgg

SEQ ID NO: 11579 - DNA, 25 bp, Homo sapien
tcccgtaggacagaaggagtgctca

SEQ ID NO: 11580 - DNA, 25 bp, Homo sapien
tctccctgaatgtagagtcccgtcc

SEQ ID NO: 11581 - DNA, 25 bp, Homo sapien
ctgtctgtgcatgaagcagtgcccg

SEQ ID NO: 11582 - DNA, 25 bp, Homo sapien
ggggtcgacttaagataatctggtc

SEQ ID NO: 11583 - DNA, 25 bp, Homo sapien
gtaggggtcgacttaagataatctg

SEQ ID NO: 11584 - DNA, 25 bp, Homo sapien
tcgacttaagataatctggtccagg

SEQ ID NO: 11585 - DNA, 25 bp, Homo sapien
taatctggtccaggggttctgctct

SEQ ID NO: 11586 - DNA, 25 bp, Homo sapien
ggctcgcggggaggctgtttgccct

SEQ ID NO: 11587 - DNA, 25 bp, Homo sapien
ccgcacccaggcgagcaacgtggag

SEQ ID NO: 11588 - DNA, 25 bp, Homo sapien
cggtgccacggtgggtgacagggct

SEQ ID NO: 11589 - DNA, 25 bp, Homo sapien
ttaagataatctggtccaggggttc

SEQ ID NO: 11590 - DNA, 25 bp, Homo sapien
ctgcacccggcaatgggcatggcct

SEQ ID NO: 11591 - DNA, 25 bp, Homo sapien
gtggccgacaagttccaccagcacg

SEQ ID NO: 11592 - DNA, 25 bp, Homo sapien
tctacggaccctacggcaaggagct

SEQ ID NO: 11593 - DNA, 25 bp, Homo sapien
acctggctggggacaagctgctgcc

SEQ ID NO: 11594 - DNA, 25 bp, Homo sapien
gcaggcaatcttcgcgcagcggatc

SEQ ID NO: 11595 - DNA, 25 bp, Homo sapien
cgcagcggatcctgtgtcgctctca

SEQ ID NO: 11596 - DNA, 25 bp, Homo sapien
tgtgtcgctctcagggcacgctctc

SEQ ID NO: 11597 - DNA, 25 bp, Homo sapien
cagcggccgaggagatcaacaccaa

SEQ ID NO: 11598 - DNA, 25 bp, Homo sapien
ctggggcgttgaggatgataaaccc

SEQ ID NO: 11599 - DNA, 25 bp, Homo sapien
ccggtcgctgcgcaaatgaaaagcg

SEQ ID NO: 11600 - DNA, 25 bp, Homo sapien
aaagcggttaagtggcggcaaatcg

SEQ ID NO: 11601 - DNA, 25 bp, Homo sapien
cccaacgctggtgctcggaaaggga

SEQ ID NO: 11602 - DNA, 25 bp, Homo sapien
gcctcctccaaggagaactttgcgc

SEQ ID NO: 11603 - DNA, 25 bp, Homo sapien
ttgcgcacctgtcgcgtctcaggtg

SEQ ID NO: 11604 - DNA, 25 bp, Homo sapien
cccaggcctttagttccggtcgctg

SEQ ID NO: 11605 - DNA, 25 bp, Homo sapien
gggttcacgccgtcaaccttgcgca

SEQ ID NO: 11606 - DNA, 25 bp, Homo sapien
cctcagggtcactggtgcgggctcc

SEQ ID NO: 11607 - DNA, 25 bp, Homo sapien
gccgcgttgcgcacatcggtccttg

SEQ ID NO: 11608 - DNA, 25 bp, Homo sapien
ttgcgcacatcggtccttggcgggt

SEQ ID NO: 11609 - DNA, 25 bp, Homo sapien
cctgacaggacctggacgcacgtgc

SEQ ID NO: 11610 - DNA, 25 bp, Homo sapien
cggccttggagcctcagggtcactg

SEQ ID NO: 11611 - DNA, 25 bp, Homo sapien
caccaggcgcgagtgttcttcttcc

SEQ ID NO: 11612 - DNA, 25 bp, Homo sapien
gtccacgcatttccaagcgcccttt

SEQ ID NO: 11613 - DNA, 25 bp, Homo sapien
ggcgcgagtgttcttcttccttgtc

SEQ ID NO: 11614 - DNA, 25 bp, Homo sapien
ccctcagcccgcacgcggccaacgt

SEQ ID NO: 11615 - DNA, 25 bp, Homo sapien
cccacagcacctcgctcagacttcg

SEQ ID NO: 11616 - DNA, 25 bp, Homo sapien
gcacacccgatggtggacggaggct

SEQ ID NO: 11617 - DNA, 25 bp, Homo sapien
ctcgctcagacttcgccctccaccc

SEQ ID NO: 11618 - DNA, 25 bp, Homo sapien
acgcggccaacgtcaggcgcgcgca

SEQ ID NO: 11619 - DNA, 25 bp, Homo sapien
gtcaggcgcgcgcagaggcacccac

SEQ ID NO: 11620 - DNA, 25 bp, Homo sapien
cgcgcgcagaggcacccacgggccc

SEQ ID NO: 11621 - DNA, 25 bp, Homo sapien
ttgggaagcctcaggcagccccacg

SEQ ID NO: 11622 - DNA, 25 bp, Homo sapien
ggacttctgtgtatggacgagccca

SEQ ID NO: 11623 - DNA, 25 bp, Homo sapien
ctctccctgaagtgctcacgaggtg

SEQ ID NO: 11624 - DNA, 25 bp, Homo sapien
aagtgtcattttgccgaccgtgtcc

SEQ ID NO: 11625 - DNA, 25 bp, Homo sapien
ccaaaatggtacgtgtgggagaaca

SEQ ID NO: 11626 - DNA, 25 bp, Homo sapien
cagagccagacacgcacaggaaact

SEQ ID NO: 11627 - DNA, 25 bp, Homo sapien
acggcctgactcacgggacttctgt

SEQ ID NO: 11628 - DNA, 25 bp, Homo sapien
gaccgtgtcccagtttgcgtccatc

SEQ ID NO: 11629 - DNA, 25 bp, Homo sapien
tggacgagcccagcgccaaaatggt

SEQ ID NO: 11630 - DNA, 25 bp, Homo sapien
tgcagcccaagaagcagcgcctggt

SEQ ID NO: 11631 - DNA, 25 bp, Homo sapien
ccgcagcctgcaagcgcaaggaaca

SEQ ID NO: 11632 - DNA, 25 bp, Homo sapien
ggcttggagctcaacaccgtcagca

SEQ ID NO: 11633 - DNA, 25 bp, Homo sapien
tgcaggtcaccatctcgcagcagct

SEQ ID NO: 11634 - DNA, 25 bp, Homo sapien
cgtccaaggagatgcaggtcaccat

SEQ ID NO: 11635 - DNA, 25 bp, Homo sapien
tcttcaaggagaacaagcggccgtc

SEQ ID NO: 11636 - DNA, 25 bp, Homo sapien
gacgcacgctgatcgccatcttcaa

SEQ ID NO: 11637 - DNA, 25 bp, Homo sapien
aacttcttcatgaacgcgcggcgcc

SEQ ID NO: 11638 - DNA, 25 bp, Homo sapien
tgttggtttccactctcgccaaaga

SEQ ID NO: 11639 - DNA, 25 bp, Homo sapien
cgcttcctgcgtggaaccttctgga

SEQ ID NO: 11640 - DNA, 25 bp, Homo sapien
cctttaggcaccttcgtggagcgca

SEQ ID NO: 11641 - DNA, 25 bp, Homo sapien
gttgagttcactttacctttaggca

SEQ ID NO: 11642 - DNA, 25 bp, Homo sapien
ctcgtgccaagaatcgcctgcctta

SEQ ID NO: 11643 - DNA, 25 bp, Homo sapien
cgctcctctcatctggtctgggtga

SEQ ID NO: 11644 - DNA, 25 bp, Homo sapien
ggattccgcttgctccattttttgc

SEQ ID NO: 11645 - DNA, 25 bp, Homo sapien
tcccacgtgcgggtaaattccagac

SEQ ID NO: 11646 - DNA, 25 bp, Homo sapien
agcacctcggagctacggcgggctc

SEQ ID NO: 11647 - DNA, 25 bp, Homo sapien
tcctgccacgcctcgtccatgttca

SEQ ID NO: 11648 - DNA, 25 bp, Homo sapien
tagaggaaatccctcctggactggc

SEQ ID NO: 11649 - DNA, 25 bp, Homo sapien
cgcctggcgtagaggaaatccctcc

SEQ ID NO: 11650 - DNA, 25 bp, Homo sapien
gagcccgaacctccggcacagcagg

SEQ ID NO: 11651 - DNA, 25 bp, Homo sapien
agatgaccgcctggcacttggacgc

SEQ ID NO: 11652 - DNA, 25 bp, Homo sapien
ctggcacttggacgccaggtccacg

SEQ ID NO: 11653 - DNA, 25 bp, Homo sapien
tccttccgcagggacaccagcagtt

SEQ ID NO: 11654 - DNA, 25 bp, Homo sapien
gcgcgtgctgttgaagtccattatg

SEQ ID NO: 11655 - DNA, 25 bp, Homo sapien
ttcccgtcggcgaacttgttccaga

SEQ ID NO: 11656 - DNA, 25 bp, Homo sapien
gaccgcaggcctggacatcctttag

SEQ ID NO: 11657 - DNA, 25 bp, Homo sapien
gagcacttgagactagacgaccttc

SEQ ID NO: 11658 - DNA, 25 bp, Homo sapien
ccgcctgtacaacccaatgcatgga

SEQ ID NO: 11659 - DNA, 25 bp, Homo sapien
gcctggtacaacagctggtctggta

SEQ ID NO: 11660 - DNA, 25 bp, Homo sapien
atggcgccctctggctttcgaactg

SEQ ID NO: 11661 - DNA, 25 bp, Homo sapien
cgcctgggctacacctttattgatg

SEQ ID NO: 11662 - DNA, 25 bp, Homo sapien
aggcactcagggtcacggtcagccc

SEQ ID NO: 11663 - DNA, 25 bp, Homo sapien
tgaactcggacctgcagaggcactc

SEQ ID NO: 11664 - DNA, 25 bp, Homo sapien
gtcccagtcgatgaagacgctgttc

SEQ ID NO: 11665 - DNA, 25 bp, Homo sapien
gtagtacatctgcacgtcccagtcg

SEQ ID NO: 11666 - DNA, 25 bp, Homo sapien
cacgtcctgcggcttgtagtacatc

SEQ ID NO: 11667 - DNA, 25 bp, Homo sapien
tgcccgtcttgtccgagaagatgta

SEQ ID NO: 11668 - DNA, 25 bp, Homo sapien
acgcggccgctgatgcagcacttgt

SEQ ID NO: 11669 - DNA, 25 bp, Homo sapien
tcaagatgttctgcgtgagcgtgcc

SEQ ID NO: 11670 - DNA, 25 bp, Homo sapien
tcggcgtcggcccattgctcttcag

SEQ ID NO: 11671 - DNA, 25 bp, Homo sapien
atttctcaggctcggcagcctcagc

SEQ ID NO: 11672 - DNA, 25 bp, Homo sapien
cttttgggatttctcaggctcggca

SEQ ID NO: 11673 - DNA, 25 bp, Homo sapien
attgcttctgtctggcggcggcagc

SEQ ID NO: 11674 - DNA, 25 bp, Homo sapien
gccgccggcactggattgcttctgt

SEQ ID NO: 11675 - DNA, 25 bp, Homo sapien
ctcaaagccaagtaagcggggcggc

SEQ ID NO: 11676 - DNA, 25 bp, Homo sapien
caggaacgcccctgtcgcaggaaga

SEQ ID NO: 11677 - DNA, 25 bp, Homo sapien
gctgctgcgcctcaaagccaagtaa

SEQ ID NO: 11678 - DNA, 25 bp, Homo sapien
gccaaggcgaaggtggagccagttc

SEQ ID NO: 11679 - DNA, 25 bp, Homo sapien
ttagcccggtgccaacggtcctgaa

SEQ ID NO: 11680 - DNA, 25 bp, Homo sapien
gcagtgggagcacccgccgctcacc

SEQ ID NO: 11681 - DNA, 25 bp, Homo sapien
acagcagtgggagcacccgccgctc

SEQ ID NO: 11682 - DNA, 25 bp, Homo sapien
gcgcgaacctctaggggcgcgctct

SEQ ID NO: 11683 - DNA, 25 bp, Homo sapien
aggggcacaggaccgccctggacag

SEQ ID NO: 11684 - DNA, 25 bp, Homo sapien
gcacaggaccgccctggacagggct

SEQ ID NO: 11685 - DNA, 25 bp, Homo sapien
tggtggaaccgttagcccggtgcca

SEQ ID NO: 11686 - DNA, 25 bp, Homo sapien
cctcgcagaacaggccgggatagaa

SEQ ID NO: 11687 - DNA, 25 bp, Homo sapien
atagaagacgctcgggagcagtgcc

SEQ ID NO: 11688 - DNA, 25 bp, Homo sapien
cggggtctcgctgagcaaagtcaga

SEQ ID NO: 11689 - DNA, 25 bp, Homo sapien
tctcgctgagcaaagtcagagtagg

SEQ ID NO: 11690 - DNA, 25 bp, Homo sapien
ggccaggactcaggggcttggccag

SEQ ID NO: 11691 - DNA, 25 bp, Homo sapien
catggccttgcggagcagtgttatg

SEQ ID NO: 11692 - DNA, 25 bp, Homo sapien
gggcctcgcagagcctcgcagaaca

SEQ ID NO: 11693 - DNA, 25 bp, Homo sapien
gaacaggccgggatagaagacgctc

SEQ ID NO: 11694 - DNA, 25 bp, Homo sapien
gacgggttaccggagatttattgca

SEQ ID NO: 11695 - DNA, 25 bp, Homo sapien
catcgcttggtcttggcgtcttctc

SEQ ID NO: 11696 - DNA, 25 bp, Homo sapien
cggcactcaccattgtcctggatga

SEQ ID NO: 11697 - DNA, 25 bp, Homo sapien
atctgtctgaggtagtcggccatga

SEQ ID NO: 11698 - DNA, 25 bp, Homo sapien
tgaacatgctcagcagaacggcctg

SEQ ID NO: 11699 - DNA, 25 bp, Homo sapien
cacttgtgtcggcaaggtcagcctc

SEQ ID NO: 11700 - DNA, 25 bp, Homo sapien
agcagtttctagagacgccagaggg

SEQ ID NO: 11701 - DNA, 25 bp, Homo sapien
ggcgtcttctcgaaccttccagatc

SEQ ID NO: 11702 - DNA, 25 bp, Homo sapien
ctcgtcccggatgcagcggcctgaa

SEQ ID NO: 11703 - DNA, 25 bp, Homo sapien
taggccgtcgcaggccagcgactca

SEQ ID NO: 11704 - DNA, 25 bp, Homo sapien
aggccagcgactcacagtccttggg

SEQ ID NO: 11705 - DNA, 25 bp, Homo sapien
ctcagctgtgaagatgattgcgccc

SEQ ID NO: 11706 - DNA, 25 bp, Homo sapien
tggtaataacactcctcgtcccgga

SEQ ID NO: 11707 - DNA, 25 bp, Homo sapien
gacccaggtggaagctgaggctcac

SEQ ID NO: 11708 - DNA, 25 bp, Homo sapien
cctgaagaggacacgaggtactcgg

SEQ ID NO: 11709 - DNA, 25 bp, Homo sapien
cccagtggtaataacactcctcgtc

SEQ ID NO: 11710 - DNA, 25 bp, Homo sapien
ggaacggacagagaacctccagact

SEQ ID NO: 11711 - DNA, 25 bp, Homo sapien
aagggcactgcgacagctcagcacc

SEQ ID NO: 11712 - DNA, 25 bp, Homo sapien
caggagtcctccaagccagatgagc

SEQ ID NO: 11713 - DNA, 25 bp, Homo sapien
agggtttgctcttcaggaacggaca

SEQ ID NO: 11714 - DNA, 25 bp, Homo sapien
cacgcgcctcttgcagtggagggtt

SEQ ID NO: 11715 - DNA, 25 bp, Homo sapien
aaggaagcaggctgcccgccaggct

SEQ ID NO: 11716 - DNA, 25 bp, Homo sapien
acaggacaacccgagcgcggagaca

SEQ ID NO: 11717 - DNA, 25 bp, Homo sapien
ttgggacgccagactcccttcaggc

SEQ ID NO: 11718 - DNA, 25 bp, Homo sapien
gcctcagtttctccggctgtaactc

SEQ ID NO: 11719 - DNA, 25 bp, Homo sapien
cccaagttcgcagaaggaccgagct

SEQ ID NO: 11720 - DNA, 25 bp, Homo sapien
tccctctccgttgttgcagctagaa

SEQ ID NO: 11721 - DNA, 25 bp, Homo sapien
taattcaggggatgagatcacagcc

SEQ ID NO: 11722 - DNA, 25 bp, Homo sapien
ccgagggctcacagacgaagctcaa

SEQ ID NO: 11723 - DNA, 25 bp, Homo sapien
agcagggctgattgccgggaacaaa

SEQ ID NO: 11724 - DNA, 25 bp, Homo sapien
agggtcggttccttctgcaccagaa

SEQ ID NO: 11725 - DNA, 25 bp, Homo sapien
gcccggagcccgatcgataattcag

SEQ ID NO: 11726 - DNA, 25 bp, Homo sapien
ccgatgccaccagggaaaacagacc

SEQ ID NO: 11727 - DNA, 25 bp, Homo sapien
accaggcctggcatccgcacagacc

SEQ ID NO: 11728 - DNA, 25 bp, Homo sapien
gcggcccgatgccaccagggaaaac

SEQ ID NO: 11729 - DNA, 25 bp, Homo sapien
gcccgatgccaccagggaaaacaga

SEQ ID NO: 11730 - DNA, 25 bp, Homo sapien
tgccaccagggaaaacagacccaac

SEQ ID NO: 11731 - DNA, 25 bp, Homo sapien
cgcacgcgtcctccgtggaacacgc

SEQ ID NO: 11732 - DNA, 25 bp, Homo sapien
gaaaacagacccaaccaggcctggc

SEQ ID NO: 11733 - DNA, 25 bp, Homo sapien
tggaacacgccggccgtcggcgtta

SEQ ID NO: 11734 - DNA, 25 bp, Homo sapien
tcagcagaggggaaggttaccctcc

SEQ ID NO: 11735 - DNA, 25 bp, Homo sapien
actgaactcagtgtccagaaaagca

SEQ ID NO: 11736 - DNA, 25 bp, Homo sapien
acaggctaatgttcctggccgcaga

SEQ ID NO: 11737 - DNA, 25 bp, Homo sapien
gctgatcattttcccagacgccgta

SEQ ID NO: 11738 - DNA, 25 bp, Homo sapien
agacgccgtaatgactgcagctgta

SEQ ID NO: 11739 - DNA, 25 bp, Homo sapien
gctgtaggacagctgctctctcaga

SEQ ID NO: 11740 - DNA, 25 bp, Homo sapien
cctgcaggtgacttcacacggttta

SEQ ID NO: 11741 - DNA, 25 bp, Homo sapien
tgctgcctcccatctggaatcctgg

SEQ ID NO: 11742 - DNA, 25 bp, Homo sapien
ctgagtctgagaaccttgcatcgca

SEQ ID NO: 11743 - DNA, 25 bp, Homo sapien
ccctcgtctagtgagcgggctttcc

SEQ ID NO: 11744 - DNA, 25 bp, Homo sapien
atggcttcttcttggtcccttccgg

SEQ ID NO: 11745 - DNA, 25 bp, Homo sapien
tggcggcctcatcttctgagtctga

SEQ ID NO: 11746 - DNA, 25 bp, Homo sapien
catcgcaactgccaaaggggtcaca

SEQ ID NO: 11747 - DNA, 25 bp, Homo sapien
ctggagttgtccaccacgtacttgc

SEQ ID NO: 11748 - DNA, 25 bp, Homo sapien
ctggctcacagccttggggacgtat

SEQ ID NO: 11749 - DNA, 25 bp, Homo sapien
gcccttgtccttggtcttgtccttc

SEQ ID NO: 11750 - DNA, 25 bp, Homo sapien
cggccggaggaaacgtcatggaaat

SEQ ID NO: 11751 - DNA, 25 bp, Homo sapien
gtcatggaaataaacaagggcggcc

SEQ ID NO: 11752 - DNA, 25 bp, Homo sapien
cgacaaacacaagagacgatcctcg

SEQ ID NO: 11753 - DNA, 25 bp, Homo sapien
aagagacgatcctcggaccatccta

SEQ ID NO: 11754 - DNA, 25 bp, Homo sapien
tcggaccatcctaactcaacgactg

SEQ ID NO: 11755 - DNA, 25 bp, Homo sapien
aactcaacgactggagactgaggtg

SEQ ID NO: 11756 - DNA, 25 bp, Homo sapien
ccacaagcacatggggtccgggaag

SEQ ID NO: 11757 - DNA, 25 bp, Homo sapien
aacaagggcggccacaagcacatgg

SEQ ID NO: 11758 - DNA, 25 bp, Homo sapien
tccacggcgcgcctgaccaaaaaag

SEQ ID NO: 11759 - DNA, 25 bp, Homo sapien
ccctgcggcgccagggctgtccacg

SEQ ID NO: 11760 - DNA, 25 bp, Homo sapien
cctgctcagaaacgcctgctcctgc

SEQ ID NO: 11761 - DNA, 25 bp, Homo sapien
tagcggcgccatcttgagccccagg

SEQ ID NO: 11762 - DNA, 25 bp, Homo sapien
ccgcagcgcgcctgctcagaaacgc

SEQ ID NO: 11763 - DNA, 25 bp, Homo sapien
cggctgtagcggcgccatcttgagc

SEQ ID NO: 11764 - DNA, 25 bp, Homo sapien
accaaggctggtgacggacccctgg

SEQ ID NO: 11765 - DNA, 25 bp, Homo sapien
cgcgaccaaggctggtgacggaccc

SEQ ID NO: 11766 - DNA, 25 bp, Homo sapien
agccgggaatttgccgcccaggttg

SEQ ID NO: 11767 - DNA, 25 bp, Homo sapien
agggaggctgccctcgagtaaagcc

SEQ ID NO: 11768 - DNA, 25 bp, Homo sapien
gccgcgcgatacgagaggccgacca

SEQ ID NO: 11769 - DNA, 25 bp, Homo sapien
gggagggcctcaaagctctcaccgc

SEQ ID NO: 11770 - DNA, 25 bp, Homo sapien
aggcgctcaatacaggagcacagga

SEQ ID NO: 11771 - DNA, 25 bp, Homo sapien
ggaccctccgtggaggagcctgtcc

SEQ ID NO: 11772 - DNA, 25 bp, Homo sapien
tgtcactgtgcctcggttgccaggc

SEQ ID NO: 11773 - DNA, 25 bp, Homo sapien
cgctggagtccacagtggttttttc

SEQ ID NO: 11774 - DNA, 25 bp, Homo sapien
tcatatgcggagtcaatgcaccatc

SEQ ID NO: 11775 - DNA, 25 bp, Homo sapien
cagtttccacgtatgcaaaacggtc

SEQ ID NO: 11776 - DNA, 25 bp, Homo sapien
ggcgcgaactgaatctactgtcata

SEQ ID NO: 11777 - DNA, 25 bp, Homo sapien
tgctgcaccatcgaggtcagcgcgc

SEQ ID NO: 11778 - DNA, 25 bp, Homo sapien
cggcaagtcccaggtaggccacgtc

SEQ ID NO: 11779 - DNA, 25 bp, Homo sapien
ctccttcgcagacgaagcggctgga

SEQ ID NO: 11780 - DNA, 25 bp, Homo sapien
tgcggctgccgagcctttccaagct

SEQ ID NO: 11781 - DNA, 25 bp, Homo sapien
caaaacggtccatggtgccctcgta

SEQ ID NO: 11782 - DNA, 25 bp, Homo sapien
gacagacacgttccagcagatccca

SEQ ID NO: 11783 - DNA, 25 bp, Homo sapien
ttggccaggtggtcactgcgggtga

SEQ ID NO: 11784 - DNA, 25 bp, Homo sapien
aacttcttgtcgcagccctgccagt

SEQ ID NO: 11785 - DNA, 25 bp, Homo sapien
tgccagtcacaagcaaaagggcgtt

SEQ ID NO: 11786 - DNA, 25 bp, Homo sapien
cagtcacaagcaaaagggcgttccc

SEQ ID NO: 11787 - DNA, 25 bp, Homo sapien
agatgacagacacgttccagcagat

SEQ ID NO: 11788 - DNA, 25 bp, Homo sapien
tgaagcgcttggagcacagagggca

SEQ ID NO: 11789 - DNA, 25 bp, Homo sapien
atgacagacacgttccagcagatcc

SEQ ID NO: 11790 - DNA, 25 bp, Homo sapien
ccgtgtcgccatcttgcaaggcaca

SEQ ID NO: 11791 - DNA, 25 bp, Homo sapien
acatcccacggctgggtgccggaca

SEQ ID NO: 11792 - DNA, 25 bp, Homo sapien
cgaagcgcctctgcgaaatgccagg

SEQ ID NO: 11793 - DNA, 25 bp, Homo sapien
gccggacagtcagttggttcacttc

SEQ ID NO: 11794 - DNA, 25 bp, Homo sapien
cccagttccactttgcaaggaggag

SEQ ID NO: 11795 - DNA, 25 bp, Homo sapien
tgggaacacagctgccgcacgtagc

SEQ ID NO: 11796 - DNA, 25 bp, Homo sapien
acaatccactcgcagggaggagggt

SEQ ID NO: 11797 - DNA, 25 bp, Homo sapien
ctccagggaacatgccgccgtgtcg

SEQ ID NO: 11798 - DNA, 25 bp, Homo sapien
cacgtgtccctacaatccgagccca

SEQ ID NO: 11799 - DNA, 25 bp, Homo sapien
ggctgctccacgtgtccctacaatc

SEQ ID NO: 11800 - DNA, 25 bp, Homo sapien
ggaccctcaattcttccgcaaggca

SEQ ID NO: 11801 - DNA, 25 bp, Homo sapien
tcaattcttccgcaaggcattcgcg

SEQ ID NO: 11802 - DNA, 25 bp, Homo sapien
attcttccgcaaggcattcgcggcc

SEQ ID NO: 11803 - DNA, 25 bp, Homo sapien
ctggacggcccacttcccttcggct

SEQ ID NO: 11804 - DNA, 25 bp, Homo sapien
gatggaccctcaattcttccgcaag

SEQ ID NO: 11805 - DNA, 25 bp, Homo sapien
cccaaagatggaccctcaattcttc

SEQ ID NO: 11806 - DNA, 25 bp, Homo sapien
cctcgagggtcctccaatactatga

SEQ ID NO: 11807 - DNA, 25 bp, Homo sapien
atactatgaagttcccccgcccaga

SEQ ID NO: 11808 - DNA, 25 bp, Homo sapien
ggtcctccaatactatgaagttccc

SEQ ID NO: 11809 - DNA, 25 bp, Homo sapien
gggtcctccaatactatgaagttcc

SEQ ID NO: 11810 - DNA, 25 bp, Homo sapien
agggtcctccaatactatgaagttc

SEQ ID NO: 11811 - DNA, 25 bp, Homo sapien
cgagggtcctccaatactatgaagt

SEQ ID NO: 11812 - DNA, 25 bp, Homo sapien
tcgagggtcctccaatactatgaag

SEQ ID NO: 11813 - DNA, 25 bp, Homo sapien
ccctcgagggtcctccaatactatg

SEQ ID NO: 11814 - DNA, 25 bp, Homo sapien
tctggggagaatccgcgcggccacc

SEQ ID NO: 11815 - DNA, 25 bp, Homo sapien
gccaggtgctctgccgacctctggg

SEQ ID NO: 11816 - DNA, 25 bp, Homo sapien
ctgccgacctctggggagaatccgc

SEQ ID NO: 11817 - DNA, 25 bp, Homo sapien
tgctctgccgacctctggggagaat

SEQ ID NO: 11818 - DNA, 25 bp, Homo sapien
aacgcagagaaaacgtgccgggctc

SEQ ID NO: 11819 - DNA, 25 bp, Homo sapien
tacagagaacgcagagaaaacgtgc

SEQ ID NO: 11820 - DNA, 25 bp, Homo sapien
ccctcgttaaaatacagagaacgca

SEQ ID NO: 11821 - DNA, 25 bp, Homo sapien
cgcagagaaaacgtgccgggctccc

SEQ ID NO: 11822 - DNA, 25 bp, Homo sapien
ttggcgcagtccgggaagggacagc

SEQ ID NO: 11823 - DNA, 25 bp, Homo sapien
gggacagcggtggctcttggcggcg

SEQ ID NO: 11824 - DNA, 25 bp, Homo sapien
agggacagcggtggctcttggcggc

SEQ ID NO: 11825 - DNA, 25 bp, Homo sapien
gctttggcgcagtccgggaagggac

SEQ ID NO: 11826 - DNA, 25 bp, Homo sapien
gaagggacagcggtggctcttggcg

SEQ ID NO: 11827 - DNA, 25 bp, Homo sapien
tttggcgcagtccgggaagggacag

SEQ ID NO: 11828 - DNA, 25 bp, Homo sapien
ctttggcgcagtccgggaagggaca

SEQ ID NO: 11829 - DNA, 25 bp, Homo sapien
aagggacagcggtggctcttggcgg

SEQ ID NO: 11830 - DNA, 25 bp, Homo sapien
tgcgactttaggtgcgaggacttgt

SEQ ID NO: 11831 - DNA, 25 bp, Homo sapien
cgggatcgcggctgcactcacctgt

SEQ ID NO: 11832 - DNA, 25 bp, Homo sapien
cgcggctgcactcacctgtgtgcgt

SEQ ID NO: 11833 - DNA, 25 bp, Homo sapien
tccgcaggtgcgactttaggtgcga

SEQ ID NO: 11834 - DNA, 25 bp, Homo sapien
actttaggtgcgaggacttgtagta

SEQ ID NO: 11835 - DNA, 25 bp, Homo sapien
aggacttgtagtaggctttggcgca

SEQ ID NO: 11836 - DNA, 25 bp, Homo sapien
acttgtagtaggctttggcgcagtc

SEQ ID NO: 11837 - DNA, 25 bp, Homo sapien
gtgtgcgtccgcaggtgcgacttta

SEQ ID NO: 11838 - DNA, 25 bp, Homo sapien
gacgtccaggccaacttgttaaata

SEQ ID NO: 11839 - DNA, 25 bp, Homo sapien
actgaggccaggtattcgggcctcc

SEQ ID NO: 11840 - DNA, 25 bp, Homo sapien
caggcatcgattcttggggttcgga

SEQ ID NO: 11841 - DNA, 25 bp, Homo sapien
agttccggagctactagagcgcgcc

SEQ ID NO: 11842 - DNA, 25 bp, Homo sapien
ctttttgcacccagttccggagcta

SEQ ID NO: 11843 - DNA, 25 bp, Homo sapien
ggctgcgttcgttcctctttttgca

SEQ ID NO: 11844 - DNA, 25 bp, Homo sapien
aggcatctgctcgtcctcttctctg

SEQ ID NO: 11845 - DNA, 25 bp, Homo sapien
cggatggcccagttcgcaggcccaa

SEQ ID NO: 11846 - DNA, 25 bp, Homo sapien
gctttgttcacggtgacctgctctg

SEQ ID NO: 11847 - DNA, 25 bp, Homo sapien
tgttcacggtgacctgctctgggca

SEQ ID NO: 11848 - DNA, 25 bp, Homo sapien
gccctggctttgttcacggtgacct

SEQ ID NO: 11849 - DNA, 25 bp, Homo sapien
ccatagagaacgctggagccctggc

SEQ ID NO: 11850 - DNA, 25 bp, Homo sapien
tgcccatagagaacgctggagccct

SEQ ID NO: 11851 - DNA, 25 bp, Homo sapien
tggcggatgcccatagagaacgctg

SEQ ID NO: 11852 - DNA, 25 bp, Homo sapien
tgctggcccgtttcgagtggcggat

SEQ ID NO: 11853 - DNA, 25 bp, Homo sapien
tgcgtccgggctgtcgtactggccc

SEQ ID NO: 11854 - DNA, 25 bp, Homo sapien
gaatcgttgtgaagatcgacgtggc

SEQ ID NO: 11855 - DNA, 25 bp, Homo sapien
cagcagcccagaatcgttgtgaaga

SEQ ID NO: 11856 - DNA, 25 bp, Homo sapien
ggggtctcggctacttctctcggtg

SEQ ID NO: 11857 - DNA, 25 bp, Homo sapien
tgagccacctgtgctgtcgtggctg

SEQ ID NO: 11858 - DNA, 25 bp, Homo sapien
ggaccttatttctgagccacctgtg

SEQ ID NO: 11859 - DNA, 25 bp, Homo sapien
gcagatgtgtgtcccgggaccttat

SEQ ID NO: 11860 - DNA, 25 bp, Homo sapien
gtcccgggaccttatttctgagcca

SEQ ID NO: 11861 - DNA, 25 bp, Homo sapien
tttctgagccacctgtgctgtcgtg

SEQ ID NO: 11862 - DNA, 25 bp, Homo sapien
ttcgccatctacgaaggaagcggcc

SEQ ID NO: 11863 - DNA, 25 bp, Homo sapien
gtcgcgcgacacaggctgaaccctg

SEQ ID NO: 11864 - DNA, 25 bp, Homo sapien
tggacaacaggccaccggttcccga

SEQ ID NO: 11865 - DNA, 25 bp, Homo sapien
ggaactcttctcgtgatcccagctc

SEQ ID NO: 11866 - DNA, 25 bp, Homo sapien
ctgtccgagctctgaggtccgtcaa

SEQ ID NO: 11867 - DNA, 25 bp, Homo sapien
acctcaggacccagagtgcgctgtc

SEQ ID NO: 11868 - DNA, 25 bp, Homo sapien
cgtgccgatctctcctagggactca

SEQ ID NO: 11869 - DNA, 25 bp, Homo sapien
aagccttctgccctagagatcgtag

SEQ ID NO: 11870 - DNA, 25 bp, Homo sapien
gtgtacctgggacaggccgagaagg

SEQ ID NO: 11871 - DNA, 25 bp, Homo sapien
agaagggccgttcacatcctcgctc

SEQ ID NO: 11872 - DNA, 25 bp, Homo sapien
gagaagggccgttcacatcctcgct

SEQ ID NO: 11873 - DNA, 25 bp, Homo sapien
cgagaagggccgttcacatcctcgc

SEQ ID NO: 11874 - DNA, 25 bp, Homo sapien
ccgagaagggccgttcacatcctcg

SEQ ID NO: 11875 - DNA, 25 bp, Homo sapien
acaggccgagaagggccgttcacat

SEQ ID NO: 11876 - DNA, 25 bp, Homo sapien
gacaggccgagaagggccgttcaca

SEQ ID NO: 11877 - DNA, 25 bp, Homo sapien
gccgttcacatcctcgctcccagcg

SEQ ID NO: 11878 - DNA, 25 bp, Homo sapien
agacggcgcaatggcggaaagcaaa

SEQ ID NO: 11879 - DNA, 25 bp, Homo sapien
cgaacggagcgggtagaaatgagac

SEQ ID NO: 11880 - DNA, 25 bp, Homo sapien
gcaaagcagaaatggcgtgacagcc

SEQ ID NO: 11881 - DNA, 25 bp, Homo sapien
aatggcgtgacagccacatgtgcgg

SEQ ID NO: 11882 - DNA, 25 bp, Homo sapien
tccacctcgcgcaggggctacccgc

SEQ ID NO: 11883 - DNA, 25 bp, Homo sapien
tacccgctcgccgtgctgagccctt

SEQ ID NO: 11884 - DNA, 25 bp, Homo sapien
cggcagcgcacgctcccaggcacct

SEQ ID NO: 11885 - DNA, 25 bp, Homo sapien
cctgtgagtcaggactcggggatcg

SEQ ID NO: 11886 - DNA, 25 bp, Homo sapien
tcccgagcaagcgatggacaacata

SEQ ID NO: 11887 - DNA, 25 bp, Homo sapien
tttgcacttcatcctgggagaaatg

SEQ ID NO: 11888 - DNA, 25 bp, Homo sapien
gctgcatcccggagaacggacgcga

SEQ ID NO: 11889 - DNA, 25 bp, Homo sapien
ttcggggcaaaagagcggaatccgc

SEQ ID NO: 11890 - DNA, 25 bp, Homo sapien
acccacgccggagggctgaatggat

SEQ ID NO: 11891 - DNA, 25 bp, Homo sapien
gggctttcccaatcacagacgctca

SEQ ID NO: 11892 - DNA, 25 bp, Homo sapien
cggacggaagtgagcctcgttctca

SEQ ID NO: 11893 - DNA, 25 bp, Homo sapien
caggcacagagcgaccgcgcgacta

SEQ ID NO: 11894 - DNA, 25 bp, Homo sapien
tccgagttttccctggccgcttgat

SEQ ID NO: 11895 - DNA, 25 bp, Homo sapien
cctttctgcgcgtgtgcgcccttat

SEQ ID NO: 11896 - DNA, 25 bp, Homo sapien
ccggatccctcaggtaagcgcgcgg

SEQ ID NO: 11897 - DNA, 25 bp, Homo sapien
taagacttggcgaagcgctgcgctc

SEQ ID NO: 11898 - DNA, 25 bp, Homo sapien
cgcgcagtgcctactagcaattgta

SEQ ID NO: 11899 - DNA, 25 bp, Homo sapien
tgggattcgaacctgcaaactcagc

SEQ ID NO: 11900 - DNA, 25 bp, Homo sapien
gctctcgcgagtttccgtagccttc

SEQ ID NO: 11901 - DNA, 25 bp, Homo sapien
ccctggccgcttgatgggattcgaa

SEQ ID NO: 11902 - DNA, 25 bp, Homo sapien
ccagcgagtcggctgctatgggccc

SEQ ID NO: 11903 - DNA, 25 bp, Homo sapien
ctgcgcggctgcgaaatgatccaga

SEQ ID NO: 11904 - DNA, 25 bp, Homo sapien
actgcatctccggttctgtgctttg

SEQ ID NO: 11905 - DNA, 25 bp, Homo sapien
gtgctttgttgaacgcgtgagcttc

SEQ ID NO: 11906 - DNA, 25 bp, Homo sapien
ggccgcttcagcgtgacctccaagg

SEQ ID NO: 11907 - DNA, 25 bp, Homo sapien
ccactggcctggagttccactggct

SEQ ID NO: 11908 - DNA, 25 bp, Homo sapien
tgcatgtcgaggagtagcacccaca

SEQ ID NO: 11909 - DNA, 25 bp, Homo sapien
tgatccagagacacatccctgtctg

SEQ ID NO: 11910 - DNA, 25 bp, Homo sapien
cgcctctgaccaggggccagttcga

SEQ ID NO: 11911 - DNA, 25 bp, Homo sapien
acgaggacaagcaggtgaccagcgc

SEQ ID NO: 11912 - DNA, 25 bp, Homo sapien
acgccgtcatggtgtgcgtggacct

SEQ ID NO: 11913 - DNA, 25 bp, Homo sapien
gcgccgtgcgtaaactggacgcaga

SEQ ID NO: 11914 - DNA, 25 bp, Homo sapien
ctacctgtgcactggctacgacctg

SEQ ID NO: 11915 - DNA, 25 bp, Homo sapien
tacgacctgtacgtgacccgcgagc

SEQ ID NO: 11916 - DNA, 25 bp, Homo sapien
cgcatcctgcgcgtcttctacggtg

SEQ ID NO: 11917 - DNA, 25 bp, Homo sapien
tccctgtcctgtccgagaagcagtc

SEQ ID NO: 11918 - DNA, 25 bp, Homo sapien
ttcggcctggccttcgtgtggctgc

SEQ ID NO: 11919 - DNA, 25 bp, Homo sapien
tctacaaggccttccggtgagcaga

SEQ ID NO: 11920 - DNA, 25 bp, Homo sapien
gctggttccggcctgtctacaaggc

SEQ ID NO: 11921 - DNA, 25 bp, Homo sapien
tctctcttcgcagtttactgcgcca

SEQ ID NO: 11922 - DNA, 25 bp, Homo sapien
aggctcggggaccaacttcggcctg

SEQ ID NO: 11923 - DNA, 25 bp, Homo sapien
gtgtggctgctcctgttcacgcctt

SEQ ID NO: 11924 - DNA, 25 bp, Homo sapien
cttgcggctacgtgtgctggttccg

SEQ ID NO: 11925 - DNA, 25 bp, Homo sapien
tgttcacgccttgcggctacgtgtg

SEQ ID NO: 11926 - DNA, 25 bp, Homo sapien
cagtttgtcctgaccgtcatccagg

SEQ ID NO: 11927 - DNA, 25 bp, Homo sapien
ccatggttcgcgattgtaggcactc

SEQ ID NO: 11928 - DNA, 25 bp, Homo sapien
gtcatccaggcgattggcttctccg

SEQ ID NO: 11929 - DNA, 25 bp, Homo sapien
ggcgcgtggtaagcctctctctgat

SEQ ID NO: 11930 - DNA, 25 bp, Homo sapien
ggattgtacgcgctctcctagggag

SEQ ID NO: 11931 - DNA, 25 bp, Homo sapien
aggggtctgagctcaccctggcagc

SEQ ID NO: 11932 - DNA, 25 bp, Homo sapien
agccgacagctcctttaatttcatg

SEQ ID NO: 11933 - DNA, 25 bp, Homo sapien
gctgtggtaaccgtcgtgttttctg

SEQ ID NO: 11934 - DNA, 25 bp, Homo sapien
tcccgcaggtcacgggagaagctga

SEQ ID NO: 11935 - DNA, 25 bp, Homo sapien
cagcgacttggctcttctcattgga

SEQ ID NO: 11936 - DNA, 25 bp, Homo sapien
cgacttcatgtccaccgttggctta

SEQ ID NO: 11937 - DNA, 25 bp, Homo sapien
aaccacagcgcacagcgacttcatg

SEQ ID NO: 11938 - DNA, 25 bp, Homo sapien
cccttgtaatgagagaaatcaaacc

SEQ ID NO: 11939 - DNA, 25 bp, Homo sapien
ggtgaacgctcttgagaaagaaacc

SEQ ID NO: 11940 - DNA, 25 bp, Homo sapien
attggagcctgggtcatctcccgca

SEQ ID NO: 11941 - DNA, 25 bp, Homo sapien
acccagcgggtcttaggagagcccg

SEQ ID NO: 11942 - DNA, 25 bp, Homo sapien
gaggaaacgtcatccacaccttcgc

SEQ ID NO: 11943 - DNA, 25 bp, Homo sapien
ggtgagggaggaaacgtcatccaca

SEQ ID NO: 11944 - DNA, 25 bp, Homo sapien
gggaggaaacgtcatccacaccttc

SEQ ID NO: 11945 - DNA, 25 bp, Homo sapien
tgagggaggaaacgtcatccacacc

SEQ ID NO: 11946 - DNA, 25 bp, Homo sapien
gtgcacacatgctgtacatgtggca

SEQ ID NO: 11947 - DNA, 25 bp, Homo sapien
catgctgtacatgtggcagtgagcc

SEQ ID NO: 11948 - DNA, 25 bp, Homo sapien
ctgtacatgtggcagtgagccacgg

SEQ ID NO: 11949 - DNA, 25 bp, Homo sapien
agcgtggcccagacacggctccaga

SEQ ID NO: 11950 - DNA, 25 bp, Homo sapien
tgcccttggccggaactaataagag

SEQ ID NO: 11951 - DNA, 25 bp, Homo sapien
gtctgatggggagctccgtctcacc

SEQ ID NO: 11952 - DNA, 25 bp, Homo sapien
cttgtcttcaggtctcgaggcctga

SEQ ID NO: 11953 - DNA, 25 bp, Homo sapien
tggtacggccttgtcttcaggtctc

SEQ ID NO: 11954 - DNA, 25 bp, Homo sapien
tccactgcacggctggtacggcctt

SEQ ID NO: 11955 - DNA, 25 bp, Homo sapien
gaaacgtgtggtcacccgccgtcca

SEQ ID NO: 11956 - DNA, 25 bp, Homo sapien
cttgctcccggaaacgtgtggtcac

SEQ ID NO: 11957 - DNA, 25 bp, Homo sapien
ccgtcaccatggcagatgcccttgg

SEQ ID NO: 11958 - DNA, 25 bp, Homo sapien
accagctcattttctggccagtcgc

SEQ ID NO: 11959 - DNA, 25 bp, Homo sapien
ctgtgacgtaacacacggcggcagg

SEQ ID NO: 11960 - DNA, 25 bp, Homo sapien
ggtgccaggacgaccagccacgcgt

SEQ ID NO: 11961 - DNA, 25 bp, Homo sapien
gcgcggcgccatccgttgtcgcaaa

SEQ ID NO: 11962 - DNA, 25 bp, Homo sapien
tcaggtggcgagactgtgacgtaac

SEQ ID NO: 11963 - DNA, 25 bp, Homo sapien
cacggcggagccaaggtaacgacgc

SEQ ID NO: 11964 - DNA, 25 bp, Homo sapien
aaagcggcgcgagaaacgcccagcc

SEQ ID NO: 11965 - DNA, 25 bp, Homo sapien
catccgttgtcgcaaagcggcgcga

SEQ ID NO: 11966 - DNA, 25 bp, Homo sapien
ccagggacttccgtgcccgttagct

SEQ ID NO: 11967 - DNA, 25 bp, Homo sapien
gcgaggtccacgcagtgtctctcct

SEQ ID NO: 11968 - DNA, 25 bp, Homo sapien
agggacttccgtgcccgttagctag

SEQ ID NO: 11969 - DNA, 25 bp, Homo sapien
cgttagctaggcgaggtccacgcag

SEQ ID NO: 11970 - DNA, 25 bp, Homo sapien
gcttccgtgcccgttagctaggcga

SEQ ID NO: 11971 - DNA, 25 bp, Homo sapien
aggcgaggtccacgcagtgtctctc

SEQ ID NO: 11972 - DNA, 25 bp, Homo sapien
acttccgtgcccgttagctaggcga

SEQ ID NO: 11973 - DNA, 25 bp, Homo sapien
cttccgtgcccgttagctaggcgag

SEQ ID NO: 11974 - DNA, 25 bp, Homo sapien
tgccatcacgctggtcaggcctgta

SEQ ID NO: 11975 - DNA, 25 bp, Homo sapien
tcacgctggtcaggcctgtacgccg

SEQ ID NO: 11976 - DNA, 25 bp, Homo sapien
cccatgagttgtcggggacctccgc

SEQ ID NO: 11977 - DNA, 25 bp, Homo sapien
tggggcccccatgagtcagctcgtc

SEQ ID NO: 11978 - DNA, 25 bp, Homo sapien
ggcctctccttcctgtgggcgcaca

SEQ ID NO: 11979 - DNA, 25 bp, Homo sapien
cccggttcctctgaaagcttcgtgg

SEQ ID NO: 11980 - DNA, 25 bp, Homo sapien
ctctgaaagcttcgtgggccgggac

SEQ ID NO: 11981 - DNA, 25 bp, Homo sapien
tgcgtgctgtgccatcacgctggtc

SEQ ID NO: 11982 - DNA, 25 bp, Homo sapien
cctcctgtgttctttacctggactc

SEQ ID NO: 11983 - DNA, 25 bp, Homo sapien
ctggtgtctgcagtgctccgaggac

SEQ ID NO: 11984 - DNA, 25 bp, Homo sapien
tgacagtcgcccttggtctggtgtc

SEQ ID NO: 11985 - DNA, 25 bp, Homo sapien
ttctcgtggtgatgacagtcgccct

SEQ ID NO: 11986 - DNA, 25 bp, Homo sapien
tgacggctcagctgcgttctcagag

SEQ ID NO: 11987 - DNA, 25 bp, Homo sapien
acctggactcttgcctttgctgatg

SEQ ID NO: 11988 - DNA, 25 bp, Homo sapien
ggtcctggccgctgtaccgcgatca

SEQ ID NO: 11989 - DNA, 25 bp, Homo sapien
tgcctttgctgatggcgacctgtga

SEQ ID NO: 11990 - DNA, 25 bp, Homo sapien
caggcggtgactctcggggccactc

SEQ ID NO: 11991 - DNA, 25 bp, Homo sapien
ggtgtgcaagcagtgctcccgtttt

SEQ ID NO: 11992 - DNA, 25 bp, Homo sapien
gtgcaagcagtgctcccgttttcca

SEQ ID NO: 11993 - DNA, 25 bp, Homo sapien
agcagtgctcccgttttccactggg

SEQ ID NO: 11994 - DNA, 25 bp, Homo sapien
gtgctcccgttttccactgggctgc

SEQ ID NO: 11995 - DNA, 25 bp, Homo sapien
ccgttttccactgggctgcccttca

SEQ ID NO: 11996 - DNA, 25 bp, Homo sapien
ggcggtgactctcggggccactcct

SEQ ID NO: 11997 - DNA, 25 bp, Homo sapien
ggctgcccttcaccggctgtgggtc

SEQ ID NO: 11998 - DNA, 25 bp, Homo sapien
tgtggcacggccactgcttagggcc

SEQ ID NO: 11999 - DNA, 25 bp, Homo sapien
agagccagcctcatgtcaccacgtg

SEQ ID NO: 12000 - DNA, 25 bp, Homo sapien
aggtgtgcgcttgtcttgtccggaa

SEQ ID NO: 12001 - DNA, 25 bp, Homo sapien
tgtgcgcttgtcttgtccggaagcc

SEQ ID NO: 12002 - DNA, 25 bp, Homo sapien
cgcttgtcttgtccggaagccgggt

SEQ ID NO: 12003 - DNA, 25 bp, Homo sapien
cgggtgttgggacgcgtcctgacga

SEQ ID NO: 12004 - DNA, 25 bp, Homo sapien
cgccgtttatgtggggtgggcgctc

SEQ ID NO: 12005 - DNA, 25 bp, Homo sapien
agcctcatgtcaccacgtgcttccc

SEQ ID NO: 12006 - DNA, 25 bp, Homo sapien
ccatggccagaacctggccgtggcg

SEQ ID NO: 12007 - DNA, 25 bp, Homo sapien
catggtggtcctctgcggaagtccc

SEQ ID NO: 12008 - DNA, 25 bp, Homo sapien
gggctccggtttcctctcctgtgga

SEQ ID NO: 12009 - DNA, 25 bp, Homo sapien
cagccgcagtggaaagacggatgga

SEQ ID NO: 12010 - DNA, 25 bp, Homo sapien
ctggccgtcgcggttgtggcattct

SEQ ID NO: 12011 - DNA, 25 bp, Homo sapien
gcggttgtggcattctcgctgtcag

SEQ ID NO: 12012 - DNA, 25 bp, Homo sapien
ctgttcccgtggctctcatggctgt

SEQ ID NO: 12013 - DNA, 25 bp, Homo sapien
tgtccgtcccgttggcagccgcagt

SEQ ID NO: 12014 - DNA, 25 bp, Homo sapien
gaggccagggtatcacaaacttatg

SEQ ID NO: 12015 - DNA, 25 bp, Homo sapien
ttgaatcatcagtccgtcgtggtgc

SEQ ID NO: 12016 - DNA, 25 bp, Homo sapien
tcactggcaggtgcgttgaatcatc

SEQ ID NO: 12017 - DNA, 25 bp, Homo sapien
cttccgcgtcggcaagaagatcggc

SEQ ID NO: 12018 - DNA, 25 bp, Homo sapien
ccagagacttgggatttgcacggca

SEQ ID NO: 12019 - DNA, 25 bp, Homo sapien
gccgcagtgatgttctagccacaga

SEQ ID NO: 12020 - DNA, 25 bp, Homo sapien
aacgcctgcgtctcagtagctggga

SEQ ID NO: 12021 - DNA, 25 bp, Homo sapien
tgtttctctgcagctgtgagccgtg

SEQ ID NO: 12022 - DNA, 25 bp, Homo sapien
cctcaagggcagatgggcaaaccaa

SEQ ID NO: 12023 - DNA, 25 bp, Homo sapien
gcagctcagtgcttggtggtcagca

SEQ ID NO: 12024 - DNA, 25 bp, Homo sapien
cacgtgactgacactttgccggaga

SEQ ID NO: 12025 - DNA, 25 bp, Homo sapien
ctgcccgcaggaagagctacacagc

SEQ ID NO: 12026 - DNA, 25 bp, Homo sapien
tacacagccgtgttcgccggaactc

SEQ ID NO: 12027 - DNA, 25 bp, Homo sapien
gccggaactccgctctggagagtca

SEQ ID NO: 12028 - DNA, 25 bp, Homo sapien
tagcacacaggcgagggcttgtcct

SEQ ID NO: 12029 - DNA, 25 bp, Homo sapien
ggagccacagctggatgatacatcg

SEQ ID NO: 12030 - DNA, 25 bp, Homo sapien
tgcggaagctcttcaccgacctctt

SEQ ID NO: 12031 - DNA, 25 bp, Homo sapien
ccctgcagatcacgcgcatggagta

SEQ ID NO: 12032 - DNA, 25 bp, Homo sapien
agagcctaatctaccgggacgtgaa

SEQ ID NO: 12033 - DNA, 25 bp, Homo sapien
ggctggccaaggagtacatcgaccc

SEQ ID NO: 12034 - DNA, 25 bp, Homo sapien
gatggccacgtacctgcgctatgtg

SEQ ID NO: 12035 - DNA, 25 bp, Homo sapien
cggcgcctggacttcttcgagaagc

SEQ ID NO: 12036 - DNA, 25 bp, Homo sapien
cggaccttcacgctcaagacggtgc

SEQ ID NO: 12037 - DNA, 25 bp, Homo sapien
cgagaagcccgactatgactacctg

SEQ ID NO: 12038 - DNA, 25 bp, Homo sapien
cctctgctggacacgccgaggaggc

SEQ ID NO: 12039 - DNA, 25 bp, Homo sapien
gccctctgctggacacgccgaggag

SEQ ID NO: 12040 - DNA, 25 bp, Homo sapien
gtggaaacatttgccccgcagcgac

SEQ ID NO: 12041 - DNA, 25 bp, Homo sapien
ggtgagtggaaacatttgccccgca

SEQ ID NO: 12042 - DNA, 25 bp, Homo sapien
cacaggccgtgggtcgtggctccgg

SEQ ID NO: 12043 - DNA, 25 bp, Homo sapien
cgcgctttcgactctccctgcacag

SEQ ID NO: 12044 - DNA, 25 bp, Homo sapien
gaaccggttcacctcccaagtgctc

SEQ ID NO: 12045 - DNA, 25 bp, Homo sapien
cggttcacctcccaagtgctcaccg

SEQ ID NO: 12046 - DNA, 25 bp, Homo sapien
ctcccaacccgttaggaactgcagg

SEQ ID NO: 12047 - DNA, 25 bp, Homo sapien
agcgcgcaaagccttgtgggccaca

SEQ ID NO: 12048 - DNA, 25 bp, Homo sapien
atcagcccgccacgaactcggagga

SEQ ID NO: 12049 - DNA, 25 bp, Homo sapien
cctgcgggtcgagaatgtcatcagc

SEQ ID NO: 12050 - DNA, 25 bp, Homo sapien
gggtgtgctgcacccgaaacaggct

SEQ ID NO: 12051 - DNA, 25 bp, Homo sapien
cttcccagtcgtgacaaccacagat

SEQ ID NO: 12052 - DNA, 25 bp, Homo sapien
cagatgccacgttagggttagtgcc

SEQ ID NO: 12053 - DNA, 25 bp, Homo sapien
accaggctccttgggcgaacggcca

SEQ ID NO: 12054 - DNA, 25 bp, Homo sapien
ttctgcaggtcaaggtcaatcgctg

SEQ ID NO: 12055 - DNA, 25 bp, Homo sapien
ttattgctcacccagctaatcacgg

SEQ ID NO: 12056 - DNA, 25 bp, Homo sapien
cccaggccaatgtcccattgagtaa

SEQ ID NO: 12057 - DNA, 25 bp, Homo sapien
ctagtttaggtcttctgcaggtcaa

SEQ ID NO: 12058 - DNA, 25 bp, Homo sapien
gtcaatcgctgaccttcagagtgtc

SEQ ID NO: 12059 - DNA, 25 bp, Homo sapien
ctgggcgcagccgtttcttgctcat

SEQ ID NO: 12060 - DNA, 25 bp, Homo sapien
tcatgggccagggtgagttattgct

SEQ ID NO: 12061 - DNA, 25 bp, Homo sapien
agatgcaatcatgacctagtttagg

SEQ ID NO: 12062 - DNA, 25 bp, Homo sapien
cgtgggcacggagcttcctgcctct

SEQ ID NO: 12063 - DNA, 25 bp, Homo sapien
tgtcaccctgctcggccctcagccc

SEQ ID NO: 12064 - DNA, 25 bp, Homo sapien
accggttggtgtcaccctgctcggc

SEQ ID NO: 12065 - DNA, 25 bp, Homo sapien
gaggaccggttggtgtcaccctgct

SEQ ID NO: 12066 - DNA, 25 bp, Homo sapien
gcttctcgacgcacttgctcccgga

SEQ ID NO: 12067 - DNA, 25 bp, Homo sapien
cgggtgcttctcgacgcacttgctc

SEQ ID NO: 12068 - DNA, 25 bp, Homo sapien
ccaggcgggtgcttctcgacgcact

SEQ ID NO: 12069 - DNA, 25 bp, Homo sapien
tctctgctccgacacccggcaagca

SEQ ID NO: 12070 - DNA, 25 bp, Homo sapien
cgcagaactcaagccggcatccagg

SEQ ID NO: 12071 - DNA, 25 bp, Homo sapien
ccacactgaatcctgcgtgcgcaga

SEQ ID NO: 12072 - DNA, 25 bp, Homo sapien
tggggcccgtgtcctgataaacgga

SEQ ID NO: 12073 - DNA, 25 bp, Homo sapien
aggaacgcaaggtctgggacccacg

SEQ ID NO: 12074 - DNA, 25 bp, Homo sapien
caggctggctcctagcagagaaatg

SEQ ID NO: 12075 - DNA, 25 bp, Homo sapien
cagagaaatgggaatcgcaaatgca

SEQ ID NO: 12076 - DNA, 25 bp, Homo sapien
tgcaatgtgcagtgaagagacgcga

SEQ ID NO: 12077 - DNA, 25 bp, Homo sapien
cggcatccaggcagtgggaacgccc

SEQ ID NO: 12078 - DNA, 25 bp, Homo sapien
tgatggcgtctgcagtgtttttgtc

SEQ ID NO: 12079 - DNA, 25 bp, Homo sapien
tgcagtgtttttgtcgatgttctcc

SEQ ID NO: 12080 - DNA, 25 bp, Homo sapien
gccagctgcggttcatcgaagagtc

SEQ ID NO: 12081 - DNA, 25 bp, Homo sapien
tcatcgaagagtcgcgcctggcaag

SEQ ID NO: 12082 - DNA, 25 bp, Homo sapien
tcgcgcctggcaagagacatcgacg

SEQ ID NO: 12083 - DNA, 25 bp, Homo sapien
cgcggtggggacatcagcacccagc

SEQ ID NO: 12084 - DNA, 25 bp, Homo sapien
ggtcaatgtcggtgaagccctccgc

SEQ ID NO: 12085 - DNA, 25 bp, Homo sapien
ctgcggttcatcgaagagtcgcgcc

SEQ ID NO: 12086 - DNA, 25 bp, Homo sapien
agcatgaaggcgttgtcggctcgca

SEQ ID NO: 12087 - DNA, 25 bp, Homo sapien
tcaggaactccacgcaatgggcctc

SEQ ID NO: 12088 - DNA, 25 bp, Homo sapien
cgcgtacttcttggcggtgtatagc

SEQ ID NO: 12089 - DNA, 25 bp, Homo sapien
atagcgtggtcatcaccgtctccgg

SEQ ID NO: 12090 - DNA, 25 bp, Homo sapien
ggccaatctgcacctcgtccgagta

SEQ ID NO: 12091 - DNA, 25 bp, Homo sapien
gaaacctgcagaagcaacgcgggtg

SEQ ID NO: 12092 - DNA, 25 bp, Homo sapien
ggggaccactcagaccgttagactc

SEQ ID NO: 12093 - DNA, 25 bp, Homo sapien
ccacctgcgtgagcagcatgaaggc

SEQ ID NO: 12094 - DNA, 25 bp, Homo sapien
tcgcgaagtgggatcacagacgctc

SEQ ID NO: 12095 - DNA, 25 bp, Homo sapien
aggccggtgctaactccgtgagtca

SEQ ID NO: 12096 - DNA, 25 bp, Homo sapien
ggtcagaaaccaacgcagtggcttc

SEQ ID NO: 12097 - DNA, 25 bp, Homo sapien
aacctccaggactggctgggcgacc

SEQ ID NO: 12098 - DNA, 25 bp, Homo sapien
ttccgcacggatgggacctgcttct

SEQ ID NO: 12099 - DNA, 25 bp, Homo sapien
agcaagtgccggctctcaacagcct

SEQ ID NO: 12100 - DNA, 25 bp, Homo sapien
cgggttcacagacgctcgcgaagtg

SEQ ID NO: 12101 - DNA, 25 bp, Homo sapien
ctccggagctacaggtggttccgca

SEQ ID NO: 12102 - DNA, 25 bp, Homo sapien
cctagccgcgcgcacttctaaagtg

SEQ ID NO: 12103 - DNA, 25 bp, Homo sapien
gtggaaccctgtattgcatagaacg

SEQ ID NO: 12104 - DNA, 25 bp, Homo sapien
ccgttttcctgaaggtggcagacca

SEQ ID NO: 12105 - DNA, 25 bp, Homo sapien
gcagaccaaaaacactgccctgggg

SEQ ID NO: 12106 - DNA, 25 bp, Homo sapien
ggtctgggctcagctctaaggacaa

SEQ ID NO: 12107 - DNA, 25 bp, Homo sapien
tctaaggacaaggacggagctgacg

SEQ ID NO: 12108 - DNA, 25 bp, Homo sapien
ctgacggagcttccaggtcaggccc

SEQ ID NO: 12109 - DNA, 25 bp, Homo sapien
cgaccgcggatttagaagccagagg

SEQ ID NO: 12110 - DNA, 25 bp, Homo sapien
ggctccgcgaggttatgcaaccgca

SEQ ID NO: 12111 - DNA, 25 bp, Homo sapien
tgcccaggtcgaagtcacagatctt

SEQ ID NO: 12112 - DNA, 25 bp, Homo sapien
cgggtagccgctgagtaggatatac

SEQ ID NO: 12113 - DNA, 25 bp, Homo sapien
gtcgcagcgcttgtcgtagatgcta

SEQ ID NO: 12114 - DNA, 25 bp, Homo sapien
tagatgctagcctcctcgctgaagg

SEQ ID NO: 12115 - DNA, 25 bp, Homo sapien
cccaaccaatcagcggctgttgcta

SEQ ID NO: 12116 - DNA, 25 bp, Homo sapien
ccgttgagtttgatgccgctgccca

SEQ ID NO: 12117 - DNA, 25 bp, Homo sapien
ccagcattacgtgggaaccgagccc

SEQ ID NO: 12118 - DNA, 25 bp, Homo sapien
aaacctgcccgagaagctgtcggtg

SEQ ID NO: 12119 - DNA, 25 bp, Homo sapien
ttcctgcagctggtagacgtctgcc

SEQ ID NO: 12120 - DNA, 25 bp, Homo sapien
agcacatcttcctgcagctggtaga

SEQ ID NO: 12121 - DNA, 25 bp, Homo sapien
caggtctgcactcgggcatgagcgc

SEQ ID NO: 12122 - DNA, 25 bp, Homo sapien
tgatcaggttgatgcaggtctgcac

SEQ ID NO: 12123 - DNA, 25 bp, Homo sapien
caccttgacggcgtactcctggctg

SEQ ID NO: 12124 - DNA, 25 bp, Homo sapien
cagccggaatgccacacactgtttc

SEQ ID NO: 12125 - DNA, 25 bp, Homo sapien
tcttcccggctgtaggacggacagc

SEQ ID NO: 12126 - DNA, 25 bp, Homo sapien
ttataggcccggacctgctctggcc

SEQ ID NO: 12127 - DNA, 25 bp, Homo sapien
agctggcctgtttttgccgcctgag

SEQ ID NO: 12128 - DNA, 25 bp, Homo sapien
cggaacctaggcagcgaccctgcgg

SEQ ID NO: 12129 - DNA, 25 bp, Homo sapien
tgtccgaaacggctagcgcacgcct

SEQ ID NO: 12130 - DNA, 25 bp, Homo sapien
ggccattccggtggtccagcccgga

SEQ ID NO: 12131 - DNA, 25 bp, Homo sapien
ttcggctggtttcttctgcaccatc

SEQ ID NO: 12132 - DNA, 25 bp, Homo sapien
cggtggaaaccctgaagttcggctg

SEQ ID NO: 12133 - DNA, 25 bp, Homo sapien
ggcctcaccttgaacgaacggtgga

SEQ ID NO: 12134 - DNA, 25 bp, Homo sapien
gatcacgctccagccaatggaattg

SEQ ID NO: 12135 - DNA, 25 bp, Homo sapien
cgatcagggccttgtgcctcttaaa

SEQ ID NO: 12136 - DNA, 25 bp, Homo sapien
ggcaacgcgtttgcgtcagcgaacc

SEQ ID NO: 12137 - DNA, 25 bp, Homo sapien
cttaaagggaccgtgcgcattactc

SEQ ID NO: 12138 - DNA, 25 bp, Homo sapien
cctgttttgcccgtttgtgtgactc

SEQ ID NO: 12139 - DNA, 25 bp, Homo sapien
ttcagtttccgcaggtgcacagagc

SEQ ID NO: 12140 - DNA, 25 bp, Homo sapien
gcgcgatgcattcacggctactcct

SEQ ID NO: 12141 - DNA, 25 bp, Homo sapien
gcagcgcccacgttttgcactagca

SEQ ID NO: 12142 - DNA, 25 bp, Homo sapien
cacaggctgctcaggaccgaggctg

SEQ ID NO: 12143 - DNA, 25 bp, Homo sapien
tcccacaggctgctcaggaccgagg

SEQ ID NO: 12144 - DNA, 25 bp, Homo sapien
ccggtagctgctctcccgagaggcg

SEQ ID NO: 12145 - DNA, 25 bp, Homo sapien
ctgtccaggagtgttctggactgtc

SEQ ID NO: 12146 - DNA, 25 bp, Homo sapien
ccaggagtgttctggactgtcccgt

SEQ ID NO: 12147 - DNA, 25 bp, Homo sapien
gtcccgtcgccaccattcccacagg

SEQ ID NO: 12148 - DNA, 25 bp, Homo sapien
tggctaggacccagtccccggtagc

SEQ ID NO: 12149 - DNA, 25 bp, Homo sapien
agtgttctggactgtcccgtcgcca

SEQ ID NO: 12150 - DNA, 25 bp, Homo sapien
aggagtgggcgcctctatttaagcg

SEQ ID NO: 12151 - DNA, 25 bp, Homo sapien
ggcgcctctatttaagcggcttccc

SEQ ID NO: 12152 - DNA, 25 bp, Homo sapien
atgaggcttggaacagacccagacc

SEQ ID NO: 12153 - DNA, 25 bp, Homo sapien
cccgtgcctgaatatgaggcttgga

SEQ ID NO: 12154 - DNA, 25 bp, Homo sapien
gcgatcttcccgtgcctgaatatga

SEQ ID NO: 12155 - DNA, 25 bp, Homo sapien
gtctgcgatcttcccgtgcctgaat

SEQ ID NO: 12156 - DNA, 25 bp, Homo sapien
catgcacttgacctcgaccctccgg

SEQ ID NO: 12157 - DNA, 25 bp, Homo sapien
gcccagcctctgtcccacttccatg

SEQ ID NO: 12158 - DNA, 25 bp, Homo sapien
ccagacagacggagccgttctcctg

SEQ ID NO: 12159 - DNA, 25 bp, Homo sapien
ccgggagcaggatcccatccagtga

SEQ ID NO: 12160 - DNA, 25 bp, Homo sapien
ccatccagtgatgcgtaggcctgtg

SEQ ID NO: 12161 - DNA, 25 bp, Homo sapien
cttctctggcttggaaagaagggca

SEQ ID NO: 12162 - DNA, 25 bp, Homo sapien
aaatatcgaggaacgtgggccacgc

SEQ ID NO: 12163 - DNA, 25 bp, Homo sapien
tggcaccagaaggtcagcagagaca

SEQ ID NO: 12164 - DNA, 25 bp, Homo sapien
tgcgcacatgggcacctgatgcctg

SEQ ID NO: 12165 - DNA, 25 bp, Homo sapien
ccgagaggacagcacggcctgaaca

SEQ ID NO: 12166 - DNA, 25 bp, Homo sapien
cttgtagcaggtgttcacgtgggcc

SEQ ID NO: 12167 - DNA, 25 bp, Homo sapien
cggaacagccgcgacaggatcttcc

SEQ ID NO: 12168 - DNA, 25 bp, Homo sapien
cgctctgggacacctgagctcagga

SEQ ID NO: 12169 - DNA, 25 bp, Homo sapien
cgccggcatttgttccgtgggagaa

SEQ ID NO: 12170 - DNA, 25 bp, Homo sapien
ggctccagctccttggtgtcgatga

SEQ ID NO: 12171 - DNA, 25 bp, Homo sapien
ggccgaactccttgacgaaatagta

SEQ ID NO: 12172 - DNA, 25 bp, Homo sapien
cccatctgcgcgatgcggtcaaagt

SEQ ID NO: 12173 - DNA, 25 bp, Homo sapien
tttcataagggacactgagcggcgc

SEQ ID NO: 12174 - DNA, 25 bp, Homo sapien
tccagtccatcagcaggtccatgta

SEQ ID NO: 12175 - DNA, 25 bp, Homo sapien
cttcttgtgcagctcgaagcgctgg

SEQ ID NO: 12176 - DNA, 25 bp, Homo sapien
acgtgaacagccacccagtcgttca

SEQ ID NO: 12177 - DNA, 25 bp, Homo sapien
actgctccgtgcagccgtcgctgat

SEQ ID NO: 12178 - DNA, 25 bp, Homo sapien
tgggcttccggaacttatgctcatc

SEQ ID NO: 12179 - DNA, 25 bp, Homo sapien
cgttgttgatctgcgcctcgatcca

SEQ ID NO: 12180 - DNA, 25 bp, Homo sapien
ccagcggtactcatacttggggccc

SEQ ID NO: 12181 - DNA, 25 bp, Homo sapien
agcgctgggtgcctggctcaaactt

SEQ ID NO: 12182 - DNA, 25 bp, Homo sapien
gcaagaagggcctattcgaaagggc

SEQ ID NO: 12183 - DNA, 25 bp, Homo sapien
cccgagcaagaagggcctattcgaa

SEQ ID NO: 12184 - DNA, 25 bp, Homo sapien
accgccgcgttggcttggggatcct

SEQ ID NO: 12185 - DNA, 25 bp, Homo sapien
tgaagccctgcagaattttaatcca

SEQ ID NO: 12186 - DNA, 25 bp, Homo sapien
ggccctgccagcgactttggggacc

SEQ ID NO: 12187 - DNA, 25 bp, Homo sapien
ctgcagaattttaatccacaccggg

SEQ ID NO: 12188 - DNA, 25 bp, Homo sapien
cagaattttaatccacaccgggagg

SEQ ID NO: 12189 - DNA, 25 bp, Homo sapien
gccagcgactttggggaccccgagc

SEQ ID NO: 12190 - DNA, 25 bp, Homo sapien
ctcaccgactggagcgacgacacga

SEQ ID NO: 12191 - DNA, 25 bp, Homo sapien
gcacggagccaagttccgggcagca

SEQ ID NO: 12192 - DNA, 25 bp, Homo sapien
gcggaggtctccgttgcctagcaac

SEQ ID NO: 12193 - DNA, 25 bp, Homo sapien
gccattggcacaggcacgggccatt

SEQ ID NO: 12194 - DNA, 25 bp, Homo sapien
accgccaccatgtgaacttcaagtc

SEQ ID NO: 12195 - DNA, 25 bp, Homo sapien
gacgacacgatgaaggagctgcacc

SEQ ID NO: 12196 - DNA, 25 bp, Homo sapien
ccaagatcagtgagtgccggagccc

SEQ ID NO: 12197 - DNA, 25 bp, Homo sapien
ggcccacccagtggcggagtcttct

SEQ ID NO: 12198 - DNA, 25 bp, Homo sapien
ccggagacacttgcctggaaccttc

SEQ ID NO: 12199 - DNA, 25 bp, Homo sapien
ccatgtgacaaatgcggcgccgaca

SEQ ID NO: 12200 - DNA, 25 bp, Homo sapien
gtgacacacgtgcaagacaagcctc

SEQ ID NO: 12201 - DNA, 25 bp, Homo sapien
gacggagaggtcaatctgcaccacg

SEQ ID NO: 12202 - DNA, 25 bp, Homo sapien
tgcaccacgggaatgtgctccacgc

SEQ ID NO: 12203 - DNA, 25 bp, Homo sapien
tcctggtaccgctgcaaaggcaaca

SEQ ID NO: 12204 - DNA, 25 bp, Homo sapien
tgcaaaggcaacacccaggcgttac

SEQ ID NO: 12205 - DNA, 25 bp, Homo sapien
tactgatctgacataggcagccctg

SEQ ID NO: 12206 - DNA, 25 bp, Homo sapien
agtggctcattgatccaggcgtcca

SEQ ID NO: 12207 - DNA, 25 bp, Homo sapien
agccagcagctcacccgagccagct

SEQ ID NO: 12208 - DNA, 25 bp, Homo sapien
ggaagacggccctgggcctctcgtc

SEQ ID NO: 12209 - DNA, 25 bp, Homo sapien
gctgtccgagagtggctcattgatc

SEQ ID NO: 12210 - DNA, 25 bp, Homo sapien
ctcattgatccaggcgtccaggtcc

SEQ ID NO: 12211 - DNA, 25 bp, Homo sapien
acacaaggcagtgtgtgaccgagca

SEQ ID NO: 12212 - DNA, 25 bp, Homo sapien
tgtgtgaccgagcacgcgcctgcag

SEQ ID NO: 12213 - DNA, 25 bp, Homo sapien
tcctctgactcgctgtccgagagtg

SEQ ID NO: 12214 - DNA, 25 bp, Homo sapien
agctccaccaggatgctgatgtacc

SEQ ID NO: 12215 - DNA, 25 bp, Homo sapien
cactgtcaagcagcgcagacatctg

SEQ ID NO: 12216 - DNA, 25 bp, Homo sapien
ctcacagatcccgttccgctgggtg

SEQ ID NO: 12217 - DNA, 25 bp, Homo sapien
ggcagcgtacagcacctcacagatc

SEQ ID NO: 12218 - DNA, 25 bp, Homo sapien
cagacatctgggacacggcgaactt

SEQ ID NO: 12219 - DNA, 25 bp, Homo sapien
cgaacttgcggatggccttcacgcg

SEQ ID NO: 12220 - DNA, 25 bp, Homo sapien
acgtccagcatttgggcggcgatga

SEQ ID NO: 12221 - DNA, 25 bp, Homo sapien
cacgcggatggccacgtccagcatt

SEQ ID NO: 12222 - DNA, 25 bp, Homo sapien
ggacagggcccatcggccacgatct

SEQ ID NO: 12223 - DNA, 25 bp, Homo sapien
acgatctagacacctccgggcggac

SEQ ID NO: 12224 - DNA, 25 bp, Homo sapien
cgatctagacacctccgggcggaca

SEQ ID NO: 12225 - DNA, 25 bp, Homo sapien
cacgatctagacacctccgggcgga

SEQ ID NO: 12226 - DNA, 25 bp, Homo sapien
gacagggcccatcggccacgatcta

SEQ ID NO: 12227 - DNA, 25 bp, Homo sapien
atcggccacgatctagacaccaggt

SEQ ID NO: 12228 - DNA, 25 bp, Homo sapien
tcggccacgatctagacaccaggtg

SEQ ID NO: 12229 - DNA, 25 bp, Homo sapien
catcggccacgatctagacaccagg

SEQ ID NO: 12230 - DNA, 25 bp, Homo sapien
cagccgaatgtttccctcaaccgga

SEQ ID NO: 12231 - DNA, 25 bp, Homo sapien
gaagtcaagcaaagcccaaacggcc

SEQ ID NO: 12232 - DNA, 25 bp, Homo sapien
tgcagggtccgaagtcaagcaaagc

SEQ ID NO: 12233 - DNA, 25 bp, Homo sapien
ccaggccaggggcatctaaccagga

SEQ ID NO: 12234 - DNA, 25 bp, Homo sapien
ggcatctaaccaggaagcctccgcg

SEQ ID NO: 12235 - DNA, 25 bp, Homo sapien
gctcgctaaggcagcaccaggcgtc

SEQ ID NO: 12236 - DNA, 25 bp, Homo sapien
cgctccgagcctacctgagacgggg

SEQ ID NO: 12237 - DNA, 25 bp, Homo sapien
tattttgatgggtgccaaggtcagg

SEQ ID NO: 12238 - DNA, 25 bp, Homo sapien
gcatctagggcgcatgtcgcccgcg

SEQ ID NO: 12239 - DNA, 25 bp, Homo sapien
aggtccctcctgctacatggccatg

SEQ ID NO: 12240 - DNA, 25 bp, Homo sapien
ggtccctcctgctacatggccatga

SEQ ID NO: 12241 - DNA, 25 bp, Homo sapien
ctgctacatggccatgacccaagag

SEQ ID NO: 12242 - DNA, 25 bp, Homo sapien
gctacatggccatgacccaagagcc

SEQ ID NO: 12243 - DNA, 25 bp, Homo sapien
ccacggcatctagggcgcatgtcgc

SEQ ID NO: 12244 - DNA, 25 bp, Homo sapien
atctagggcgcatgtcgcccgcggc

SEQ ID NO: 12245 - DNA, 25 bp, Homo sapien
cccacggcatctagggcgcatgtcg

SEQ ID NO: 12246 - DNA, 25 bp, Homo sapien
agctccttgtgtacggtgaggcgtc

SEQ ID NO: 12247 - DNA, 25 bp, Homo sapien
ggggccgcaccttccagcacaccgt

SEQ ID NO: 12248 - DNA, 25 bp, Homo sapien
acaccgtgcagctccttgtgtacgg

SEQ ID NO: 12249 - DNA, 25 bp, Homo sapien
accgtgcagctccttgtgtacggtg

SEQ ID NO: 12250 - DNA, 25 bp, Homo sapien
agcacaccgtgcagctccttgtgta

SEQ ID NO: 12251 - DNA, 25 bp, Homo sapien
tgcgcaacgcctcgctgtcggcggc

SEQ ID NO: 12252 - DNA, 25 bp, Homo sapien
gcggtgcagtcggacacgggccgca

SEQ ID NO: 12253 - DNA, 25 bp, Homo sapien
gcagcgtcctcaccgtgcgcaacgc

SEQ ID NO: 12254 - DNA, 25 bp, Homo sapien
cggcaagggcagactgcactcagca

SEQ ID NO: 12255 - DNA, 25 bp, Homo sapien
tcagcatgatgacgtcggtgccttc

SEQ ID NO: 12256 - DNA, 25 bp, Homo sapien
ggtgccttcgtgaaagctctgggaa

SEQ ID NO: 12257 - DNA, 25 bp, Homo sapien
gggaacacccaccttacggatctga

SEQ ID NO: 12258 - DNA, 25 bp, Homo sapien
tgctgcccacaggaagacgcgtgtg

SEQ ID NO: 12259 - DNA, 25 bp, Homo sapien
cctctctgcgtctgctgggaggact

SEQ ID NO: 12260 - DNA, 25 bp, Homo sapien
cggatctgattggtggtcagcatga

SEQ ID NO: 12261 - DNA, 25 bp, Homo sapien
ggaaccagacgctccggcaagggca

SEQ ID NO: 12262 - DNA, 25 bp, Homo sapien
tggagctccgcctttcctgaatgta

SEQ ID NO: 12263 - DNA, 25 bp, Homo sapien
ccgagatgtgctgctccaaggcctt

SEQ ID NO: 12264 - DNA, 25 bp, Homo sapien
tccaactaagacagagcccgggcgg

SEQ ID NO: 12265 - DNA, 25 bp, Homo sapien
tcgtcctccttgtggttacggatgc

SEQ ID NO: 12266 - DNA, 25 bp, Homo sapien
cttcaccatcttgagggccatcgcg

SEQ ID NO: 12267 - DNA, 25 bp, Homo sapien
agacgctgcgtttccctgacgacga

SEQ ID NO: 12268 - DNA, 25 bp, Homo sapien
tctcattggtcagtggcctccggaa

SEQ ID NO: 12269 - DNA, 25 bp, Homo sapien
ccacgtggagcttagccggcaagtt

SEQ ID NO: 12270 - DNA, 25 bp, Homo sapien
gccgcgttttgactggaagcccgcc

SEQ ID NO: 12271 - DNA, 25 bp, Homo sapien
tttgagggcatcctttcctgtctcc

SEQ ID NO: 12272 - DNA, 25 bp, Homo sapien
tggttggggacaggctttatttatc

SEQ ID NO: 12273 - DNA, 25 bp, Homo sapien
ttgtcacgcttttcctactcgggca

SEQ ID NO: 12274 - DNA, 25 bp, Homo sapien
ctggccctgggaaattaggcatctt

SEQ ID NO: 12275 - DNA, 25 bp, Homo sapien
ggcatctttgacctgttaatcctag

SEQ ID NO: 12276 - DNA, 25 bp, Homo sapien
tatccttggaaattgggacttctcc

SEQ ID NO: 12277 - DNA, 25 bp, Homo sapien
tggtgaccgttggaaaatgacaggc

SEQ ID NO: 12278 - DNA, 25 bp, Homo sapien
ctgcgccatatcctgcagcaggtct

SEQ ID NO: 12279 - DNA, 25 bp, Homo sapien
cagcaggtctacaaccactcggtga

SEQ ID NO: 12280 - DNA, 25 bp, Homo sapien
tccttcgacctggtggcccagatga

SEQ ID NO: 12281 - DNA, 25 bp, Homo sapien
ttgatgagatcaagatgaccgacga

SEQ ID NO: 12282 - DNA, 25 bp, Homo sapien
gatgaccgacgacgacctgtttgtg

SEQ ID NO: 12283 - DNA, 25 bp, Homo sapien
acgacgacctgtttgtggacttggg

SEQ ID NO: 12284 - DNA, 25 bp, Homo sapien
tggaagggcaccacgcagcccatga

SEQ ID NO: 12285 - DNA, 25 bp, Homo sapien
atgaagctgaacacgcggccgtcca

SEQ ID NO: 12286 - DNA, 25 bp, Homo sapien
ctgtgatgggtttccagtgctgaac

SEQ ID NO: 12287 - DNA, 25 bp, Homo sapien
ccacgcctgtctggtttggtctctg

SEQ ID NO: 12288 - DNA, 25 bp, Homo sapien
gtgcgctttttcgttgctgcttcta

SEQ ID NO: 12289 - DNA, 25 bp, Homo sapien
gcgcggtgctgtggtttctgttcct

SEQ ID NO: 12290 - DNA, 25 bp, Homo sapien
agtgctgaacgcgtccgccttggtc

SEQ ID NO: 12291 - DNA, 25 bp, Homo sapien
ggcgtgcgattctgtttatccaagg

SEQ ID NO: 12292 - DNA, 25 bp, Homo sapien
ccaaggtgggattctgctggctgat

SEQ ID NO: 12293 - DNA, 25 bp, Homo sapien
ctgcttctagtgtcagcgcggtgct

SEQ ID NO: 12294 - DNA, 25 bp, Homo sapien
cgaatcgccaacacgaggtatggcc

SEQ ID NO: 12295 - DNA, 25 bp, Homo sapien
atcgccaacacgaggtatggccagc

SEQ ID NO: 12296 - DNA, 25 bp, Homo sapien
gccaacacgaggtatggccagcgtg

SEQ ID NO: 12297 - DNA, 25 bp, Homo sapien
ccaacacgaggtatggccagcgtgg

SEQ ID NO: 12298 - DNA, 25 bp, Homo sapien
agcgtggggcatgcagggcatgtgg

SEQ ID NO: 12299 - DNA, 25 bp, Homo sapien
cctcgctcctgtgctggctgtggca

SEQ ID NO: 12300 - DNA, 25 bp, Homo sapien
gcgcctttccctcacgctgggtctc

SEQ ID NO: 12301 - DNA, 25 bp, Homo sapien
agggcatgtggggtgtgcgctcaca

SEQ ID NO: 12302 - DNA, 25 bp, Homo sapien
gtttgttcccagacgaattgcgcca

SEQ ID NO: 12303 - DNA, 25 bp, Homo sapien
cccagacgaattgcgccacctgtga

SEQ ID NO: 12304 - DNA, 25 bp, Homo sapien
ctctgttgtggggtttgttcccaga

SEQ ID NO: 12305 - DNA, 25 bp, Homo sapien
tggagcaggacaaccgcgcgctccg

SEQ ID NO: 12306 - DNA, 25 bp, Homo sapien
agaaggagatctccgcccataacca

SEQ ID NO: 12307 - DNA, 25 bp, Homo sapien
tgattcaagcgcagaaggagatctc

SEQ ID NO: 12308 - DNA, 25 bp, Homo sapien
tgacctacaacgacctgattcaagc

SEQ ID NO: 12309 - DNA, 25 bp, Homo sapien
cgccacctgtgaaagcttgtcgagc

SEQ ID NO: 12310 - DNA, 25 bp, Homo sapien
ccaagattgtgctgaggcggcacct

SEQ ID NO: 12311 - DNA, 25 bp, Homo sapien
ggcacctgagccaggaccacacggt

SEQ ID NO: 12312 - DNA, 25 bp, Homo sapien
ctcacttgagcagcatgagcccgga

SEQ ID NO: 12313 - DNA, 25 bp, Homo sapien
atgagcccggagctctccatgaacg

SEQ ID NO: 12314 - DNA, 25 bp, Homo sapien
ccaggctgctggctatgagctctgc

SEQ ID NO: 12315 - DNA, 25 bp, Homo sapien
ctgagccggccttcgtcgaagcaga

SEQ ID NO: 12316 - DNA, 25 bp, Homo sapien
gagaagctgtctggcctagccgcac

SEQ ID NO: 12317 - DNA, 25 bp, Homo sapien
gctggactgcaccaagttctcgctg

SEQ ID NO: 12318 - DNA, 25 bp, Homo sapien
gcgcgggcggatttctgttgcacaa

SEQ ID NO: 12319 - DNA, 25 bp, Homo sapien
ctctgcgtccatcggccagaggaga

SEQ ID NO: 12320 - DNA, 25 bp, Homo sapien
ggctccggagcgaactcacttggct

SEQ ID NO: 12321 - DNA, 25 bp, Homo sapien
gcactcaagggcaagcggaagccga

SEQ ID NO: 12322 - DNA, 25 bp, Homo sapien
tttctgttgcacaaatgggccaaac

SEQ ID NO: 12323 - DNA, 25 bp, Homo sapien
caaatgggccaaacaggttcgtaag

SEQ ID NO: 12324 - DNA, 25 bp, Homo sapien
gtgcctggtctgaagttccgcgccc

SEQ ID NO: 12325 - DNA, 25 bp, Homo sapien
tccgggctccgcactcaagggcaag

SEQ ID NO: 12326 - DNA, 25 bp, Homo sapien
tcgggccttcgtctgcagggcctga

SEQ ID NO: 12327 - DNA, 25 bp, Homo sapien
ccaagggccacgttgaggcaaaaca

SEQ ID NO: 12328 - DNA, 25 bp, Homo sapien
aaacagtctggggtgctcgagacct

SEQ ID NO: 12329 - DNA, 25 bp, Homo sapien
cgagacctggctcactttgcgaagt

SEQ ID NO: 12330 - DNA, 25 bp, Homo sapien
ttgcgaagtctcacgctgtaaaatg

SEQ ID NO: 12331 - DNA, 25 bp, Homo sapien
ctgtaaaatgtcgagcgtgaggcaa

SEQ ID NO: 12332 - DNA, 25 bp, Homo sapien
atgcagtcaaggtgggctgtccaaa

SEQ ID NO: 12333 - DNA, 25 bp, Homo sapien
tcgagcgtgaggcaatgcagtcaag

SEQ ID NO: 12334 - DNA, 25 bp, Homo sapien
ttttcagaaggccaccgtgcgcagg

SEQ ID NO: 12335 - DNA, 25 bp, Homo sapien
gtgtctttaaccacgcggtgccctc

SEQ ID NO: 12336 - DNA, 25 bp, Homo sapien
ttccctttttgtgagcctgcggctg

SEQ ID NO: 12337 - DNA, 25 bp, Homo sapien
tttctcccgtggaggtcacctgcta

SEQ ID NO: 12338 - DNA, 25 bp, Homo sapien
accgcgtccctcttgttttcagaag

SEQ ID NO: 12339 - DNA, 25 bp, Homo sapien
ttccgcactctcttgcagcaggagc

SEQ ID NO: 12340 - DNA, 25 bp, Homo sapien
actcgcacgccatgggcagcttttc

SEQ ID NO: 12341 - DNA, 25 bp, Homo sapien
gaggtcgacctcaagaatggccaca

SEQ ID NO: 12342 - DNA, 25 bp, Homo sapien
tgcggtgtcagaaagctccctctgg

SEQ ID NO: 12343 - DNA, 25 bp, Homo sapien
acggggacggcacccagcaagctct

SEQ ID NO: 12344 - DNA, 25 bp, Homo sapien
tcggtgagaagcttaaccaggagtc

SEQ ID NO: 12345 - DNA, 25 bp, Homo sapien
ccgaaagcagtgagggaagatccac

SEQ ID NO: 12346 - DNA, 25 bp, Homo sapien
cttatggaggagactgcttgtgttt

SEQ ID NO: 12347 - DNA, 25 bp, Homo sapien
ggcttagtggtttcctcggtgagaa

SEQ ID NO: 12348 - DNA, 25 bp, Homo sapien
ccaataggggctcagcgcagctgca

SEQ ID NO: 12349 - DNA, 25 bp, Homo sapien
cctggagagccatggcagagtttac

SEQ ID NO: 12350 - DNA, 25 bp, Homo sapien
cccttctgcaggtaactaggatttc

SEQ ID NO: 12351 - DNA, 25 bp, Homo sapien
cgggcacgttgaacaagtgcattta

SEQ ID NO: 12352 - DNA, 25 bp, Homo sapien
cgatggtaacctcaggccgctcttc

SEQ ID NO: 12353 - DNA, 25 bp, Homo sapien
gcttggtgctgactagacgctgaca

SEQ ID NO: 12354 - DNA, 25 bp, Homo sapien
agctccactgtgaatcggcggcacg

SEQ ID NO: 12355 - DNA, 25 bp, Homo sapien
acctatgcaaggacggtgtggacca

SEQ ID NO: 12356 - DNA, 25 bp, Homo sapien
tatttctcggctgtccatggctcgc

SEQ ID NO: 12357 - DNA, 25 bp, Homo sapien
taggatttctacctcaaccgcgaga

SEQ ID NO: 12358 - DNA, 25 bp, Homo sapien
ggccggcgccaaaaatgtctcaggg

SEQ ID NO: 12359 - DNA, 25 bp, Homo sapien
agaggaaattcaccaccagcttcac

SEQ ID NO: 12360 - DNA, 25 bp, Homo sapien
agctccttctcgttgtaccgcatgg

SEQ ID NO: 12361 - DNA, 25 bp, Homo sapien
tctcagggcgcagacacggaagcac

SEQ ID NO: 12362 - DNA, 25 bp, Homo sapien
ccggaccaaggtggaacagaatcaa

SEQ ID NO: 12363 - DNA, 25 bp, Homo sapien
gccgttcgccaaacgaagtcgtgga

SEQ ID NO: 12364 - DNA, 25 bp, Homo sapien
cggcctcgtctgtccgaaagtagaa

SEQ ID NO: 12365 - DNA, 25 bp, Homo sapien
gagacggaccgttgttacataacca

SEQ ID NO: 12366 - DNA, 25 bp, Homo sapien
ccaaaggcacccaagaggcggctct

SEQ ID NO: 12367 - DNA, 25 bp, Homo sapien
accggcgctggcagtacctgctcat

SEQ ID NO: 12368 - DNA, 25 bp, Homo sapien
cgtacgagcagaggatcgagcctcc

SEQ ID NO: 12369 - DNA, 25 bp, Homo sapien
accgcttcatgtctgcgtacgagca

SEQ ID NO: 12370 - DNA, 25 bp, Homo sapien
atcgccgagggcatcatgccacgtc

SEQ ID NO: 12371 - DNA, 25 bp, Homo sapien
attgactaccctgagatcgccgagg

SEQ ID NO: 12372 - DNA, 25 bp, Homo sapien
gagccctacgagaccattgccttca

SEQ ID NO: 12373 - DNA, 25 bp, Homo sapien
ggccgtgtccctgcagattgactac

SEQ ID NO: 12374 - DNA, 25 bp, Homo sapien
ttccgcggcctctctttcttaggtc

SEQ ID NO: 12375 - DNA, 25 bp, Homo sapien
ggctcctcttcgtcgttctctgcag

SEQ ID NO: 12376 - DNA, 25 bp, Homo sapien
gcggccgcagcactcgctttatttc

SEQ ID NO: 12377 - DNA, 25 bp, Homo sapien
ccaggcgtaaaggagcaggtgactc

SEQ ID NO: 12378 - DNA, 25 bp, Homo sapien
tgcccaacatggtggccaccgagtg

SEQ ID NO: 12379 - DNA, 25 bp, Homo sapien
tacgcgggcaagctgctcatcagcc

SEQ ID NO: 12380 - DNA, 25 bp, Homo sapien
ctttatttcgccagagtcgcggggc

SEQ ID NO: 12381 - DNA, 25 bp, Homo sapien
tcccgggaatcttgggtctgacctc

SEQ ID NO: 12382 - DNA, 25 bp, Homo sapien
ggtctcggtcgagctttcccgactg

SEQ ID NO: 12383 - DNA, 25 bp, Homo sapien
acgtagacggcacccagggcttctc

SEQ ID NO: 12384 - DNA, 25 bp, Homo sapien
ggtccctgttgcctcgatgtggccc

SEQ ID NO: 12385 - DNA, 25 bp, Homo sapien
agcgctttgcggtggacgagctccc

SEQ ID NO: 12386 - DNA, 25 bp, Homo sapien
aatctgcacttttcggtcccggccg

SEQ ID NO: 12387 - DNA, 25 bp, Homo sapien
ggggctggtgaatctgcacttttcg

SEQ ID NO: 12388 - DNA, 25 bp, Homo sapien
ctttgtcaaggccagaatcgcgccg

SEQ ID NO: 12389 - DNA, 25 bp, Homo sapien
cccggccttagcagtgctctcgggg

SEQ ID NO: 12390 - DNA, 25 bp, Homo sapien
tgagattgtgagaccggggcatccc

SEQ ID NO: 12391 - DNA, 25 bp, Homo sapien
gggccagccgagacgctgacactcg

SEQ ID NO: 12392 - DNA, 25 bp, Homo sapien
cggcaggggttctgacggcttctcc

SEQ ID NO: 12393 - DNA, 25 bp, Homo sapien
cgctgacactcgctgcagctttgca

SEQ ID NO: 12394 - DNA, 25 bp, Homo sapien
cctacacgttcgagagagagtcttc

SEQ ID NO: 12395 - DNA, 25 bp, Homo sapien
ggtaggaaccgtagactcgctcatc

SEQ ID NO: 12396 - DNA, 25 bp, Homo sapien
aggacagaggtaggtgacccgtatc

SEQ ID NO: 12397 - DNA, 25 bp, Homo sapien
aggtgacccgtatcgcctgcagtag

SEQ ID NO: 12398 - DNA, 25 bp, Homo sapien
ctcaacttttgagttcgccgtgtta

SEQ ID NO: 12399 - DNA, 25 bp, Homo sapien
ctcgaaaagattgtagacttggcga

SEQ ID NO: 12400 - DNA, 25 bp, Homo sapien
aggaggaactcgaaaagattgtaga

SEQ ID NO: 12401 - DNA, 25 bp, Homo sapien
acccggaaaatcagggccaggcctg

SEQ ID NO: 12402 - DNA, 25 bp, Homo sapien
agcgccacccggaaaatcagggcca

SEQ ID NO: 12403 - DNA, 25 bp, Homo sapien
gccgttcggggcagcagcacttccg

SEQ ID NO: 12404 - DNA, 25 bp, Homo sapien
aaaagattgtagacttggcgagcgg

SEQ ID NO: 12405 - DNA, 25 bp, Homo sapien
ttgagttcgccgtgttactggccgc

SEQ ID NO: 12406 - DNA, 25 bp, Homo sapien
cttacaccttggagaacgctgggcg

SEQ ID NO: 12407 - DNA, 25 bp, Homo sapien
cgccagtatgggaagatcctgcctc

SEQ ID NO: 12408 - DNA, 25 bp, Homo sapien
ggccggagctgatctagaagaaata

SEQ ID NO: 12409 - DNA, 25 bp, Homo sapien
cgcgcggcgcactttaaactctagc

SEQ ID NO: 12410 - DNA, 25 bp, Homo sapien
ggtcgctgaaagcagagactcctca

SEQ ID NO: 12411 - DNA, 25 bp, Homo sapien
tagaacctgctggactgactgcggc

SEQ ID NO: 12412 - DNA, 25 bp, Homo sapien
tccatgtgacacaggagccacgtga

SEQ ID NO: 12413 - DNA, 25 bp, Homo sapien
ccacccaaaggatctgccgagctga

SEQ ID NO: 12414 - DNA, 25 bp, Homo sapien
ggcccaaagatcctgaaaattccga

SEQ ID NO: 12415 - DNA, 25 bp, Homo sapien
gcgaaactgcgagctggtctccaga

SEQ ID NO: 12416 - DNA, 25 bp, Homo sapien
gcgtccgagtgaccctgtctagcct

SEQ ID NO: 12417 - DNA, 25 bp, Homo sapien
cgggattctcggacaccacaaacgc

SEQ ID NO: 12418 - DNA, 25 bp, Homo sapien
ggccttggagcaaattgcgcttgtc

SEQ ID NO: 12419 - DNA, 25 bp, Homo sapien
gcctcgtgcaaaatcgcgggtttcg

SEQ ID NO: 12420 - DNA, 25 bp, Homo sapien
ggcccttcgagaaccctgtggaatg

SEQ ID NO: 12421 - DNA, 25 bp, Homo sapien
ggtttcccaccaatggcctcggatc

SEQ ID NO: 12422 - DNA, 25 bp, Homo sapien
tcctacctggtgaagttcgtcctgc

SEQ ID NO: 12423 - DNA, 25 bp, Homo sapien
ctacagttgcattttggcggatttc

SEQ ID NO: 12424 - DNA, 25 bp, Homo sapien
aaaagaccatcctcgctggagcacg

SEQ ID NO: 12425 - DNA, 25 bp, Homo sapien
ggagcacgctccaaaactactactg

SEQ ID NO: 12426 - DNA, 25 bp, Homo sapien
gcgattccgaatgtctgcacgattt

SEQ ID NO: 12427 - DNA, 25 bp, Homo sapien
cggctgcgtcgctaaaatgagtgca

SEQ ID NO: 12428 - DNA, 25 bp, Homo sapien
gcttcgctcaagtgcagtcgctttc

SEQ ID NO: 12429 - DNA, 25 bp, Homo sapien
gacactttgcaactccggacggact

SEQ ID NO: 12430 - DNA, 25 bp, Homo sapien
ctctgctaggcgcaggaccagcagc

SEQ ID NO: 12431 - DNA, 25 bp, Homo sapien
gtattcgcaacacagccagtcctcg

SEQ ID NO: 12432 - DNA, 25 bp, Homo sapien
cgcaagcgggtcagctgtgctgcca

SEQ ID NO: 12433 - DNA, 25 bp, Homo sapien
cgaggtgccaccagcagcaagttct

SEQ ID NO: 12434 - DNA, 25 bp, Homo sapien
gttctccggccgcaactcgactagg

SEQ ID NO: 12435 - DNA, 25 bp, Homo sapien
ccaggaacttcagggccgcgctcag

SEQ ID NO: 12436 - DNA, 25 bp, Homo sapien
gcctcggccaggtattcgcaacaca

SEQ ID NO: 12437 - DNA, 25 bp, Homo sapien
gctgcagacagacgcggccaaagtc

SEQ ID NO: 12438 - DNA, 25 bp, Homo sapien
gcagtgtgcacagcctccgggctgt

SEQ ID NO: 12439 - DNA, 25 bp, Homo sapien
caccacgcggtaatacagggcgtcc

SEQ ID NO: 12440 - DNA, 25 bp, Homo sapien
tgcgcgcgcaccacgcggtaataca

SEQ ID NO: 12441 - DNA, 25 bp, Homo sapien
tctctgcgcagggtgagctgtctag

SEQ ID NO: 12442 - DNA, 25 bp, Homo sapien
agtgcagtgtgcacagcctccgggc

SEQ ID NO: 12443 - DNA, 25 bp, Homo sapien
tagatggtacggaggccctgcagct

SEQ ID NO: 12444 - DNA, 25 bp, Homo sapien
gcatagatggtacggaggccctgca

SEQ ID NO: 12445 - DNA, 25 bp, Homo sapien
ccgctctctgcgcagggtgagctgt

SEQ ID NO: 12446 - DNA, 25 bp, Homo sapien
tccagcagcggccagttgtcaatct

SEQ ID NO: 12447 - DNA, 25 bp, Homo sapien
cctccaacgtggagagcaggttgtt

SEQ ID NO: 12448 - DNA, 25 bp, Homo sapien
accgagtggaaggtgctctcctcca

SEQ ID NO: 12449 - DNA, 25 bp, Homo sapien
gtctctagcgtgttcaccgagtgga

SEQ ID NO: 12450 - DNA, 25 bp, Homo sapien
gaataccaggtcgttgtcgcccact

SEQ ID NO: 12451 - DNA, 25 bp, Homo sapien
ttgcggcacacgaagtactcgaaca

SEQ ID NO: 12452 - DNA, 25 bp, Homo sapien
gtcttgcgacgctgcacgatccaca

SEQ ID NO: 12453 - DNA, 25 bp, Homo sapien
ccagcaggattaccagcttgttctc

SEQ ID NO: 12454 - DNA, 25 bp, Homo sapien
gttgtagtgcgcgatgccttcttgg

SEQ ID NO: 12455 - DNA, 25 bp, Homo sapien
caccactcccagaggtgcgcagtgg

SEQ ID NO: 12456 - DNA, 25 bp, Homo sapien
acggaaatgctacgtgcggccctgc

SEQ ID NO: 12457 - DNA, 25 bp, Homo sapien
gcctgcgctcgcctgtaaacggcgg

SEQ ID NO: 12458 - DNA, 25 bp, Homo sapien
tggggcagcgatggacttcaactcc

SEQ ID NO: 12459 - DNA, 25 bp, Homo sapien
tacttcgagaacatgggcctgcgct

SEQ ID NO: 12460 - DNA, 25 bp, Homo sapien
gccttcctggctcactacttcgaga

SEQ ID NO: 12461 - DNA, 25 bp, Homo sapien
tcggcgtgacggaaatgctacgtgc

SEQ ID NO: 12462 - DNA, 25 bp, Homo sapien
aaaccaggttgtgcgtctcctcacg

SEQ ID NO: 12463 - DNA, 25 bp, Homo sapien
actggccttcgatcctcatttgcta

SEQ ID NO: 12464 - DNA, 25 bp, Homo sapien
tcatttgctaaatatctgcgaaggc

SEQ ID NO: 12465 - DNA, 25 bp, Homo sapien
aatatctgcgaaggcagctcccgcc

SEQ ID NO: 12466 - DNA, 25 bp, Homo sapien
cagtgcctacgcgaatttaatccca

SEQ ID NO: 12467 - DNA, 25 bp, Homo sapien
tcccagagcgaacagacgcggagcc

SEQ ID NO: 12468 - DNA, 25 bp, Homo sapien
cgcgaatttaatcccagagcgaaca

SEQ ID NO: 12469 - DNA, 25 bp, Homo sapien
cccgtggcccaaaccaggttgtgcg

SEQ ID NO: 12470 - DNA, 25 bp, Homo sapien
cccagcaaggggcacgtcccaccag

SEQ ID NO: 12471 - DNA, 25 bp, Homo sapien
gactcgtgtttcaaggacagagcct

SEQ ID NO: 12472 - DNA, 25 bp, Homo sapien
gacagagcctcattaccatgcacga

SEQ ID NO: 12473 - DNA, 25 bp, Homo sapien
catgcacgaccagccgcagctgagg

SEQ ID NO: 12474 - DNA, 25 bp, Homo sapien
gcacagcggcttccacgcagacgcc

SEQ ID NO: 12475 - DNA, 25 bp, Homo sapien
agggaggactcgtgtttcaaggaca

SEQ ID NO: 12476 - DNA, 25 bp, Homo sapien
gttggcgaccgagaaccttcctgcc

SEQ ID NO: 12477 - DNA, 25 bp, Homo sapien
gggtgacgtcacctcctcggctctg

SEQ ID NO: 12478 - DNA, 25 bp, Homo sapien
aggctctattcggacgttccccaca

SEQ ID NO: 12479 - DNA, 25 bp, Homo sapien
agaggagcgcatcctcccagcgtcc

SEQ ID NO: 12480 - DNA, 25 bp, Homo sapien
gctgcaggctctattcggacgttcc

SEQ ID NO: 12481 - DNA, 25 bp, Homo sapien
cagataccctttgcgtcttccagct

SEQ ID NO: 12482 - DNA, 25 bp, Homo sapien
cggtgtggaccccagataccctttg

SEQ ID NO: 12483 - DNA, 25 bp, Homo sapien
gccgtcagctccagcgatggagcag

SEQ ID NO: 12484 - DNA, 25 bp, Homo sapien
ccgggccgtcagctccagcgatgga

SEQ ID NO: 12485 - DNA, 25 bp, Homo sapien
gggcctggcaaggagcgatgagccc

SEQ ID NO: 12486 - DNA, 25 bp, Homo sapien
gccacgagcacgcagggacctcaga

SEQ ID NO: 12487 - DNA, 25 bp, Homo sapien
caagtccgcgggaaaccgagctgct

SEQ ID NO: 12488 - DNA, 25 bp, Homo sapien
ctccatgccgtcctgcgggcagatt

SEQ ID NO: 12489 - DNA, 25 bp, Homo sapien
cgggcagattagcaccacggacgtg

SEQ ID NO: 12490 - DNA, 25 bp, Homo sapien
tgtcctccgtgagcttgtactggtc

SEQ ID NO: 12491 - DNA, 25 bp, Homo sapien
agcttgtactggtcgtcagggtctg

SEQ ID NO: 12492 - DNA, 25 bp, Homo sapien
gacctcagacgggatgcgctctgtg

SEQ ID NO: 12493 - DNA, 25 bp, Homo sapien
agcagcagccaagtccgcgggaaac

SEQ ID NO: 12494 - DNA, 25 bp, Homo sapien
cttcacgttggtaactcagaggttt

SEQ ID NO: 12495 - DNA, 25 bp, Homo sapien
cgtctaggaccagtgagcgctcaag

SEQ ID NO: 12496 - DNA, 25 bp, Homo sapien
taggaccagtgagcgctcaagcccg

SEQ ID NO: 12497 - DNA, 25 bp, Homo sapien
agtgagcgctcaagcccgtccatcg

SEQ ID NO: 12498 - DNA, 25 bp, Homo sapien
cacgaggcttcacgttggtaactca

SEQ ID NO: 12499 - DNA, 25 bp, Homo sapien
actcagaggttttgtgggtttgaga

SEQ ID NO: 12500 - DNA, 25 bp, Homo sapien
ttgtgggtttgagagaagaagagcc

SEQ ID NO: 12501 - DNA, 25 bp, Homo sapien
ccgccacgaggcttcacgttggtaa

SEQ ID NO: 12502 - DNA, 25 bp, Homo sapien
tcccaccgggtctgaaatttgtgcc

SEQ ID NO: 12503 - DNA, 25 bp, Homo sapien
cccggatcgtcttgtcgatgtactt

SEQ ID NO: 12504 - DNA, 25 bp, Homo sapien
ggacaagtccaagatgctctccttt

SEQ ID NO: 12505 - DNA, 25 bp, Homo sapien
cttctccttatcctgcggggaaagc

SEQ ID NO: 12506 - DNA, 25 bp, Homo sapien
ctgggaaacatctgccgttggttgc

SEQ ID NO: 12507 - DNA, 25 bp, Homo sapien
atcctccggttctgcttctccgttt

SEQ ID NO: 12508 - DNA, 25 bp, Homo sapien
tgcttctccgtttcggggtctccag

SEQ ID NO: 12509 - DNA, 25 bp, Homo sapien
aagcagagcgcatgagacctggagc

SEQ ID NO: 12510 - DNA, 25 bp, Homo sapien
accttgcgtgcctggtcgttatctt

SEQ ID NO: 12511 - DNA, 25 bp, Homo sapien
agtcagacactgtcgcggactgtca

SEQ ID NO: 12512 - DNA, 25 bp, Homo sapien
cgcgacatcggagactgtcgggaaa

SEQ ID NO: 12513 - DNA, 25 bp, Homo sapien
ggacggttgcggacagtcagacact

SEQ ID NO: 12514 - DNA, 25 bp, Homo sapien
acactgtcgcggactgtcagggaag

SEQ ID NO: 12515 - DNA, 25 bp, Homo sapien
cagatggtcggggacagtcggaaaa

SEQ ID NO: 12516 - DNA, 25 bp, Homo sapien
agctcctaccttgcgtgcctggtcg

SEQ ID NO: 12517 - DNA, 25 bp, Homo sapien
acatcggagactgtcgggaaagtcg

SEQ ID NO: 12518 - DNA, 25 bp, Homo sapien
cgcgcggttccaggtatcggctcag

SEQ ID NO: 12519 - DNA, 25 bp, Homo sapien
ggggcgcgcggttccaggtatcagc

SEQ ID NO: 12520 - DNA, 25 bp, Homo sapien
gcgcggttccaggtatcggctcaga

SEQ ID NO: 12521 - DNA, 25 bp, Homo sapien
ccaggtatcagctcagagggagagg

SEQ ID NO: 12522 - DNA, 25 bp, Homo sapien
cgcggttccaggtatcggctcagag

SEQ ID NO: 12523 - DNA, 25 bp, Homo sapien
gcgcgcggttccaggtatcggctca

SEQ ID NO: 12524 - DNA, 25 bp, Homo sapien
gggcgcgcggttccaggtatcagct

SEQ ID NO: 12525 - DNA, 25 bp, Homo sapien
ttccaggtatcggctcagagggaga

SEQ ID NO: 12526 - DNA, 25 bp, Homo sapien
cccgaaggcaaagactactgcatcc

SEQ ID NO: 12527 - DNA, 25 bp, Homo sapien
agcaaggcagtgagtacccgctggc

SEQ ID NO: 12528 - DNA, 25 bp, Homo sapien
ttccgcacgacctcagcaaggcagt

SEQ ID NO: 12529 - DNA, 25 bp, Homo sapien
ggcaaagactactgcatcctctaca

SEQ ID NO: 12530 - DNA, 25 bp, Homo sapien
catggtgcacgtggtctcccaggcc

SEQ ID NO: 12531 - DNA, 25 bp, Homo sapien
tggctctgactgctggccttgtcct

SEQ ID NO: 12532 - DNA, 25 bp, Homo sapien
cacgtcccgtgctgtggctctgact

SEQ ID NO: 12533 - DNA, 25 bp, Homo sapien
tgcatcctctacaacccgcagtggg

SEQ ID NO: 12534 - DNA, 25 bp, Homo sapien
cggccagtcttccagaacagcagtg

SEQ ID NO: 12535 - DNA, 25 bp, Homo sapien
tggtgtctcccaagaaggtacatga

SEQ ID NO: 12536 - DNA, 25 bp, Homo sapien
atccaagctgcggttgctgcccaca

SEQ ID NO: 12537 - DNA, 25 bp, Homo sapien
ccatgtccagggctctttatgcaga

SEQ ID NO: 12538 - DNA, 25 bp, Homo sapien
gaatcagtctcttttcctgccaggg

SEQ ID NO: 12539 - DNA, 25 bp, Homo sapien
tgctccatgctggtgctgctctact

SEQ ID NO: 12540 - DNA, 25 bp, Homo sapien
agtgtacgtggtcatcgggatcttc

SEQ ID NO: 12541 - DNA, 25 bp, Homo sapien
catcttcatcatggctgtgggcacc

SEQ ID NO: 12542 - DNA, 25 bp, Homo sapien
acgcactcttattcgcctgattccg

SEQ ID NO: 12543 - DNA, 25 bp, Homo sapien
gttctctccctccacacacagactc

SEQ ID NO: 12544 - DNA, 25 bp, Homo sapien
tcacgcactcttattcgcctgattc

SEQ ID NO: 12545 - DNA, 25 bp, Homo sapien
ctcacgcactcttattcgcctgatt

SEQ ID NO: 12546 - DNA, 25 bp, Homo sapien
actcacgcactcttattcgcctgat

SEQ ID NO: 12547 - DNA, 25 bp, Homo sapien
ccctccacacacagactcacgcgct

SEQ ID NO: 12548 - DNA, 25 bp, Homo sapien
tccgttctctccctccacacacaga

SEQ ID NO: 12549 - DNA, 25 bp, Homo sapien
tccctccacacacagactcacgcgc

SEQ ID NO: 12550 - DNA, 25 bp, Homo sapien
ctcattcgcttgattccattctctc

SEQ ID NO: 12551 - DNA, 25 bp, Homo sapien
actcacgctctcattcgcttgattc

SEQ ID NO: 12552 - DNA, 25 bp, Homo sapien
attcgcttgattccgttctctctcc

SEQ ID NO: 12553 - DNA, 25 bp, Homo sapien
cattcgcttgattccgttctctctc

SEQ ID NO: 12554 - DNA, 25 bp, Homo sapien
tcattcgcctgattccgttctctct

SEQ ID NO: 12555 - DNA, 25 bp, Homo sapien
ctcattcgcttgattccgttctctc

SEQ ID NO: 12556 - DNA, 25 bp, Homo sapien
gctctcattcgcttgattccgttct

SEQ ID NO: 12557 - DNA, 25 bp, Homo sapien
tcacgctctcattcgcttgattccg

SEQ ID NO: 12558 - DNA, 25 bp, Homo sapien
gctctcattcgcttgattccgttct

SEQ ID NO: 12559 - DNA, 25 bp, Homo sapien
cgctctcattcgcttgactctgttc

SEQ ID NO: 12560 - DNA, 25 bp, Homo sapien
cgctctcatttgcttgattccgttc

SEQ ID NO: 12561 - DNA, 25 bp, Homo sapien
cgctctcattcgcttgattccgttc

SEQ ID NO: 12562 - DNA, 25 bp, Homo sapien
ctcattcgcttgattccgttctctc

SEQ ID NO: 12563 - DNA, 25 bp, Homo sapien
cgcgctctcattcgcttgattccgt

SEQ ID NO: 12564 - DNA, 25 bp, Homo sapien
attcgcttgattccgttctctctct

SEQ ID NO: 12565 - DNA, 25 bp, Homo sapien
gctctcatttgcttgattccgttct

SEQ ID NO: 12566 - DNA, 25 bp, Homo sapien
cttcatcgcgaaggtcaagccggtg

SEQ ID NO: 12567 - DNA, 25 bp, Homo sapien
ataaaatgtgttgcgaggctgacgc

SEQ ID NO: 12568 - DNA, 25 bp, Homo sapien
ccatgacccgcgaggagtttctgga

SEQ ID NO: 12569 - DNA, 25 bp, Homo sapien
gggcacactcacctgcttcgtgctg

SEQ ID NO: 12570 - DNA, 25 bp, Homo sapien
acaacaacgtgagcgtggcctacga

SEQ ID NO: 12571 - DNA, 25 bp, Homo sapien
gcagggccgccttcaacaacaacgt

SEQ ID NO: 12572 - DNA, 25 bp, Homo sapien
cccggtgcccgcagaagacgctttt

SEQ ID NO: 12573 - DNA, 25 bp, Homo sapien
gggcgcacctacagcgagctgctca

SEQ ID NO: 12574 - DNA, 25 bp, Homo sapien
ttgagtgagacctccagccacagcc

SEQ ID NO: 12575 - DNA, 25 bp, Homo sapien
ttaaagttgagtgagacctccagcc

SEQ ID NO: 12576 - DNA, 25 bp, Homo sapien
tgagccctaactagagttaaagttg

SEQ ID NO: 12577 - DNA, 25 bp, Homo sapien
gaaatactcgcctagtgagccctaa

SEQ ID NO: 12578 - DNA, 25 bp, Homo sapien
ttgctctgactgtgagaaatactcg

SEQ ID NO: 12579 - DNA, 25 bp, Homo sapien
tgaataccagtttgctctgactgtg

SEQ ID NO: 12580 - DNA, 25 bp, Homo sapien
agcggctttgcggtgaataccagtt

SEQ ID NO: 12581 - DNA, 25 bp, Homo sapien
ggtaccttctgctttgggtgtcatg

SEQ ID NO: 12582 - DNA, 25 bp, Homo sapien
tcctcccatagctgatctccctctg

SEQ ID NO: 12583 - DNA, 25 bp, Homo sapien
ttgggcatgggtgcagctcctccca

SEQ ID NO: 12584 - DNA, 25 bp, Homo sapien
ggcagcgcctcttggagtccatgac

SEQ ID NO: 12585 - DNA, 25 bp, Homo sapien
gccatagggcgatcctcaggctgtt

SEQ ID NO: 12586 - DNA, 25 bp, Homo sapien
agatgccgcgcttctcagcggtgct

SEQ ID NO: 12587 - DNA, 25 bp, Homo sapien
ctcttggagtccatgaccgcccagg

SEQ ID NO: 12588 - DNA, 25 bp, Homo sapien
tggagtccatgaccgcccagggagc

SEQ ID NO: 12589 - DNA, 25 bp, Homo sapien
atgggtgcagctcctcccatagctg

SEQ ID NO: 12590 - DNA, 25 bp, Homo sapien
cgtgcccgccacaccaagatgttgg

SEQ ID NO: 12591 - DNA, 25 bp, Homo sapien
aacatggtgctcatccttgccgaga

SEQ ID NO: 12592 - DNA, 25 bp, Homo sapien
cacaagctctctgcgggtccatcct

SEQ ID NO: 12593 - DNA, 25 bp, Homo sapien
cctcaagcgtcgtctgcatgagtga

SEQ ID NO: 12594 - DNA, 25 bp, Homo sapien
cctgggagcccagctgaatccgagg

SEQ ID NO: 12595 - DNA, 25 bp, Homo sapien
aaatcacgcacgtccgaggagatgg

SEQ ID NO: 12596 - DNA, 25 bp, Homo sapien
ccagctgaatccgagggccgggacc

SEQ ID NO: 12597 - DNA, 25 bp, Homo sapien
gccgcccagcgaagaaccagccaca

SEQ ID NO: 12598 - DNA, 25 bp, Homo sapien
ggcctccagactcgagtccagaatc

SEQ ID NO: 12599 - DNA, 25 bp, Homo sapien
tcgctgcacgtggtcacttccgaag

SEQ ID NO: 12600 - DNA, 25 bp, Homo sapien
cgccctgttgagtgcggcctccaga

SEQ ID NO: 12601 - DNA, 25 bp, Homo sapien
ctcgagtccagaatctgtttctgtc

SEQ ID NO: 12602 - DNA, 25 bp, Homo sapien
cccagctgcacacggggactgctga

SEQ ID NO: 12603 - DNA, 25 bp, Homo sapien
gactgctgagcgctgcgctctcacg

SEQ ID NO: 12604 - DNA, 25 bp, Homo sapien
gctgcgctctcacgggtctgttccg

SEQ ID NO: 12605 - DNA, 25 bp, Homo sapien
gtggccgcagagacagagcccgcac

SEQ ID NO: 12606 - DNA, 25 bp, Homo sapien
ccagggttgtgtggactcaggtgcc

SEQ ID NO: 12607 - DNA, 25 bp, Homo sapien
tagcggtgcagcctcgtcgtccgga

SEQ ID NO: 12608 - DNA, 25 bp, Homo sapien
ccccggggctgtttggttgcctctg

SEQ ID NO: 12609 - DNA, 25 bp, Homo sapien
tgtgtagatgcagccaggctgtgta

SEQ ID NO: 12610 - DNA, 25 bp, Homo sapien
gatgcagccaggctgtgtagacacc

SEQ ID NO: 12611 - DNA, 25 bp, Homo sapien
gctgtgtagacaccaccggggttgt

SEQ ID NO: 12612 - DNA, 25 bp, Homo sapien
agacatggccaggttgtgtagatgc

SEQ ID NO: 12613 - DNA, 25 bp, Homo sapien
atccgggcagtagcggtgcagcctc

SEQ ID NO: 12614 - DNA, 25 bp, Homo sapien
cccttacagttgagaacaaggtgag

SEQ ID NO: 12615 - DNA, 25 bp, Homo sapien
cacctcgattcccttacagttgaga

SEQ ID NO: 12616 - DNA, 25 bp, Homo sapien
aggcgtgggaggcacctcgattccc

SEQ ID NO: 12617 - DNA, 25 bp, Homo sapien
tgctgaacgcggaaacgtgagccga

SEQ ID NO: 12618 - DNA, 25 bp, Homo sapien
aatggtgacaagatgggtgctgaac

SEQ ID NO: 12619 - DNA, 25 bp, Homo sapien
cttgagacaggacgcgtggagaccc

SEQ ID NO: 12620 - DNA, 25 bp, Homo sapien
ggagaacgccaggattgcttgagac

SEQ ID NO: 12621 - DNA, 25 bp, Homo sapien
ccgctgggtcacagcactggtgacg

SEQ ID NO: 12622 - DNA, 25 bp, Homo sapien
ggaatttccactccacagccgttta

SEQ ID NO: 12623 - DNA, 25 bp, Homo sapien
gccacctttgcattgagcccatttt

SEQ ID NO: 12624 - DNA, 25 bp, Homo sapien
tccagatagtgaaaatgcggctccc

SEQ ID NO: 12625 - DNA, 25 bp, Homo sapien
agtgaccaccacgtgactgcccagg

SEQ ID NO: 12626 - DNA, 25 bp, Homo sapien
gccgagactctacgtgaaagcaaca

SEQ ID NO: 12627 - DNA, 25 bp, Homo sapien
ggatgcattttggtaccaccctttg

SEQ ID NO: 12628 - DNA, 25 bp, Homo sapien
ggtggcagcagcaacacattcctcg

SEQ ID NO: 12629 - DNA, 25 bp, Homo sapien
cagcggatcaagcagggagcctttt

SEQ ID NO: 12630 - DNA, 25 bp, Homo sapien
acggcacgggcttacacagagggat

SEQ ID NO: 12631 - DNA, 25 bp, Homo sapien
ctggcatgaggacaggtgcatgatc

SEQ ID NO: 12632 - DNA, 25 bp, Homo sapien
tgatcggattctgggtcagcccgca

SEQ ID NO: 12633 - DNA, 25 bp, Homo sapien
ttcagcgttaacctggcgctgtgca

SEQ ID NO: 12634 - DNA, 25 bp, Homo sapien
cgctaggcttcgagtcacacggcac

SEQ ID NO: 12635 - DNA, 25 bp, Homo sapien
ccagaacccgcgttggtccagcagg

SEQ ID NO: 12636 - DNA, 25 bp, Homo sapien
acagagggatggtttcgcatcgttc

SEQ ID NO: 12637 - DNA, 25 bp, Homo sapien
tcgcatcgttctaagcggcacacag

SEQ ID NO: 12638 - DNA, 25 bp, Homo sapien
gcccaggcagcggagtgaaaacccg

SEQ ID NO: 12639 - DNA, 25 bp, Homo sapien
gaattcctacgcagtttccgcgctc

SEQ ID NO: 12640 - DNA, 25 bp, Homo sapien
accaccactgaattcctacgcagtt

SEQ ID NO: 12641 - DNA, 25 bp, Homo sapien
ggtcgacgcctggattctgaatttg

SEQ ID NO: 12642 - DNA, 25 bp, Homo sapien
tccgaagctgggcagccagaatgca

SEQ ID NO: 12643 - DNA, 25 bp, Homo sapien
ggcagcggagtgaaaacccgccctg

SEQ ID NO: 12644 - DNA, 25 bp, Homo sapien
tgcgctgccagaacgggaatctgga

SEQ ID NO: 12645 - DNA, 25 bp, Homo sapien
acacccgctgcgtggctgcctgagg

SEQ ID NO: 12646 - DNA, 25 bp, Homo sapien
caccttgtccgagttgttcttgagc

SEQ ID NO: 12647 - DNA, 25 bp, Homo sapien
tgttcttgagctgcacaaacttgcc

SEQ ID NO: 12648 - DNA, 25 bp, Homo sapien
acaaacttgccctccaggtcgatct

SEQ ID NO: 12649 - DNA, 25 bp, Homo sapien
aggagcttccggtaggcgttgatct

SEQ ID NO: 12650 - DNA, 25 bp, Homo sapien
ccagacagcccagggcacgcagagt

SEQ ID NO: 12651 - DNA, 25 bp, Homo sapien
tccagctcccgaatgcgatcttcag

SEQ ID NO: 12652 - DNA, 25 bp, Homo sapien
aatgcgatcttcagcggcactggcc

SEQ ID NO: 12653 - DNA, 25 bp, Homo sapien
gtcgatctcctcgatgctgacgcta

SEQ ID NO: 12654 - DNA, 25 bp, Homo sapien
gacgtcgtgcccagccgtgaccact

SEQ ID NO: 12655 - DNA, 25 bp, Homo sapien
tcagcttcccaatctctatctgcag

SEQ ID NO: 12656 - DNA, 25 bp, Homo sapien
ttcccaatctctatctgcagccggg

SEQ ID NO: 12657 - DNA, 25 bp, Homo sapien
tatctgcagccgggcacgctctcga

SEQ ID NO: 12658 - DNA, 25 bp, Homo sapien
cgctctcgagccgtctcatccagga

SEQ ID NO: 12659 - DNA, 25 bp, Homo sapien
tcatccaggactctccgggcatcgg

SEQ ID NO: 12660 - DNA, 25 bp, Homo sapien
gcatcggccagctccgactcgtaca

SEQ ID NO: 12661 - DNA, 25 bp, Homo sapien
ctcttgttgacctcgtccaactctg

SEQ ID NO: 12662 - DNA, 25 bp, Homo sapien
ggctcagcatttccggtgagcacgg

SEQ ID NO: 12663 - DNA, 25 bp, Homo sapien
ggggctcagcatttccggtgagcac

SEQ ID NO: 12664 - DNA, 25 bp, Homo sapien
agcagcatttccggtgagcacgggc

SEQ ID NO: 12665 - DNA, 25 bp, Homo sapien
gcagcatttccggtgagcacgggcc

SEQ ID NO: 12666 - DNA, 25 bp, Homo sapien
gctccgcagcatttccggtgagcac

SEQ ID NO: 12667 - DNA, 25 bp, Homo sapien
tcagcatttccggtgagcacgggcc

SEQ ID NO: 12668 - DNA, 25 bp, Homo sapien
cagcatttccggtgagcacgggccg

SEQ ID NO: 12669 - DNA, 25 bp, Homo sapien
ctccgcagcatttccggtgagcacg

SEQ ID NO: 12670 - DNA, 25 bp, Homo sapien
aggagccggtcgttctccagctcca

SEQ ID NO: 12671 - DNA, 25 bp, Homo sapien
ctccttctctgagatcttgagcagg

SEQ ID NO: 12672 - DNA, 25 bp, Homo sapien
cagggactctccgaaacgcggcgga

SEQ ID NO: 12673 - DNA, 25 bp, Homo sapien
acctttcactcagggactctccgaa

SEQ ID NO: 12674 - DNA, 25 bp, Homo sapien
caagccgggagtcgttcagagtccc

SEQ ID NO: 12675 - DNA, 25 bp, Homo sapien
aggacctgcacccttcatccaggag

SEQ ID NO: 12676 - DNA, 25 bp, Homo sapien
gctcggcgggctcattcaatccgcg

SEQ ID NO: 12677 - DNA, 25 bp, Homo sapien
ctggccgagtagcacctttcactca

SEQ ID NO: 12678 - DNA, 25 bp, Homo sapien
gtgctgttccatccgccaggagcgc

SEQ ID NO: 12679 - DNA, 25 bp, Homo sapien
gcaattttcaaattttggcgccgaa

SEQ ID NO: 12680 - DNA, 25 bp, Homo sapien
ggaggcgctgggcaattttcaaatt

SEQ ID NO: 12681 - DNA, 25 bp, Homo sapien
tgcaaaccggggtctcgaatctacc

SEQ ID NO: 12682 - DNA, 25 bp, Homo sapien
tcttgcgctctgcaaaccggggtct

SEQ ID NO: 12683 - DNA, 25 bp, Homo sapien
tgggcctcagtcttgcgctctgcaa

SEQ ID NO: 12684 - DNA, 25 bp, Homo sapien
gaggtctggggcatcccgcaaagct

SEQ ID NO: 12685 - DNA, 25 bp, Homo sapien
caggagcgccgtttcctgcctgact

SEQ ID NO: 12686 - DNA, 25 bp, Homo sapien
tgccatgctctgcaaaccagcgagg

SEQ ID NO: 12687 - DNA, 25 bp, Homo sapien
cacctgggcgagatcacgctgcaaa

SEQ ID NO: 12688 - DNA, 25 bp, Homo sapien
ccaccaataggaggggcgaatgact

SEQ ID NO: 12689 - DNA, 25 bp, Homo sapien
tgaggccacgcccaatgttcaagtc

SEQ ID NO: 12690 - DNA, 25 bp, Homo sapien
gaggctcccagctcagatcgccgaa

SEQ ID NO: 12691 - DNA, 25 bp, Homo sapien
tcctcgccaaggactttgcaatata

SEQ ID NO: 12692 - DNA, 25 bp, Homo sapien
acaatggctttctccagggcctgga

SEQ ID NO: 12693 - DNA, 25 bp, Homo sapien
cttttctggcattcgcggtcaccta

SEQ ID NO: 12694 - DNA, 25 bp, Homo sapien
agcgctcagccacgtttggcatgtc

SEQ ID NO: 12695 - DNA, 25 bp, Homo sapien
gggctgactggtcctgcacagctca

SEQ ID NO: 12696 - DNA, 25 bp, Homo sapien
tcgggctgactggtcctgcacagct

SEQ ID NO: 12697 - DNA, 25 bp, Homo sapien
gctcagcgctcagccacgtttggca

SEQ ID NO: 12698 - DNA, 25 bp, Homo sapien
tcagccacgtttggcatgtcccgtg

SEQ ID NO: 12699 - DNA, 25 bp, Homo sapien
ccacgtttggcatgtcccgtgggca

SEQ ID NO: 12700 - DNA, 25 bp, Homo sapien
cgtttggcatgtcccgtgggcagcc

SEQ ID NO: 12701 - DNA, 25 bp, Homo sapien
gactggtcctgcacagctcagcgct

SEQ ID NO: 12702 - DNA, 25 bp, Homo sapien
acatcaacatcgtgcgggtgtcggg

SEQ ID NO: 12703 - DNA, 25 bp, Homo sapien
gacccagggcaccaccgaggcccga

SEQ ID NO: 12704 - DNA, 25 bp, Homo sapien
cgaggcccgagacctgcattgtctc

SEQ ID NO: 12705 - DNA, 25 bp, Homo sapien
ctgcattgtctcctggtcacggtga

SEQ ID NO: 12706 - DNA, 25 bp, Homo sapien
attgtctcctggtcacggtgagtcg

SEQ ID NO: 12707 - DNA, 25 bp, Homo sapien
gtcacggtgagtcgggcctctgccc

SEQ ID NO: 12708 - DNA, 25 bp, Homo sapien
tttgtcaacaaagtcgggctgactg

SEQ ID NO: 12709 - DNA, 25 bp, Homo sapien
cacctgggccggtgtttgtcaacaa

SEQ ID NO: 12710 - DNA, 25 bp, Homo sapien
gtcggcctcccatttccatttccag

SEQ ID NO: 12711 - DNA, 25 bp, Homo sapien
tcttcatcttgccactcgggtcggc

SEQ ID NO: 12712 - DNA, 25 bp, Homo sapien
catttccagagagctcgctgtcggc

SEQ ID NO: 12713 - DNA, 25 bp, Homo sapien
catgggaaccatgaccgcagccagc

SEQ ID NO: 12714 - DNA, 25 bp, Homo sapien
tccagagcgcctcattggactgcgc

SEQ ID NO: 12715 - DNA, 25 bp, Homo sapien
ttaccatgggaaccatgaccgcagc

SEQ ID NO: 12716 - DNA, 25 bp, Homo sapien
cgctcggccaccgttggttaccatg

SEQ ID NO: 12717 - DNA, 25 bp, Homo sapien
gcctcattggactgcgctgagccca

SEQ ID NO: 12718 - DNA, 25 bp, Homo sapien
cggctccctaggagtcacggggatc

SEQ ID NO: 12719 - DNA, 25 bp, Homo sapien
cgcagtgctgcgttttgcctgtaaa

SEQ ID NO: 12720 - DNA, 25 bp, Homo sapien
ccagcggctccctaggagtcacggg

SEQ ID NO: 12721 - DNA, 25 bp, Homo sapien
tcacgtgggcgcatgaggaaaaccc

SEQ ID NO: 12722 - DNA, 25 bp, Homo sapien
tacttctcccaaagttgcaggcgcg

SEQ ID NO: 12723 - DNA, 25 bp, Homo sapien
cctgtaaaccgaaactgcgagccct

SEQ ID NO: 12724 - DNA, 25 bp, Homo sapien
tttgcctgtaaaccgaaactgcgag

SEQ ID NO: 12725 - DNA, 25 bp, Homo sapien
gctgcgttttgcctgtaaaccgaaa

SEQ ID NO: 12726 - DNA, 25 bp, Homo sapien
ccgtgtacacagcaggcacgccata

SEQ ID NO: 12727 - DNA, 25 bp, Homo sapien
ttgttccgttccgtgctcccagttc

SEQ ID NO: 12728 - DNA, 25 bp, Homo sapien
gtttgggccgccgtgtacacagcag

SEQ ID NO: 12729 - DNA, 25 bp, Homo sapien
agcgctgcgggccaagaccctcttg

SEQ ID NO: 12730 - DNA, 25 bp, Homo sapien
caagaccctcttgcgcatgtgacga

SEQ ID NO: 12731 - DNA, 25 bp, Homo sapien
ggagcttcggcctgcgctcacaggc

SEQ ID NO: 12732 - DNA, 25 bp, Homo sapien
tccctacattgttccgttccgtgct

SEQ ID NO: 12733 - DNA, 25 bp, Homo sapien
ttgcgcatgtgacgagagcgcacga

SEQ ID NO: 12734 - DNA, 25 bp, Homo sapien
agaccctccttttgtgagcggcgcc

SEQ ID NO: 12735 - DNA, 25 bp, Homo sapien
gcagatctccgtcttcgtgcagggc

SEQ ID NO: 12736 - DNA, 25 bp, Homo sapien
aacgcccgctgtgtgcagatctccg

SEQ ID NO: 12737 - DNA, 25 bp, Homo sapien
cttttgtgtgaaaacgcccgctgtg

SEQ ID NO: 12738 - DNA, 25 bp, Homo sapien
tgcgcagcccgtcttttgtgtgaaa

SEQ ID NO: 12739 - DNA, 25 bp, Homo sapien
ctactgtgcgcagcccgtcttttgt

SEQ ID NO: 12740 - DNA, 25 bp, Homo sapien
aaccgggtgcgtgctcagctgcacg

SEQ ID NO: 12741 - DNA, 25 bp, Homo sapien
actggacgcgtgcagccgggcctac

SEQ ID NO: 12742 - DNA, 25 bp, Homo sapien
gacacccactttcgttgactgccaa

SEQ ID NO: 12743 - DNA, 25 bp, Homo sapien
tttgagcctggggatgacatcagcc

SEQ ID NO: 12744 - DNA, 25 bp, Homo sapien
agacccactgtggacgcctgcttgt

SEQ ID NO: 12745 - DNA, 25 bp, Homo sapien
tacctttgcatttcacgcgggattg

SEQ ID NO: 12746 - DNA, 25 bp, Homo sapien
tcgtgcacacgcatgcctacctttg

SEQ ID NO: 12747 - DNA, 25 bp, Homo sapien
gtgtgtccggaatctgtactctcca

SEQ ID NO: 12748 - DNA, 25 bp, Homo sapien
cccgtctggtcctgacagtaattag

SEQ ID NO: 12749 - DNA, 25 bp, Homo sapien
tgccaacccgtgcagagcgcttagt

SEQ ID NO: 12750 - DNA, 25 bp, Homo sapien
caggacgggctgttaacttggagat

SEQ ID NO: 12751 - DNA, 25 bp, Homo sapien
ggaaacaggagcaccttccgccctg

SEQ ID NO: 12752 - DNA, 25 bp, Homo sapien
tctttacgaaggttagatgggcagc

SEQ ID NO: 12753 - DNA, 25 bp, Homo sapien
ctggccggcatatggcttctgtgca

SEQ ID NO: 12754 - DNA, 25 bp, Homo sapien
acaggtgtgtgacggccctctccta

SEQ ID NO: 12755 - DNA, 25 bp, Homo sapien
aggcctagcgttgcgcctcggacac

SEQ ID NO: 12756 - DNA, 25 bp, Homo sapien
cggcccgtcaaagggaccacgcaga

SEQ ID NO: 12757 - DNA, 25 bp, Homo sapien
gcctcaggccgtggactttttaata

SEQ ID NO: 12758 - DNA, 25 bp, Homo sapien
tctcggcacgggttcttagacgcct

SEQ ID NO: 12759 - DNA, 25 bp, Homo sapien
ttagacgcctgtctccactggggcc

SEQ ID NO: 12760 - DNA, 25 bp, Homo sapien
ttctactacttgcttctaggccagc

SEQ ID NO: 12761 - DNA, 25 bp, Homo sapien
cgcagaggaggacgcagtcatcttt

SEQ ID NO: 12762 - DNA, 25 bp, Homo sapien
tcttcgatttccacttgccgctggg

SEQ ID NO: 12763 - DNA, 25 bp, Homo sapien
agtggcccatcctgcgtctaaggca

SEQ ID NO: 12764 - DNA, 25 bp, Homo sapien
cgagcgacagggtaacgttttgagc

SEQ ID NO: 12765 - DNA, 25 bp, Homo sapien
agcggacgttttgatctccgggaca

SEQ ID NO: 12766 - DNA, 25 bp, Homo sapien
ccctgatccctgaccctgtgccgcc

SEQ ID NO: 12767 - DNA, 25 bp, Homo sapien
gaggccaaggccgaccgaagcccac

SEQ ID NO: 12768 - DNA, 25 bp, Homo sapien
ctggcctcacagcagcatagagcgc

SEQ ID NO: 12769 - DNA, 25 bp, Homo sapien
cagcccggaagctgacgcgtcctcc

SEQ ID NO: 12770 - DNA, 25 bp, Homo sapien
atgacccttaccagcgcagcccgga

SEQ ID NO: 12771 - DNA, 25 bp, Homo sapien
aatcccggcatgacccttaccagcg

SEQ ID NO: 12772 - DNA, 25 bp, Homo sapien
cgtctgtcctaatcccggcatgacc

SEQ ID NO: 12773 - DNA, 25 bp, Homo sapien
tggcctcacagcagcatagagcgcg

SEQ ID NO: 12774 - DNA, 25 bp, Homo sapien
cgcgctggcctcctagcaaaaggct

SEQ ID NO: 12775 - DNA, 25 bp, Homo sapien
tcggtgcacaggctcctgcaggcag

SEQ ID NO: 12776 - DNA, 25 bp, Homo sapien
ggctcatagccacacccgagtctaa

SEQ ID NO: 12777 - DNA, 25 bp, Homo sapien
taagcccgcctcgtgcagaaaaatc

SEQ ID NO: 12778 - DNA, 25 bp, Homo sapien
ctcgtgcagaaaaatcccactcgcg

SEQ ID NO: 12779 - DNA, 25 bp, Homo sapien
cgggcaccccgacctgaatgagctt

SEQ ID NO: 12780 - DNA, 25 bp, Homo sapien
tggtcaaaggtgcacacagtcccca

SEQ ID NO: 12781 - DNA, 25 bp, Homo sapien
ggcctcctagcaaaaggctcatagc

SEQ ID NO: 12782 - DNA, 25 bp, Homo sapien
tcgataaaccgaccaggagccgccg

SEQ ID NO: 12783 - DNA, 25 bp, Homo sapien
agagacagggactttaccgagcggc

SEQ ID NO: 12784 - DNA, 25 bp, Homo sapien
gaatgtcaagaatgcacccggcctg

SEQ ID NO: 12785 - DNA, 25 bp, Homo sapien
tgtcaagaatgcacccggcctggca

SEQ ID NO: 12786 - DNA, 25 bp, Homo sapien
gacaggaatgtcaagaatgcacccg

SEQ ID NO: 12787 - DNA, 25 bp, Homo sapien
catcttctcaccagcagggagagag

SEQ ID NO: 12788 - DNA, 25 bp, Homo sapien
gggagctaccgagggttcctccatc

SEQ ID NO: 12789 - DNA, 25 bp, Homo sapien
agggactttaccgagcggctcctgg

SEQ ID NO: 12790 - DNA, 25 bp, Homo sapien
gccagcgggcgtttgctctcctgac

SEQ ID NO: 12791 - DNA, 25 bp, Homo sapien
tcaaagcagagccagccttgtgtgg

SEQ ID NO: 12792 - DNA, 25 bp, Homo sapien
tttccagtctgctcatcaaagcaga

SEQ ID NO: 12793 - DNA, 25 bp, Homo sapien
ggctgcgcttttccagtctgctcat

SEQ ID NO: 12794 - DNA, 25 bp, Homo sapien
gctccacaatgaggcggctgcgctt

SEQ ID NO: 12795 - DNA, 25 bp, Homo sapien
caggctcagcgaattccagctcaga

SEQ ID NO: 12796 - DNA, 25 bp, Homo sapien
caggaagtcaggctcagcgaattcc

SEQ ID NO: 12797 - DNA, 25 bp, Homo sapien
ttgctctcctgacggcacaggaagt

SEQ ID NO: 12798 - DNA, 25 bp, Homo sapien
gggacgttccagcatgtgagcctgc

SEQ ID NO: 12799 - DNA, 25 bp, Homo sapien
ggacgttccagcatgtgagcctgcg

SEQ ID NO: 12800 - DNA, 25 bp, Homo sapien
gacgttcccgcatgtgagcctgcgg

SEQ ID NO: 12801 - DNA, 25 bp, Homo sapien
ggacgttccagcctgtgagcctgcg

SEQ ID NO: 12802 - DNA, 25 bp, Homo sapien
acgttccagcatgtgagcctgcggg

SEQ ID NO: 12803 - DNA, 25 bp, Homo sapien
gggacgttccagcctgtgagcctgc

SEQ ID NO: 12804 - DNA, 25 bp, Homo sapien
ggacgttcccgcatgtgagcctgcg

SEQ ID NO: 12805 - DNA, 25 bp, Homo sapien
ggggacgttccagcctgtgagcctg

SEQ ID NO: 12806 - DNA, 25 bp, Homo sapien
tcagccggagcttggagcctaagaa

SEQ ID NO: 12807 - DNA, 25 bp, Homo sapien
gctgaggaaatgctgtcaccctggc

SEQ ID NO: 12808 - DNA, 25 bp, Homo sapien
gtggctcctgtcactccagttctgg

SEQ ID NO: 12809 - DNA, 25 bp, Homo sapien
tgtgagagtttgcaagcccgggaac

SEQ ID NO: 12810 - DNA, 25 bp, Homo sapien
gaccacggtcatgtgagagtttgca

SEQ ID NO: 12811 - DNA, 25 bp, Homo sapien
aagaaaagctgctctctgtccaccc

SEQ ID NO: 12812 - DNA, 25 bp, Homo sapien
ttgttcagacaaagaggccgcgacg

SEQ ID NO: 12813 - DNA, 25 bp, Homo sapien
gcctaagaatgagccggcttgttca

SEQ ID NO: 12814 - DNA, 25 bp, Homo sapien
tggagctgcggttttccatggaacg

SEQ ID NO: 12815 - DNA, 25 bp, Homo sapien
acggccgtctccaatgcacagtgca

SEQ ID NO: 12816 - DNA, 25 bp, Homo sapien
tggtctttcctgactcccactaagg

SEQ ID NO: 12817 - DNA, 25 bp, Homo sapien
tcccactaaggtctggagggagatc

SEQ ID NO: 12818 - DNA, 25 bp, Homo sapien
agcttcgcggcagcctcctatttcg

SEQ ID NO: 12819 - DNA, 25 bp, Homo sapien
ctatttcgtggacaaggaggcccga

SEQ ID NO: 12820 - DNA, 25 bp, Homo sapien
ttccatggaacggaatcctctgttc

SEQ ID NO: 12821 - DNA, 25 bp, Homo sapien
ccgtatccgtctccaatgcacagtg

SEQ ID NO: 12822 - DNA, 25 bp, Homo sapien
tcggggacatgcaaggacaagctgc

SEQ ID NO: 12823 - DNA, 25 bp, Homo sapien
tgctggtcaccttcctcggggacat

SEQ ID NO: 12824 - DNA, 25 bp, Homo sapien
cctctgaggtctccaagtgtttatg

SEQ ID NO: 12825 - DNA, 25 bp, Homo sapien
gacaggggcttttctggttgccaaa

SEQ ID NO: 12826 - DNA, 25 bp, Homo sapien
cggacacacctgactcggaccatgt

SEQ ID NO: 12827 - DNA, 25 bp, Homo sapien
acgccaaggtctgcacaggggtcac

SEQ ID NO: 12828 - DNA, 25 bp, Homo sapien
cccaagaatgcacatggctcgtctc

SEQ ID NO: 12829 - DNA, 25 bp, Homo sapien
aggctgggaatccttgagcgttttc

SEQ ID NO: 12830 - DNA, 25 bp, Homo sapien
agcgacaggtagtaaacagacctta

SEQ ID NO: 12831 - DNA, 25 bp, Homo sapien
gcggctctctgcaaagcgacaggta

SEQ ID NO: 12832 - DNA, 25 bp, Homo sapien
gaactttctcccgtcagtcaggggc

SEQ ID NO: 12833 - DNA, 25 bp, Homo sapien
gtcaacagctggtgaatcgcacagg

SEQ ID NO: 12834 - DNA, 25 bp, Homo sapien
acgcacgtcatgaggtttgtttttc

SEQ ID NO: 12835 - DNA, 25 bp, Homo sapien
acagctggtgaatcgcacagggccg

SEQ ID NO: 12836 - DNA, 25 bp, Homo sapien
ccgtggaactttctcccgtcagtca

SEQ ID NO: 12837 - DNA, 25 bp, Homo sapien
taaacagaccttaacgcacgtcatg

SEQ ID NO: 12838 - DNA, 25 bp, Homo sapien
gcgacagcgacacagggcagcaaca

SEQ ID NO: 12839 - DNA, 25 bp, Homo sapien
ctccgcttctcacttcagaggcaga

SEQ ID NO: 12840 - DNA, 25 bp, Homo sapien
agggcagcaacagcggttccctcct

SEQ ID NO: 12841 - DNA, 25 bp, Homo sapien
ctgggaagtagcctgcagtgtcagc

SEQ ID NO: 12842 - DNA, 25 bp, Homo sapien
aggacagcaatacgttcaggcgaca

SEQ ID NO: 12843 - DNA, 25 bp, Homo sapien
acggaggctttctagggagcagtcc

SEQ ID NO: 12844 - DNA, 25 bp, Homo sapien
tcaccaacgacacggcacggaggct

SEQ ID NO: 12845 - DNA, 25 bp, Homo sapien
cagtgtcagcacagaccggcgctca

SEQ ID NO: 12846 - DNA, 25 bp, Homo sapien
ggcctcgctgtcaccactgagtgag

SEQ ID NO: 12847 - DNA, 25 bp, Homo sapien
atggcttccctctcgcaatctgctt

SEQ ID NO: 12848 - DNA, 25 bp, Homo sapien
tactaagccgctcagcccagggatc

SEQ ID NO: 12849 - DNA, 25 bp, Homo sapien
agctggtatcgcgaatgtctacacg

SEQ ID NO: 12850 - DNA, 25 bp, Homo sapien
aggaattccgcctggcgagcgtcta

SEQ ID NO: 12851 - DNA, 25 bp, Homo sapien
cgagcgtctagactgcggtgtttct

SEQ ID NO: 12852 - DNA, 25 bp, Homo sapien
ttctcagaaaggaccacgcccggca

SEQ ID NO: 12853 - DNA, 25 bp, Homo sapien
gggaagcgtcctcaacattctcaga

SEQ ID NO: 12854 - DNA, 25 bp, Homo sapien
agcgacatctaaaggccggcaagtg

SEQ ID NO: 12855 - DNA, 25 bp, Homo sapien
ctaaggccagcgaaggccacggcca

SEQ ID NO: 12856 - DNA, 25 bp, Homo sapien
ttgcaggcgtctgttgcgagaccac

SEQ ID NO: 12857 - DNA, 25 bp, Homo sapien
aagtgcaatgcagaatccacccagg

SEQ ID NO: 12858 - DNA, 25 bp, Homo sapien
cgtctgttgcgagaccacatcctca

SEQ ID NO: 12859 - DNA, 25 bp, Homo sapien
gaatcagacagaagctcgcagccta

SEQ ID NO: 12860 - DNA, 25 bp, Homo sapien
cagaagctcgcagcctaaggccagc

SEQ ID NO: 12861 - DNA, 25 bp, Homo sapien
ccagcctcgcacaggtgggtccgtt

SEQ ID NO: 12862 - DNA, 25 bp, Homo sapien
gattccgcgtgacactggtggacga

SEQ ID NO: 12863 - DNA, 25 bp, Homo sapien
gccctccctgtagcatctgggcgtg

SEQ ID NO: 12864 - DNA, 25 bp, Homo sapien
gccgctagtgcccagctcgcagaag

SEQ ID NO: 12865 - DNA, 25 bp, Homo sapien
agttcccttcaaggcatcgtccggt

SEQ ID NO: 12866 - DNA, 25 bp, Homo sapien
ggctcgtttcccttctatggccacg

SEQ ID NO: 12867 - DNA, 25 bp, Homo sapien
aagcctcctggcttgggctcgtttc

SEQ ID NO: 12868 - DNA, 25 bp, Homo sapien
cacctactacgagggcggctacttc

SEQ ID NO: 12869 - DNA, 25 bp, Homo sapien
tggacgagggcgatctatacaactg

SEQ ID NO: 12870 - DNA, 25 bp, Homo sapien
aggggaacccaacgcgagcaacgcg

SEQ ID NO: 12871 - DNA, 25 bp, Homo sapien
ttccgggatggggaacccaatgcga

SEQ ID NO: 12872 - DNA, 25 bp, Homo sapien
aggggaacccaatgcgagcaacgcg

SEQ ID NO: 12873 - DNA, 25 bp, Homo sapien
ggaacccaacgcgagcaacgcggca

SEQ ID NO: 12874 - DNA, 25 bp, Homo sapien
gaacccaacgcgagcaacgcggcag

SEQ ID NO: 12875 - DNA, 25 bp, Homo sapien
atggggaacccaatgcgagcaacgc

SEQ ID NO: 12876 - DNA, 25 bp, Homo sapien
gaaggggaacccaatgcgagcaacg

SEQ ID NO: 12877 - DNA, 25 bp, Homo sapien
ggaacccaatgcgagcaacgcggca

SEQ ID NO: 12878 - DNA, 25 bp, Homo sapien
ccctgcaccatgtccactggaaatg

SEQ ID NO: 12879 - DNA, 25 bp, Homo sapien
ctggaaatgcaaagtccgagacctc

SEQ ID NO: 12880 - DNA, 25 bp, Homo sapien
ccgtcggcaccggaaatgcaaagtc

SEQ ID NO: 12881 - DNA, 25 bp, Homo sapien
gtcggcaccggaaatgcaaagtctg

SEQ ID NO: 12882 - DNA, 25 bp, Homo sapien
tggaaatgcaaagtccgagacctct

SEQ ID NO: 12883 - DNA, 25 bp, Homo sapien
ggccctgcaccatgtccactggaaa

SEQ ID NO: 12884 - DNA, 25 bp, Homo sapien
aaatgcaaagtctgagcctctccgg

SEQ ID NO: 12885 - DNA, 25 bp, Homo sapien
ggaaatgcaaagtccgagacctctc

SEQ ID NO: 12886 - DNA, 25 bp, Homo sapien
agaacgttcctactgttttcacgca

SEQ ID NO: 12887 - DNA, 25 bp, Homo sapien
actgttttcacgcagccaaacacgc

SEQ ID NO: 12888 - DNA, 25 bp, Homo sapien
ggattccgtgatttcagaacgttcc

SEQ ID NO: 12889 - DNA, 25 bp, Homo sapien
gagttcttctcataaggattccgtg

SEQ ID NO: 12890 - DNA, 25 bp, Homo sapien
ggtattggatgacgagttcttctca

SEQ ID NO: 12891 - DNA, 25 bp, Homo sapien
agcagctcctgttgggtattggatg

SEQ ID NO: 12892 - DNA, 25 bp, Homo sapien
tggagccctcgcgttgtgaagaccg

SEQ ID NO: 12893 - DNA, 25 bp, Homo sapien
ctttgctcccttggactcgggctca

SEQ ID NO: 12894 - DNA, 25 bp, Homo sapien
tcagcggctcactcagcctgacaga

SEQ ID NO: 12895 - DNA, 25 bp, Homo sapien
ccctcagaaactgccgagctggggc

SEQ ID NO: 12896 - DNA, 25 bp, Homo sapien
acaaggaggagagacctctccgcgg

SEQ ID NO: 12897 - DNA, 25 bp, Homo sapien
aatcacaatcgacccgggcggccag

SEQ ID NO: 12898 - DNA, 25 bp, Homo sapien
tggacaaatcacaatcgacccgggc

SEQ ID NO: 12899 - DNA, 25 bp, Homo sapien
agcctgacagaaacgctgtgttttc

SEQ ID NO: 12900 - DNA, 25 bp, Homo sapien
agccgctctgtcctcgggccttgag

SEQ ID NO: 12901 - DNA, 25 bp, Homo sapien
ttcatgttccctgtgtggacaaatc

SEQ ID NO: 12902 - DNA, 25 bp, Homo sapien
gccgaatccgagctgtcccagtccc

SEQ ID NO: 12903 - DNA, 25 bp, Homo sapien
gaatcccgcgctaggtgagctggtt

SEQ ID NO: 12904 - DNA, 25 bp, Homo sapien
agtagtttcgcgagttcgaatcccg

SEQ ID NO: 12905 - DNA, 25 bp, Homo sapien
aaggcgcgagtagtttcgcgagttc

SEQ ID NO: 12906 - DNA, 25 bp, Homo sapien
acttcgtgacgtcaggaaggcgcga

SEQ ID NO: 12907 - DNA, 25 bp, Homo sapien
tttccagggtgacttcgtgacgtca

SEQ ID NO: 12908 - DNA, 25 bp, Homo sapien
aactcggtccgcagccgaatccgag

SEQ ID NO: 12909 - DNA, 25 bp, Homo sapien
gcgtcccggcaaggccaatcgcgag

SEQ ID NO: 12910 - DNA, 25 bp, Homo sapien
ggtctgtcctcttctgcttcccgga

SEQ ID NO: 12911 - DNA, 25 bp, Homo sapien
cgcttgccgtcgatgttgaggctca

SEQ ID NO: 12912 - DNA, 25 bp, Homo sapien
ccgaggtctccatgaaagcgcactt

SEQ ID NO: 12913 - DNA, 25 bp, Homo sapien
tgcccacgagcatcacggggatgtc

SEQ ID NO: 12914 - DNA, 25 bp, Homo sapien
acgctgcccttgatctgcacgatga

SEQ ID NO: 12915 - DNA, 25 bp, Homo sapien
gtgcacacgctcttgtcgcagctga

SEQ ID NO: 12916 - DNA, 25 bp, Homo sapien
ccgggctcacatgagggtgcatttg

SEQ ID NO: 12917 - DNA, 25 bp, Homo sapien
tgtagttcatcttggccgaggtctc

SEQ ID NO: 12918 - DNA, 25 bp, Homo sapien
ccgggccgcctacctgggcccgctg

SEQ ID NO: 12919 - DNA, 25 bp, Homo sapien
tctagcgggggtcacgcctgaccaa

SEQ ID NO: 12920 - DNA, 25 bp, Homo sapien
gcgacccttgactcaggaggacctc

SEQ ID NO: 12921 - DNA, 25 bp, Homo sapien
cccttgactcaggaggacctcagtg

SEQ ID NO: 12922 - DNA, 25 bp, Homo sapien
ttgactcaggaggacctcagtggtg

SEQ ID NO: 12923 - DNA, 25 bp, Homo sapien
ccaggggcgacccttgactcaggag

SEQ ID NO: 12924 - DNA, 25 bp, Homo sapien
gagaggtcgccaggatccgggaccc

SEQ ID NO: 12925 - DNA, 25 bp, Homo sapien
ctgcccgaggggaccaatgcggaga

SEQ ID NO: 12926 - DNA, 25 bp, Homo sapien
taactccacgctgcggctgctattt

SEQ ID NO: 12927 - DNA, 25 bp, Homo sapien
gaacggggtctccacacatggcccg

SEQ ID NO: 12928 - DNA, 25 bp, Homo sapien
aggaacggggtctccacacatggcc

SEQ ID NO: 12929 - DNA, 25 bp, Homo sapien
ctgctatttatagctcccaggccag

SEQ ID NO: 12930 - DNA, 25 bp, Homo sapien
cagggcggtaactccacgctgcggc

SEQ ID NO: 12931 - DNA, 25 bp, Homo sapien
ctcaggccggggcaggctgactcat

SEQ ID NO: 12932 - DNA, 25 bp, Homo sapien
ctcgctgtccctgaggaacggggtc

SEQ ID NO: 12933 - DNA, 25 bp, Homo sapien
caggctgactcatgcgtaggagagt

SEQ ID NO: 12934 - DNA, 25 bp, Homo sapien
tcaggccttccggaggttgccacag

SEQ ID NO: 12935 - DNA, 25 bp, Homo sapien
aggccttccggaggttgccacagag

SEQ ID NO: 12936 - DNA, 25 bp, Homo sapien
ccttccggaggttgccacagagcca

SEQ ID NO: 12937 - DNA, 25 bp, Homo sapien
cttccggaggttgccacagagccag

SEQ ID NO: 12938 - DNA, 25 bp, Homo sapien
cccggctgctcgtcccccgtgctcc

SEQ ID NO: 12939 - DNA, 25 bp, Homo sapien
ttgccgggacgacggctcaggcctt

SEQ ID NO: 12940 - DNA, 25 bp, Homo sapien
gtgtccacgggagggatcgcaccgc

SEQ ID NO: 12941 - DNA, 25 bp, Homo sapien
ccgcggcgccacagcggcttcgagc

SEQ ID NO: 12942 - DNA, 25 bp, Homo sapien
tgaaggggctctcatactccgagtc

SEQ ID NO: 12943 - DNA, 25 bp, Homo sapien
cttctccttgcggaaggtcaggatc

SEQ ID NO: 12944 - DNA, 25 bp, Homo sapien
gcccacgtccgatccggcgttgaag

SEQ ID NO: 12945 - DNA, 25 bp, Homo sapien
ccctcaaagaccgagtgggccgaca

SEQ ID NO: 12946 - DNA, 25 bp, Homo sapien
gccaggatctccaggaaggtgatga

SEQ ID NO: 12947 - DNA, 25 bp, Homo sapien
gaccttgagcagacggtcactcttc

SEQ ID NO: 12948 - DNA, 25 bp, Homo sapien
gcgaggccgctcaccacttgaggaa

SEQ ID NO: 12949 - DNA, 25 bp, Homo sapien
tctccaggtcgatgaaggacggctt

SEQ ID NO: 12950 - DNA, 25 bp, Homo sapien
gctaacgtgcgggtagagtccaaca

SEQ ID NO: 12951 - DNA, 25 bp, Homo sapien
ccatactattggctgcgaaacctgc

SEQ ID NO: 12952 - DNA, 25 bp, Homo sapien
ggctgcgaaacctgccactcatatg

SEQ ID NO: 12953 - DNA, 25 bp, Homo sapien
gaaacctgccactcatatgcgactc

SEQ ID NO: 12954 - DNA, 25 bp, Homo sapien
cctggtgctgaatcccgcttggaaa

SEQ ID NO: 12955 - DNA, 25 bp, Homo sapien
gctggcagaactttccatactattg

SEQ ID NO: 12956 - DNA, 25 bp, Homo sapien
cgtgcgggtagagtccaacagaccc

SEQ ID NO: 12957 - DNA, 25 bp, Homo sapien
agacccgctggcagaactttccata

SEQ ID NO: 12958 - DNA, 25 bp, Homo sapien
ccaaggcctgattcgggacctgcca

SEQ ID NO: 12959 - DNA, 25 bp, Homo sapien
ctgacctgtcttcttcttgtgcaga

SEQ ID NO: 12960 - DNA, 25 bp, Homo sapien
gggacgtgtgtatctccatcctcca

SEQ ID NO: 12961 - DNA, 25 bp, Homo sapien
ccagaacatcaggtaggccgggctc

SEQ ID NO: 12962 - DNA, 25 bp, Homo sapien
cctcgctgtacctgcacggtaggtg

SEQ ID NO: 12963 - DNA, 25 bp, Homo sapien
ccaggtacaagcactgggccgtgtt

SEQ ID NO: 12964 - DNA, 25 bp, Homo sapien
cccgtgtgtcctggagtgtagtcta

SEQ ID NO: 12965 - DNA, 25 bp, Homo sapien
cagaacgtcaggtaagccggcccaa

SEQ ID NO: 12966 - DNA, 25 bp, Homo sapien
tcaccgccatgagcggctgcagggc

SEQ ID NO: 12967 - DNA, 25 bp, Homo sapien
ccgtgacccaagaagtgcggctccg

SEQ ID NO: 12968 - DNA, 25 bp, Homo sapien
cgtcgcggggattcactcacaagca

SEQ ID NO: 12969 - DNA, 25 bp, Homo sapien
ggattcactcacaagcagcccagct

SEQ ID NO: 12970 - DNA, 25 bp, Homo sapien
aagcagcccagctgatccacaaact

SEQ ID NO: 12971 - DNA, 25 bp, Homo sapien
cagaggtcacaacgcctatttattc

SEQ ID NO: 12972 - DNA, 25 bp, Homo sapien
tcaacacgaagacagacagaggtca

SEQ ID NO: 12973 - DNA, 25 bp, Homo sapien
ggtggcgccaaggtcaacacgaaga

SEQ ID NO: 12974 - DNA, 25 bp, Homo sapien
gtccatgtgggaaccctaccgtcca

SEQ ID NO: 12975 - DNA, 25 bp, Homo sapien
catgtgggaaccctaccgtccacgt

SEQ ID NO: 12976 - DNA, 25 bp, Homo sapien
gtgagaaccctaccgtccatgtggg

SEQ ID NO: 12977 - DNA, 25 bp, Homo sapien
cacgtgagaaccctaccgtccatgt

SEQ ID NO: 12978 - DNA, 25 bp, Homo sapien
tgggaaccctactgtccacgtggga

SEQ ID NO: 12979 - DNA, 25 bp, Homo sapien
atgtgggaaccctaccgtccacgtg

SEQ ID NO: 12980 - DNA, 25 bp, Homo sapien
cgtgagaaccctaccgtccatgtgg

SEQ ID NO: 12981 - DNA, 25 bp, Homo sapien
gagaaccctaccgtccatgtgggaa

SEQ ID NO: 12982 - DNA, 25 bp, Homo sapien
gttcctgcagacagaccacgggatg

SEQ ID NO: 12983 - DNA, 25 bp, Homo sapien
gaaacctgccacttctctgagagcg

SEQ ID NO: 12984 - DNA, 25 bp, Homo sapien
ggctgaacgtgaaacctgccacttc

SEQ ID NO: 12985 - DNA, 25 bp, Homo sapien
cgatccgccacacggctgaacgtga

SEQ ID NO: 12986 - DNA, 25 bp, Homo sapien
gctgtaaaaggctttggaagccaca

SEQ ID NO: 12987 - DNA, 25 bp, Homo sapien
tctcacagacgggagagttcctgca

SEQ ID NO: 12988 - DNA, 25 bp, Homo sapien
ggtcgactcggaaagaggcttctca

SEQ ID NO: 12989 - DNA, 25 bp, Homo sapien
tttggaagccacacgatccgccaca

SEQ ID NO: 12990 - DNA, 25 bp, Homo sapien
gccacccgaaatcatgccggacatg

SEQ ID NO: 12991 - DNA, 25 bp, Homo sapien
atcatgccggacatgctgcaggaga

SEQ ID NO: 12992 - DNA, 25 bp, Homo sapien
ggggacgcagcactttcgctctcct

SEQ ID NO: 12993 - DNA, 25 bp, Homo sapien
gtcctccgtcctcttggaagcagtt

SEQ ID NO: 12994 - DNA, 25 bp, Homo sapien
gtcctcttggaagcagttccactca

SEQ ID NO: 12995 - DNA, 25 bp, Homo sapien
ttccactcacgcctggatgaggctg

SEQ ID NO: 12996 - DNA, 25 bp, Homo sapien
actcacgcctggatgaggctggcca

SEQ ID NO: 12997 - DNA, 25 bp, Homo sapien
ggggttgttgccacccgaaatcatg

SEQ ID NO: 12998 - DNA, 25 bp, Homo sapien
cccgcacagcgcgaccgcccgggga

SEQ ID NO: 12999 - DNA, 25 bp, Homo sapien
acggcacagtctatcatcccgtgtt

SEQ ID NO: 13000 - DNA, 25 bp, Homo sapien
gcccggggacggcacagtctatcat

SEQ ID NO: 13001 - DNA, 25 bp, Homo sapien
ccggggacggcacagtctatcatcc

SEQ ID NO: 13002 - DNA, 25 bp, Homo sapien
acagtctatcatcccgtgtttattc

SEQ ID NO: 13003 - DNA, 25 bp, Homo sapien
ggcacagtctatcatcccgtgttta

SEQ ID NO: 13004 - DNA, 25 bp, Homo sapien
cccggggacggcacagtctatcatc

SEQ ID NO: 13005 - DNA, 25 bp, Homo sapien
gcacagtctatcatcccgtgtttat

SEQ ID NO: 13006 - DNA, 25 bp, Homo sapien
tgacgcggccacacggcagggactc

SEQ ID NO: 13007 - DNA, 25 bp, Homo sapien
tgacacggccacacggcagggactc

SEQ ID NO: 13008 - DNA, 25 bp, Homo sapien
acggccacacggcagggactccgag

SEQ ID NO: 13009 - DNA, 25 bp, Homo sapien
gtgacgcggccacacggcagggaca

SEQ ID NO: 13010 - DNA, 25 bp, Homo sapien
gcagagatgggtgacgcggccacac

SEQ ID NO: 13011 - DNA, 25 bp, Homo sapien
tgacgcggccacacggcggggacac

SEQ ID NO: 13012 - DNA, 25 bp, Homo sapien
ccacagggcagggacaccgagggca

SEQ ID NO: 13013 - DNA, 25 bp, Homo sapien
gacgcggccacacggcagggactcc

SEQ ID NO: 13014 - DNA, 25 bp, Homo sapien
agtgcacagatgtctaatggcccga

SEQ ID NO: 13015 - DNA, 25 bp, Homo sapien
cccgaggggcagcttcttttataag

SEQ ID NO: 13016 - DNA, 25 bp, Homo sapien
gtccattttaactttaagtgcacag

SEQ ID NO: 13017 - DNA, 25 bp, Homo sapien
ctaatggcccgagacacgtaggtta

SEQ ID NO: 13018 - DNA, 25 bp, Homo sapien
acgtaggttaacacccgtgcacgcg

SEQ ID NO: 13019 - DNA, 25 bp, Homo sapien
aacgacacttcctatcacgtctatg

SEQ ID NO: 13020 - DNA, 25 bp, Homo sapien
ggcagcttcttttataagaaaacga

SEQ ID NO: 13021 - DNA, 25 bp, Homo sapien
cacgtctatgcaaatgtccatttta

SEQ ID NO: 13022 - DNA, 25 bp, Homo sapien
ggcaactgacctctgcgacctaatg

SEQ ID NO: 13023 - DNA, 25 bp, Homo sapien
cgcgtttggacacctggactccaga

SEQ ID NO: 13024 - DNA, 25 bp, Homo sapien
accagctggttgttagggcaactga

SEQ ID NO: 13025 - DNA, 25 bp, Homo sapien
tgcgacctaatggaggccggaaatc

SEQ ID NO: 13026 - DNA, 25 bp, Homo sapien
gaaatcgggtctggtttgccctcta

SEQ ID NO: 13027 - DNA, 25 bp, Homo sapien
ttgccctctagagcgggaatgaagc

SEQ ID NO: 13028 - DNA, 25 bp, Homo sapien
cacggtggaacagtggctgactcca

SEQ ID NO: 13029 - DNA, 25 bp, Homo sapien
tcccttctgcacaggcgcgttaatg

SEQ ID NO: 13030 - DNA, 25 bp, Homo sapien
acgcaccgccgagaccaataacgga

SEQ ID NO: 13031 - DNA, 25 bp, Homo sapien
cggtagcctgaagcccaagcgaagt

SEQ ID NO: 13032 - DNA, 25 bp, Homo sapien
gcccaagcgaagtctcagcgcaatg

SEQ ID NO: 13033 - DNA, 25 bp, Homo sapien
ctcagcgcaatgagccgcgcagagg

SEQ ID NO: 13034 - DNA, 25 bp, Homo sapien
cgtcagcggcgtgcgcggtttccaa

SEQ ID NO: 13035 - DNA, 25 bp, Homo sapien
cccagcggctctggaatggtagagc

SEQ ID NO: 13036 - DNA, 25 bp, Homo sapien
aatggtagagcaagaggctccgccc

SEQ ID NO: 13037 - DNA, 25 bp, Homo sapien
gtggacgaccctgctctctcgtttg

SEQ ID NO: 13038 - DNA, 25 bp, Homo sapien
tgtatgaccaggttggcacccagga

SEQ ID NO: 13039 - DNA, 25 bp, Homo sapien
ctgggttttgtttctgcgtagcctg

SEQ ID NO: 13040 - DNA, 25 bp, Homo sapien
tctccgtgctctgtggtaaacgacc

SEQ ID NO: 13041 - DNA, 25 bp, Homo sapien
cgtgtcctacgagagcacgctcaag

SEQ ID NO: 13042 - DNA, 25 bp, Homo sapien
tcatcgagcagaccaagcgcgtgta

SEQ ID NO: 13043 - DNA, 25 bp, Homo sapien
ggccgatgtggaggtcacctacaca

SEQ ID NO: 13044 - DNA, 25 bp, Homo sapien
gcccagcagatagaggagcgcacca

SEQ ID NO: 13045 - DNA, 25 bp, Homo sapien
acacaggtaagtcccaggcagggtc

SEQ ID NO: 13046 - DNA, 25 bp, Homo sapien
aggccgaagtacgtggacctgaccg

SEQ ID NO: 13047 - DNA, 25 bp, Homo sapien
tcttggggaaatccctcagccctcg

SEQ ID NO: 13048 - DNA, 25 bp, Homo sapien
ttctctccagaacatcaaacgcatc

SEQ ID NO: 13049 - DNA, 25 bp, Homo sapien
gagccttctgtgcatcgacttcaac

SEQ ID NO: 13050 - DNA, 25 bp, Homo sapien
gaacctgaacgaggacacgaccttc

SEQ ID NO: 13051 - DNA, 25 bp, Homo sapien
gccatcggtcctgggactcagtgca

SEQ ID NO: 13052 - DNA, 25 bp, Homo sapien
gcttcctcctgtgggcttctgtgct

SEQ ID NO: 13053 - DNA, 25 bp, Homo sapien
gttgcctcttctttcggcctggttc

SEQ ID NO: 13054 - DNA, 25 bp, Homo sapien
cgacggatcccacgtgcaggcagcg

SEQ ID NO: 13055 - DNA, 25 bp, Homo sapien
gtccattctgtgtggacaggggcaa

SEQ ID NO: 13056 - DNA, 25 bp, Homo sapien
cccagtcctgacgtgttctgaagca

SEQ ID NO: 13057 - DNA, 25 bp, Homo sapien
ttctgaagcagaaggaggtgctacc

SEQ ID NO: 13058 - DNA, 25 bp, Homo sapien
ccagcggcagcgctaagtccagtct

SEQ ID NO: 13059 - DNA, 25 bp, Homo sapien
cgctaagtccagtctgggccgcata

SEQ ID NO: 13060 - DNA, 25 bp, Homo sapien
taagtccagtctgggccgcatacgc

SEQ ID NO: 13061 - DNA, 25 bp, Homo sapien
tcccaacggcggggtctcttctgtc

SEQ ID NO: 13062 - DNA, 25 bp, Homo sapien
cttcggttgaaggaatgcaggaatg

SEQ ID NO: 13063 - DNA, 25 bp, Homo sapien
cgtcagactcagtgcagcgacgcgg

SEQ ID NO: 13064 - DNA, 25 bp, Homo sapien
tgcacgtcagactcagtgcagcgac

SEQ ID NO: 13065 - DNA, 25 bp, Homo sapien
gccctgcctgtcagactcagtgcgg

SEQ ID NO: 13066 - DNA, 25 bp, Homo sapien
agcaaggcgctcagctcctgcccgt

SEQ ID NO: 13067 - DNA, 25 bp, Homo sapien
cagtcagcagcaaggcgctcagctc

SEQ ID NO: 13068 - DNA, 25 bp, Homo sapien
gcacacgcggggcagtcagcagcaa

SEQ ID NO: 13069 - DNA, 25 bp, Homo sapien
cctgtcagactcagtgcggcggaca

SEQ ID NO: 13070 - DNA, 25 bp, Homo sapien
gcttggaaagcaaagcttggcgtcc

SEQ ID NO: 13071 - DNA, 25 bp, Homo sapien
caaagcttggcgtccgctgggtccc

SEQ ID NO: 13072 - DNA, 25 bp, Homo sapien
ttttttcatctgtgtgcgtgttggc

SEQ ID NO: 13073 - DNA, 25 bp, Homo sapien
gtggcagcccaagtcccgctgagct

SEQ ID NO: 13074 - DNA, 25 bp, Homo sapien
tcagggatgttggtcttgctgaaca

SEQ ID NO: 13075 - DNA, 25 bp, Homo sapien
tgctgaacaggacctccagaccgtc

SEQ ID NO: 13076 - DNA, 25 bp, Homo sapien
ctccagctcatgctggcggtgtgcc

SEQ ID NO: 13077 - DNA, 25 bp, Homo sapien
cccagcccatcggagagcttggaaa

SEQ ID NO: 13078 - DNA, 25 bp, Homo sapien
actgcgggtcctcccttccaaatgg

SEQ ID NO: 13079 - DNA, 25 bp, Homo sapien
tgcctgggacatgcgctactacatg

SEQ ID NO: 13080 - DNA, 25 bp, Homo sapien
ctactgcgtggaccagaacctgctc

SEQ ID NO: 13081 - DNA, 25 bp, Homo sapien
ctgctgggcatctaccaggagctcc

SEQ ID NO: 13082 - DNA, 25 bp, Homo sapien
tcagggactcttgcggtgtctctag

SEQ ID NO: 13083 - DNA, 25 bp, Homo sapien
ccacctctgctgagagggaggttta

SEQ ID NO: 13084 - DNA, 25 bp, Homo sapien
gaaggaagtcgttgcctgctccatg

SEQ ID NO: 13085 - DNA, 25 bp, Homo sapien
tcggcaagttctacctggacctgta

SEQ ID NO: 13086 - DNA, 25 bp, Homo sapien
tcgccaaggtggaccaggccctgca

SEQ ID NO: 13087 - DNA, 25 bp, Homo sapien
tgcgccagatcgtcctcgccaaggt

SEQ ID NO: 13088 - DNA, 25 bp, Homo sapien
attgagtcccggcaggccaacacag

SEQ ID NO: 13089 - DNA, 25 bp, Homo sapien
ctcctggagaagctcattgagtccc

SEQ ID NO: 13090 - DNA, 25 bp, Homo sapien
ttcgccatgttcagcgggacccacg

SEQ ID NO: 13091 - DNA, 25 bp, Homo sapien
ctgcaggcggagttcgccatgttca

SEQ ID NO: 13092 - DNA, 25 bp, Homo sapien
atcacctgtgcactcgccctgtttg

SEQ ID NO: 13093 - DNA, 25 bp, Homo sapien
cactgtggcagctgacacgggccag

SEQ ID NO: 13094 - DNA, 25 bp, Homo sapien
ccagtactacgggtacctgtggagc

SEQ ID NO: 13095 - DNA, 25 bp, Homo sapien
tacctgtggagcgaggtgtattcca

SEQ ID NO: 13096 - DNA, 25 bp, Homo sapien
aggagggtgtcctgaacagcaaggt

SEQ ID NO: 13097 - DNA, 25 bp, Homo sapien
ttccacacgcgcttcaagcaggagg

SEQ ID NO: 13098 - DNA, 25 bp, Homo sapien
ggacatgttccacacgcgcttcaag

SEQ ID NO: 13099 - DNA, 25 bp, Homo sapien
cgacgcccagtactacgggtacctg

SEQ ID NO: 13100 - DNA, 25 bp, Homo sapien
gtattccatggacatgttccacacg

SEQ ID NO: 13101 - DNA, 25 bp, Homo sapien
cgaggtgtattccatggacatgttc

SEQ ID NO: 13102 - DNA, 25 bp, Homo sapien
ggcagctcagccgtaagtgccgccg

SEQ ID NO: 13103 - DNA, 25 bp, Homo sapien
tccagcgaaccacacggggtggatc

SEQ ID NO: 13104 - DNA, 25 bp, Homo sapien
accacacggggtggatccaacagcc

SEQ ID NO: 13105 - DNA, 25 bp, Homo sapien
atccaacagccgcaggggcatcgtg

SEQ ID NO: 13106 - DNA, 25 bp, Homo sapien
cgctgtgacccaggttggagagtca

SEQ ID NO: 13107 - DNA, 25 bp, Homo sapien
ggcgcagtgccgagtttacctctgc

SEQ ID NO: 13108 - DNA, 25 bp, Homo sapien
ggcatgaccctgtcgcgatagggtc

SEQ ID NO: 13109 - DNA, 25 bp, Homo sapien
ccgagtttacctctgcgcgcgtcgg

SEQ ID NO: 13110 - DNA, 25 bp, Homo sapien
cggggccgagacaagtatccaatga

SEQ ID NO: 13111 - DNA, 25 bp, Homo sapien
cacctgcgccggtagcgaagaaatc

SEQ ID NO: 13112 - DNA, 25 bp, Homo sapien
acgcctctgtcctagccgtgagtgc

SEQ ID NO: 13113 - DNA, 25 bp, Homo sapien
ggcttcccgagctctgtctaatcag

SEQ ID NO: 13114 - DNA, 25 bp, Homo sapien
tggggaattctccaatcagagtcgc

SEQ ID NO: 13115 - DNA, 25 bp, Homo sapien
accagttcgcccagaagccagtgtc

SEQ ID NO: 13116 - DNA, 25 bp, Homo sapien
cgcctcgtgaggaaactagtctgga

SEQ ID NO: 13117 - DNA, 25 bp, Homo sapien
actgtccaatcagaagcgcggcttc

SEQ ID NO: 13118 - DNA, 25 bp, Homo sapien
ccggcagactgttcccaggatgcaa

SEQ ID NO: 13119 - DNA, 25 bp, Homo sapien
gcaacacgggctcgcgtctaaaaga

SEQ ID NO: 13120 - DNA, 25 bp, Homo sapien
cacagtccaggacgcgtcttactaa

SEQ ID NO: 13121 - DNA, 25 bp, Homo sapien
ggaagtggagttcccgaacagaagc

SEQ ID NO: 13122 - DNA, 25 bp, Homo sapien
gcctcagcccattggcctgcgggaa

SEQ ID NO: 13123 - DNA, 25 bp, Homo sapien
gggagtttccgccttccatgaagtg

SEQ ID NO: 13124 - DNA, 25 bp, Homo sapien
tactaacgcctcaccagagcgcatg

SEQ ID NO: 13125 - DNA, 25 bp, Homo sapien
gctttttctgcgcactcaggtcgtg

SEQ ID NO: 13126 - DNA, 25 bp, Homo sapien
tcccggatgtgacgtagcgtgacgc

SEQ ID NO: 13127 - DNA, 25 bp, Homo sapien
attgatgctgaaatgacgaggtggc

SEQ ID NO: 13128 - DNA, 25 bp, Homo sapien
cgtgacgcctgcaggattgatgctg

SEQ ID NO: 13129 - DNA, 25 bp, Homo sapien
gtccacggactaccaggaagccagg

SEQ ID NO: 13130 - DNA, 25 bp, Homo sapien
gaatgcgcatgtgcggtcccgagcc

SEQ ID NO: 13131 - DNA, 25 bp, Homo sapien
gtcccgagcctcaggctagcgttcg

SEQ ID NO: 13132 - DNA, 25 bp, Homo sapien
ccgcatgttgcacctgtcggcagcg

SEQ ID NO: 13133 - DNA, 25 bp, Homo sapien
gacaccgcctggtgtccacggacta

SEQ ID NO: 13134 - DNA, 25 bp, Homo sapien
ctggaaccagagtccgccgaagtct

SEQ ID NO: 13135 - DNA, 25 bp, Homo sapien
tgagtctggacttctcgtgcccgtt

SEQ ID NO: 13136 - DNA, 25 bp, Homo sapien
tatcttccaatcaggtgctccgggg

SEQ ID NO: 13137 - DNA, 25 bp, Homo sapien
gcgggtccggaaaactgtccaatca

SEQ ID NO: 13138 - DNA, 25 bp, Homo sapien
tgcaggtttgcagtagtgtccaatc

SEQ ID NO: 13139 - DNA, 25 bp, Homo sapien
gtgtccaaaacgctgtccgctcaga

SEQ ID NO: 13140 - DNA, 25 bp, Homo sapien
ggagtacctgtacctttcagctgcg

SEQ ID NO: 13141 - DNA, 25 bp, Homo sapien
agttcgcgcaaacgggagtgtccac

SEQ ID NO: 13142 - DNA, 25 bp, Homo sapien
ggcgacagaaaaggggactcagaca

SEQ ID NO: 13143 - DNA, 25 bp, Homo sapien
gcttgtgggaaacggcgacctcaaa

SEQ ID NO: 13144 - DNA, 25 bp, Homo sapien
cgggagattacggacatcctgaacc

SEQ ID NO: 13145 - DNA, 25 bp, Homo sapien
ggcgacctcaaacggaggctgcaca

SEQ ID NO: 13146 - DNA, 25 bp, Homo sapien
agcccgacaactgcgccggcgaggt

SEQ ID NO: 13147 - DNA, 25 bp, Homo sapien
ttccctacttctgcgagggcggctg

SEQ ID NO: 13148 - DNA, 25 bp, Homo sapien
acgccgctgtagcacgggcgaactt

SEQ ID NO: 13149 - DNA, 25 bp, Homo sapien
gggcgaacttccctacttctgcgag

SEQ ID NO: 13150 - DNA, 25 bp, Homo sapien
tcctgccgcgcggacactcagggcg

SEQ ID NO: 13151 - DNA, 25 bp, Homo sapien
cgctccgtcccggatttgcaggcag

SEQ ID NO: 13152 - DNA, 25 bp, Homo sapien
aatctcgtaactccggcgctggccg

SEQ ID NO: 13153 - DNA, 25 bp, Homo sapien
cgtcccggatttgcaggcagctgga

SEQ ID NO: 13154 - DNA, 25 bp, Homo sapien
ctcagggcggcccaaggaatcgcct

SEQ ID NO: 13155 - DNA, 25 bp, Homo sapien
gcggcccaaggaatcgcctacatgg

SEQ ID NO: 13156 - DNA, 25 bp, Homo sapien
ggaatcgcctacatgggatccaccc

SEQ ID NO: 13157 - DNA, 25 bp, Homo sapien
aaaaatctcgtaactccggcgctgg

SEQ ID NO: 13158 - DNA, 25 bp, Homo sapien
tggacagtgctgtcgactccgcacc

SEQ ID NO: 13159 - DNA, 25 bp, Homo sapien
tgcacggcaactccagactcagttt

SEQ ID NO: 13160 - DNA, 25 bp, Homo sapien
cgcggatctgggagaactcactcca

SEQ ID NO: 13161 - DNA, 25 bp, Homo sapien
tcgtcgagaacacgcgtggctgacc

SEQ ID NO: 13162 - DNA, 25 bp, Homo sapien
aattctctcctcagtgacgggctcg

SEQ ID NO: 13163 - DNA, 25 bp, Homo sapien
ctccgcttcggattaacgtctctga

SEQ ID NO: 13164 - DNA, 25 bp, Homo sapien
tgcctgtcctgattggataattctc

SEQ ID NO: 13165 - DNA, 25 bp, Homo sapien
accgtcctcggggtctgattggaca

SEQ ID NO: 13166 - DNA, 25 bp, Homo sapien
gctcaggccgtttttgcgtttccca

SEQ ID NO: 13167 - DNA, 25 bp, Homo sapien
agggctcagacctcttctacgacga

SEQ ID NO: 13168 - DNA, 25 bp, Homo sapien
ctggccgagtactgcgtgaagacca

SEQ ID NO: 13169 - DNA, 25 bp, Homo sapien
gtggtcgccacacgccgttttaaga

SEQ ID NO: 13170 - DNA, 25 bp, Homo sapien
tgcgtttcccatctcacctgtgctg

SEQ ID NO: 13171 - DNA, 25 bp, Homo sapien
acagggctttgtcctaagtggtcgc

SEQ ID NO: 13172 - DNA, 25 bp, Homo sapien
tggagttcctcacgcacagggcttt

SEQ ID NO: 13173 - DNA, 25 bp, Homo sapien
ctgttgccggcatcgttattttctc

SEQ ID NO: 13174 - DNA, 25 bp, Homo sapien
tcgctgagcaggaaaagctagtttc

SEQ ID NO: 13175 - DNA, 25 bp, Homo sapien
tggtctttcgcgcaatcctccaacg

SEQ ID NO: 13176 - DNA, 25 bp, Homo sapien
gcgtggctaaaacaagaccgaggtc

SEQ ID NO: 13177 - DNA, 25 bp, Homo sapien
tccgccgtctgggagataattggca

SEQ ID NO: 13178 - DNA, 25 bp, Homo sapien
acctacgtcgtccaatcgctgagca

SEQ ID NO: 13179 - DNA, 25 bp, Homo sapien
ttggcctctgccacgaagatacggg

SEQ ID NO: 13180 - DNA, 25 bp, Homo sapien
cggtgccaggacttcgccattaaac

SEQ ID NO: 13181 - DNA, 25 bp, Homo sapien
taattggcattgttggcagatccgc

SEQ ID NO: 13182 - DNA, 25 bp, Homo sapien
cacgtgcgtaaacggcctcgctatt

SEQ ID NO: 13183 - DNA, 25 bp, Homo sapien
actgcgccttcattgatctgcttcg

SEQ ID NO: 13184 - DNA, 25 bp, Homo sapien
aaacggcctcgctattggccggcgc

SEQ ID NO: 13185 - DNA, 25 bp, Homo sapien
attgatctgcttcgcggtccaggtg

SEQ ID NO: 13186 - DNA, 25 bp, Homo sapien
gggcgtacgcgacccacgtgcgtaa

SEQ ID NO: 13187 - DNA, 25 bp, Homo sapien
aggctcccggctcgctgagtgacag

SEQ ID NO: 13188 - DNA, 25 bp, Homo sapien
gaccgaaagggtaaagcagaggctc

SEQ ID NO: 13189 - DNA, 25 bp, Homo sapien
acgtgcagctactgcgccttcattg

SEQ ID NO: 13190 - DNA, 25 bp, Homo sapien
cagacacgtggaaggagtaggccct

SEQ ID NO: 13191 - DNA, 25 bp, Homo sapien
tctgcccgtccgcagacacgtggaa

SEQ ID NO: 13192 - DNA, 25 bp, Homo sapien
aagggaaccggctgcatctgcccgt

SEQ ID NO: 13193 - DNA, 25 bp, Homo sapien
ctcaccaggcagtcgagctgggcca

SEQ ID NO: 13194 - DNA, 25 bp, Homo sapien
cgcctaccagtgcatccgaggggaa

SEQ ID NO: 13195 - DNA, 25 bp, Homo sapien
ctgatggtgaccgcgcagaccacct

SEQ ID NO: 13196 - DNA, 25 bp, Homo sapien
cttgccgcccgtgtacacatgctgt

SEQ ID NO: 13197 - DNA, 25 bp, Homo sapien
tacacatgctgtgtggagccgctga

SEQ ID NO: 13198 - DNA, 25 bp, Homo sapien
ccaggcgccaccagagcttgatgat

SEQ ID NO: 13199 - DNA, 25 bp, Homo sapien
ttccctgggggtacatcctgccgat

SEQ ID NO: 13200 - DNA, 25 bp, Homo sapien
gcagtccgcactcaccgggtgcctt

SEQ ID NO: 13201 - DNA, 25 bp, Homo sapien
ccaagatcgagaacttgaagggctg

SEQ ID NO: 13202 - DNA, 25 bp, Homo sapien
atgcggtcgcagatctccaagatcg

SEQ ID NO: 13203 - DNA, 25 bp, Homo sapien
caccagagcttgatgatatggaggc

SEQ ID NO: 13204 - DNA, 25 bp, Homo sapien
tggtattgagcctgaagaaactgga

SEQ ID NO: 13205 - DNA, 25 bp, Homo sapien
gcctgaagaaactggaattcttctt

SEQ ID NO: 13206 - DNA, 25 bp, Homo sapien
gctcccacatgggtcagtgacgtca

SEQ ID NO: 13207 - DNA, 25 bp, Homo sapien
tcgcgacgctcccacatgggtcagt

SEQ ID NO: 13208 - DNA, 25 bp, Homo sapien
ccacatgggtcagtgacgtcacata

SEQ ID NO: 13209 - DNA, 25 bp, Homo sapien
gtgacgtcacataggaaactggcca

SEQ ID NO: 13210 - DNA, 25 bp, Homo sapien
acgtcacataggaaactggccaatg

SEQ ID NO: 13211 - DNA, 25 bp, Homo sapien
cacataggaaactggccaatgggga

SEQ ID NO: 13212 - DNA, 25 bp, Homo sapien
taggaaactggccaatggggattag

SEQ ID NO: 13213 - DNA, 25 bp, Homo sapien
tgggtcagtgacgtcacataggaaa

SEQ ID NO: 13214 - DNA, 25 bp, Homo sapien
gaccctagtggacgcccgagctcga

SEQ ID NO: 13215 - DNA, 25 bp, Homo sapien
gggattaggagaccagcaaccaatg

SEQ ID NO: 13216 - DNA, 25 bp, Homo sapien
agcaaccaatggcaggaggcactgg

SEQ ID NO: 13217 - DNA, 25 bp, Homo sapien
ggcactgggatcagtagggccaatc

SEQ ID NO: 13218 - DNA, 25 bp, Homo sapien
ctgggatcagtagggccaatcggaa

SEQ ID NO: 13219 - DNA, 25 bp, Homo sapien
cctccctaggagaatctgagaccct

SEQ ID NO: 13220 - DNA, 25 bp, Homo sapien
atctgagaccctagtggacgcccga

SEQ ID NO: 13221 - DNA, 25 bp, Homo sapien
gccaatggggattaggagaccagca

SEQ ID NO: 13222 - DNA, 25 bp, Homo sapien
cccggcgcggtataattacagccca

SEQ ID NO: 13223 - DNA, 25 bp, Homo sapien
ggcgcggtataattacagcccattg

SEQ ID NO: 13224 - DNA, 25 bp, Homo sapien
gcggtataattacagcccattgatc

SEQ ID NO: 13225 - DNA, 25 bp, Homo sapien
ttacagcccattgatccgacccggg

SEQ ID NO: 13226 - DNA, 25 bp, Homo sapien
aagcctttggcttccgacaccgcca

SEQ ID NO: 13227 - DNA, 25 bp, Homo sapien
ttccgacaccgccaacctctgccta

SEQ ID NO: 13228 - DNA, 25 bp, Homo sapien
ctccagccgaactgccgggccacca

SEQ ID NO: 13229 - DNA, 25 bp, Homo sapien
cggcccggcgcggtataattacagc

SEQ ID NO: 13230 - DNA, 25 bp, Homo sapien
gccagcaacatcaatatcagtaata

SEQ ID NO: 13231 - DNA, 25 bp, Homo sapien
tgctgccagcaacatcaatatcagt

SEQ ID NO: 13232 - DNA, 25 bp, Homo sapien
cttcttccgagaagaccccttgtgg

SEQ ID NO: 13233 - DNA, 25 bp, Homo sapien
tggctgagtaggcaggaccccttct

SEQ ID NO: 13234 - DNA, 25 bp, Homo sapien
attagccgatcaattagccgaggtc

SEQ ID NO: 13235 - DNA, 25 bp, Homo sapien
tcgcccgcggcgcagtcgttaagcg

SEQ ID NO: 13236 - DNA, 25 bp, Homo sapien
gcggggcccattagccgatcaatta

SEQ ID NO: 13237 - DNA, 25 bp, Homo sapien
gccgatcaattagccgaggtcgccc

SEQ ID NO: 13238 - DNA, 25 bp, Homo sapien
gggcagcgattcctccctgcaaagt

SEQ ID NO: 13239 - DNA, 25 bp, Homo sapien
tcctcggggacacgctcttccggga

SEQ ID NO: 13240 - DNA, 25 bp, Homo sapien
tctcggtgctcgaaatcttccgggg

SEQ ID NO: 13241 - DNA, 25 bp, Homo sapien
ccctgcaaagtcctcttgggggagg

SEQ ID NO: 13242 - DNA, 25 bp, Homo sapien
gggtgcgccctctaccgccctccaa

SEQ ID NO: 13243 - DNA, 25 bp, Homo sapien
tccgaggtggtgaatttgagttgct

SEQ ID NO: 13244 - DNA, 25 bp, Homo sapien
gggtctctctctcggtgctcgaaat

SEQ ID NO: 13245 - DNA, 25 bp, Homo sapien
tgcgttttaaggcccgccctagatg

SEQ ID NO: 13246 - DNA, 25 bp, Homo sapien
ctctactcgggcattaggcaggctg

SEQ ID NO: 13247 - DNA, 25 bp, Homo sapien
tcagtgcccgcttccctgagcaaag

SEQ ID NO: 13248 - DNA, 25 bp, Homo sapien
gggcacacagcgagcctctactcgg

SEQ ID NO: 13249 - DNA, 25 bp, Homo sapien
aacggatggtcttgcgaatctagcc

SEQ ID NO: 13250 - DNA, 25 bp, Homo sapien
gtttcccgctgcgtgaacggatggt

SEQ ID NO: 13251 - DNA, 25 bp, Homo sapien
tcgtctggactctgacgcggaccca

SEQ ID NO: 13252 - DNA, 25 bp, Homo sapien
gagcaaaggctcgtctggactctga

SEQ ID NO: 13253 - DNA, 25 bp, Homo sapien
caggctgtaacgactgagtgctgca

SEQ ID NO: 13254 - DNA, 25 bp, Homo sapien
accctcgagtgtcagccctgcctgt

SEQ ID NO: 13255 - DNA, 25 bp, Homo sapien
tgccgtccgggtcgcgagaccctcc

SEQ ID NO: 13256 - DNA, 25 bp, Homo sapien
ggtcgcgagaccctccggggtcagc

SEQ ID NO: 13257 - DNA, 25 bp, Homo sapien
gtcgcgggaccctcgagtgtcagcc

SEQ ID NO: 13258 - DNA, 25 bp, Homo sapien
gatcagccctgcctgtgtcgtctgg

SEQ ID NO: 13259 - DNA, 25 bp, Homo sapien
atcagccctgcctgtgtcgtctggg

SEQ ID NO: 13260 - DNA, 25 bp, Homo sapien
ctgcctgtgtcgtctgggtcggctc

SEQ ID NO: 13261 - DNA, 25 bp, Homo sapien
ttccctgcctgtccgggtcgcggga

SEQ ID NO: 13262 - DNA, 25 bp, Homo sapien
agatgggcctctccgttacgtacaa

SEQ ID NO: 13263 - DNA, 25 bp, Homo sapien
tgttcacgcctcagatgggcctctc

SEQ ID NO: 13264 - DNA, 25 bp, Homo sapien
aaatgtgctgttcacgcctcagatg

SEQ ID NO: 13265 - DNA, 25 bp, Homo sapien
cgcggcggctaaaatgtgctgttca

SEQ ID NO: 13266 - DNA, 25 bp, Homo sapien
agcctggcgaggacattccgtgccc

SEQ ID NO: 13267 - DNA, 25 bp, Homo sapien
cgcgtctgctcgctctcatccactg

SEQ ID NO: 13268 - DNA, 25 bp, Homo sapien
gtcggtcagcctggcgaggacattc

SEQ ID NO: 13269 - DNA, 25 bp, Homo sapien
tctccgttacgtacaacaggtctcc

SEQ ID NO: 13270 - DNA, 25 bp, Homo sapien
tgcgtccctgggtgcacatctgggc

SEQ ID NO: 13271 - DNA, 25 bp, Homo sapien
cgttttcgtgtggacctacctgctc

SEQ ID NO: 13272 - DNA, 25 bp, Homo sapien
acatctgggcggcttcgtctgcgtc

SEQ ID NO: 13273 - DNA, 25 bp, Homo sapien
ctccctccagattagacccgtggga

SEQ ID NO: 13274 - DNA, 25 bp, Homo sapien
ttagacccgtgggagtggcatctcg

SEQ ID NO: 13275 - DNA, 25 bp, Homo sapien
cgggctgttcagtgactctgtttca

SEQ ID NO: 13276 - DNA, 25 bp, Homo sapien
gtctgcgtccgtccgtctgaagctt

SEQ ID NO: 13277 - DNA, 25 bp, Homo sapien
tctgaagctttgctgggagccgcct

SEQ ID NO: 13278 - DNA, 25 bp, Homo sapien
tacaagtacgagcagaacaaggtga

SEQ ID NO: 13279 - DNA, 25 bp, Homo sapien
cggcgccggctactcggaggaggac

SEQ ID NO: 13280 - DNA, 25 bp, Homo sapien
ggacaagcgcggcttcaccaagctc

SEQ ID NO: 13281 - DNA, 25 bp, Homo sapien
caagtacgagcagaacaaggtgagc

SEQ ID NO: 13282 - DNA, 25 bp, Homo sapien
tacgagcagaacaaggtgagcccgc

SEQ ID NO: 13283 - DNA, 25 bp, Homo sapien
gcgcctgggcagctgtgggcttggt

SEQ ID NO: 13284 - DNA, 25 bp, Homo sapien
atccacggcgccggctactcggagg

SEQ ID NO: 13285 - DNA, 25 bp, Homo sapien
agtacgagcagaacaaggtgagccc

SEQ ID NO: 13286 - DNA, 25 bp, Homo sapien
cgcgtttttctgacacgtgttcaca

SEQ ID NO: 13287 - DNA, 25 bp, Homo sapien
gggccgtcacaagctttctggtgga

SEQ ID NO: 13288 - DNA, 25 bp, Homo sapien
ctcgtgttggggcaccatgtaaact

SEQ ID NO: 13289 - DNA, 25 bp, Homo sapien
aaccgagtctggagctgcacactgc

SEQ ID NO: 13290 - DNA, 25 bp, Homo sapien
ttgcaacgtcctgtgactgggcttc

SEQ ID NO: 13291 - DNA, 25 bp, Homo sapien
tgcctcccggtgtgtctggagaatt

SEQ ID NO: 13292 - DNA, 25 bp, Homo sapien
accttcgagcatcagtacgtcagtg

SEQ ID NO: 13293 - DNA, 25 bp, Homo sapien
ctccgactctgccaagtagtaagtg

SEQ ID NO: 13294 - DNA, 25 bp, Homo sapien
gagaacatcatcttccggtaccgcc

SEQ ID NO: 13295 - DNA, 25 bp, Homo sapien
cagacactgccgtaggtggcgcagt

SEQ ID NO: 13296 - DNA, 25 bp, Homo sapien
gacgttgaccgcatcgccaccttgg

SEQ ID NO: 13297 - DNA, 25 bp, Homo sapien
accggcatcatcgagtaccctttcg

SEQ ID NO: 13298 - DNA, 25 bp, Homo sapien
tgcagctacctgaccgacgttgacc

SEQ ID NO: 13299 - DNA, 25 bp, Homo sapien
agcacccaccgctgtgttgcagcta

SEQ ID NO: 13300 - DNA, 25 bp, Homo sapien
ccgtcctcccgctggtttgggtgct

SEQ ID NO: 13301 - DNA, 25 bp, Homo sapien
atcgagtaccctttcgacctggaga

SEQ ID NO: 13302 - DNA, 25 bp, Homo sapien
gagacacggggcaggaccttccttc

SEQ ID NO: 13303 - DNA, 25 bp, Homo sapien
ggaccttccttccacggagcctgcg

SEQ ID NO: 13304 - DNA, 25 bp, Homo sapien
tcacacttcacgtgtgccaccgaca

SEQ ID NO: 13305 - DNA, 25 bp, Homo sapien
atctactcacacttcacgtgtgcca

SEQ ID NO: 13306 - DNA, 25 bp, Homo sapien
tcatctactcacacttcacgtgtgc

SEQ ID NO: 13307 - DNA, 25 bp, Homo sapien
gatcatctactcacacttcacgtgt

SEQ ID NO: 13308 - DNA, 25 bp, Homo sapien
agatcatctactcacacttcacgtg

SEQ ID NO: 13309 - DNA, 25 bp, Homo sapien
cttccttccacggagcctgcggctg

SEQ ID NO: 13310 - DNA, 25 bp, Homo sapien
gggaagccagcactcgcactttggc

SEQ ID NO: 13311 - DNA, 25 bp, Homo sapien
ggcttcgcacagctgtcccagggat

SEQ ID NO: 13312 - DNA, 25 bp, Homo sapien
tgactgaacactacagcgccctgtg

SEQ ID NO: 13313 - DNA, 25 bp, Homo sapien
cgtctgctgttgactgaacactaca

SEQ ID NO: 13314 - DNA, 25 bp, Homo sapien
aggtggctttttcgtctgctgttga

SEQ ID NO: 13315 - DNA, 25 bp, Homo sapien
ctgaggcaccgagactggttctccc

SEQ ID NO: 13316 - DNA, 25 bp, Homo sapien
ccagggatggatcgcctgtgctgcc

SEQ ID NO: 13317 - DNA, 25 bp, Homo sapien
cccttgaggcactgaggcaccgaga

SEQ ID NO: 13318 - DNA, 25 bp, Homo sapien
cagaacatccgcaaggtcttcaagg

SEQ ID NO: 13319 - DNA, 25 bp, Homo sapien
tcagccactacacatgtgccacaga

SEQ ID NO: 13320 - DNA, 25 bp, Homo sapien
aggtcttcaaggacgtgcgggactc

SEQ ID NO: 13321 - DNA, 25 bp, Homo sapien
gacgagatcaacctgctgtgaccca

SEQ ID NO: 13322 - DNA, 25 bp, Homo sapien
agtgtccctggtctatctctccagc

SEQ ID NO: 13323 - DNA, 25 bp, Homo sapien
agcctcggcccacacgcaagggagt

SEQ ID NO: 13324 - DNA, 25 bp, Homo sapien
caagaagggcgcacgatcccgacgc

SEQ ID NO: 13325 - DNA, 25 bp, Homo sapien
tcgcccgctacctggacgagatcaa

SEQ ID NO: 13326 - DNA, 25 bp, Homo sapien
catgggcctctatggggccatcttc

SEQ ID NO: 13327 - DNA, 25 bp, Homo sapien
aagcgctacatcctcttctgcctgg

SEQ ID NO: 13328 - DNA, 25 bp, Homo sapien
gtcgaggctcactccggagcttcca

SEQ ID NO: 13329 - DNA, 25 bp, Homo sapien
ccgcctgctgaagacggtgctgatg

SEQ ID NO: 13330 - DNA, 25 bp, Homo sapien
tgttctgcactacaaccactcgggc

SEQ ID NO: 13331 - DNA, 25 bp, Homo sapien
gctgggtctactattgcctggtgaa

SEQ ID NO: 13332 - DNA, 25 bp, Homo sapien
gcgtctacggcttcatcggcctctg

SEQ ID NO: 13333 - DNA, 25 bp, Homo sapien
tgctggccgacgtctttggctccaa

SEQ ID NO: 13334 - DNA, 25 bp, Homo sapien
caactgcggcgatcggagtccgcgc

SEQ ID NO: 13335 - DNA, 25 bp, Homo sapien
gctccgttctgcgacatggcgccag

SEQ ID NO: 13336 - DNA, 25 bp, Homo sapien
gctcgagcagagtcgaaagagtctg

SEQ ID NO: 13337 - DNA, 25 bp, Homo sapien
gggcccgtctttccatcctgctagt

SEQ ID NO: 13338 - DNA, 25 bp, Homo sapien
tggctaccacggagacgccgctacg

SEQ ID NO: 13339 - DNA, 25 bp, Homo sapien
ggactctctgggcactggctaccac

SEQ ID NO: 13340 - DNA, 25 bp, Homo sapien
ccctgcgtgaacagcggggcccgtt

SEQ ID NO: 13341 - DNA, 25 bp, Homo sapien
gcgtcgcccattggccgcgacttgg

SEQ ID NO: 13342 - DNA, 25 bp, Homo sapien
cagcagtacgacctgcagggccagc

SEQ ID NO: 13343 - DNA, 25 bp, Homo sapien
ggtattagccgaacagcctgccgca

SEQ ID NO: 13344 - DNA, 25 bp, Homo sapien
gggagttccagagtgggcctacaac

SEQ ID NO: 13345 - DNA, 25 bp, Homo sapien
actacaattcccgacaggcagcgcg

SEQ ID NO: 13346 - DNA, 25 bp, Homo sapien
gctacccatgccgaggtgagtccgc

SEQ ID NO: 13347 - DNA, 25 bp, Homo sapien
tgctggagaacatgctgaaggcgtc

SEQ ID NO: 13348 - DNA, 25 bp, Homo sapien
gttcaccgtgtaccgcatgcagcag

SEQ ID NO: 13349 - DNA, 25 bp, Homo sapien
acgccgcgcacgagttcaccgtgta

SEQ ID NO: 13350 - DNA, 25 bp, Homo sapien
ctcgctcactccctatcccgcctgc

SEQ ID NO: 13351 - DNA, 25 bp, Homo sapien
gccccaaaggggtgacattcgagtc

SEQ ID NO: 13352 - DNA, 25 bp, Homo sapien
ccgcagagggccgtgtccacactag

SEQ ID NO: 13353 - DNA, 25 bp, Homo sapien
agggccgtgtccacactagcttgtg

SEQ ID NO: 13354 - DNA, 25 bp, Homo sapien
ccgtgtccacactagcttgtggcca

SEQ ID NO: 13355 - DNA, 25 bp, Homo sapien
cacagagagcccttgccattgggcc

SEQ ID NO: 13356 - DNA, 25 bp, Homo sapien
gggtgcctgccagttggcctcatct

SEQ ID NO: 13357 - DNA, 25 bp, Homo sapien
tggggccacccaaggccatctgttc

SEQ ID NO: 13358 - DNA, 25 bp, Homo sapien
aataagcccgtgatggagcgacagc

SEQ ID NO: 13359 - DNA, 25 bp, Homo sapien
atcgtcgcggtgctgagacttgcag

SEQ ID NO: 13360 - DNA, 25 bp, Homo sapien
aggctctcagcgacggccgtggcct

SEQ ID NO: 13361 - DNA, 25 bp, Homo sapien
tggggagcgccaccgcagaagtgaa

SEQ ID NO: 13362 - DNA, 25 bp, Homo sapien
cctggcgagtttccagagcggtgac

SEQ ID NO: 13363 - DNA, 25 bp, Homo sapien
agaagccctggcgagtttccagagc

SEQ ID NO: 13364 - DNA, 25 bp, Homo sapien
ggcagcggcgaaaccagaagccctg

SEQ ID NO: 13365 - DNA, 25 bp, Homo sapien
tcccaggaagcaaaaggcagcggcg

SEQ ID NO: 13366 - DNA, 25 bp, Homo sapien
gattccgtagcgtgagcctgccgga

SEQ ID NO: 13367 - DNA, 25 bp, Homo sapien
cttgcttttcggtcacctggggttg

SEQ ID NO: 13368 - DNA, 25 bp, Homo sapien
tgtgtgggcgtgaagctccctgctt

SEQ ID NO: 13369 - DNA, 25 bp, Homo sapien
tgggattcgcgctgctgggcaccca

SEQ ID NO: 13370 - DNA, 25 bp, Homo sapien
gaataggaatcatggcggctgcgct

SEQ ID NO: 13371 - DNA, 25 bp, Homo sapien
tagcaacgccgggtcacgtgcgccg

SEQ ID NO: 13372 - DNA, 25 bp, Homo sapien
cgctcattgcaactttgaaagcagg

SEQ ID NO: 13373 - DNA, 25 bp, Homo sapien
ctgcgctgttcgtgctgctgggatt

SEQ ID NO: 13374 - DNA, 25 bp, Homo sapien
gccgctgcgtgctcatgcggctact

SEQ ID NO: 13375 - DNA, 25 bp, Homo sapien
tgctcatgcggctactggacttctc

SEQ ID NO: 13376 - DNA, 25 bp, Homo sapien
ggctactggacttctcctacgagca

SEQ ID NO: 13377 - DNA, 25 bp, Homo sapien
agcagtaccagaaggccctgcggca

SEQ ID NO: 13378 - DNA, 25 bp, Homo sapien
aatgcagtgctgaacacggaggcgc

SEQ ID NO: 13379 - DNA, 25 bp, Homo sapien
tcctacgagcagtaccagaaggccc

SEQ ID NO: 13380 - DNA, 25 bp, Homo sapien
cccacaggcacacggaatgcagtgc

SEQ ID NO: 13381 - DNA, 25 bp, Homo sapien
acgtcgtccgggtgagcgtctgccc

SEQ ID NO: 13382 - DNA, 25 bp, Homo sapien
gccaacggcttccagatggtcacca

SEQ ID NO: 13383 - DNA, 25 bp, Homo sapien
gctgatgggaaactggagtcggatc

SEQ ID NO: 13384 - DNA, 25 bp, Homo sapien
ggccactgccaacggcttccagatg

SEQ ID NO: 13385 - DNA, 25 bp, Homo sapien
caaggccgtgagtgactggctgatt

SEQ ID NO: 13386 - DNA, 25 bp, Homo sapien
tccagatggtcaccagcggggtaca

SEQ ID NO: 13387 - DNA, 25 bp, Homo sapien
gccgtgagtgactggctgattgcca

SEQ ID NO: 13388 - DNA, 25 bp, Homo sapien
tgagtgactggctgattgccagcgt

SEQ ID NO: 13389 - DNA, 25 bp, Homo sapien
tcggccgtactagaggggagccgct

SEQ ID NO: 13390 - DNA, 25 bp, Homo sapien
ccacagggcttggattctggctcca

SEQ ID NO: 13391 - DNA, 25 bp, Homo sapien
ccactacgacgcctttggagtggcc

SEQ ID NO: 13392 - DNA, 25 bp, Homo sapien
gggcttggattctggctccagtcca

SEQ ID NO: 13393 - DNA, 25 bp, Homo sapien
cagtccagtgccgaggcaaagcgcc

SEQ ID NO: 13394 - DNA, 25 bp, Homo sapien
cagtgccgaggcaaagcgcctgtag

SEQ ID NO: 13395 - DNA, 25 bp, Homo sapien
agcggctctccctgtgacggccttt

SEQ ID NO: 13396 - DNA, 25 bp, Homo sapien
ggaccttcccaccatcgtcatcgtg

SEQ ID NO: 13397 - DNA, 25 bp, Homo sapien
atcgtggcccactacgacgcctttg

SEQ ID NO: 13398 - DNA, 25 bp, Homo sapien
tgactgtggccttgcctctcccgtc

SEQ ID NO: 13399 - DNA, 25 bp, Homo sapien
ggctctacacctacaagcgcacgca

SEQ ID NO: 13400 - DNA, 25 bp, Homo sapien
ggcacgcctcttctcccggctctac

SEQ ID NO: 13401 - DNA, 25 bp, Homo sapien
tgctggagctggcacgcctcttctc

SEQ ID NO: 13402 - DNA, 25 bp, Homo sapien
cggcgtctctgtgctgctggagctg

SEQ ID NO: 13403 - DNA, 25 bp, Homo sapien
tccaacgggagcggcgtctctgtgc

SEQ ID NO: 13404 - DNA, 25 bp, Homo sapien
tctcccgtccctgtagtggctgtcg

SEQ ID NO: 13405 - DNA, 25 bp, Homo sapien
ccgtccctgtagtggctgtcgctgg

SEQ ID NO: 13406 - DNA, 25 bp, Homo sapien
ctgagccactggtcgcaactgcaga

SEQ ID NO: 13407 - DNA, 25 bp, Homo sapien
tgtcccacctggagagccaccgtga

SEQ ID NO: 13408 - DNA, 25 bp, Homo sapien
tcgcaactgcagaggccatgagagc

SEQ ID NO: 13409 - DNA, 25 bp, Homo sapien
cagcagcatcatggacgtgcggtga

SEQ ID NO: 13410 - DNA, 25 bp, Homo sapien
tgcacaagcggatcaacctggcgga

SEQ ID NO: 13411 - DNA, 25 bp, Homo sapien
aggtacggttctccatggtgcacaa

SEQ ID NO: 13412 - DNA, 25 bp, Homo sapien
cgcaccagttccctgaggtacggtt

SEQ ID NO: 13413 - DNA, 25 bp, Homo sapien
cctgggagcacgagcgcttcgccat

SEQ ID NO: 13414 - DNA, 25 bp, Homo sapien
tgcacgattaaagaggagacgccgg

SEQ ID NO: 13415 - DNA, 25 bp, Homo sapien
gccctcggtctggtgtaagcacaca

SEQ ID NO: 13416 - DNA, 25 bp, Homo sapien
ctcggtctggtgtaagcacacatgc

SEQ ID NO: 13417 - DNA, 25 bp, Homo sapien
tggtgtaagcacacatgcacgatta

SEQ ID NO: 13418 - DNA, 25 bp, Homo sapien
agcacacatgcacgattaaagagga

SEQ ID NO: 13419 - DNA, 25 bp, Homo sapien
catgcacgattaaagaggagacgcc

SEQ ID NO: 13420 - DNA, 25 bp, Homo sapien
ccaggctacggacttgcggacgagc

SEQ ID NO: 13421 - DNA, 25 bp, Homo sapien
aggctacggacttgcggacgagccc

SEQ ID NO: 13422 - DNA, 25 bp, Homo sapien
cgtaacgttggtgttcatgtcgctg

SEQ ID NO: 13423 - DNA, 25 bp, Homo sapien
ctggtgttcgtaacgttggtgttca

SEQ ID NO: 13424 - DNA, 25 bp, Homo sapien
ctggtgttcatgacgctggtgttca

SEQ ID NO: 13425 - DNA, 25 bp, Homo sapien
gtaacgctggtgttcatgtccctgg

SEQ ID NO: 13426 - DNA, 25 bp, Homo sapien
tgtgtccctgttgttcatgacaatg

SEQ ID NO: 13427 - DNA, 25 bp, Homo sapien
atgacgctggtgttcatgtccctgg

SEQ ID NO: 13428 - DNA, 25 bp, Homo sapien
cgtaacgctggtgttcatgtccctg

SEQ ID NO: 13429 - DNA, 25 bp, Homo sapien
ctggtgttcatgtccctggtgttca

SEQ ID NO: 13430 - DNA, 25 bp, Homo sapien
acgagctcacggtgctcaaagaccc

SEQ ID NO: 13431 - DNA, 25 bp, Homo sapien
ggcatgaaggacctggacgccatca

SEQ ID NO: 13432 - DNA, 25 bp, Homo sapien
tgaaggacctggacgccatcaaact

SEQ ID NO: 13433 - DNA, 25 bp, Homo sapien
gcagcccgacggcatgaaggacctg

SEQ ID NO: 13434 - DNA, 25 bp, Homo sapien
atctacgagctcacggtgctcaaag

SEQ ID NO: 13435 - DNA, 25 bp, Homo sapien
gacctggacgccatcaaactcttcg

SEQ ID NO: 13436 - DNA, 25 bp, Homo sapien
ggacgccatcaaactcttcgtgggc

SEQ ID NO: 13437 - DNA, 25 bp, Homo sapien
ccctacacggggatgcacaaaggtg

SEQ ID NO: 13438 - DNA, 25 bp, Homo sapien
gattccgcgtgtgacgcaccagctc

SEQ ID NO: 13439 - DNA, 25 bp, Homo sapien
gagattccgcgtgtgacgcaccagc

SEQ ID NO: 13440 - DNA, 25 bp, Homo sapien
tgtgacgcaccagctccagggagaa

SEQ ID NO: 13441 - DNA, 25 bp, Homo sapien
gaccgcgggagcagttggcacccct

SEQ ID NO: 13442 - DNA, 25 bp, Homo sapien
ggaaggactcctgccggggtgctgt

SEQ ID NO: 13443 - DNA, 25 bp, Homo sapien
ggggtgctgtgtggcttcaagctga

SEQ ID NO: 13444 - DNA, 25 bp, Homo sapien
gtgagattccgcgtgtgacgcacca

SEQ ID NO: 13445 - DNA, 25 bp, Homo sapien
gcgtgtgacgcaccagctccaggga

SEQ ID NO: 13446 - DNA, 25 bp, Homo sapien
tgggtcctccctcgcacgcgcagaa

SEQ ID NO: 13447 - DNA, 25 bp, Homo sapien
ggtcattgacgagtgcaccgtgctc

SEQ ID NO: 13448 - DNA, 25 bp, Homo sapien
cttcggggtcattgacgagtgcacc

SEQ ID NO: 13449 - DNA, 25 bp, Homo sapien
cagcccttcggggtcattgacgagt

SEQ ID NO: 13450 - DNA, 25 bp, Homo sapien
atgctgaacaagcagcagtcggagg

SEQ ID NO: 13451 - DNA, 25 bp, Homo sapien
tggggatgctgaacaagcagcagtc

SEQ ID NO: 13452 - DNA, 25 bp, Homo sapien
attgacgagtgcaccgtgctccggg

SEQ ID NO: 13453 - DNA, 25 bp, Homo sapien
ctgttcgtggggatgctgaacaagc

SEQ ID NO: 13454 - DNA, 25 bp, Homo sapien
catgatcacacccactcctgccttg

SEQ ID NO: 13455 - DNA, 25 bp, Homo sapien
gccatcacgcccatcgcgcacagcg

SEQ ID NO: 13456 - DNA, 25 bp, Homo sapien
gctggacaggccagagttgagtccc

SEQ ID NO: 13457 - DNA, 25 bp, Homo sapien
caggccagagttgagtcccggtgca

SEQ ID NO: 13458 - DNA, 25 bp, Homo sapien
tgcagccgctgacccctgggaatct

SEQ ID NO: 13459 - DNA, 25 bp, Homo sapien
cccgtaggaatagcagtgacttcct

SEQ ID NO: 13460 - DNA, 25 bp, Homo sapien
aggaatagcagtgacttcctaccag

SEQ ID NO: 13461 - DNA, 25 bp, Homo sapien
cccgtttcgtctgtgatcttggccc

SEQ ID NO: 13462 - DNA, 25 bp, Homo sapien
cagtcgtgctagtcctggaacgtga

SEQ ID NO: 13463 - DNA, 25 bp, Homo sapien
tcgtgccatccgttccgtcgtttct

SEQ ID NO: 13464 - DNA, 25 bp, Homo sapien
tgcccgagatccagtggtggtttga

SEQ ID NO: 13465 - DNA, 25 bp, Homo sapien
ttgaagggcagggtcccaacgacac

SEQ ID NO: 13466 - DNA, 25 bp, Homo sapien
tcgacacgctcgtggaggaggacac

SEQ ID NO: 13467 - DNA, 25 bp, Homo sapien
gcacttacgagtgccgggccagcaa

SEQ ID NO: 13468 - DNA, 25 bp, Homo sapien
ccagggtcaagtgggtccgcgccca

SEQ ID NO: 13469 - DNA, 25 bp, Homo sapien
gggccagcaacgacccggatcgcaa

SEQ ID NO: 13470 - DNA, 25 bp, Homo sapien
cagccgccctgaggctgtaggcatg

SEQ ID NO: 13471 - DNA, 25 bp, Homo sapien
gagctttgataacccggccagcgcc

SEQ ID NO: 13472 - DNA, 25 bp, Homo sapien
ctggtttctgcaggcttcgtgagct

SEQ ID NO: 13473 - DNA, 25 bp, Homo sapien
accctggtttctgcaggcttcgtga

SEQ ID NO: 13474 - DNA, 25 bp, Homo sapien
gaggtccaccctggtttctgcaggc

SEQ ID NO: 13475 - DNA, 25 bp, Homo sapien
ccacggaggtccaccctggtttctg

SEQ ID NO: 13476 - DNA, 25 bp, Homo sapien
aggacacccgcagcgccaaccacgg

SEQ ID NO: 13477 - DNA, 25 bp, Homo sapien
ccctgaggctgtaggcatggcccag

SEQ ID NO: 13478 - DNA, 25 bp, Homo sapien
tccgggcgaaagttgcaagatctgg

SEQ ID NO: 13479 - DNA, 25 bp, Homo sapien
tcgccgcacccactttcgttttcgc

SEQ ID NO: 13480 - DNA, 25 bp, Homo sapien
gctccgggcgaaagttgcaagatct

SEQ ID NO: 13481 - DNA, 25 bp, Homo sapien
cgccgggcgccttgaacttggagcc

SEQ ID NO: 13482 - DNA, 25 bp, Homo sapien
ccagctagcggaaaatggccgctgc

SEQ ID NO: 13483 - DNA, 25 bp, Homo sapien
cgccagctagcggaaaatggccgct

SEQ ID NO: 13484 - DNA, 25 bp, Homo sapien
cccactcgccagtcgccacgggacc

SEQ ID NO: 13485 - DNA, 25 bp, Homo sapien
agcagcgccatggtacgtcgccgca

SEQ ID NO: 13486 - DNA, 25 bp, Homo sapien
cgctgcatcgattctggattctgga

SEQ ID NO: 13487 - DNA, 25 bp, Homo sapien
ggcttggtctgcagatttgcgtccc

SEQ ID NO: 13488 - DNA, 25 bp, Homo sapien
actctcgggacctctcccggatgtg

SEQ ID NO: 13489 - DNA, 25 bp, Homo sapien
cccgcctgcctctgagaggaatcta

SEQ ID NO: 13490 - DNA, 25 bp, Homo sapien
gaaagggacctctcatgtgttttcc

SEQ ID NO: 13491 - DNA, 25 bp, Homo sapien
ctcggtcgcctttccctcgttattg

SEQ ID NO: 13492 - DNA, 25 bp, Homo sapien
accgtcccggtattttcgctgcatc

SEQ ID NO: 13493 - DNA, 25 bp, Homo sapien
cgttattggcccacgtgtgcatgga

SEQ ID NO: 13494 - DNA, 25 bp, Homo sapien
ggctcagcggtgactcaagcgcttt

SEQ ID NO: 13495 - DNA, 25 bp, Homo sapien
gggtccctgtctcattcgttcgttg

SEQ ID NO: 13496 - DNA, 25 bp, Homo sapien
tgactcaagcgctttttcactttta

SEQ ID NO: 13497 - DNA, 25 bp, Homo sapien
tcttaagaggaactgtgtggagccc

SEQ ID NO: 13498 - DNA, 25 bp, Homo sapien
tggctcccataaatcctgccggcgg

SEQ ID NO: 13499 - DNA, 25 bp, Homo sapien
gacccggatccttctcgggagccga

SEQ ID NO: 13500 - DNA, 25 bp, Homo sapien
gtttccttcattcgttcgtcccatg

SEQ ID NO: 13501 - DNA, 25 bp, Homo sapien
cctcttggccgcagcgtggcggatt

SEQ ID NO: 13502 - DNA, 25 bp, Homo sapien
acctggtcatggtcatcctgttcaa

SEQ ID NO: 13503 - DNA, 25 bp, Homo sapien
cctacttcgtgcgtgagcgaggtga

SEQ ID NO: 13504 - DNA, 25 bp, Homo sapien
agccgcaccacattggcgtggccgt

SEQ ID NO: 13505 - DNA, 25 bp, Homo sapien
aagatgcggcgcatcgactgtctcc

SEQ ID NO: 13506 - DNA, 25 bp, Homo sapien
ctgttcaagggcatcccgctggaga

SEQ ID NO: 13507 - DNA, 25 bp, Homo sapien
actgtctccggcaggcggacaaggt

SEQ ID NO: 13508 - DNA, 25 bp, Homo sapien
cactctgcgggtctgttcagggccc

SEQ ID NO: 13509 - DNA, 25 bp, Homo sapien
ggacctctacctggcctacttcgtg

SEQ ID NO: 13510 - DNA, 25 bp, Homo sapien
tcctctgtcaagtggagatcggcgc

SEQ ID NO: 13511 - DNA, 25 bp, Homo sapien
gcgatgggcatatctgtggcttatt

SEQ ID NO: 13512 - DNA, 25 bp, Homo sapien
ggcttattttcagcactgtcgcgca

SEQ ID NO: 13513 - DNA, 25 bp, Homo sapien
ggattacagcagcaccgcggatgtg

SEQ ID NO: 13514 - DNA, 25 bp, Homo sapien
agacgcttctgtgggttaggtccta

SEQ ID NO: 13515 - DNA, 25 bp, Homo sapien
gccgcgtcgaatacagccgtacaga

SEQ ID NO: 13516 - DNA, 25 bp, Homo sapien
ttgctcccgggcacttgttagaaga

SEQ ID NO: 13517 - DNA, 25 bp, Homo sapien
tgctcagtgcctagacgatggtggt

SEQ ID NO: 13518 - DNA, 25 bp, Homo sapien
gtcgtgccaagctcctgcagtccag

SEQ ID NO: 13519 - DNA, 25 bp, Homo sapien
ggcccgggaagctcatagcacgcca

SEQ ID NO: 13520 - DNA, 25 bp, Homo sapien
tgttcccgccttgcgtcgtgccaag

SEQ ID NO: 13521 - DNA, 25 bp, Homo sapien
cgccatgggccagcctcctgttccc

SEQ ID NO: 13522 - DNA, 25 bp, Homo sapien
tgcccatctgctgacgccgccatgg

SEQ ID NO: 13523 - DNA, 25 bp, Homo sapien
cgggaagctcatagcacgccagaga

SEQ ID NO: 13524 - DNA, 25 bp, Homo sapien
cttgcgtcgtgccaagctcctgcag

SEQ ID NO: 13525 - DNA, 25 bp, Homo sapien
ctcatagcacgccagagaggctgcc

SEQ ID NO: 13526 - DNA, 25 bp, Homo sapien
cggacccgggctgtaccctgtgaca

SEQ ID NO: 13527 - DNA, 25 bp, Homo sapien
agccggcccgcttacataaggggag

SEQ ID NO: 13528 - DNA, 25 bp, Homo sapien
cagacagcccgggacaggttgctgc

SEQ ID NO: 13529 - DNA, 25 bp, Homo sapien
tgtaaccagtttatgcaagggcagc

SEQ ID NO: 13530 - DNA, 25 bp, Homo sapien
ctgccggatggacaagcctgtgcct

SEQ ID NO: 13531 - DNA, 25 bp, Homo sapien
aattcataggcgagctgcggactcc

SEQ ID NO: 13532 - DNA, 25 bp, Homo sapien
accctgtgacagctccgggtggcta

SEQ ID NO: 13533 - DNA, 25 bp, Homo sapien
ccacgggcactggtgcgaattcata

SEQ ID NO: 13534 - DNA, 25 bp, Homo sapien
tcgcgttctcggatctctttggttc

SEQ ID NO: 13535 - DNA, 25 bp, Homo sapien
tctgagtcaccgtggcgggaactac

SEQ ID NO: 13536 - DNA, 25 bp, Homo sapien
gctcccgcgatgtctcgcgatacta

SEQ ID NO: 13537 - DNA, 25 bp, Homo sapien
ccataaggagcaagcggcacaaatc

SEQ ID NO: 13538 - DNA, 25 bp, Homo sapien
cccacgagtagcagccgcaactgga

SEQ ID NO: 13539 - DNA, 25 bp, Homo sapien
gaactacgtcttccggcagccactg

SEQ ID NO: 13540 - DNA, 25 bp, Homo sapien
ggaattgtagtcgtcccgagctgcg

SEQ ID NO: 13541 - DNA, 25 bp, Homo sapien
ccctggcggcgattactacacttcg

SEQ ID NO: 13542 - DNA, 25 bp, Homo sapien
aaagatcttgtctcgctggcctgcg

SEQ ID NO: 13543 - DNA, 25 bp, Homo sapien
cccgctcaaagatcttgtctcgctg

SEQ ID NO: 13544 - DNA, 25 bp, Homo sapien
cccaggacccgctcaaagatcttgt

SEQ ID NO: 13545 - DNA, 25 bp, Homo sapien
ggccatccgctacccacctcatctc

SEQ ID NO: 13546 - DNA, 25 bp, Homo sapien
tctgcatttccctacgacgtccatc

SEQ ID NO: 13547 - DNA, 25 bp, Homo sapien
agcccacacccgtcctccgctctgc

SEQ ID NO: 13548 - DNA, 25 bp, Homo sapien
actgtctccgcagggatcgcccgga

SEQ ID NO: 13549 - DNA, 25 bp, Homo sapien
gatcttgtctcgctggcctgcgacc

SEQ ID NO: 13550 - DNA, 25 bp, Homo sapien
cgggctttgagtgacaccagcaagc

SEQ ID NO: 13551 - DNA, 25 bp, Homo sapien
gaaaaacgcggagaacctgctgtta

SEQ ID NO: 13552 - DNA, 25 bp, Homo sapien
ccagttaaatggaagtggtcagctc

SEQ ID NO: 13553 - DNA, 25 bp, Homo sapien
gtggtcagctcaaaatgcccagcca

SEQ ID NO: 13554 - DNA, 25 bp, Homo sapien
cagccactgcctttctgctcagatg

SEQ ID NO: 13555 - DNA, 25 bp, Homo sapien
ttctgctcagatgctggcacctccg

SEQ ID NO: 13556 - DNA, 25 bp, Homo sapien
cctcgccttgtaagcacgcgggaag

SEQ ID NO: 13557 - DNA, 25 bp, Homo sapien
gcgtgctcgcagtgaattaggaaaa

SEQ ID NO: 13558 - DNA, 25 bp, Homo sapien
gcaggcttgatccaggcggaagtta

SEQ ID NO: 13559 - DNA, 25 bp, Homo sapien
gcctgtggtccgtgagaacaaaaga

SEQ ID NO: 13560 - DNA, 25 bp, Homo sapien
agccggcacagtcttcactaccgta

SEQ ID NO: 13561 - DNA, 25 bp, Homo sapien
tcactaccgtagaagaccttggctc

SEQ ID NO: 13562 - DNA, 25 bp, Homo sapien
ttggctccaagatactcctcacctg

SEQ ID NO: 13563 - DNA, 25 bp, Homo sapien
gctccttgaatgacagcgccacaga

SEQ ID NO: 13564 - DNA, 25 bp, Homo sapien
aagtgagtgcctgaccacgccatgc

SEQ ID NO: 13565 - DNA, 25 bp, Homo sapien
ctgcccggccagaaaacggagttca

SEQ ID NO: 13566 - DNA, 25 bp, Homo sapien
ccacctgggcgatctcagccgtgac

SEQ ID NO: 13567 - DNA, 25 bp, Homo sapien
gcagcctactctccgcccgacacgt

SEQ ID NO: 13568 - DNA, 25 bp, Homo sapien
gctgcccaccctgaataattcacgg

SEQ ID NO: 13569 - DNA, 25 bp, Homo sapien
cctgaataattcacgggcggttttg

SEQ ID NO: 13570 - DNA, 25 bp, Homo sapien
cacgggcggttttgtgaattacaga

SEQ ID NO: 13571 - DNA, 25 bp, Homo sapien
gtgaattacagagccatcctgcctt

SEQ ID NO: 13572 - DNA, 25 bp, Homo sapien
tcgctaacgggctctcggtctctct

SEQ ID NO: 13573 - DNA, 25 bp, Homo sapien
ctcccaaggaccttgggcctttcag

SEQ ID NO: 13574 - DNA, 25 bp, Homo sapien
tcgctggggactctttcagccctcg

SEQ ID NO: 13575 - DNA, 25 bp, Homo sapien
agtgccttacattctggagcgaccc

SEQ ID NO: 13576 - DNA, 25 bp, Homo sapien
ctgggcgtcacttcgcaagcgtcct

SEQ ID NO: 13577 - DNA, 25 bp, Homo sapien
tgtccagctgggacacggaatggcc

SEQ ID NO: 13578 - DNA, 25 bp, Homo sapien
cgagtggtttaagtgcctgattacc

SEQ ID NO: 13579 - DNA, 25 bp, Homo sapien
ggagggacccacattgcacacactg

SEQ ID NO: 13580 - DNA, 25 bp, Homo sapien
cccgtttgggaggagaagtctctat

SEQ ID NO: 13581 - DNA, 25 bp, Homo sapien
ggaccgccgtttgcactttcatcgc

SEQ ID NO: 13582 - DNA, 25 bp, Homo sapien
ccattggggtgtccggaagcttctc

SEQ ID NO: 13583 - DNA, 25 bp, Homo sapien
ggcagactatccctggctctatctc

SEQ ID NO: 13584 - DNA, 25 bp, Homo sapien
gcatggcagactatccctggctcta

SEQ ID NO: 13585 - DNA, 25 bp, Homo sapien
ggcgctgacacacatgcatggcaga

SEQ ID NO: 13586 - DNA, 25 bp, Homo sapien
aactttgcatggtgcttagtcaagg

SEQ ID NO: 13587 - DNA, 25 bp, Homo sapien
gcgacgagaaccaactctttaccta

SEQ ID NO: 13588 - DNA, 25 bp, Homo sapien
gggcgcgacgagaaccaactcttta

SEQ ID NO: 13589 - DNA, 25 bp, Homo sapien
ctctttacctaactttgcatggtgc

SEQ ID NO: 13590 - DNA, 25 bp, Homo sapien
aggctctcctgtcctcaaccttggt

SEQ ID NO: 13591 - DNA, 25 bp, Homo sapien
cctctcttccggaggtctgcggatg

SEQ ID NO: 13592 - DNA, 25 bp, Homo sapien
tgctgagtcgctgtcacttcctctc

SEQ ID NO: 13593 - DNA, 25 bp, Homo sapien
cggcgtcatcgcacaggtgtttatg

SEQ ID NO: 13594 - DNA, 25 bp, Homo sapien
agctgacacgggagcagccatggcc

SEQ ID NO: 13595 - DNA, 25 bp, Homo sapien
tggtccctcggctgattagatagtg

SEQ ID NO: 13596 - DNA, 25 bp, Homo sapien
ccgggagcgttgatgactcaggctc

SEQ ID NO: 13597 - DNA, 25 bp, Homo sapien
gctgattagatagtgggccctgccc

SEQ ID NO: 13598 - DNA, 25 bp, Homo sapien
tcttgaaatgtgacgggaagtccga

SEQ ID NO: 13599 - DNA, 25 bp, Homo sapien
ggaagtccgaggcatcacgaagtcg

SEQ ID NO: 13600 - DNA, 25 bp, Homo sapien
ctctctgtcgggagaatgcggccac

SEQ ID NO: 13601 - DNA, 25 bp, Homo sapien
ggtgcgttcacagcgggagaaaccc

SEQ ID NO: 13602 - DNA, 25 bp, Homo sapien
cggaggacacacgtgccctacgcgg

SEQ ID NO: 13603 - DNA, 25 bp, Homo sapien
ggcgtggacaagtttgcctcccaga

SEQ ID NO: 13604 - DNA, 25 bp, Homo sapien
agaagtttcccagacggcacccgcg

SEQ ID NO: 13605 - DNA, 25 bp, Homo sapien
ccgggatcccgcagtcttgaaatgt

SEQ ID NO: 13606 - DNA, 25 bp, Homo sapien
ggcttcgggccaaacgcccagtctg

SEQ ID NO: 13607 - DNA, 25 bp, Homo sapien
cgtatgtgaaagtcgccagcgtcca

SEQ ID NO: 13608 - DNA, 25 bp, Homo sapien
caggattcaagttgccatcagcttc

SEQ ID NO: 13609 - DNA, 25 bp, Homo sapien
tctgtctacacgaccgccaaagcgt

SEQ ID NO: 13610 - DNA, 25 bp, Homo sapien
cggcgcgcgtaagttctgtctacac

SEQ ID NO: 13611 - DNA, 25 bp, Homo sapien
aaggagaaagccgtccgctgcgacc

SEQ ID NO: 13612 - DNA, 25 bp, Homo sapien
cgaggtctttgatgaggtgcccgac

SEQ ID NO: 13613 - DNA, 25 bp, Homo sapien
ctcagctaggagaagcactaggatc

SEQ ID NO: 13614 - DNA, 25 bp, Homo sapien
cagggagtcacagcacaacggcagc

SEQ ID NO: 13615 - DNA, 25 bp, Homo sapien
cgcttgcacgggttcttaagaggcc

SEQ ID NO: 13616 - DNA, 25 bp, Homo sapien
cctggggtgttctaccttgaagaca

SEQ ID NO: 13617 - DNA, 25 bp, Homo sapien
aggtcacaaagtcctggcgatcttc

SEQ ID NO: 13618 - DNA, 25 bp, Homo sapien
aaggggagctctgtcttttcgaaga

SEQ ID NO: 13619 - DNA, 25 bp, Homo sapien
ccggtctcgtgctcatacatgtcca

SEQ ID NO: 13620 - DNA, 25 bp, Homo sapien
acccggtttagacgccaaagctctg

SEQ ID NO: 13621 - DNA, 25 bp, Homo sapien
tgcgcccagcaagacacaagcgatg

SEQ ID NO: 13622 - DNA, 25 bp, Homo sapien
cagtcaacgaatccctgagaccgga

SEQ ID NO: 13623 - DNA, 25 bp, Homo sapien
acagtattcctagtgcgttcttcgg

SEQ ID NO: 13624 - DNA, 25 bp, Homo sapien
gtgccacagctcatgcaaacgcagg

SEQ ID NO: 13625 - DNA, 25 bp, Homo sapien
gacctagtgagaggctccgtgcatg

SEQ ID NO: 13626 - DNA, 25 bp, Homo sapien
acggcaccaacgcagccgcgggtga

SEQ ID NO: 13627 - DNA, 25 bp, Homo sapien
agctctggagactcaggacccgtcg

SEQ ID NO: 13628 - DNA, 25 bp, Homo sapien
tgagaccggattccctaacgaggcg

SEQ ID NO: 13629 - DNA, 25 bp, Homo sapien
ggacgcctcaccgagctctggagac

SEQ ID NO: 13630 - DNA, 25 bp, Homo sapien
agcatccgcgtctcccgagttaaca

SEQ ID NO: 13631 - DNA, 25 bp, Homo sapien
tgggtcccatctgcgctcattaggc

SEQ ID NO: 13632 - DNA, 25 bp, Homo sapien
aggcgcgacgtcaatgccgcactga

SEQ ID NO: 13633 - DNA, 25 bp, Homo sapien
tgtgcctggcttcgatctaccctag

SEQ ID NO: 13634 - DNA, 25 bp, Homo sapien
agccgcgcttcctgtattgatttga

SEQ ID NO: 13635 - DNA, 25 bp, Homo sapien
gagacgtcacgtcctcccgagatgc

SEQ ID NO: 13636 - DNA, 25 bp, Homo sapien
gagttaacacccaaatcccagcgtc

SEQ ID NO: 13637 - DNA, 25 bp, Homo sapien
agcgaccgccgccatattagggacc

SEQ ID NO: 13638 - DNA, 25 bp, Homo sapien
gaccaacgccaggacgggcacagtc

SEQ ID NO: 13639 - DNA, 25 bp, Homo sapien
ggccagacctgacaccggtgctctg

SEQ ID NO: 13640 - DNA, 25 bp, Homo sapien
tgcccatgccttccatcctagggga

SEQ ID NO: 13641 - DNA, 25 bp, Homo sapien
agccgcagggaagaagctgtccatg

SEQ ID NO: 13642 - DNA, 25 bp, Homo sapien
gctgtccatgttggagggccacacg

SEQ ID NO: 13643 - DNA, 25 bp, Homo sapien
tggcctggaatgctgagcagctgtc

SEQ ID NO: 13644 - DNA, 25 bp, Homo sapien
agggacgtgcattcgagagtcgtta

SEQ ID NO: 13645 - DNA, 25 bp, Homo sapien
acacaagggcttcgtgcagatctgg

SEQ ID NO: 13646 - DNA, 25 bp, Homo sapien
tgcaatctggcctggtccaagcacg

SEQ ID NO: 13647 - DNA, 25 bp, Homo sapien
gtgtatcgacacgggctcccaagtg

SEQ ID NO: 13648 - DNA, 25 bp, Homo sapien
gctcccaagtgtgcaatctggcctg

SEQ ID NO: 13649 - DNA, 25 bp, Homo sapien
caagtgtgcaatctggcctggtcca

SEQ ID NO: 13650 - DNA, 25 bp, Homo sapien
tggcctggtccaagcacgccaacga

SEQ ID NO: 13651 - DNA, 25 bp, Homo sapien
ctggtccaagcacgccaacgagctg

SEQ ID NO: 13652 - DNA, 25 bp, Homo sapien
tccaagcacgccaacgagctggtga

SEQ ID NO: 13653 - DNA, 25 bp, Homo sapien
cacgccaacgagctggtgagcacgg

SEQ ID NO: 13654 - DNA, 25 bp, Homo sapien
tgctggtcaccatcatcttcatcta

SEQ ID NO: 13655 - DNA, 25 bp, Homo sapien
ttcatctacgagaagcgccggaagc

SEQ ID NO: 13656 - DNA, 25 bp, Homo sapien
tgcaacggcaccagctccaagggct

SEQ ID NO: 13657 - DNA, 25 bp, Homo sapien
agaacctgaacatggaggccgaccc

SEQ ID NO: 13658 - DNA, 25 bp, Homo sapien
agggccggtcagagctacacattga

SEQ ID NO: 13659 - DNA, 25 bp, Homo sapien
ttcttcgtgagttcctcgcagggcc

SEQ ID NO: 13660 - DNA, 25 bp, Homo sapien
ccgagagcaggttcttcgtgagttc

SEQ ID NO: 13661 - DNA, 25 bp, Homo sapien
ccttcctgggcatcgtggctgaggt

SEQ ID NO: 13662 - DNA, 25 bp, Homo sapien
agccctaccgtgtggggaccgatga

SEQ ID NO: 13663 - DNA, 25 bp, Homo sapien
cacagccgctgcgtacacggccaca

SEQ ID NO: 13664 - DNA, 25 bp, Homo sapien
accgatgaggtcggccgtcatggcc

SEQ ID NO: 13665 - DNA, 25 bp, Homo sapien
cgtacacgaacgctccgctgttctg

SEQ ID NO: 13666 - DNA, 25 bp, Homo sapien
cgaacgctccgctgttctgtggaga

SEQ ID NO: 13667 - DNA, 25 bp, Homo sapien
tccgctgttctgtggagacacaggc

SEQ ID NO: 13668 - DNA, 25 bp, Homo sapien
ggctaccagccctaccgtgtgggga

SEQ ID NO: 13669 - DNA, 25 bp, Homo sapien
agcgtgcaccccgagatctaggacc

SEQ ID NO: 13670 - DNA, 25 bp, Homo sapien
gactcaacaagacgccaggaacctg

SEQ ID NO: 13671 - DNA, 25 bp, Homo sapien
tagacggtgatgttggccaccacgg

SEQ ID NO: 13672 - DNA, 25 bp, Homo sapien
tgatgtcttgggtgggctccacccg

SEQ ID NO: 13673 - DNA, 25 bp, Homo sapien
ccagctggtcgctgatgctgatgtc

SEQ ID NO: 13674 - DNA, 25 bp, Homo sapien
ggctcgaggacttcaggcgacccac

SEQ ID NO: 13675 - DNA, 25 bp, Homo sapien
tagcagtgagaacacggcgccgaca

SEQ ID NO: 13676 - DNA, 25 bp, Homo sapien
gcccaggtggaatagcagtgagaac

SEQ ID NO: 13677 - DNA, 25 bp, Homo sapien
gccaccacggtgaacgcatacctgg

SEQ ID NO: 13678 - DNA, 25 bp, Homo sapien
cctcgtagcccacgagcggtgtgca

SEQ ID NO: 13679 - DNA, 25 bp, Homo sapien
taggtgaaccacatggacgcgcaca

SEQ ID NO: 13680 - DNA, 25 bp, Homo sapien
cacaggtcgttgaggaagtggccca

SEQ ID NO: 13681 - DNA, 25 bp, Homo sapien
gggaaccgcagccaatcgccaagga

SEQ ID NO: 13682 - DNA, 25 bp, Homo sapien
cgcaccgagtgcaggtagagcagca

SEQ ID NO: 13683 - DNA, 25 bp, Homo sapien
atagtaccagctggcctttaacgag

SEQ ID NO: 13684 - DNA, 25 bp, Homo sapien
cggagaggacgcaacaacactaatt

SEQ ID NO: 13685 - DNA, 25 bp, Homo sapien
catagactggggaaggaaatggacc

SEQ ID NO: 13686 - DNA, 25 bp, Homo sapien
cccaggtgagacttgctgttgttcc

SEQ ID NO: 13687 - DNA, 25 bp, Homo sapien
ggaaagctgtctcccacagtcccgg

SEQ ID NO: 13688 - DNA, 25 bp, Homo sapien
tgctgttgttccgtgggctgaaaca

SEQ ID NO: 13689 - DNA, 25 bp, Homo sapien
ttccgcccaggtgagacttgctgtt

SEQ ID NO: 13690 - DNA, 25 bp, Homo sapien
ctgaaacaggccatgcgcctggctg

SEQ ID NO: 13691 - DNA, 25 bp, Homo sapien
ccctgtttctgggagcagacggaag

SEQ ID NO: 13692 - DNA, 25 bp, Homo sapien
gggccgaaagccacaggaaagctgt

SEQ ID NO: 13693 - DNA, 25 bp, Homo sapien
accagcaaatgaccacaaaccgggg

SEQ ID NO: 13694 - DNA, 25 bp, Homo sapien
atttgaattgcttgtggctccgccc

SEQ ID NO: 13695 - DNA, 25 bp, Homo sapien
cattttcctctggaagctgagaccc

SEQ ID NO: 13696 - DNA, 25 bp, Homo sapien
tgactgtcaagcaagagcgcggcga

SEQ ID NO: 13697 - DNA, 25 bp, Homo sapien
ctgaccgcggtatccttggctccag

SEQ ID NO: 13698 - DNA, 25 bp, Homo sapien
tcgggctcatgcactctcgctgcag

SEQ ID NO: 13699 - DNA, 25 bp, Homo sapien
agttcgcggtctgccatcgggcagc

SEQ ID NO: 13700 - DNA, 25 bp, Homo sapien
caacaaaggattcttggggcgcccg

SEQ ID NO: 13701 - DNA, 25 bp, Homo sapien
ggggcaatcgcccaacaaaggattc

SEQ ID NO: 13702 - DNA, 25 bp, Homo sapien
cccgcttactcgcttcctcccgcag

SEQ ID NO: 13703 - DNA, 25 bp, Homo sapien
ctgcgctggcggtgtccggacctct

SEQ ID NO: 13704 - DNA, 25 bp, Homo sapien
ttcccagaccacacccgagctccgc

SEQ ID NO: 13705 - DNA, 25 bp, Homo sapien
gctcgccacgccacgttcccattca

SEQ ID NO: 13706 - DNA, 25 bp, Homo sapien
tccgtccgtgactgtcctcagcgga

SEQ ID NO: 13707 - DNA, 25 bp, Homo sapien
tgactgtcctcagcggaccctggac

SEQ ID NO: 13708 - DNA, 25 bp, Homo sapien
cttaccttagcccaccctgcgccgc

SEQ ID NO: 13709 - DNA, 25 bp, Homo sapien
gctcaccgccagcttcgcctcactg

SEQ ID NO: 13710 - DNA, 25 bp, Homo sapien
ttacccgggcgtctcggctgtcgcg

SEQ ID NO: 13711 - DNA, 25 bp, Homo sapien
ggcgcccaagaccacccgcctgatg

SEQ ID NO: 13712 - DNA, 25 bp, Homo sapien
atcgcgcccaccgaggtaaggagcc

SEQ ID NO: 13713 - DNA, 25 bp, Homo sapien
gtacgccaagatcgccgaagccttc

SEQ ID NO: 13714 - DNA, 25 bp, Homo sapien
cgtccgcgagctgtacgccaagatc

SEQ ID NO: 13715 - DNA, 25 bp, Homo sapien
gcttcaccaacgtccgcgagctgta

SEQ ID NO: 13716 - DNA, 25 bp, Homo sapien
agatcgagggcttcaccaacgtccg

SEQ ID NO: 13717 - DNA, 25 bp, Homo sapien
cccacgggcaagatcgagggcttca

SEQ ID NO: 13718 - DNA, 25 bp, Homo sapien
tgccgccactacgaggtggccaaga

SEQ ID NO: 13719 - DNA, 25 bp, Homo sapien
gaagccatcaacgaccactccattg

SEQ ID NO: 13720 - DNA, 25 bp, Homo sapien
cgtgggtgacagcatcgaagccatc

SEQ ID NO: 13721 - DNA, 25 bp, Homo sapien
tcatcaaccggatcgaggcagtgtg

SEQ ID NO: 13722 - DNA, 25 bp, Homo sapien
tcaaggaaggcagtatcatcaaccg

SEQ ID NO: 13723 - DNA, 25 bp, Homo sapien
ctggaaggttctaggtgcacccgct

SEQ ID NO: 13724 - DNA, 25 bp, Homo sapien
ccgaagtgcgttctacggatgcctg

SEQ ID NO: 13725 - DNA, 25 bp, Homo sapien
agcgacgctggatccctgcagagaa

SEQ ID NO: 13726 - DNA, 25 bp, Homo sapien
actgtctgggcgatgaagacctgca

SEQ ID NO: 13727 - DNA, 25 bp, Homo sapien
cgcgcaagtagatgagcagctcctt

SEQ ID NO: 13728 - DNA, 25 bp, Homo sapien
tccaggtggccacgcgcaagtagat

SEQ ID NO: 13729 - DNA, 25 bp, Homo sapien
aacaggatatacacccaggggtcca

SEQ ID NO: 13730 - DNA, 25 bp, Homo sapien
gcgcggcggaacaggatatacaccc

SEQ ID NO: 13731 - DNA, 25 bp, Homo sapien
gcaggcgggtttcgcagcactgtct

SEQ ID NO: 13732 - DNA, 25 bp, Homo sapien
acctgcaaaggggagagctgtcagc

SEQ ID NO: 13733 - DNA, 25 bp, Homo sapien
agctccttctccgtggtgcgggaca

SEQ ID NO: 13734 - DNA, 25 bp, Homo sapien
ctgggacaccacgatggtaccggtc

SEQ ID NO: 13735 - DNA, 25 bp, Homo sapien
tcctgcccgtggtagacgtggcaca

SEQ ID NO: 13736 - DNA, 25 bp, Homo sapien
ctgaccgtgttcagcaggaaggaca

SEQ ID NO: 13737 - DNA, 25 bp, Homo sapien
gaagagcagcccgaaggccacgtcc

SEQ ID NO: 13738 - DNA, 25 bp, Homo sapien
gtattgcacggtgtagcgacccacg

SEQ ID NO: 13739 - DNA, 25 bp, Homo sapien
ccgggtgatacccaggtagcgctct

SEQ ID NO: 13740 - DNA, 25 bp, Homo sapien
ccgaagaagatcatgacgacgccca

SEQ ID NO: 13741 - DNA, 25 bp, Homo sapien
cccatgaagcgacagagacggcagc

SEQ ID NO: 13742 - DNA, 25 bp, Homo sapien
gggacaccctacagccttctgggga

SEQ ID NO: 13743 - DNA, 25 bp, Homo sapien
gctccaaattcactgggtgcgctgg

SEQ ID NO: 13744 - DNA, 25 bp, Homo sapien
caggcccgcattattcaccatctgg

SEQ ID NO: 13745 - DNA, 25 bp, Homo sapien
ttcagagacctcatctgcggggctc

SEQ ID NO: 13746 - DNA, 25 bp, Homo sapien
cccagcagaggacccacacagatgg

SEQ ID NO: 13747 - DNA, 25 bp, Homo sapien
aactgagtcagtctggctgtgacca

SEQ ID NO: 13748 - DNA, 25 bp, Homo sapien
ggggcgacctcaccttcagagacct

SEQ ID NO: 13749 - DNA, 25 bp, Homo sapien
ttattcaccatctgggcagcaccca

SEQ ID NO: 13750 - DNA, 25 bp, Homo sapien
tgccctcagcatttagtgtcctcgt

SEQ ID NO: 13751 - DNA, 25 bp, Homo sapien
gtagctttgtacacctgccctcagc

SEQ ID NO: 13752 - DNA, 25 bp, Homo sapien
accgccaggtcatgagatgagatta

SEQ ID NO: 13753 - DNA, 25 bp, Homo sapien
agtgtcctcgttcatccaacaagca

SEQ ID NO: 13754 - DNA, 25 bp, Homo sapien
catctaataagcactggggtacgca

SEQ ID NO: 13755 - DNA, 25 bp, Homo sapien
tgctcttggtggcaactcgctgaag

SEQ ID NO: 13756 - DNA, 25 bp, Homo sapien
gtatcaggaaaaggcctcagggctc

SEQ ID NO: 13757 - DNA, 25 bp, Homo sapien
gattagatcatccttgccaagtatc

SEQ ID NO: 13758 - DNA, 25 bp, Homo sapien
tgcaggtcctcatccggttccagca

SEQ ID NO: 13759 - DNA, 25 bp, Homo sapien
cttgttccactcgaagcccgtgtgc

SEQ ID NO: 13760 - DNA, 25 bp, Homo sapien
tgagtggcatctccacgctgaactg

SEQ ID NO: 13761 - DNA, 25 bp, Homo sapien
cggaagaagatgtcctcggcgctct

SEQ ID NO: 13762 - DNA, 25 bp, Homo sapien
ttcatgtctatcgtcctcctgggtg

SEQ ID NO: 13763 - DNA, 25 bp, Homo sapien
gcccaggggttttctgaagccagta

SEQ ID NO: 13764 - DNA, 25 bp, Homo sapien
tgacggaatgcacgctcagagaccc

SEQ ID NO: 13765 - DNA, 25 bp, Homo sapien
cagcggccggtaaaagcttccacca

SEQ ID NO: 13766 - DNA, 25 bp, Homo sapien
tgagaggacccatctcttgagtgcc

SEQ ID NO: 13767 - DNA, 25 bp, Homo sapien
ttctcctcgggcgtctcgaaggcct

SEQ ID NO: 13768 - DNA, 25 bp, Homo sapien
atgctgaggagctaggagaccacga

SEQ ID NO: 13769 - DNA, 25 bp, Homo sapien
tccgactgagaggacccatctcttg

SEQ ID NO: 13770 - DNA, 25 bp, Homo sapien
ggacccatctcttgagtgccacttg

SEQ ID NO: 13771 - DNA, 25 bp, Homo sapien
tctcttgagtgccacttgggccgcg

SEQ ID NO: 13772 - DNA, 25 bp, Homo sapien
ggggctccggcttcgcatccctgag

SEQ ID NO: 13773 - DNA, 25 bp, Homo sapien
ctcctctcctgagtccgactgagag

SEQ ID NO: 13774 - DNA, 25 bp, Homo sapien
ccctgtgtcctggtcgttctatagg

SEQ ID NO: 13775 - DNA, 25 bp, Homo sapien
ttctataggacacttgccgtgggcc

SEQ ID NO: 13776 - DNA, 25 bp, Homo sapien
gccaggcgtagcacctttggagagc

SEQ ID NO: 13777 - DNA, 25 bp, Homo sapien
gaagttggtccgagctaccctgcct

SEQ ID NO: 13778 - DNA, 25 bp, Homo sapien
ccaacagatggtcataggcccggtc

SEQ ID NO: 13779 - DNA, 25 bp, Homo sapien
agcgacggcttcaaggttacctgcg

SEQ ID NO: 13780 - DNA, 25 bp, Homo sapien
tgaggctttcgagagacgtctgctt

SEQ ID NO: 13781 - DNA, 25 bp, Homo sapien
agcggtcacctcctcgaagttggtc

SEQ ID NO: 13782 - DNA, 25 bp, Homo sapien
gtggccgcggcaccaacaccaatag

SEQ ID NO: 13783 - DNA, 25 bp, Homo sapien
cctgccgaggcgagaccaataagaa

SEQ ID NO: 13784 - DNA, 25 bp, Homo sapien
gactccagtgggattgttgcctcca

SEQ ID NO: 13785 - DNA, 25 bp, Homo sapien
tctgcaaatgtggaccgcgtgattg

SEQ ID NO: 13786 - DNA, 25 bp, Homo sapien
agactttccactacgtctgcaaatg

SEQ ID NO: 13787 - DNA, 25 bp, Homo sapien
ctgagccgggaaagagcaacccatc

SEQ ID NO: 13788 - DNA, 25 bp, Homo sapien
acaccaatagccgaagcctgcgctg

SEQ ID NO: 13789 - DNA, 25 bp, Homo sapien
tctaggtcggaagtagcgcttcatt

SEQ ID NO: 13790 - DNA, 25 bp, Homo sapien
ttcgacgtgggaccgaatgacattc

SEQ ID NO: 13791 - DNA, 25 bp, Homo sapien
tgacattcccagtgacgcatgcagc

SEQ ID NO: 13792 - DNA, 25 bp, Homo sapien
ccgtgatttacccaaagcccttctg

SEQ ID NO: 13793 - DNA, 25 bp, Homo sapien
cagtacctcccatccgtgaactgga

SEQ ID NO: 13794 - DNA, 25 bp, Homo sapien
ccttctggaaaacaactgacgtcag

SEQ ID NO: 13795 - DNA, 25 bp, Homo sapien
cgtcagacactgagcttccggccgg

SEQ ID NO: 13796 - DNA, 25 bp, Homo sapien
gcggggagagtaaatccagtacctc

SEQ ID NO: 13797 - DNA, 25 bp, Homo sapien
ctgacctcaattgcagccgtgattt

SEQ ID NO: 13798 - DNA, 25 bp, Homo sapien
gagggtaccatcagcatcccgcaga

SEQ ID NO: 13799 - DNA, 25 bp, Homo sapien
aggccgagggtaccatcagcatccc

SEQ ID NO: 13800 - DNA, 25 bp, Homo sapien
ttcacagcggggatcccgcccatcc

SEQ ID NO: 13801 - DNA, 25 bp, Homo sapien
cccgcggccgttcacagcggggatc

SEQ ID NO: 13802 - DNA, 25 bp, Homo sapien
gcacccacctgtaggactgcaggat

SEQ ID NO: 13803 - DNA, 25 bp, Homo sapien
gatgtcgatgatgccaatgtgcagc

SEQ ID NO: 13804 - DNA, 25 bp, Homo sapien
taccatcagcatcccgcagagctgg

SEQ ID NO: 13805 - DNA, 25 bp, Homo sapien
cggggcgtccacctgtaggactgca

SEQ ID NO: 13806 - DNA, 25 bp, Homo sapien
cgccacaggctggtacgctcacctg

SEQ ID NO: 13807 - DNA, 25 bp, Homo sapien
tgcccagcgcggttagtgaggccac

SEQ ID NO: 13808 - DNA, 25 bp, Homo sapien
gccaggccagcgaagaccctacaaa

SEQ ID NO: 13809 - DNA, 25 bp, Homo sapien
cctgcacgctctgctcacgccacag

SEQ ID NO: 13810 - DNA, 25 bp, Homo sapien
cagcagtcatcctgaagccactggg

SEQ ID NO: 13811 - DNA, 25 bp, Homo sapien
ggccacacgtgcagcagtcatcctg

SEQ ID NO: 13812 - DNA, 25 bp, Homo sapien
ttagtgaggccacacgtgcagcagt

SEQ ID NO: 13813 - DNA, 25 bp, Homo sapien
caggccagcgaagaccctacaaacg

SEQ ID NO: 13814 - DNA, 25 bp, Homo sapien
agttaactgtcacccggcaccatgc

SEQ ID NO: 13815 - DNA, 25 bp, Homo sapien
cagcgcgggagttaactgtcacccg

SEQ ID NO: 13816 - DNA, 25 bp, Homo sapien
ccagcgcgggagttaactgtcaccc

SEQ ID NO: 13817 - DNA, 25 bp, Homo sapien
gagttaactgtcacccggcaccatg

SEQ ID NO: 13818 - DNA, 25 bp, Homo sapien
tgcccagcgcgggagttaactgtca

SEQ ID NO: 13819 - DNA, 25 bp, Homo sapien
agcgcgggagttaactgtcacccgg

SEQ ID NO: 13820 - DNA, 25 bp, Homo sapien
gggagttaactgtcacccggcacca

SEQ ID NO: 13821 - DNA, 25 bp, Homo sapien
gcccagcgcgggagttaactgtcac

SEQ ID NO: 13822 - DNA, 25 bp, Homo sapien
cacctacgtgtcatccgattcgatg

SEQ ID NO: 13823 - DNA, 25 bp, Homo sapien
gaccctatggggttcccagcacgga

SEQ ID NO: 13824 - DNA, 25 bp, Homo sapien
gtccatgatcttgaaactttccagg

SEQ ID NO: 13825 - DNA, 25 bp, Homo sapien
cagcagcaggctgtagtccatgatc

SEQ ID NO: 13826 - DNA, 25 bp, Homo sapien
ctggtcgatgttgtgcacgcccagc

SEQ ID NO: 13827 - DNA, 25 bp, Homo sapien
ttctcatctgaggtgctctgggcgc

SEQ ID NO: 13828 - DNA, 25 bp, Homo sapien
ggagtagagcgccttctggcccaca

SEQ ID NO: 13829 - DNA, 25 bp, Homo sapien
accctggatggactccatggccgtg

SEQ ID NO: 13830 - DNA, 25 bp, Homo sapien
gtggagcccttgaggtcgaacttga

SEQ ID NO: 13831 - DNA, 25 bp, Homo sapien
gctgcagcgtcttgaccagggcgct

SEQ ID NO: 13832 - DNA, 25 bp, Homo sapien
cctcgggcatgtcctgcatgaagtc

SEQ ID NO: 13833 - DNA, 25 bp, Homo sapien
tcgaacttgaggtgcatcttgacca

SEQ ID NO: 13834 - DNA, 25 bp, Homo sapien
gcatcttgaccacgcggggcaggat

SEQ ID NO: 13835 - DNA, 25 bp, Homo sapien
ggcaggatgttgttcatgaccacga

SEQ ID NO: 13836 - DNA, 25 bp, Homo sapien
gaccacgacgcggatgttcttgccc

SEQ ID NO: 13837 - DNA, 25 bp, Homo sapien
gactgcacgcagtacagcccataga

SEQ ID NO: 13838 - DNA, 25 bp, Homo sapien
ccctggctggagcacatgctagttc

SEQ ID NO: 13839 - DNA, 25 bp, Homo sapien
ggaccgtgctgtcgtgacaaccaga

SEQ ID NO: 13840 - DNA, 25 bp, Homo sapien
gacacgacccggagcatggtgactc

SEQ ID NO: 13841 - DNA, 25 bp, Homo sapien
cgggcacctgaacaggctggagttc

SEQ ID NO: 13842 - DNA, 25 bp, Homo sapien
tcgggcgcttcctacagactgagat

SEQ ID NO: 13843 - DNA, 25 bp, Homo sapien
acgcacagtcagcaaccaccaaaga

SEQ ID NO: 13844 - DNA, 25 bp, Homo sapien
aaggcacaaggaaccgaccaccgcg

SEQ ID NO: 13845 - DNA, 25 bp, Homo sapien
tagttctccctggaagagcgcagcc

SEQ ID NO: 13846 - DNA, 25 bp, Homo sapien
ctgcggtgcacggctctgatcgctg

SEQ ID NO: 13847 - DNA, 25 bp, Homo sapien
gctctgatcgctggctgcacggtga

SEQ ID NO: 13848 - DNA, 25 bp, Homo sapien
tctgatcgctggctgcacggtgacc

SEQ ID NO: 13849 - DNA, 25 bp, Homo sapien
gcctgcggtgcacggctctgatcgc

SEQ ID NO: 13850 - DNA, 25 bp, Homo sapien
acgtggtggcgacccgggcctgcgg

SEQ ID NO: 13851 - DNA, 25 bp, Homo sapien
tggccccatcacaggacgtggtggc

SEQ ID NO: 13852 - DNA, 25 bp, Homo sapien
tcctggccccatcacaggacgtggt

SEQ ID NO: 13853 - DNA, 25 bp, Homo sapien
gaggaaaggcgagccgcgctgcgga

SEQ ID NO: 13854 - DNA, 25 bp, Homo sapien
aggaggcgtctttctgcttctccca

SEQ ID NO: 13855 - DNA, 25 bp, Homo sapien
ccaccttgggacaaacagctgtcct

SEQ ID NO: 13856 - DNA, 25 bp, Homo sapien
gcgcctgcaggaggcgtctttctgc

SEQ ID NO: 13857 - DNA, 25 bp, Homo sapien
actgccaggcatgggcggttctcgt

SEQ ID NO: 13858 - DNA, 25 bp, Homo sapien
tcttcccagggtgaacataaaagaa

SEQ ID NO: 13859 - DNA, 25 bp, Homo sapien
cttcagctggagcacgcatctgcct

SEQ ID NO: 13860 - DNA, 25 bp, Homo sapien
tcctgcccgcctatgcggaggtggc

SEQ ID NO: 13861 - DNA, 25 bp, Homo sapien
tgggacaaacagctgtcctgcccgc

SEQ ID NO: 13862 - DNA, 25 bp, Homo sapien
acaggcagatctagaaataaaaggc

SEQ ID NO: 13863 - DNA, 25 bp, Homo sapien
tcggtcaactctagaaatcacaatg

SEQ ID NO: 13864 - DNA, 25 bp, Homo sapien
aaataaaaggctgcaccatcactcg

SEQ ID NO: 13865 - DNA, 25 bp, Homo sapien
tcacaatgttttggagaaaaacctg

SEQ ID NO: 13866 - DNA, 25 bp, Homo sapien
cgagtcgccgtaaactgtcacccgg

SEQ ID NO: 13867 - DNA, 25 bp, Homo sapien
aactgtcacccggtacatccgcggt

SEQ ID NO: 13868 - DNA, 25 bp, Homo sapien
tgcggtgtttgggttcggtcaactc

SEQ ID NO: 13869 - DNA, 25 bp, Homo sapien
ggtttctcgaaaaacaggcagatct

SEQ ID NO: 13870 - DNA, 25 bp, Homo sapien
agagacacgaggactccgcgctaca

SEQ ID NO: 13871 - DNA, 25 bp, Homo sapien
gcgcagcgtggttactgtagacgtc

SEQ ID NO: 13872 - DNA, 25 bp, Homo sapien
tgtagacgtctgaggtcccgaaacc

SEQ ID NO: 13873 - DNA, 25 bp, Homo sapien
gaaacctgccttcgtgtcctagtcc

SEQ ID NO: 13874 - DNA, 25 bp, Homo sapien
cgatcctgcaagagaaagagacacg

SEQ ID NO: 13875 - DNA, 25 bp, Homo sapien
tccgcgctacaaagcccgctgtaaa

SEQ ID NO: 13876 - DNA, 25 bp, Homo sapien
gcccgctgtaaaccttaggtgtgga

SEQ ID NO: 13877 - DNA, 25 bp, Homo sapien
tgtggaaaaggaatcaacgatcctg

SEQ ID NO: 13878 - DNA, 25 bp, Homo sapien
gcggagcatccagaactccgcaggc

SEQ ID NO: 13879 - DNA, 25 bp, Homo sapien
cctgaggtgttgggtcgtttcccag

SEQ ID NO: 13880 - DNA, 25 bp, Homo sapien
aggcgggcggagcatccagaactcc

SEQ ID NO: 13881 - DNA, 25 bp, Homo sapien
ggtaaacaggaagctctgcgcaggc

SEQ ID NO: 13882 - DNA, 25 bp, Homo sapien
gccaggccggtaaacaggaagctct

SEQ ID NO: 13883 - DNA, 25 bp, Homo sapien
cccgcagggcatagagtgatcgctt

SEQ ID NO: 13884 - DNA, 25 bp, Homo sapien
actctcagcaccaagctcccgggcg

SEQ ID NO: 13885 - DNA, 25 bp, Homo sapien
ttgcgcgctccgtctccagcacagc

SEQ ID NO: 13886 - DNA, 25 bp, Homo sapien
agacattgctttgcctcccatcgga

SEQ ID NO: 13887 - DNA, 25 bp, Homo sapien
ggagcccaggcaattagaggaacca

SEQ ID NO: 13888 - DNA, 25 bp, Homo sapien
gtgtcgccatcgcttctaacagtga

SEQ ID NO: 13889 - DNA, 25 bp, Homo sapien
ggcacgacaatcaccaagcacgagc

SEQ ID NO: 13890 - DNA, 25 bp, Homo sapien
tcggatcagccgaaatcgccaagga

SEQ ID NO: 13891 - DNA, 25 bp, Homo sapien
acggcccatggagacgccattcagg

SEQ ID NO: 13892 - DNA, 25 bp, Homo sapien
ctgagctttctggaaggtgtcgcca

SEQ ID NO: 13893 - DNA, 25 bp, Homo sapien
acagtgagcggtgactccagaaacc

SEQ ID NO: 13894 - DNA, 25 bp, Homo sapien
gggcctgcttgcgacccgcagccag

SEQ ID NO: 13895 - DNA, 25 bp, Homo sapien
cccagcggcgcccacgccgagtcgc

SEQ ID NO: 13896 - DNA, 25 bp, Homo sapien
gcgggtcaggcagaacggggatccc

SEQ ID NO: 13897 - DNA, 25 bp, Homo sapien
gactctcggcgctcggacgagccca

SEQ ID NO: 13898 - DNA, 25 bp, Homo sapien
tctccgcctcgtccggtacctccag

SEQ ID NO: 13899 - DNA, 25 bp, Homo sapien
tccggtacctccagctccatggccg

SEQ ID NO: 13900 - DNA, 25 bp, Homo sapien
ctccagctccatggccgcgcgcgga

SEQ ID NO: 13901 - DNA, 25 bp, Homo sapien
gcagccgccactcacacgacgggca

SEQ ID NO: 13902 - DNA, 25 bp, Homo sapien
gaaacaccttccaaatagtaggctc

SEQ ID NO: 13903 - DNA, 25 bp, Homo sapien
tcaggacctggctcctgtgatggga

SEQ ID NO: 13904 - DNA, 25 bp, Homo sapien
ctgcgtggataacccggcctggagt

SEQ ID NO: 13905 - DNA, 25 bp, Homo sapien
ctctcggctgcgtggataacccggc

SEQ ID NO: 13906 - DNA, 25 bp, Homo sapien
gtcttgctggcagccttgtcgggcc

SEQ ID NO: 13907 - DNA, 25 bp, Homo sapien
attcctgccgggtcttgctggcagc

SEQ ID NO: 13908 - DNA, 25 bp, Homo sapien
caaatagtaggctccgttccaagcg

SEQ ID NO: 13909 - DNA, 25 bp, Homo sapien
gggagagaaacctccgccgcgtcca

SEQ ID NO: 13910 - DNA, 25 bp, Homo sapien
ctatgacggcgactcatccagtggc

SEQ ID NO: 13911 - DNA, 25 bp, Homo sapien
gctctgaggccaacgggctggccct

SEQ ID NO: 13912 - DNA, 25 bp, Homo sapien
gtgtccggctttaagcggctgccac

SEQ ID NO: 13913 - DNA, 25 bp, Homo sapien
tgccacggcaggacgtgcagatgaa

SEQ ID NO: 13914 - DNA, 25 bp, Homo sapien
cgtgcagatgaagcctgtgaagtca

SEQ ID NO: 13915 - DNA, 25 bp, Homo sapien
cgggaggtcggacacgatcagtact

SEQ ID NO: 13916 - DNA, 25 bp, Homo sapien
cacgatcagtactggacacagggca

SEQ ID NO: 13917 - DNA, 25 bp, Homo sapien
cgccaggactcggatgaagacgatg

SEQ ID NO: 13918 - DNA, 25 bp, Homo sapien
acagccgcgttaacagcgactacga

SEQ ID NO: 13919 - DNA, 25 bp, Homo sapien
tcggagcccgtgcaggcagatgagt

SEQ ID NO: 13920 - DNA, 25 bp, Homo sapien
cgagggctacacagacggcgagggg

SEQ ID NO: 13921 - DNA, 25 bp, Homo sapien
cgcgttaacagcgactacgagacgg

SEQ ID NO: 13922 - DNA, 25 bp, Homo sapien
gccgcgttaacagcgactacgagac

SEQ ID NO: 13923 - DNA, 25 bp, Homo sapien
agccgcgttaacagcgactacgaga

SEQ ID NO: 13924 - DNA, 25 bp, Homo sapien
cagccgcgttaacagcgactacgag

SEQ ID NO: 13925 - DNA, 25 bp, Homo sapien
ggagcccgtgcaggcagatgagtcc

SEQ ID NO: 13926 - DNA, 25 bp, Homo sapien
acacctcgccataggcctcggtgag

SEQ ID NO: 13927 - DNA, 25 bp, Homo sapien
tgagtgtcaccgacgtctgcgactt

SEQ ID NO: 13928 - DNA, 25 bp, Homo sapien
gcagtggacgatgctgagtgtcacc

SEQ ID NO: 13929 - DNA, 25 bp, Homo sapien
cctcggtgagcagctcgatgatgcg

SEQ ID NO: 13930 - DNA, 25 bp, Homo sapien
acgctcggcgatgccaccacggagg

SEQ ID NO: 13931 - DNA, 25 bp, Homo sapien
acactctgcccattgatctcaatga

SEQ ID NO: 13932 - DNA, 25 bp, Homo sapien
acgtctgcgacttcgtctcctgtgg

SEQ ID NO: 13933 - DNA, 25 bp, Homo sapien
gatctcaatgatgcggtggccgacg

SEQ ID NO: 13934 - DNA, 25 bp, Homo sapien
cgcgtagaatacgtggcagagcatc

SEQ ID NO: 13935 - DNA, 25 bp, Homo sapien
acgtggcagagcatcttgtagaggc

SEQ ID NO: 13936 - DNA, 25 bp, Homo sapien
agggcgtggtccatcatggcctcct

SEQ ID NO: 13937 - DNA, 25 bp, Homo sapien
gtacctgggagtccgctgtcaagac

SEQ ID NO: 13938 - DNA, 25 bp, Homo sapien
tgtcaagaccttgatcctcttggtg

SEQ ID NO: 13939 - DNA, 25 bp, Homo sapien
gacgaacaggtccacctccgtcatg

SEQ ID NO: 13940 - DNA, 25 bp, Homo sapien
ctgctcacgtcctccgcgtagaata

SEQ ID NO: 13941 - DNA, 25 bp, Homo sapien
tcctcttggtggagacgaacaggtc

SEQ ID NO: 13942 - DNA, 25 bp, Homo sapien
agagccctggcccattgagcatgcg

SEQ ID NO: 13943 - DNA, 25 bp, Homo sapien
tggcccattgagcatgcgcggcctc

SEQ ID NO: 13944 - DNA, 25 bp, Homo sapien
aagcgccgactcagactgcgctctg

SEQ ID NO: 13945 - DNA, 25 bp, Homo sapien
cgaagacctcaagcgccgactcaga

SEQ ID NO: 13946 - DNA, 25 bp, Homo sapien
gactgcgctctgcacctcgaggaca

SEQ ID NO: 13947 - DNA, 25 bp, Homo sapien
aggacactcacttcccaaatcgagg

SEQ ID NO: 13948 - DNA, 25 bp, Homo sapien
cgctgggacaactgcagatgttgga

SEQ ID NO: 13949 - DNA, 25 bp, Homo sapien
gcgcccgctcctctatccgcgcaga

SEQ ID NO: 13950 - DNA, 25 bp, Homo sapien
cgacttcaggtaccgcctccgggag

SEQ ID NO: 13951 - DNA, 25 bp, Homo sapien
gcgggcctggaaagcgtgcgggtcc

SEQ ID NO: 13952 - DNA, 25 bp, Homo sapien
agccgtccttggagcgcctggggag

SEQ ID NO: 13953 - DNA, 25 bp, Homo sapien
agcgacttcaggtaccgcctccggg

SEQ ID NO: 13954 - DNA, 25 bp, Homo sapien
ccaaggtgtcgttctcgtgccgcgg

SEQ ID NO: 13955 - DNA, 25 bp, Homo sapien
ggcccaaggtgtcgttctcgtgccg

SEQ ID NO: 13956 - DNA, 25 bp, Homo sapien
caagggcagcccgaacggcgagtgc

SEQ ID NO: 13957 - DNA, 25 bp, Homo sapien
cagagaggacgaatagaggggaacg

SEQ ID NO: 13958 - DNA, 25 bp, Homo sapien
aactcgtggtccctgcatctgcaga

SEQ ID NO: 13959 - DNA, 25 bp, Homo sapien
tgattgcgttctcgctgcgtccaga

SEQ ID NO: 13960 - DNA, 25 bp, Homo sapien
ccactgtgcggataccggattggta

SEQ ID NO: 13961 - DNA, 25 bp, Homo sapien
gggtgcctcctattctacttacaaa

SEQ ID NO: 13962 - DNA, 25 bp, Homo sapien
gccaggtcccatttcgtgttcatta

SEQ ID NO: 13963 - DNA, 25 bp, Homo sapien
gctgagcaaggtctcctcgaattta

SEQ ID NO: 13964 - DNA, 25 bp, Homo sapien
tttgctcctaagaacgtacggcgcc

SEQ ID NO: 13965 - DNA, 25 bp, Homo sapien
ctcccaggtccagtgtaaactcgtg

SEQ ID NO: 13966 - DNA, 25 bp, Homo sapien
gtcatggcgaccaaacgccttttcg

SEQ ID NO: 13967 - DNA, 25 bp, Homo sapien
tggagaccacgcgtttcactgcgca

SEQ ID NO: 13968 - DNA, 25 bp, Homo sapien
atactgtagcgattggacccagggc

SEQ ID NO: 13969 - DNA, 25 bp, Homo sapien
gcgtctggctcggagatactgtagc

SEQ ID NO: 13970 - DNA, 25 bp, Homo sapien
gcccgggattatgccaagaaaccag

SEQ ID NO: 13971 - DNA, 25 bp, Homo sapien
tgcccgcaatacgtcatggcgacca

SEQ ID NO: 13972 - DNA, 25 bp, Homo sapien
gtgctagaactgatgcgcaagcgca

SEQ ID NO: 13973 - DNA, 25 bp, Homo sapien
gtgcacttgcaagctgcccgcaata

SEQ ID NO: 13974 - DNA, 25 bp, Homo sapien
ctgagcaagaacaagaggttgtagc

SEQ ID NO: 13975 - DNA, 25 bp, Homo sapien
agcccaggggtcaccgtgtagctct

SEQ ID NO: 13976 - DNA, 25 bp, Homo sapien
ggtcaccgtgtagctctgattcctg

SEQ ID NO: 13977 - DNA, 25 bp, Homo sapien
cgtgtagctctgattcctgcccgca

SEQ ID NO: 13978 - DNA, 25 bp, Homo sapien
cccgtcaggctgttcgagatgaact

SEQ ID NO: 13979 - DNA, 25 bp, Homo sapien
gctgttcgagatgaacttgggtccc

SEQ ID NO: 13980 - DNA, 25 bp, Homo sapien
cggctgcggaaacagaacatctggc

SEQ ID NO: 13981 - DNA, 25 bp, Homo sapien
aacatctggcgccacaaccggctga

SEQ ID NO: 13982 - DNA, 25 bp, Homo sapien
agcctgtgcatgttccttggccagc

SEQ ID NO: 13983 - DNA, 25 bp, Homo sapien
ggagtctcggagctgccacggcacc

SEQ ID NO: 13984 - DNA, 25 bp, Homo sapien
tgaggcccgaaggacgcttgcagcc

SEQ ID NO: 13985 - DNA, 25 bp, Homo sapien
gcatgaggcccgaaggacgcttgca

SEQ ID NO: 13986 - DNA, 25 bp, Homo sapien
tcctccagggcgaagccatctgcga

SEQ ID NO: 13987 - DNA, 25 bp, Homo sapien
ccagagcctgtgcatgttccttggc

SEQ ID NO: 13988 - DNA, 25 bp, Homo sapien
agccatctgcgaaggtgggagcaaa

SEQ ID NO: 13989 - DNA, 25 bp, Homo sapien
gagcctgactccagccgctcctggc

SEQ ID NO: 13990 - DNA, 25 bp, Homo sapien
ccacgtggaaacaggtgtgcgcaca

SEQ ID NO: 13991 - DNA, 25 bp, Homo sapien
cagctgcgcgcagacaagcaaagga

SEQ ID NO: 13992 - DNA, 25 bp, Homo sapien
cacacctgggaacgtgcgcacctgt

SEQ ID NO: 13993 - DNA, 25 bp, Homo sapien
acactggaacacctgggcgccagcg

SEQ ID NO: 13994 - DNA, 25 bp, Homo sapien
gtactcacacgcatacggatgcatg

SEQ ID NO: 13995 - DNA, 25 bp, Homo sapien
gtcccggctgcacaacttggagcga

SEQ ID NO: 13996 - DNA, 25 bp, Homo sapien
tggagcgagttgctccgtttcctca

SEQ ID NO: 13997 - DNA, 25 bp, Homo sapien
acacagggctcggacacagctgcgc

SEQ ID NO: 13998 - DNA, 25 bp, Homo sapien
atcccttcgctaaccaactgcttga

SEQ ID NO: 13999 - DNA, 25 bp, Homo sapien
tcgctcctgtccgtgaccttgcaga

SEQ ID NO: 14000 - DNA, 25 bp, Homo sapien
tgacagcctgcccttccgtttttgt

SEQ ID NO: 14001 - DNA, 25 bp, Homo sapien
tttttgtctttccagtcccgcctgc

SEQ ID NO: 14002 - DNA, 25 bp, Homo sapien
tacactcaccgatgtcgcctagcaa

SEQ ID NO: 14003 - DNA, 25 bp, Homo sapien
cgcagctagcatccgcaaccgaggt

SEQ ID NO: 14004 - DNA, 25 bp, Homo sapien
aactgcttgattttgctgtcgcgcc

SEQ ID NO: 14005 - DNA, 25 bp, Homo sapien
agacggtccatccatctgcaccgaa

SEQ ID NO: 14006 - DNA, 25 bp, Homo sapien
ccaggaccttgtgggtctgccggaa

SEQ ID NO: 14007 - DNA, 25 bp, Homo sapien
ggtctgccggaaggccagcattcgc

SEQ ID NO: 14008 - DNA, 25 bp, Homo sapien
caggagatccatgcccaggaccttg

SEQ ID NO: 14009 - DNA, 25 bp, Homo sapien
ctgggcggcaggagatccatgccca

SEQ ID NO: 14010 - DNA, 25 bp, Homo sapien
cgcacacgtccaggagtgcagggat

SEQ ID NO: 14011 - DNA, 25 bp, Homo sapien
cggcgcgcacacgtccaggagtgca

SEQ ID NO: 14012 - DNA, 25 bp, Homo sapien
atgaagcagccattggtcggcgcgc

SEQ ID NO: 14013 - DNA, 25 bp, Homo sapien
aaggccagcattcgcagggcgtgct

SEQ ID NO: 14014 - DNA, 25 bp, Homo sapien
ctgatgacgatcacgcatggctgca

SEQ ID NO: 14015 - DNA, 25 bp, Homo sapien
ccaggaagctgatggcaggcgtccc

SEQ ID NO: 14016 - DNA, 25 bp, Homo sapien
tcaagtcagcactcggccaggaagc

SEQ ID NO: 14017 - DNA, 25 bp, Homo sapien
gccagcgttggttgtcaagtcagca

SEQ ID NO: 14018 - DNA, 25 bp, Homo sapien
cccatcagccaggagccagcgttgg

SEQ ID NO: 14019 - DNA, 25 bp, Homo sapien
tggaaacagagtccactcccacatg

SEQ ID NO: 14020 - DNA, 25 bp, Homo sapien
cacacggttagctttcaggggctca

SEQ ID NO: 14021 - DNA, 25 bp, Homo sapien
aggggctcacgtggccacacggcat

SEQ ID NO: 14022 - DNA, 25 bp, Homo sapien
gaggtcgcccgcgtttgcacacaga

SEQ ID NO: 14023 - DNA, 25 bp, Homo sapien
gtcctcccgaggaggtgtccgctgc

SEQ ID NO: 14024 - DNA, 25 bp, Homo sapien
tgctccggggagtgtgaggtcgccc

SEQ ID NO: 14025 - DNA, 25 bp, Homo sapien
tcgcccgcgtttgcacacagaggaa

SEQ ID NO: 14026 - DNA, 25 bp, Homo sapien
ccgcgtttgcacacagaggaaactg

SEQ ID NO: 14027 - DNA, 25 bp, Homo sapien
ttgcacacagaggaaactgtaccta

SEQ ID NO: 14028 - DNA, 25 bp, Homo sapien
aggaaactgtacctacctggagtgg

SEQ ID NO: 14029 - DNA, 25 bp, Homo sapien
tccggcctgcccatgagcagaggct

SEQ ID NO: 14030 - DNA, 25 bp, Homo sapien
tggagcccacgtgtcaggtccgcac

SEQ ID NO: 14031 - DNA, 25 bp, Homo sapien
gtgcccttgcccgtctgctctggaa

SEQ ID NO: 14032 - DNA, 25 bp, Homo sapien
gcgtctaggttccacgctggacctg

SEQ ID NO: 14033 - DNA, 25 bp, Homo sapien
aggtgccgctgcttcctcatgcgct

SEQ ID NO: 14034 - DNA, 25 bp, Homo sapien
aatctgcagcagtgggcgtctaggt

SEQ ID NO: 14035 - DNA, 25 bp, Homo sapien
aggagctccgtaatctgcagcagtg

SEQ ID NO: 14036 - DNA, 25 bp, Homo sapien
actgctcgagagctcacacggagga

SEQ ID NO: 14037 - DNA, 25 bp, Homo sapien
ccggcagtgtccctgcgtctacgga

SEQ ID NO: 14038 - DNA, 25 bp, Homo sapien
cttcgcgttaaggtcgttgaaactg

SEQ ID NO: 14039 - DNA, 25 bp, Homo sapien
ctcacgtgcaggtccttcgcgttaa

SEQ ID NO: 14040 - DNA, 25 bp, Homo sapien
tgcactcgcacagcttgcagtggaa

SEQ ID NO: 14041 - DNA, 25 bp, Homo sapien
ctgctggacgcacccggtactgcag

SEQ ID NO: 14042 - DNA, 25 bp, Homo sapien
agtggaagcgaagcactcgcccttc

SEQ ID NO: 14043 - DNA, 25 bp, Homo sapien
gcccttcgtcgctgaacacctgaga

SEQ ID NO: 14044 - DNA, 25 bp, Homo sapien
tgagacacagaacagccgcacgcgc

SEQ ID NO: 14045 - DNA, 25 bp, Homo sapien
aggtcgttgaaactgcactcgcaca

SEQ ID NO: 14046 - DNA, 25 bp, Homo sapien
aaccgaagaggaggcgaccgcagcc

SEQ ID NO: 14047 - DNA, 25 bp, Homo sapien
ccacaaggcccacgcttgcgccctc

SEQ ID NO: 14048 - DNA, 25 bp, Homo sapien
gtccaggcctctcctcgaagggttc

SEQ ID NO: 14049 - DNA, 25 bp, Homo sapien
cctcgaagggttccgcgcgcagaaa

SEQ ID NO: 14050 - DNA, 25 bp, Homo sapien
gacgcgctggaaaggcgttttctgc

SEQ ID NO: 14051 - DNA, 25 bp, Homo sapien
tcggcccgtccgcaaccgaagagga

SEQ ID NO: 14052 - DNA, 25 bp, Homo sapien
gaggcgaccgcagcctggaaaagaa

SEQ ID NO: 14053 - DNA, 25 bp, Homo sapien
cctccgggcctcgggaatatttgtg

SEQ ID NO: 14054 - DNA, 25 bp, Homo sapien
gcaggagaggctccaccgggcctca

SEQ ID NO: 14055 - DNA, 25 bp, Homo sapien
atcccagtcagggtgtcttgctccg

SEQ ID NO: 14056 - DNA, 25 bp, Homo sapien
tgccatccaggtcctggtctgcgtc

SEQ ID NO: 14057 - DNA, 25 bp, Homo sapien
ccagccgcgtctgctgggcgaagta

SEQ ID NO: 14058 - DNA, 25 bp, Homo sapien
gtagtcgtagcgctccgacttcttc

SEQ ID NO: 14059 - DNA, 25 bp, Homo sapien
gtagtagtactcgacacactcgccc

SEQ ID NO: 14060 - DNA, 25 bp, Homo sapien
ggccatcggggtcgctgccatccag

SEQ ID NO: 14061 - DNA, 25 bp, Homo sapien
cgacttcttccacaggtagtagtac

SEQ ID NO: 14062 - DNA, 25 bp, Homo sapien
tccctttcttaatcctgggcacctg

SEQ ID NO: 14063 - DNA, 25 bp, Homo sapien
gcgagagttcggtgaacatctgccc

SEQ ID NO: 14064 - DNA, 25 bp, Homo sapien
ccacagctgagagtgccgtctccta

SEQ ID NO: 14065 - DNA, 25 bp, Homo sapien
cgcccggcgagagttcggtgaacat

SEQ ID NO: 14066 - DNA, 25 bp, Homo sapien
gctgagagtgccgtctcctaatccc

SEQ ID NO: 14067 - DNA, 25 bp, Homo sapien
gcacctgccacggatctggccatga

SEQ ID NO: 14068 - DNA, 25 bp, Homo sapien
gatctggccatgactccacagctga

SEQ ID NO: 14069 - DNA, 25 bp, Homo sapien
tagcagctccctttcttaatcctgg

SEQ ID NO: 14070 - DNA, 25 bp, Homo sapien
acgaaactttcactaggcggccagg

SEQ ID NO: 14071 - DNA, 25 bp, Homo sapien
ttgaagacctgcaacagacagagcc

SEQ ID NO: 14072 - DNA, 25 bp, Homo sapien
tggcctgctcgaggcacacacgctg

SEQ ID NO: 14073 - DNA, 25 bp, Homo sapien
gctcccagcctgatggcctttttca

SEQ ID NO: 14074 - DNA, 25 bp, Homo sapien
tcgactggatggtagattttctcac

SEQ ID NO: 14075 - DNA, 25 bp, Homo sapien
cgggaagacatgacgaaaatcgact

SEQ ID NO: 14076 - DNA, 25 bp, Homo sapien
taaggccttcgaggccacgggtctc

SEQ ID NO: 14077 - DNA, 25 bp, Homo sapien
atacagacacacgtaccctcgcata

SEQ ID NO: 14078 - DNA, 25 bp, Homo sapien
tgagcagcagagaaaacaatgagtc

SEQ ID NO: 14079 - DNA, 25 bp, Homo sapien
tcacgatggaagctgacgactcggg

SEQ ID NO: 14080 - DNA, 25 bp, Homo sapien
gaacgctggtcttacccgtgtaggc

SEQ ID NO: 14081 - DNA, 25 bp, Homo sapien
ggagatgctgattccactgagttga

SEQ ID NO: 14082 - DNA, 25 bp, Homo sapien
ggtgtatcccgaggacaaggtgctc

SEQ ID NO: 14083 - DNA, 25 bp, Homo sapien
gacgcgtcatagttcgggtagcttg

SEQ ID NO: 14084 - DNA, 25 bp, Homo sapien
cagcggagtacaccgacgcgtcata

SEQ ID NO: 14085 - DNA, 25 bp, Homo sapien
accacctgggcaaggaacgctggtc

SEQ ID NO: 14086 - DNA, 25 bp, Homo sapien
ggggctggtatccaccgtaccctgc

SEQ ID NO: 14087 - DNA, 25 bp, Homo sapien
tcccggcaacgctggtcaaagaaag

SEQ ID NO: 14088 - DNA, 25 bp, Homo sapien
cccgagagcagtggattctttcgga

SEQ ID NO: 14089 - DNA, 25 bp, Homo sapien
ttcggaagcgactctgccctgattt

SEQ ID NO: 14090 - DNA, 25 bp, Homo sapien
accacgggtacgcaatgccagcaga

SEQ ID NO: 14091 - DNA, 25 bp, Homo sapien
gcaatgccagcagaagggtcccgaa

SEQ ID NO: 14092 - DNA, 25 bp, Homo sapien
tagctgtgggaagcccaccgctctc

SEQ ID NO: 14093 - DNA, 25 bp, Homo sapien
atcacggttaagaggcctgggagaa

SEQ ID NO: 14094 - DNA, 25 bp, Homo sapien
ccgacaatacattcgatgaacaccg

SEQ ID NO: 14095 - DNA, 25 bp, Homo sapien
tgacacccgatgaacatcccgacaa

SEQ ID NO: 14096 - DNA, 25 bp, Homo sapien
acacccgatgaacatcccgacaata

SEQ ID NO: 14097 - DNA, 25 bp, Homo sapien
cccgatgaacatcccgacaatacat

SEQ ID NO: 14098 - DNA, 25 bp, Homo sapien
gatgaacatcccgacaatacattcg

SEQ ID NO: 14099 - DNA, 25 bp, Homo sapien
gaacatcccgacaatacattcgatg

SEQ ID NO: 14100 - DNA, 25 bp, Homo sapien
atcccgacaatacattcgatgaaca

SEQ ID NO: 14101 - DNA, 25 bp, Homo sapien
gtgacacccgatgaacatcccgaca

SEQ ID NO: 14102 - DNA, 25 bp, Homo sapien
tgcagagacgtctcagccggagccc

SEQ ID NO: 14103 - DNA, 25 bp, Homo sapien
ccgccctgcgcgaagtcgaaatact

SEQ ID NO: 14104 - DNA, 25 bp, Homo sapien
gtcgaaatactgactcgtcgccatc

SEQ ID NO: 14105 - DNA, 25 bp, Homo sapien
cgccgacagacaccgttggctgcag

SEQ ID NO: 14106 - DNA, 25 bp, Homo sapien
tctcgcttccttctcttaggctagg

SEQ ID NO: 14107 - DNA, 25 bp, Homo sapien
acaccgttggctgcagagacgtctc

SEQ ID NO: 14108 - DNA, 25 bp, Homo sapien
gactcgtcgccatcttggcgtcttc

SEQ ID NO: 14109 - DNA, 25 bp, Homo sapien
cagttacctgtactgcgggccgccg

SEQ ID NO: 14110 - DNA, 25 bp, Homo sapien
tgcaacctccaggagcatcggctca

SEQ ID NO: 14111 - DNA, 25 bp, Homo sapien
tgcttctcggaccaaccaacgccgt

SEQ ID NO: 14112 - DNA, 25 bp, Homo sapien
gcggatccgtctcttgcttccacag

SEQ ID NO: 14113 - DNA, 25 bp, Homo sapien
gatccgtctcttgcttccacagtgt

SEQ ID NO: 14114 - DNA, 25 bp, Homo sapien
gatggaacagatccgggaactcact

SEQ ID NO: 14115 - DNA, 25 bp, Homo sapien
tcttcttgcaacctccaggagcatc

SEQ ID NO: 14116 - DNA, 25 bp, Homo sapien
agcatcggctcagccatctcctgct

SEQ ID NO: 14117 - DNA, 25 bp, Homo sapien
ccgctgatttcctctcttcttgcaa

SEQ ID NO: 14118 - DNA, 25 bp, Homo sapien
gggaaaaccgttccctgagctgcgc

SEQ ID NO: 14119 - DNA, 25 bp, Homo sapien
ttcctcctaggctctgaaggcccgg

SEQ ID NO: 14120 - DNA, 25 bp, Homo sapien
ttgtgactccgtgaaggccctcaca

SEQ ID NO: 14121 - DNA, 25 bp, Homo sapien
cagagagccacggtcttgtgactcc

SEQ ID NO: 14122 - DNA, 25 bp, Homo sapien
tccctggaaggtttatccggcagcc

SEQ ID NO: 14123 - DNA, 25 bp, Homo sapien
cagggctcgcctttgtttgccagta

SEQ ID NO: 14124 - DNA, 25 bp, Homo sapien
gcaccattttcaggacacgctgaga

SEQ ID NO: 14125 - DNA, 25 bp, Homo sapien
gagctgcgcccagcaacacagttta

SEQ ID NO: 14126 - DNA, 25 bp, Homo sapien
cgccaagaacatgcccggggacagc

SEQ ID NO: 14127 - DNA, 25 bp, Homo sapien
cctctcctcagggtactacggcgaa

SEQ ID NO: 14128 - DNA, 25 bp, Homo sapien
aggactctgacgttgccgatcggct

SEQ ID NO: 14129 - DNA, 25 bp, Homo sapien
cctcagcgaaggcagagactggcta

SEQ ID NO: 14130 - DNA, 25 bp, Homo sapien
ttaagccgtcaactcgcttcgggtg

SEQ ID NO: 14131 - DNA, 25 bp, Homo sapien
cctctctgatgcacggggatgttaa

SEQ ID NO: 14132 - DNA, 25 bp, Homo sapien
atccggccttacatgaaagtggtca

SEQ ID NO: 14133 - DNA, 25 bp, Homo sapien
gagcaccgtatagacctgcacatga

SEQ ID NO: 14134 - DNA, 25 bp, Homo sapien
cggaatcggagcgaccttggtgact

SEQ ID NO: 14135 - DNA, 25 bp, Homo sapien
tatactccttaagggccgcggaatc

SEQ ID NO: 14136 - DNA, 25 bp, Homo sapien
ggcctttcttgcagaattcgccata

SEQ ID NO: 14137 - DNA, 25 bp, Homo sapien
tttgccaccacttaggcctttcttg

SEQ ID NO: 14138 - DNA, 25 bp, Homo sapien
cgatgcatctcttcttgcttgctta

SEQ ID NO: 14139 - DNA, 25 bp, Homo sapien
gggcgagcttgcacgttacatcacc

SEQ ID NO: 14140 - DNA, 25 bp, Homo sapien
tttctgcagatctagggcgagcttg

SEQ ID NO: 14141 - DNA, 25 bp, Homo sapien
ctgcgcacagtctaatccgcgggga

SEQ ID NO: 14142 - DNA, 25 bp, Homo sapien
atgcctggcgcctgaggtcacctac

SEQ ID NO: 14143 - DNA, 25 bp, Homo sapien
cgagacctataaaggcgccaggttt

SEQ ID NO: 14144 - DNA, 25 bp, Homo sapien
cgccaggttttctcaatgaagccgg

SEQ ID NO: 14145 - DNA, 25 bp, Homo sapien
tttctcaatgaagccgggacgcact

SEQ ID NO: 14146 - DNA, 25 bp, Homo sapien
gacgcactccggagcgcactgcgtg

SEQ ID NO: 14147 - DNA, 25 bp, Homo sapien
gagcgcactgcgtggtcgcacccta

SEQ ID NO: 14148 - DNA, 25 bp, Homo sapien
tccgcaccggcatgaagctcatcgt

SEQ ID NO: 14149 - DNA, 25 bp, Homo sapien
ggcctccaggctgccgagacctata

SEQ ID NO: 14150 - DNA, 25 bp, Homo sapien
ggtccgccctcctgcaatgcccgct

SEQ ID NO: 14151 - DNA, 25 bp, Homo sapien
tccgccctcctgcaatacccgctcc

SEQ ID NO: 14152 - DNA, 25 bp, Homo sapien
ccgccctcctgcaatacccgctccc

SEQ ID NO: 14153 - DNA, 25 bp, Homo sapien
ccgccctcctgcaatgcccgctccc

SEQ ID NO: 14154 - DNA, 25 bp, Homo sapien
gtccgccctcctgcaatgcccgctc

SEQ ID NO: 14155 - DNA, 25 bp, Homo sapien
tccgccctcctgcaatgcccgctcc

SEQ ID NO: 14156 - DNA, 25 bp, Homo sapien
cctcctgcaatacccgctccccgtc

SEQ ID NO: 14157 - DNA, 25 bp, Homo sapien
tgcaatacccgctccccgtccactg

SEQ ID NO: 14158 - DNA, 25 bp, Homo sapien
gaagatcaagaagaagtatctgcgc

SEQ ID NO: 14159 - DNA, 25 bp, Homo sapien
caagaagaagtatctgcgcacgtgg

SEQ ID NO: 14160 - DNA, 25 bp, Homo sapien
gaagtatctgcgcacgtggttcgtg

SEQ ID NO: 14161 - DNA, 25 bp, Homo sapien
agtatctgcgcacgtggttcgtggt

SEQ ID NO: 14162 - DNA, 25 bp, Homo sapien
atctgcgcacgtggttcgtggtgga

SEQ ID NO: 14163 - DNA, 25 bp, Homo sapien
tacaagacggcacgcgccctgcgca

SEQ ID NO: 14164 - DNA, 25 bp, Homo sapien
tcaagaagaagtatctgcgcacgtg

SEQ ID NO: 14165 - DNA, 25 bp, Homo sapien
ggcacgcgccctgcgcatcgtgcgc

SEQ ID NO: 14166 - DNA, 25 bp, Homo sapien
atcgaggacaacacggagatcatcc

SEQ ID NO: 14167 - DNA, 25 bp, Homo sapien
ttcaacgtggtctcggacaccttct

SEQ ID NO: 14168 - DNA, 25 bp, Homo sapien
cctcatggacctggtgttgaacttc

SEQ ID NO: 14169 - DNA, 25 bp, Homo sapien
ggtgttgaacttccgcaccggcatt

SEQ ID NO: 14170 - DNA, 25 bp, Homo sapien
cgcaccggcattgtgatcgaggaca

SEQ ID NO: 14171 - DNA, 25 bp, Homo sapien
tggtggacttcgtgtcctccatccc

SEQ ID NO: 14172 - DNA, 25 bp, Homo sapien
gtggatcgtgttcaacgtggtctcg

SEQ ID NO: 14173 - DNA, 25 bp, Homo sapien
tcgtgcgcttcaccaagatcctcag

SEQ ID NO: 14174 - DNA, 25 bp, Homo sapien
ctctggacatggaggccatgctgga

SEQ ID NO: 14175 - DNA, 25 bp, Homo sapien
gtctctggacatggaggccatgctg

SEQ ID NO: 14176 - DNA, 25 bp, Homo sapien
tggacaccgtgcaggcctggctgag

SEQ ID NO: 14177 - DNA, 25 bp, Homo sapien
ccgcagaagtttgcccgtgcccacg

SEQ ID NO: 14178 - DNA, 25 bp, Homo sapien
cagaagtttgcccgtgcccacgggg

SEQ ID NO: 14179 - DNA, 25 bp, Homo sapien
agtttgcccgtgcccacggggtcag

SEQ ID NO: 14180 - DNA, 25 bp, Homo sapien
gagtctctggacatggaggccatgc

SEQ ID NO: 14181 - DNA, 25 bp, Homo sapien
tctggacatggaggccatgctggac

SEQ ID NO: 14182 - DNA, 25 bp, Homo sapien
gcagccctgacgcagcctttctgat

SEQ ID NO: 14183 - DNA, 25 bp, Homo sapien
acccggacgcggatgcggccacaga

SEQ ID NO: 14184 - DNA, 25 bp, Homo sapien
cctggaagacattcagaactcgctg

SEQ ID NO: 14185 - DNA, 25 bp, Homo sapien
ccgagaggagctcttccgtgaagtc

SEQ ID NO: 14186 - DNA, 25 bp, Homo sapien
acctggacggcatgaagtcccgaga

SEQ ID NO: 14187 - DNA, 25 bp, Homo sapien
cagtctacctggacggcatgaagtc

SEQ ID NO: 14188 - DNA, 25 bp, Homo sapien
tgcggccacagaacggccaggcctg

SEQ ID NO: 14189 - DNA, 25 bp, Homo sapien
gcctttctgatttcagtctacctgg

SEQ ID NO: 14190 - DNA, 25 bp, Homo sapien
gtactccttcagacgcgtggtcttc

SEQ ID NO: 14191 - DNA, 25 bp, Homo sapien
tccttctcctcgtagatggcggcca

SEQ ID NO: 14192 - DNA, 25 bp, Homo sapien
tacttgcttggccagcgcctcgtag

SEQ ID NO: 14193 - DNA, 25 bp, Homo sapien
acgacctcctcctgggctaatggca

SEQ ID NO: 14194 - DNA, 25 bp, Homo sapien
ctaatggcagcaacaggcagcaccc

SEQ ID NO: 14195 - DNA, 25 bp, Homo sapien
tgcacgaagcgcatctcggaggcta

SEQ ID NO: 14196 - DNA, 25 bp, Homo sapien
gccgaattgtccgtgcaactacccg

SEQ ID NO: 14197 - DNA, 25 bp, Homo sapien
gtgcgacttgatggtgtactccttc

SEQ ID NO: 14198 - DNA, 25 bp, Homo sapien
gatgcaccgctcaggctgcgagaca

SEQ ID NO: 14199 - DNA, 25 bp, Homo sapien
tcctgcttggtctcgcccaggaacg

SEQ ID NO: 14200 - DNA, 25 bp, Homo sapien
cgtcgaagtcgtagttcacggctga

SEQ ID NO: 14201 - DNA, 25 bp, Homo sapien
tgctgaagtactcctcgtcgaagtc

SEQ ID NO: 14202 - DNA, 25 bp, Homo sapien
ccagctcgctggtgttgctgaagta

SEQ ID NO: 14203 - DNA, 25 bp, Homo sapien
aatgaagtccttggccagctcgctg

SEQ ID NO: 14204 - DNA, 25 bp, Homo sapien
tacttgggatctttgacgagcagcc

SEQ ID NO: 14205 - DNA, 25 bp, Homo sapien
cgagcagccggcgaatgaagtcctt

SEQ ID NO: 14206 - DNA, 25 bp, Homo sapien
tctccgccaggaagtcaaagagctc

SEQ ID NO: 14207 - DNA, 25 bp, Homo sapien
ggcacttccgcacgatcgcaaactg

SEQ ID NO: 14208 - DNA, 25 bp, Homo sapien
gatgaacttggctgcgtactccttg

SEQ ID NO: 14209 - DNA, 25 bp, Homo sapien
acaggcggcgcttcttgatgaactt

SEQ ID NO: 14210 - DNA, 25 bp, Homo sapien
ggatctcccgcaggatgttcacctc

SEQ ID NO: 14211 - DNA, 25 bp, Homo sapien
gatgaggaccacgtccgtcttgttc

SEQ ID NO: 14212 - DNA, 25 bp, Homo sapien
ccgtccaggatctgcttgaggaact

SEQ ID NO: 14213 - DNA, 25 bp, Homo sapien
cgtcttgttctcgaagatgtcgtgc

SEQ ID NO: 14214 - DNA, 25 bp, Homo sapien
tgacctccactgtcctcgcaagatt

SEQ ID NO: 14215 - DNA, 25 bp, Homo sapien
acgctcctgaaagcccactttgcct

SEQ ID NO: 14216 - DNA, 25 bp, Homo sapien
gacgacgccttccacgctcctgaaa

SEQ ID NO: 14217 - DNA, 25 bp, Homo sapien
acctccactgtcctcgcaagattaa

SEQ ID NO: 14218 - DNA, 25 bp, Homo sapien
cactgtcctcgcaagattaacctct

SEQ ID NO: 14219 - DNA, 25 bp, Homo sapien
gtcctcgcaagattaacctcttcct

SEQ ID NO: 14220 - DNA, 25 bp, Homo sapien
tcctccacgctccatgtatcaaagt

SEQ ID NO: 14221 - DNA, 25 bp, Homo sapien
ccatctgagtctcctccaccgtcct

SEQ ID NO: 14222 - DNA, 25 bp, Homo sapien
cggatgcagcctcaccactggctga

SEQ ID NO: 14223 - DNA, 25 bp, Homo sapien
cgcctctcctctgacccaggtgctg

SEQ ID NO: 14224 - DNA, 25 bp, Homo sapien
cgacgctggtcaagcggacggaaaa

SEQ ID NO: 14225 - DNA, 25 bp, Homo sapien
attggctgcagtcgacgctggtcaa

SEQ ID NO: 14226 - DNA, 25 bp, Homo sapien
ccctgatttcattggctgcagtcga

SEQ ID NO: 14227 - DNA, 25 bp, Homo sapien
cactcgccatccctgatttcattgg

SEQ ID NO: 14228 - DNA, 25 bp, Homo sapien
tggctgaacactcgccatccctgat

SEQ ID NO: 14229 - DNA, 25 bp, Homo sapien
gcgaatggatggctcacctgtggcc

SEQ ID NO: 14230 - DNA, 25 bp, Homo sapien
ccttgcgcgtacgacagcaaacctg

SEQ ID NO: 14231 - DNA, 25 bp, Homo sapien
tgtgacgccacacgtagcagagagc

SEQ ID NO: 14232 - DNA, 25 bp, Homo sapien
cctccgcgatgtctgtccttttctt

SEQ ID NO: 14233 - DNA, 25 bp, Homo sapien
gcggaggagccttttagatgagccc

SEQ ID NO: 14234 - DNA, 25 bp, Homo sapien
taccgtaaaggtcgcagcagagccc

SEQ ID NO: 14235 - DNA, 25 bp, Homo sapien
ctgacaacagctactggcccagagg

SEQ ID NO: 14236 - DNA, 25 bp, Homo sapien
catcttggccgctacgtgtgacgcc

SEQ ID NO: 14237 - DNA, 25 bp, Homo sapien
gctggcttactctctctcggttgtc

SEQ ID NO: 14238 - DNA, 25 bp, Homo sapien
agcacgttcgactcttcactgaccg

SEQ ID NO: 14239 - DNA, 25 bp, Homo sapien
ctcgttgaggtactgcacacccttg

SEQ ID NO: 14240 - DNA, 25 bp, Homo sapien
tgaggtccctctagagcctggaaac

SEQ ID NO: 14241 - DNA, 25 bp, Homo sapien
accacactgtccttgatctcgttga

SEQ ID NO: 14242 - DNA, 25 bp, Homo sapien
agcaccagatcttgcgggcctcagc

SEQ ID NO: 14243 - DNA, 25 bp, Homo sapien
acctcgcctttatcgatgtcctcgg

SEQ ID NO: 14244 - DNA, 25 bp, Homo sapien
gcgccttcatgtacagccggttgtg

SEQ ID NO: 14245 - DNA, 25 bp, Homo sapien
tcacctccttggtggcccactggaa

SEQ ID NO: 14246 - DNA, 25 bp, Homo sapien
ggggacccactgcttacctgacacg

SEQ ID NO: 14247 - DNA, 25 bp, Homo sapien
gcggcgctgtcatcctcaagcaagg

SEQ ID NO: 14248 - DNA, 25 bp, Homo sapien
cagcacaggcttgatgcgctcggca

SEQ ID NO: 14249 - DNA, 25 bp, Homo sapien
gcgcggtccatcttgttcatcatca

SEQ ID NO: 14250 - DNA, 25 bp, Homo sapien
ccacgatgcgctggaaagtctggta

SEQ ID NO: 14251 - DNA, 25 bp, Homo sapien
tgacgttcacgttctccacgatgcg

SEQ ID NO: 14252 - DNA, 25 bp, Homo sapien
cctcgccgtaggtggagatgatgac

SEQ ID NO: 14253 - DNA, 25 bp, Homo sapien
accaatgcgccatcggtgactcgga

SEQ ID NO: 14254 - DNA, 25 bp, Homo sapien
agcgccgttttagctgagaacgaga

SEQ ID NO: 14255 - DNA, 25 bp, Homo sapien
gcgggttacataaggcgcctccctg

SEQ ID NO: 14256 - DNA, 25 bp, Homo sapien
tcagctttttataggcggacgccgg

SEQ ID NO: 14257 - DNA, 25 bp, Homo sapien
ggcgcggcgctctagaatagaagct

SEQ ID NO: 14258 - DNA, 25 bp, Homo sapien
gcggtggattctcccaggtagaacc

SEQ ID NO: 14259 - DNA, 25 bp, Homo sapien
ttatggcgccctcggaaacggagaa

SEQ ID NO: 14260 - DNA, 25 bp, Homo sapien
gctttgctcgttctgccattccctg

SEQ ID NO: 14261 - DNA, 25 bp, Homo sapien
gtgcacaaagtaaagagcgccgttt

SEQ ID NO: 14262 - DNA, 25 bp, Homo sapien
gccgtgatcacgcaggcagcagaga

SEQ ID NO: 14263 - DNA, 25 bp, Homo sapien
gcgacatcagcaaggccgtgtgtga

SEQ ID NO: 14264 - DNA, 25 bp, Homo sapien
cccggtgtagcacctggctcgggca

SEQ ID NO: 14265 - DNA, 25 bp, Homo sapien
caggacgggcctgacactagggacc

SEQ ID NO: 14266 - DNA, 25 bp, Homo sapien
ggcctgacactagggacctcgggcc

SEQ ID NO: 14267 - DNA, 25 bp, Homo sapien
cgtgtacacccgttgctcccaggag

SEQ ID NO: 14268 - DNA, 25 bp, Homo sapien
tcccaggaggcacacactgcggttc

SEQ ID NO: 14269 - DNA, 25 bp, Homo sapien
gaggcacacactgcggttcgcttcg

SEQ ID NO: 14270 - DNA, 25 bp, Homo sapien
accactttaaggagtcaggcgccgc

SEQ ID NO: 14271 - DNA, 25 bp, Homo sapien
ttccctccctagaggaaaccgagca

SEQ ID NO: 14272 - DNA, 25 bp, Homo sapien
ctcactgtacgcactggcggccgtt

SEQ ID NO: 14273 - DNA, 25 bp, Homo sapien
agctgcattgttgtcgctgccaccg

SEQ ID NO: 14274 - DNA, 25 bp, Homo sapien
atctgcacaccaggacccggatgtg

SEQ ID NO: 14275 - DNA, 25 bp, Homo sapien
ctgcgcagggctagtaccactttaa

SEQ ID NO: 14276 - DNA, 25 bp, Homo sapien
gccacggcacctagctgcattgttg

SEQ ID NO: 14277 - DNA, 25 bp, Homo sapien
gttgagctactcgttgccctcttgg

SEQ ID NO: 14278 - DNA, 25 bp, Homo sapien
cgaccagctcatcatcgacgggtga

SEQ ID NO: 14279 - DNA, 25 bp, Homo sapien
cacacagcgaagcttgggactcatc

SEQ ID NO: 14280 - DNA, 25 bp, Homo sapien
tcagtgccggagagaactcgaatca

SEQ ID NO: 14281 - DNA, 25 bp, Homo sapien
gtgtccctcatctgtccggtgagtc

SEQ ID NO: 14282 - DNA, 25 bp, Homo sapien
ctccgtgttcctgaggcatgagtga

SEQ ID NO: 14283 - DNA, 25 bp, Homo sapien
tgcagtgcttcgacgccgtcttcta

SEQ ID NO: 14284 - DNA, 25 bp, Homo sapien
cgagaagaagcccacctggatgtgc

SEQ ID NO: 14285 - DNA, 25 bp, Homo sapien
gagaagctgcgccttgatcctgaca

SEQ ID NO: 14286 - DNA, 25 bp, Homo sapien
gttttagccgagaagccatggagtg

SEQ ID NO: 14287 - DNA, 25 bp, Homo sapien
tggacagctcatcgtcctcggagga

SEQ ID NO: 14288 - DNA, 25 bp, Homo sapien
ggccgcacactcgactttcctggtg

SEQ ID NO: 14289 - DNA, 25 bp, Homo sapien
tttcctggtgctcaccacgcagagg

SEQ ID NO: 14290 - DNA, 25 bp, Homo sapien
tgtacctctggactctcctatcggg

SEQ ID NO: 14291 - DNA, 25 bp, Homo sapien
tgcaaatgcatcctcgcccagagac

SEQ ID NO: 14292 - DNA, 25 bp, Homo sapien
tggtattttgaagacccggcgtgtg

SEQ ID NO: 14293 - DNA, 25 bp, Homo sapien
tctggcgaccactttgacgtttgtc

SEQ ID NO: 14294 - DNA, 25 bp, Homo sapien
cggtgggccgcagcccttgttccta

SEQ ID NO: 14295 - DNA, 25 bp, Homo sapien
ccgaggtctgtgtaagtgtcgcggt

SEQ ID NO: 14296 - DNA, 25 bp, Homo sapien
ggtttagtgcaatccccgaggtctg

SEQ ID NO: 14297 - DNA, 25 bp, Homo sapien
ctaggaacgagggtttagtgcaatc

SEQ ID NO: 14298 - DNA, 25 bp, Homo sapien
aagctgagtgcggagctaggaacga

SEQ ID NO: 14299 - DNA, 25 bp, Homo sapien
ccggctctgggcccatgcagaggct

SEQ ID NO: 14300 - DNA, 25 bp, Homo sapien
atacagtatgtgattgcgcggagtc

SEQ ID NO: 14301 - DNA, 25 bp, Homo sapien
cgattcacgtctatatacagtatgt

SEQ ID NO: 14302 - DNA, 25 bp, Homo sapien
gcacgcgcatgtggttcttcaggtc

SEQ ID NO: 14303 - DNA, 25 bp, Homo sapien
cgagtccggctgtgaagttaccgtc

SEQ ID NO: 14304 - DNA, 25 bp, Homo sapien
ccgtctttcttgaggtgtctgtgca

SEQ ID NO: 14305 - DNA, 25 bp, Homo sapien
tcttcaggtcgtagttgtgggcaaa

SEQ ID NO: 14306 - DNA, 25 bp, Homo sapien
tgcttccgcatgtgcaccttcagct

SEQ ID NO: 14307 - DNA, 25 bp, Homo sapien
aacacggaccgtgcaccagaggttt

SEQ ID NO: 14308 - DNA, 25 bp, Homo sapien
tggatcatcacccttgcagaacacg

SEQ ID NO: 14309 - DNA, 25 bp, Homo sapien
ctcgtcctcgtccttaaagtgcttc

SEQ ID NO: 14310 - DNA, 25 bp, Homo sapien
cggcgctgacgaagtcgatctcgta

SEQ ID NO: 14311 - DNA, 25 bp, Homo sapien
ggtagtagtccatgacgcccttgtc

SEQ ID NO: 14312 - DNA, 25 bp, Homo sapien
ctccttggtggcatccaggtcatca

SEQ ID NO: 14313 - DNA, 25 bp, Homo sapien
tcatggggttgctctggaagaactc

SEQ ID NO: 14314 - DNA, 25 bp, Homo sapien
atgtcacccacgttggctgtgctga

SEQ ID NO: 14315 - DNA, 25 bp, Homo sapien
atctcgtacacgttctgctggtcca

SEQ ID NO: 14316 - DNA, 25 bp, Homo sapien
gcgcccgacgtgaacagcttcttga

SEQ ID NO: 14317 - DNA, 25 bp, Homo sapien
tgatctacaaggtccagctgcccgg

SEQ ID NO: 14318 - DNA, 25 bp, Homo sapien
tcgctcatcttctacaacgtcaaca

SEQ ID NO: 14319 - DNA, 25 bp, Homo sapien
tcatggcctacctgtactccaggtg

SEQ ID NO: 14320 - DNA, 25 bp, Homo sapien
tacaacgtcaacaagcacccgggcg

SEQ ID NO: 14321 - DNA, 25 bp, Homo sapien
ccagtgatcgtgaacatcgcggccg

SEQ ID NO: 14322 - DNA, 25 bp, Homo sapien
tgcaccctcccagtgatcgtgaaca

SEQ ID NO: 14323 - DNA, 25 bp, Homo sapien
ctccggcaggtcatgtacgcggaac

SEQ ID NO: 14324 - DNA, 25 bp, Homo sapien
actccaggtgcgttgggagaaaagc

SEQ ID NO: 14325 - DNA, 25 bp, Homo sapien
gcgttgggagaaaagctcacccgga

SEQ ID NO: 14326 - DNA, 25 bp, Homo sapien
tgcctcggtttatccggagccggcg

SEQ ID NO: 14327 - DNA, 25 bp, Homo sapien
gaaatgacccttcgctggccctggg

SEQ ID NO: 14328 - DNA, 25 bp, Homo sapien
ggctgaatgcggaaggaaatgaccc

SEQ ID NO: 14329 - DNA, 25 bp, Homo sapien
tggggcggcgaagcatcttcaccac

SEQ ID NO: 14330 - DNA, 25 bp, Homo sapien
ccgcgctccggctgcaatttaaata

SEQ ID NO: 14331 - DNA, 25 bp, Homo sapien
gggcagtctcggcacattttgcgca

SEQ ID NO: 14332 - DNA, 25 bp, Homo sapien
agatccgccaagacaggagcgctgg

SEQ ID NO: 14333 - DNA, 25 bp, Homo sapien
tccacagaggaaatccggcctggcc

SEQ ID NO: 14334 - DNA, 25 bp, Homo sapien
ctccgtgggatttccggggctgctt

SEQ ID NO: 14335 - DNA, 25 bp, Homo sapien
cccgcgctggcctccgtgggatttc

SEQ ID NO: 14336 - DNA, 25 bp, Homo sapien
gctgcttggtgctgactcggcggcc

SEQ ID NO: 14337 - DNA, 25 bp, Homo sapien
cccatctttcatcacagctcctccc

SEQ ID NO: 14338 - DNA, 25 bp, Homo sapien
cacggtacacgcctccggaggtggc

SEQ ID NO: 14339 - DNA, 25 bp, Homo sapien
acacacggtacacgcctccggaggt

SEQ ID NO: 14340 - DNA, 25 bp, Homo sapien
gacacacggtacacgcctccggagg

SEQ ID NO: 14341 - DNA, 25 bp, Homo sapien
acccggggccccatctttcatcaca

SEQ ID NO: 14342 - DNA, 25 bp, Homo sapien
tggaaacttagcaggcgacgcgccc

SEQ ID NO: 14343 - DNA, 25 bp, Homo sapien
tggcgcacaagctcatgcacttagc

SEQ ID NO: 14344 - DNA, 25 bp, Homo sapien
cgaaaagccatgcacccgggttggg

SEQ ID NO: 14345 - DNA, 25 bp, Homo sapien
tggccaactccaacgtatgcacgca

SEQ ID NO: 14346 - DNA, 25 bp, Homo sapien
tatgcacgcagcaccgaataggccc

SEQ ID NO: 14347 - DNA, 25 bp, Homo sapien
actacgaagcccagaggtccctgcg

SEQ ID NO: 14348 - DNA, 25 bp, Homo sapien
gacttgtagtccaagccgcttgcca

SEQ ID NO: 14349 - DNA, 25 bp, Homo sapien
catggagctcaatcctggccaactc

SEQ ID NO: 14350 - DNA, 25 bp, Homo sapien
gatgtcctctccgtgctgggctgaa

SEQ ID NO: 14351 - DNA, 25 bp, Homo sapien
ctccgtgctgggctgaagcaaagcc

SEQ ID NO: 14352 - DNA, 25 bp, Homo sapien
acgccgaacggaagaaagaagcagg

SEQ ID NO: 14353 - DNA, 25 bp, Homo sapien
gatggcgcggtttgctttttctctc

SEQ ID NO: 14354 - DNA, 25 bp, Homo sapien
cccgttcctgcatgcgctgtcgccc

SEQ ID NO: 14355 - DNA, 25 bp, Homo sapien
aaccagccggcaaaatccacttctt

SEQ ID NO: 14356 - DNA, 25 bp, Homo sapien
ggtcagctcagggatgtcctctccg

SEQ ID NO: 14357 - DNA, 25 bp, Homo sapien
ggctgaagcaaagcccagcacccaa

SEQ ID NO: 14358 - DNA, 25 bp, Homo sapien
tgggccttacctcggtgcatgatct

SEQ ID NO: 14359 - DNA, 25 bp, Homo sapien
gggccttacctcggtgcatgatctg

SEQ ID NO: 14360 - DNA, 25 bp, Homo sapien
ctgggccttacctcggtgcatgatc

SEQ ID NO: 14361 - DNA, 25 bp, Homo sapien
gctgggccttacctcggtgcatgat

SEQ ID NO: 14362 - DNA, 25 bp, Homo sapien
cgggctgggccttacctcggtgcat

SEQ ID NO: 14363 - DNA, 25 bp, Homo sapien
gcgcccaacagttgcctgccggccc

SEQ ID NO: 14364 - DNA, 25 bp, Homo sapien
aggggcgcccaacagttgcctgccg

SEQ ID NO: 14365 - DNA, 25 bp, Homo sapien
tgaggggcgcccaacagttgcctgc

SEQ ID NO: 14366 - DNA, 25 bp, Homo sapien
tgcatgatctggtgcttctctcgga

SEQ ID NO: 14367 - DNA, 25 bp, Homo sapien
cccacgaaggagttggccatggagt

SEQ ID NO: 14368 - DNA, 25 bp, Homo sapien
tgcttctctcggaggtacgccaagc

SEQ ID NO: 14369 - DNA, 25 bp, Homo sapien
atggagtcgatgagctggccgctca

SEQ ID NO: 14370 - DNA, 25 bp, Homo sapien
cctctagagttcacgaggatgttgg

SEQ ID NO: 14371 - DNA, 25 bp, Homo sapien
cacgaggatgttggagggcttcaca

SEQ ID NO: 14372 - DNA, 25 bp, Homo sapien
tcggtgcatgatctggtgcttctct

SEQ ID NO: 14373 - DNA, 25 bp, Homo sapien
gcgtgcccacgaaggagttggccat

SEQ ID NO: 14374 - DNA, 25 bp, Homo sapien
cgaaggggcactgagcgttttttct

SEQ ID NO: 14375 - DNA, 25 bp, Homo sapien
tactgccgcctctattcgctgagcg

SEQ ID NO: 14376 - DNA, 25 bp, Homo sapien
agcgtgcgggctgacacctactgcc

SEQ ID NO: 14377 - DNA, 25 bp, Homo sapien
cgcgccacgtgcagagatctgcctg

SEQ ID NO: 14378 - DNA, 25 bp, Homo sapien
tgagcccgtctctcagacgaggaaa

SEQ ID NO: 14379 - DNA, 25 bp, Homo sapien
caatacggtgtcaaacggcgaaggg

SEQ ID NO: 14380 - DNA, 25 bp, Homo sapien
gcagatgtcgccaatacggtgtcaa

SEQ ID NO: 14381 - DNA, 25 bp, Homo sapien
ccctgcaggagatcgtcaacttcaa

SEQ ID NO: 14382 - DNA, 25 bp, Homo sapien
acacgcacggtctgctgaaaccaca

SEQ ID NO: 14383 - DNA, 25 bp, Homo sapien
tgctatggacaaggtgcaagctcca

SEQ ID NO: 14384 - DNA, 25 bp, Homo sapien
tgctgaaaccacacggctctacgga

SEQ ID NO: 14385 - DNA, 25 bp, Homo sapien
ggacaaggtgcaagctccaagaagc

SEQ ID NO: 14386 - DNA, 25 bp, Homo sapien
gtgtcttaatccaacactggtatgg

SEQ ID NO: 14387 - DNA, 25 bp, Homo sapien
gcatgcgtcctgtgtcttaatccaa

SEQ ID NO: 14388 - DNA, 25 bp, Homo sapien
tccaagaagcaacacgcacggtctg

SEQ ID NO: 14389 - DNA, 25 bp, Homo sapien
tggcagcatgcgtcctgtgtcttaa

SEQ ID NO: 14390 - DNA, 25 bp, Homo sapien
gtcccatcctcgaatcagttgcgtg

SEQ ID NO: 14391 - DNA, 25 bp, Homo sapien
cggccaggctggagaccagcgtctt

SEQ ID NO: 14392 - DNA, 25 bp, Homo sapien
aggtcgccacggcagaggctctgct

SEQ ID NO: 14393 - DNA, 25 bp, Homo sapien
aatcagttgcgtgactcggccctcc

SEQ ID NO: 14394 - DNA, 25 bp, Homo sapien
gtcctcttcccagcacacgaaggga

SEQ ID NO: 14395 - DNA, 25 bp, Homo sapien
agttctgcctttgggtctgaacacc

SEQ ID NO: 14396 - DNA, 25 bp, Homo sapien
cagggcgtcttctgacagttctgcc

SEQ ID NO: 14397 - DNA, 25 bp, Homo sapien
tggtctgcctcctgacgggaagcag

SEQ ID NO: 14398 - DNA, 25 bp, Homo sapien
tgccttgctcgggtcacatggctac

SEQ ID NO: 14399 - DNA, 25 bp, Homo sapien
aggcggtctgatacctgatgagctc

SEQ ID NO: 14400 - DNA, 25 bp, Homo sapien
tctggttttgcaaacgacgctgtgc

SEQ ID NO: 14401 - DNA, 25 bp, Homo sapien
gggtgtcacccaagcattctggttt

SEQ ID NO: 14402 - DNA, 25 bp, Homo sapien
atcgcacgtttgcagggtgtcaccc

SEQ ID NO: 14403 - DNA, 25 bp, Homo sapien
gggccttgctcaaattcacttcctg

SEQ ID NO: 14404 - DNA, 25 bp, Homo sapien
ccaggtctccctcgcaggcgggaaa

SEQ ID NO: 14405 - DNA, 25 bp, Homo sapien
caaaactgtcaaaggggatcgcacg

SEQ ID NO: 14406 - DNA, 25 bp, Homo sapien
ttctcgcgataacgggatcgggagc

SEQ ID NO: 14407 - DNA, 25 bp, Homo sapien
tcgcttgccttaccacggcgcgtgt

SEQ ID NO: 14408 - DNA, 25 bp, Homo sapien
ctgcctcgtgcactcctcgcgaacc

SEQ ID NO: 14409 - DNA, 25 bp, Homo sapien
ccgaggcccgaagaaggctgacgcc

SEQ ID NO: 14410 - DNA, 25 bp, Homo sapien
gaagaaggctgacgccgcagcccga

SEQ ID NO: 14411 - DNA, 25 bp, Homo sapien
ggaccggcttctcgcgataacggga

SEQ ID NO: 14412 - DNA, 25 bp, Homo sapien
tgcgcagcagcacaaggccgccttt

SEQ ID NO: 14413 - DNA, 25 bp, Homo sapien
cggccacaagatcgcggaccggctt

SEQ ID NO: 14414 - DNA, 25 bp, Homo sapien
gggagagtggaacccggctgctcct

SEQ ID NO: 14415 - DNA, 25 bp, Homo sapien
tgcccgggcgccatcgcaaaatcgc

SEQ ID NO: 14416 - DNA, 25 bp, Homo sapien
agaggcgccgggcacgacttcagca

SEQ ID NO: 14417 - DNA, 25 bp, Homo sapien
aggcgtggcgcttccaaggtgtccc

SEQ ID NO: 14418 - DNA, 25 bp, Homo sapien
ccaaggtgtcccctccggagttgcg

SEQ ID NO: 14419 - DNA, 25 bp, Homo sapien
gcgaggacaccgaggcgtcggaagt

SEQ ID NO: 14420 - DNA, 25 bp, Homo sapien
ctgctcctgcgctcgtctgtggggt

SEQ ID NO: 14421 - DNA, 25 bp, Homo sapien
accctgctcattttgcgggcgagga

SEQ ID NO: 14422 - DNA, 25 bp, Homo sapien
tgcctttgtgtgtccgtggctttgc

SEQ ID NO: 14423 - DNA, 25 bp, Homo sapien
cccgcgcttcttggaaagagtgtga

SEQ ID NO: 14424 - DNA, 25 bp, Homo sapien
aaagagtgtgatccagagttgcgtc

SEQ ID NO: 14425 - DNA, 25 bp, Homo sapien
gacaggctccgctttgagacccact

SEQ ID NO: 14426 - DNA, 25 bp, Homo sapien
tgggagcctcacatacacaggtttc

SEQ ID NO: 14427 - DNA, 25 bp, Homo sapien
acacaggtttcaactgggacggcca

SEQ ID NO: 14428 - DNA, 25 bp, Homo sapien
cgtgcatctcacgtttgtgggtctt

SEQ ID NO: 14429 - DNA, 25 bp, Homo sapien
ggtctttgtgcggacacgtgcatct

SEQ ID NO: 14430 - DNA, 25 bp, Homo sapien
acttgcccttgtccgcgtacggcga

SEQ ID NO: 14431 - DNA, 25 bp, Homo sapien
gtaattcaccgacatcctcgactgc

SEQ ID NO: 14432 - DNA, 25 bp, Homo sapien
tttcccttgttgaggccgcttccgc

SEQ ID NO: 14433 - DNA, 25 bp, Homo sapien
aggaaccgcgttccagtcctgcgca

SEQ ID NO: 14434 - DNA, 25 bp, Homo sapien
acgccgcaggcgacatgttatctgc

SEQ ID NO: 14435 - DNA, 25 bp, Homo sapien
tatctgctgtcagaaggaagcctgc

SEQ ID NO: 14436 - DNA, 25 bp, Homo sapien
tgcctctttgcatgcaggtgtttgc

SEQ ID NO: 14437 - DNA, 25 bp, Homo sapien
cccgacagggtgaccacagagttgg

SEQ ID NO: 14438 - DNA, 25 bp, Homo sapien
cctacctgggtcttcccattccatc

SEQ ID NO: 14439 - DNA, 25 bp, Homo sapien
tgcgcagccgcctccttcgcggtag

SEQ ID NO: 14440 - DNA, 25 bp, Homo sapien
ccatgaagcagctgtgtctgtgcgc

SEQ ID NO: 14441 - DNA, 25 bp, Homo sapien
tcttcccattccatcccgtggggga

SEQ ID NO: 14442 - DNA, 25 bp, Homo sapien
catcctccaggcgacaaggtcagga

SEQ ID NO: 14443 - DNA, 25 bp, Homo sapien
gcccggaggcacctgcgcgcccttg

SEQ ID NO: 14444 - DNA, 25 bp, Homo sapien
tccagacccgggaaagatggtcggc

SEQ ID NO: 14445 - DNA, 25 bp, Homo sapien
ccggacgccatgaagcagctgtgtc

SEQ ID NO: 14446 - DNA, 25 bp, Homo sapien
gcgctctcggagcacgaacgcatcg

SEQ ID NO: 14447 - DNA, 25 bp, Homo sapien
cagcgtggcgctctcggagcacgaa

SEQ ID NO: 14448 - DNA, 25 bp, Homo sapien
ctccgagaccgggactcccgcctgc

SEQ ID NO: 14449 - DNA, 25 bp, Homo sapien
gctggaggttctgcgggagcagctg

SEQ ID NO: 14450 - DNA, 25 bp, Homo sapien
actgggccgggcacgggacgccgct

SEQ ID NO: 14451 - DNA, 25 bp, Homo sapien
aggccctccgccagtccgtggtgcc

SEQ ID NO: 14452 - DNA, 25 bp, Homo sapien
ctctgagcaccgccggctgcaggag

SEQ ID NO: 14453 - DNA, 25 bp, Homo sapien
cagccagtctggagcaggaggtggt

SEQ ID NO: 14454 - DNA, 25 bp, Homo sapien
cgactggggcttttcaatcggagca

SEQ ID NO: 14455 - DNA, 25 bp, Homo sapien
caaaattttaacgagccgctgcccg

SEQ ID NO: 14456 - DNA, 25 bp, Homo sapien
gggcgcagcgcactatacaaaattc

SEQ ID NO: 14457 - DNA, 25 bp, Homo sapien
tggctcccggaatccttatttcgcg

SEQ ID NO: 14458 - DNA, 25 bp, Homo sapien
tttcgcgctactcaggttgcaactc

SEQ ID NO: 14459 - DNA, 25 bp, Homo sapien
gtgacgtttgcggaagtaaggcttc

SEQ ID NO: 14460 - DNA, 25 bp, Homo sapien
ttccgtcggaaaagctcgataatta

SEQ ID NO: 14461 - DNA, 25 bp, Homo sapien
catttctcaggtgcttgcgaggtga

SEQ ID NO: 14462 - DNA, 25 bp, Homo sapien
cgtgtcgctccagggaaccgcgctg

SEQ ID NO: 14463 - DNA, 25 bp, Homo sapien
cgggcgtcccggtcagtgtccagct

SEQ ID NO: 14464 - DNA, 25 bp, Homo sapien
cccagaacagctgaaggtctcagtc

SEQ ID NO: 14465 - DNA, 25 bp, Homo sapien
tcagtcacctccgaggggagcgcag

SEQ ID NO: 14466 - DNA, 25 bp, Homo sapien
gaaagtctctccgaaagcgtgaagg

SEQ ID NO: 14467 - DNA, 25 bp, Homo sapien
ttatttccctttgtgcgggtggctg

SEQ ID NO: 14468 - DNA, 25 bp, Homo sapien
agcgcgacaaaggatgcgtcccgcc

SEQ ID NO: 14469 - DNA, 25 bp, Homo sapien
ccaggaagggatcccggagcttcct

SEQ ID NO: 14470 - DNA, 25 bp, Homo sapien
tgcagagacctcatggccctcaagg

SEQ ID NO: 14471 - DNA, 25 bp, Homo sapien
ttcagcgtgcctgacgcagccaaga

SEQ ID NO: 14472 - DNA, 25 bp, Homo sapien
ccaagagcaaaagcccagctgcagt

SEQ ID NO: 14473 - DNA, 25 bp, Homo sapien
tgcgcagaagcacaggccaagaccc

SEQ ID NO: 14474 - DNA, 25 bp, Homo sapien
ccagggcatgagcaattcaaccgca

SEQ ID NO: 14475 - DNA, 25 bp, Homo sapien
ggctgagttcctaggccctgcatga

SEQ ID NO: 14476 - DNA, 25 bp, Homo sapien
cctgcatgaccagaccagggcatga

SEQ ID NO: 14477 - DNA, 25 bp, Homo sapien
ttcaaccgcatacacggagctcagc

SEQ ID NO: 14478 - DNA, 25 bp, Homo sapien
ggcaagcactgtgtgcgcacccgcg

SEQ ID NO: 14479 - DNA, 25 bp, Homo sapien
gcgctccctgtgcacacgctaacgc

SEQ ID NO: 14480 - DNA, 25 bp, Homo sapien
ctctcccgcaggcaagaagaattcc

SEQ ID NO: 14481 - DNA, 25 bp, Homo sapien
cagtccgcccagaagccatagacga

SEQ ID NO: 14482 - DNA, 25 bp, Homo sapien
gcccagaagccatagacgagacgta

SEQ ID NO: 14483 - DNA, 25 bp, Homo sapien
cagaagccatagacgagacgtaggt

SEQ ID NO: 14484 - DNA, 25 bp, Homo sapien
ctcggtgcccgctgtacgcagcagg

SEQ ID NO: 14485 - DNA, 25 bp, Homo sapien
cacccgcggtgcagagtaggtgctc

SEQ ID NO: 14486 - DNA, 25 bp, Homo sapien
tggcgcccacgcagtcagcaagaaa

SEQ ID NO: 14487 - DNA, 25 bp, Homo sapien
acatcctcaggacaggccaaggtga

SEQ ID NO: 14488 - DNA, 25 bp, Homo sapien
aggggccaccaagcacccatgaagc

SEQ ID NO: 14489 - DNA, 25 bp, Homo sapien
cgcacctggggaaagtcgctcagct

SEQ ID NO: 14490 - DNA, 25 bp, Homo sapien
ccaacgtgttcgcagcgcgacatgc

SEQ ID NO: 14491 - DNA, 25 bp, Homo sapien
ggcacacccgtctgagttttaaatg

SEQ ID NO: 14492 - DNA, 25 bp, Homo sapien
ccgtccacttgcttagggagtcctg

SEQ ID NO: 14493 - DNA, 25 bp, Homo sapien
gtcagcaagaaacgcccaagcccta

SEQ ID NO: 14494 - DNA, 25 bp, Homo sapien
gaggccagcgcggaactacatttcc

SEQ ID NO: 14495 - DNA, 25 bp, Homo sapien
gggccaggcacgtgccttctacgcc

SEQ ID NO: 14496 - DNA, 25 bp, Homo sapien
ccacatcttggcttggggccaggca

SEQ ID NO: 14497 - DNA, 25 bp, Homo sapien
tgggctgcagccatggaagaacaga

SEQ ID NO: 14498 - DNA, 25 bp, Homo sapien
ctaccggccgcggcaaaggcagctt

SEQ ID NO: 14499 - DNA, 25 bp, Homo sapien
ctcggcgggccattggctaccggcc

SEQ ID NO: 14500 - DNA, 25 bp, Homo sapien
aatgcgcgcggtgatggagcgctaa

SEQ ID NO: 14501 - DNA, 25 bp, Homo sapien
tgcccagtatcccagtcccatccct

SEQ ID NO: 14502 - DNA, 25 bp, Homo sapien
cttcgagcaactgggcaagacggcc

SEQ ID NO: 14503 - DNA, 25 bp, Homo sapien
ctacgagccggacagcaaggcgttc

SEQ ID NO: 14504 - DNA, 25 bp, Homo sapien
tggtgcctgcacgtcaacaattggc

SEQ ID NO: 14505 - DNA, 25 bp, Homo sapien
cacgtcaacaattggctgcaggtca

SEQ ID NO: 14506 - DNA, 25 bp, Homo sapien
ctgcaggtcagcttcacggccaagc

SEQ ID NO: 14507 - DNA, 25 bp, Homo sapien
cgccacaggggacacgctgatcgac

SEQ ID NO: 14508 - DNA, 25 bp, Homo sapien
tcacggccaagcacgccaacaaggt

SEQ ID NO: 14509 - DNA, 25 bp, Homo sapien
agcattactgggaggtgcgctacga

SEQ ID NO: 14510 - DNA, 25 bp, Homo sapien
ctcgtctaacaggaatggcaccagc

SEQ ID NO: 14511 - DNA, 25 bp, Homo sapien
tcaccttgtaatgccggaccacgtg

SEQ ID NO: 14512 - DNA, 25 bp, Homo sapien
catcgatcacgtacttggggccctc

SEQ ID NO: 14513 - DNA, 25 bp, Homo sapien
ccggctgttccacatcgatcacgta

SEQ ID NO: 14514 - DNA, 25 bp, Homo sapien
ttctagggactctggcccaacgctc

SEQ ID NO: 14515 - DNA, 25 bp, Homo sapien
agcgcctttttggtatgcgacacga

SEQ ID NO: 14516 - DNA, 25 bp, Homo sapien
agcaccttctcgtagtcctcgtcta

SEQ ID NO: 14517 - DNA, 25 bp, Homo sapien
acgaaatagttgaccacggcgtcca

SEQ ID NO: 14518 - DNA, 25 bp, Homo sapien
caggttcccgcactcggggtagcgc

SEQ ID NO: 14519 - DNA, 25 bp, Homo sapien
ccgcactcggggtagcgctccagga

SEQ ID NO: 14520 - DNA, 25 bp, Homo sapien
cgctccaggagcagttgtgcctcca

SEQ ID NO: 14521 - DNA, 25 bp, Homo sapien
agcagttgtgcctccagccggctca

SEQ ID NO: 14522 - DNA, 25 bp, Homo sapien
ggctcaccttcaggaagcacctgtg

SEQ ID NO: 14523 - DNA, 25 bp, Homo sapien
cggagaccaagtccgctcttctgca

SEQ ID NO: 14524 - DNA, 25 bp, Homo sapien
atgcgcacccgttgtgcatctgccg

SEQ ID NO: 14525 - DNA, 25 bp, Homo sapien
atctgccgcgtggtgaccgacacgc

SEQ ID NO: 14526 - DNA, 25 bp, Homo sapien
tgtttgctttatgcggccagtccct

SEQ ID NO: 14527 - DNA, 25 bp, Homo sapien
cggatgccatcacgctgggcgggct

SEQ ID NO: 14528 - DNA, 25 bp, Homo sapien
ttcccgcccaccagactaccctcgc

SEQ ID NO: 14529 - DNA, 25 bp, Homo sapien
ctgcgctgtttgctttatgcggcca

SEQ ID NO: 14530 - DNA, 25 bp, Homo sapien
ccaaagtgggctgcgctgtttgctt

SEQ ID NO: 14531 - DNA, 25 bp, Homo sapien
tcgtgctcacgcatggccagacacc

SEQ ID NO: 14532 - DNA, 25 bp, Homo sapien
ccagccataaggagagcggaagccc

SEQ ID NO: 14533 - DNA, 25 bp, Homo sapien
tggcctcctgccagccataaggaga

SEQ ID NO: 14534 - DNA, 25 bp, Homo sapien
gtgctgtccatctactacctggtga

SEQ ID NO: 14535 - DNA, 25 bp, Homo sapien
ccggggtgctgtccatctactacct

SEQ ID NO: 14536 - DNA, 25 bp, Homo sapien
ttgcaacctctatccctggacagcg

SEQ ID NO: 14537 - DNA, 25 bp, Homo sapien
attcgcaccaatgagctcccggtca

SEQ ID NO: 14538 - DNA, 25 bp, Homo sapien
cctcagtttcccgaatgttcccaga

SEQ ID NO: 14539 - DNA, 25 bp, Homo sapien
ttcccgaatgttcccagagggctga

SEQ ID NO: 14540 - DNA, 25 bp, Homo sapien
tcacactgcgggtgctcctcaaaga

SEQ ID NO: 14541 - DNA, 25 bp, Homo sapien
cactgcgggtgctcctcaaagacgc

SEQ ID NO: 14542 - DNA, 25 bp, Homo sapien
tcgttctcgggctcgaagtcgtaca

SEQ ID NO: 14543 - DNA, 25 bp, Homo sapien
agtcactgcggcaggggcacaagca

SEQ ID NO: 14544 - DNA, 25 bp, Homo sapien
ttctcatcgatctggttggtcagcg

SEQ ID NO: 14545 - DNA, 25 bp, Homo sapien
atgccctcgtaccagttctcatcga

SEQ ID NO: 14546 - DNA, 25 bp, Homo sapien
gaagaagcccgactggccgtccagc

SEQ ID NO: 14547 - DNA, 25 bp, Homo sapien
cctccacgtagctgagcgggaagaa

SEQ ID NO: 14548 - DNA, 25 bp, Homo sapien
aggggcacaagcacctccacgtagc

SEQ ID NO: 14549 - DNA, 25 bp, Homo sapien
gcgtgatgacgtcgccctcatggaa

SEQ ID NO: 14550 - DNA, 25 bp, Homo sapien
tggtgtctgcctgcccgtcggcatc

SEQ ID NO: 14551 - DNA, 25 bp, Homo sapien
tgctgtggtgctgcacgctgtgcta

SEQ ID NO: 14552 - DNA, 25 bp, Homo sapien
acgctgtgctacagagccatctccg

SEQ ID NO: 14553 - DNA, 25 bp, Homo sapien
ctgtgctacagagccatctccgcgt

SEQ ID NO: 14554 - DNA, 25 bp, Homo sapien
ctgcagtcctcctcagcggaatctg

SEQ ID NO: 14555 - DNA, 25 bp, Homo sapien
cagtcctcctcagcggaatctgtga

SEQ ID NO: 14556 - DNA, 25 bp, Homo sapien
tgagcgcacagaccacaggggcctc

SEQ ID NO: 14557 - DNA, 25 bp, Homo sapien
cctcagcggaatctgtgagcgcaca

SEQ ID NO: 14558 - DNA, 25 bp, Homo sapien
ctgaagagcgcacgtgcacattgtc

SEQ ID NO: 14559 - DNA, 25 bp, Homo sapien
tggaggtgaccctaacgtcttggaa

SEQ ID NO: 14560 - DNA, 25 bp, Homo sapien
cgtgcacattgtctaccgcgggaga

SEQ ID NO: 14561 - DNA, 25 bp, Homo sapien
attacatggcaaccgcacgcttccg

SEQ ID NO: 14562 - DNA, 25 bp, Homo sapien
ccgcgcggccaggatattacatggc

SEQ ID NO: 14563 - DNA, 25 bp, Homo sapien
ctggcaggggacacgcgccaacgtc

SEQ ID NO: 14564 - DNA, 25 bp, Homo sapien
ccttggtcttcccacctggcagggg

SEQ ID NO: 14565 - DNA, 25 bp, Homo sapien
ggccgcctctgtcagtgagttgagc

SEQ ID NO: 14566 - DNA, 25 bp, Homo sapien
gcttttgcgtcagttcgtccctcca

SEQ ID NO: 14567 - DNA, 25 bp, Homo sapien
aagtcacggatctcgcgaggatgcc

SEQ ID NO: 14568 - DNA, 25 bp, Homo sapien
acgtgacccgggctcgcccaattgg

SEQ ID NO: 14569 - DNA, 25 bp, Homo sapien
cggttcccgccaaatacgagcgcgg

SEQ ID NO: 14570 - DNA, 25 bp, Homo sapien
aagggcacccttgttgacgttattg

SEQ ID NO: 14571 - DNA, 25 bp, Homo sapien
gacgttattgttgtagccgcgacca

SEQ ID NO: 14572 - DNA, 25 bp, Homo sapien
tagccgcgaccatattgtttgtttc

SEQ ID NO: 14573 - DNA, 25 bp, Homo sapien
cggatatgtcaatgggcgagccctg

SEQ ID NO: 14574 - DNA, 25 bp, Homo sapien
ttcaaggccaggttctcgtcctcgg

SEQ ID NO: 14575 - DNA, 25 bp, Homo sapien
ccaggcagttcgaactgcgaggcca

SEQ ID NO: 14576 - DNA, 25 bp, Homo sapien
tctgctgtgaggttgaagaagtccc

SEQ ID NO: 14577 - DNA, 25 bp, Homo sapien
gcgcagcagcgtgtagttgtacttg

SEQ ID NO: 14578 - DNA, 25 bp, Homo sapien
ccgctcccgagcgtagaaagtgcct

SEQ ID NO: 14579 - DNA, 25 bp, Homo sapien
ctcccgaggccagcagctcaaaagg

SEQ ID NO: 14580 - DNA, 25 bp, Homo sapien
gcccgcactcgttcaaggccaggtt

SEQ ID NO: 14581 - DNA, 25 bp, Homo sapien
gctcaaaaggcagccagtcgctctg

SEQ ID NO: 14582 - DNA, 25 bp, Homo sapien
gaggctgcataagaaaccacgagtc

SEQ ID NO: 14583 - DNA, 25 bp, Homo sapien
actctcggagcacgggcttaagttg

SEQ ID NO: 14584 - DNA, 25 bp, Homo sapien
taagagccctaaacaccacacctgg

SEQ ID NO: 14585 - DNA, 25 bp, Homo sapien
aaccgccgagagagggttcctcgca

SEQ ID NO: 14586 - DNA, 25 bp, Homo sapien
cccaggtgcaaagaggcaaaggtca

SEQ ID NO: 14587 - DNA, 25 bp, Homo sapien
ctggccgtctccctttgtgttacct

SEQ ID NO: 14588 - DNA, 25 bp, Homo sapien
cggaagtagactcccaggatgcagc

SEQ ID NO: 14589 - DNA, 25 bp, Homo sapien
cgcactcgaggtgcagcaggtcaaa

SEQ ID NO: 14590 - DNA, 25 bp, Homo sapien
aatttcttcatggtggcggctggcc

SEQ ID NO: 14591 - DNA, 25 bp, Homo sapien
cggagaccagccaccggaagaaaat

SEQ ID NO: 14592 - DNA, 25 bp, Homo sapien
tgaacttgatgtcggccttgaactc

SEQ ID NO: 14593 - DNA, 25 bp, Homo sapien
actctttgagcttctgaccgggtcc

SEQ ID NO: 14594 - DNA, 25 bp, Homo sapien
tggcctgccacgtgacaatcgacta

SEQ ID NO: 14595 - DNA, 25 bp, Homo sapien
ccgcgtctctgtggttcttccggac

SEQ ID NO: 14596 - DNA, 25 bp, Homo sapien
gacgagtgcacctctcgattggaga

SEQ ID NO: 14597 - DNA, 25 bp, Homo sapien
ggtcccgcgctcttgaacttgatgt

SEQ ID NO: 14598 - DNA, 25 bp, Homo sapien
tcagagagtcgctccctgggagtct

SEQ ID NO: 14599 - DNA, 25 bp, Homo sapien
gtgttcggatcctgcaggacccgcc

SEQ ID NO: 14600 - DNA, 25 bp, Homo sapien
atcgacggctttgccggcccgtgac

SEQ ID NO: 14601 - DNA, 25 bp, Homo sapien
ccggggacttggtgttcgctaagat

SEQ ID NO: 14602 - DNA, 25 bp, Homo sapien
acacgccttcaagcccggggacttg

SEQ ID NO: 14603 - DNA, 25 bp, Homo sapien
aacgcccaataagcgcgcgtcggca

SEQ ID NO: 14604 - DNA, 25 bp, Homo sapien
ctgagagactctcgcccttggtgta

SEQ ID NO: 14605 - DNA, 25 bp, Homo sapien
agggctgaacttccgttggcgcaac

SEQ ID NO: 14606 - DNA, 25 bp, Homo sapien
tgtcgcttgggccacgaagacacaa

SEQ ID NO: 14607 - DNA, 25 bp, Homo sapien
aaacgtgggccttactctgcctgtc

SEQ ID NO: 14608 - DNA, 25 bp, Homo sapien
tccgggcatttctactcagacgctg

SEQ ID NO: 14609 - DNA, 25 bp, Homo sapien
tctcgttttccttgtgtgctgattg

SEQ ID NO: 14610 - DNA, 25 bp, Homo sapien
actctcagcgttctccgtttgcggc

SEQ ID NO: 14611 - DNA, 25 bp, Homo sapien
attggccgcgagagcgttattactc

SEQ ID NO: 14612 - DNA, 25 bp, Homo sapien
aggccatgcttccattctgtccggg

SEQ ID NO: 14613 - DNA, 25 bp, Homo sapien
aaaattacacagacagggccctgtc

SEQ ID NO: 14614 - DNA, 25 bp, Homo sapien
catcgccgagttctgtgagtgtggc

SEQ ID NO: 14615 - DNA, 25 bp, Homo sapien
caaagagcgaacctggccgcgaagg

SEQ ID NO: 14616 - DNA, 25 bp, Homo sapien
gagaactactccgtgacctggtaca

SEQ ID NO: 14617 - DNA, 25 bp, Homo sapien
gactggtgcgaggagaactactccg

SEQ ID NO: 14618 - DNA, 25 bp, Homo sapien
acccggcacagtgagcggagcgcct

SEQ ID NO: 14619 - DNA, 25 bp, Homo sapien
agcctaacccggcacagtgagcgga

SEQ ID NO: 14620 - DNA, 25 bp, Homo sapien
aggaaggcaaagagcgaacctggcc

SEQ ID NO: 14621 - DNA, 25 bp, Homo sapien
tgacctggtacatcgccgagttctg

SEQ ID NO: 14622 - DNA, 25 bp, Homo sapien
tctggcggctcctccatcggctgag

SEQ ID NO: 14623 - DNA, 25 bp, Homo sapien
cgtccagctccagcagtgacaggtg

SEQ ID NO: 14624 - DNA, 25 bp, Homo sapien
cctcttcctgtagcggagaagcctc

SEQ ID NO: 14625 - DNA, 25 bp, Homo sapien
tcgtgctcgcacatctcttggcctg

SEQ ID NO: 14626 - DNA, 25 bp, Homo sapien
ccgatgtgtctgtgaagaagcctcc

SEQ ID NO: 14627 - DNA, 25 bp, Homo sapien
tcctccgactccgatgtgtctgtga

SEQ ID NO: 14628 - DNA, 25 bp, Homo sapien
gactccgactccaaggccgattcgg

SEQ ID NO: 14629 - DNA, 25 bp, Homo sapien
tccgcctccagtgacagcgacgagg

SEQ ID NO: 14630 - DNA, 25 bp, Homo sapien
gtccctgaagcagcgggcatcagcg

SEQ ID NO: 14631 - DNA, 25 bp, Homo sapien
tcgtccaccaggtccgccaggtcgg

SEQ ID NO: 14632 - DNA, 25 bp, Homo sapien
ctcgggtcgctccacaaggatgggc

SEQ ID NO: 14633 - DNA, 25 bp, Homo sapien
tcgctccacaaggatgggcgcgaag

SEQ ID NO: 14634 - DNA, 25 bp, Homo sapien
ggcgcgaagggtcccaccagccagg

SEQ ID NO: 14635 - DNA, 25 bp, Homo sapien
gccgctggcacgtccctgaagcagc

SEQ ID NO: 14636 - DNA, 25 bp, Homo sapien
cgaaggcggtctgcagggcatccac

SEQ ID NO: 14637 - DNA, 25 bp, Homo sapien
aggcggtctgcagggcatccacact

SEQ ID NO: 14638 - DNA, 25 bp, Homo sapien
aggccgcacacgcagttctcagcca

SEQ ID NO: 14639 - DNA, 25 bp, Homo sapien
ctgcaccacgttctgcgggaagggt

SEQ ID NO: 14640 - DNA, 25 bp, Homo sapien
acacgctgcaccacgttctgcggga

SEQ ID NO: 14641 - DNA, 25 bp, Homo sapien
ggggcagagccaccacacgctgcac

SEQ ID NO: 14642 - DNA, 25 bp, Homo sapien
agaccgcggtgcacgtggccctgac

SEQ ID NO: 14643 - DNA, 25 bp, Homo sapien
tgcactgtaaacatcgcagaccgcg

SEQ ID NO: 14644 - DNA, 25 bp, Homo sapien
gtccttggctgcactgtaaacatcg

SEQ ID NO: 14645 - DNA, 25 bp, Homo sapien
taaacatcgcagaccgcggtgcacg

SEQ ID NO: 14646 - DNA, 25 bp, Homo sapien
ggcctccggaactgaccaatgggga

SEQ ID NO: 14647 - DNA, 25 bp, Homo sapien
ttcgcccaaccaccctatctggagc

SEQ ID NO: 14648 - DNA, 25 bp, Homo sapien
cctatctggagctcctctcctaagc

SEQ ID NO: 14649 - DNA, 25 bp, Homo sapien
gcgagcggcttcagacaccagctgt

SEQ ID NO: 14650 - DNA, 25 bp, Homo sapien
agcggcttcagacaccagctgtctc

SEQ ID NO: 14651 - DNA, 25 bp, Homo sapien
gcccttcttatagctgctcgcgcag

SEQ ID NO: 14652 - DNA, 25 bp, Homo sapien
tcttatagctgctcgcgcagtgggg

SEQ ID NO: 14653 - DNA, 25 bp, Homo sapien
cggtcatacccgtcccacgccgccg

SEQ ID NO: 14654 - DNA, 25 bp, Homo sapien
tctcgctcctggttcccgtggctgg

SEQ ID NO: 14655 - DNA, 25 bp, Homo sapien
gggacttgagcacccactcggagtt

SEQ ID NO: 14656 - DNA, 25 bp, Homo sapien
cgtggctggcactgccaaggcatcg

SEQ ID NO: 14657 - DNA, 25 bp, Homo sapien
cctcgccgctgttgaacgtgtgggt

SEQ ID NO: 14658 - DNA, 25 bp, Homo sapien
cttggcccagccgttctgcatcagg

SEQ ID NO: 14659 - DNA, 25 bp, Homo sapien
cgttctgcatcaggggcgccagcag

SEQ ID NO: 14660 - DNA, 25 bp, Homo sapien
aggcccacgaaccagcccacgctga

SEQ ID NO: 14661 - DNA, 25 bp, Homo sapien
accgacgacgttaccagcaggttca

SEQ ID NO: 14662 - DNA, 25 bp, Homo sapien
gggagcctcccacgtcgttcttgca

SEQ ID NO: 14663 - DNA, 25 bp, Homo sapien
caccacctgggcgtgacagtggacg

SEQ ID NO: 14664 - DNA, 25 bp, Homo sapien
cgttgaagtagaaatgggagtctcc

SEQ ID NO: 14665 - DNA, 25 bp, Homo sapien
gagtctccgggtacagagcagttga

SEQ ID NO: 14666 - DNA, 25 bp, Homo sapien
acagagcagttgagccgcgccttca

SEQ ID NO: 14667 - DNA, 25 bp, Homo sapien
ccttcaggaaggacgtccactgctt

SEQ ID NO: 14668 - DNA, 25 bp, Homo sapien
acgtcgttcttgcacactcgggcca

SEQ ID NO: 14669 - DNA, 25 bp, Homo sapien
cagcctgcagcacgttgaagtagaa

SEQ ID NO: 14670 - DNA, 25 bp, Homo sapien
cgcagggagtctgaagactcacgct

SEQ ID NO: 14671 - DNA, 25 bp, Homo sapien
aagtttcgacactcgccctgaggtg

SEQ ID NO: 14672 - DNA, 25 bp, Homo sapien
gtcccgaaggagcagcacctttacg

SEQ ID NO: 14673 - DNA, 25 bp, Homo sapien
gcagcacctttacgaagtttcgaca

SEQ ID NO: 14674 - DNA, 25 bp, Homo sapien
aagagcgtggactcgtcccgaagga

SEQ ID NO: 14675 - DNA, 25 bp, Homo sapien
ttggaaccgcacacaaagagcgtgg

SEQ ID NO: 14676 - DNA, 25 bp, Homo sapien
actcacgctgtagttggcgcacacc

SEQ ID NO: 14677 - DNA, 25 bp, Homo sapien
gttgaaggcgttggaaccgcacaca

SEQ ID NO: 14678 - DNA, 25 bp, Homo sapien
ccaccgacaggtctacgtggctatc

SEQ ID NO: 14679 - DNA, 25 bp, Homo sapien
acaggtctacgtggctatcctccct

SEQ ID NO: 14680 - DNA, 25 bp, Homo sapien
cattcctgccgcctccgacgtgccc

SEQ ID NO: 14681 - DNA, 25 bp, Homo sapien
tggctggtcccacggctgacgcacg

SEQ ID NO: 14682 - DNA, 25 bp, Homo sapien
ccacacccttgtgggcctggctttc

SEQ ID NO: 14683 - DNA, 25 bp, Homo sapien
tggctttcgggaaactacaatttgc

SEQ ID NO: 14684 - DNA, 25 bp, Homo sapien
gaaactacaatttgcggggagagaa

SEQ ID NO: 14685 - DNA, 25 bp, Homo sapien
agagaagtcccacgagggcatgccc

SEQ ID NO: 14686 - DNA, 25 bp, Homo sapien
cgtggccacaagacggcgggcgaga

SEQ ID NO: 14687 - DNA, 25 bp, Homo sapien
gcggctcctcaggaaagaggccgtg

SEQ ID NO: 14688 - DNA, 25 bp, Homo sapien
tcctcaggaaagaggccgtgggcgc

SEQ ID NO: 14689 - DNA, 25 bp, Homo sapien
acgctcgcggggtctgcatggcgag

SEQ ID NO: 14690 - DNA, 25 bp, Homo sapien
catggcgagggccaggcgacaggag

SEQ ID NO: 14691 - DNA, 25 bp, Homo sapien
tgcagtcccgctcgtggccacaaga

SEQ ID NO: 14692 - DNA, 25 bp, Homo sapien
cccgctcgtggccacaagacggcgg

SEQ ID NO: 14693 - DNA, 25 bp, Homo sapien
agtcccgctcgtggccacaagacgg

SEQ ID NO: 14694 - DNA, 25 bp, Homo sapien
cgatctggggttacccgacgcctgt

SEQ ID NO: 14695 - DNA, 25 bp, Homo sapien
ccctatccccaagaccatctgcttc

SEQ ID NO: 14696 - DNA, 25 bp, Homo sapien
atccccaagaccatctgcttctctc

SEQ ID NO: 14697 - DNA, 25 bp, Homo sapien
cccgacgcctgtgcgcctcccccta

SEQ ID NO: 14698 - DNA, 25 bp, Homo sapien
gttacccgacgcctgtgcgcctccc

SEQ ID NO: 14699 - DNA, 25 bp, Homo sapien
tggggttacccgacgcctgtgcgcc

SEQ ID NO: 14700 - DNA, 25 bp, Homo sapien
ctggggttacccgacgcctgtgcgc

SEQ ID NO: 14701 - DNA, 25 bp, Homo sapien
gatctggggttacccgacgcctgtg

SEQ ID NO: 14702 - DNA, 25 bp, Homo sapien
atctgcttctctccgtgaaactcga

SEQ ID NO: 14703 - DNA, 25 bp, Homo sapien
tccgtgaaactcgaggagcctctgc

SEQ ID NO: 14704 - DNA, 25 bp, Homo sapien
ctctccgtgaaactcgaggagcctc

SEQ ID NO: 14705 - DNA, 25 bp, Homo sapien
tcggcgcctgcctgctcagaagcgg

SEQ ID NO: 14706 - DNA, 25 bp, Homo sapien
ttctctccgtgaaactcgaggagcc

SEQ ID NO: 14707 - DNA, 25 bp, Homo sapien
tgcttctctccgtgaaactcgagga

SEQ ID NO: 14708 - DNA, 25 bp, Homo sapien
acacctgccacgctgcggctgccgg

SEQ ID NO: 14709 - DNA, 25 bp, Homo sapien
cggctgccggacacctggtcacagg

SEQ ID NO: 14710 - DNA, 25 bp, Homo sapien
tacgtgttctccgagcactgcggtg

SEQ ID NO: 14711 - DNA, 25 bp, Homo sapien
ggtgccgcctacgaggattttaaca

SEQ ID NO: 14712 - DNA, 25 bp, Homo sapien
gattttaacatccagctacgccgca

SEQ ID NO: 14713 - DNA, 25 bp, Homo sapien
tggatggcgtggtcatccagctgac

SEQ ID NO: 14714 - DNA, 25 bp, Homo sapien
tcatccagctgaccaagggctccgt

SEQ ID NO: 14715 - DNA, 25 bp, Homo sapien
accaagggctccgtcctggtcaacg

SEQ ID NO: 14716 - DNA, 25 bp, Homo sapien
caacggccacccgtgagtctgggtt

SEQ ID NO: 14717 - DNA, 25 bp, Homo sapien
cctggggcagcttccactacaagac

SEQ ID NO: 14718 - DNA, 25 bp, Homo sapien
caggcacggggctcatgaagtctca

SEQ ID NO: 14719 - DNA, 25 bp, Homo sapien
gccatacggggcacgaccccagaac

SEQ ID NO: 14720 - DNA, 25 bp, Homo sapien
gtctcaccctcagccatacggggca

SEQ ID NO: 14721 - DNA, 25 bp, Homo sapien
aagtctcaccctcagccatacgggg

SEQ ID NO: 14722 - DNA, 25 bp, Homo sapien
cggggctcatgaagtctcaccctca

SEQ ID NO: 14723 - DNA, 25 bp, Homo sapien
acggggctcatgaagtctcaccctc

SEQ ID NO: 14724 - DNA, 25 bp, Homo sapien
gcacggggctcatgaagtctcaccc

SEQ ID NO: 14725 - DNA, 25 bp, Homo sapien
aggcacggggctcatgaagtctcac

SEQ ID NO: 14726 - DNA, 25 bp, Homo sapien
ccagctccggattcggggttcaact

SEQ ID NO: 14727 - DNA, 25 bp, Homo sapien
accgtcctgactgtagccaggcctc

SEQ ID NO: 14728 - DNA, 25 bp, Homo sapien
tatccgatgacacccaccgtcctga

SEQ ID NO: 14729 - DNA, 25 bp, Homo sapien
gtctatatccgatgacacccaccgt

SEQ ID NO: 14730 - DNA, 25 bp, Homo sapien
gccttgtacgctcctgggtcccgaa

SEQ ID NO: 14731 - DNA, 25 bp, Homo sapien
cagctccggattcggggttcaactt

SEQ ID NO: 14732 - DNA, 25 bp, Homo sapien
cgtctctcttttccctcgactcacg

SEQ ID NO: 14733 - DNA, 25 bp, Homo sapien
ctcttgggcggccttgtacgctcct

SEQ ID NO: 14734 - DNA, 25 bp, Homo sapien
gccgcgagcctcattattgtgtctt

SEQ ID NO: 14735 - DNA, 25 bp, Homo sapien
tggacccgcgactcgtcctgttctg

SEQ ID NO: 14736 - DNA, 25 bp, Homo sapien
gtcgcctcgacttggctctcaggac

SEQ ID NO: 14737 - DNA, 25 bp, Homo sapien
tcattattgtgtcttctccgggccc

SEQ ID NO: 14738 - DNA, 25 bp, Homo sapien
cccacgttgcggtgccattagacac

SEQ ID NO: 14739 - DNA, 25 bp, Homo sapien
cggatccctccatacggccagcgac

SEQ ID NO: 14740 - DNA, 25 bp, Homo sapien
agtcctagcgcctgacctggccacc

SEQ ID NO: 14741 - DNA, 25 bp, Homo sapien
aggacaaaatctccacccgctgcgg

SEQ ID NO: 14742 - DNA, 25 bp, Homo sapien
ccagccgtgggattctgagcaaagc

SEQ ID NO: 14743 - DNA, 25 bp, Homo sapien
tccgaacgggcagctccgattggct

SEQ ID NO: 14744 - DNA, 25 bp, Homo sapien
gcgcagacgcgattctcctcggaca

SEQ ID NO: 14745 - DNA, 25 bp, Homo sapien
tcctcggacagatttttccctcgtc

SEQ ID NO: 14746 - DNA, 25 bp, Homo sapien
gggtcctcgctgctaggttgcaccc

SEQ ID NO: 14747 - DNA, 25 bp, Homo sapien
agatgcgccggctaaatccgcccag

SEQ ID NO: 14748 - DNA, 25 bp, Homo sapien
ggtctccgctcaggccagggaatcc

SEQ ID NO: 14749 - DNA, 25 bp, Homo sapien
tgggccgagctgtagtcaggctcac

SEQ ID NO: 14750 - DNA, 25 bp, Homo sapien
ccacgccttgttccctctccgggag

SEQ ID NO: 14751 - DNA, 25 bp, Homo sapien
cccagggacgcagacaatcaattag

SEQ ID NO: 14752 - DNA, 25 bp, Homo sapien
tcaattagaattggcagcgcctgcc

SEQ ID NO: 14753 - DNA, 25 bp, Homo sapien
ggcagcgcctgcctaagtaaaaggc

SEQ ID NO: 14754 - DNA, 25 bp, Homo sapien
ctgcctaagtaaaaggcctgcttta

SEQ ID NO: 14755 - DNA, 25 bp, Homo sapien
cctgctttaatgaggaggctgtggc

SEQ ID NO: 14756 - DNA, 25 bp, Homo sapien
gcgggtccaatctccacgccttgtt

SEQ ID NO: 14757 - DNA, 25 bp, Homo sapien
gggacgcagacaatcaattagaatt

SEQ ID NO: 14758 - DNA, 25 bp, Homo sapien
ggatcgatccccgacctcctaagga

SEQ ID NO: 14759 - DNA, 25 bp, Homo sapien
ggtcgctagctgcaggttgcacagc

SEQ ID NO: 14760 - DNA, 25 bp, Homo sapien
aggcccggagaagagggtcgctagc

SEQ ID NO: 14761 - DNA, 25 bp, Homo sapien
tctgccgggcatgatcggaaacggc

SEQ ID NO: 14762 - DNA, 25 bp, Homo sapien
ctcccacccggctgagctttaccgg

SEQ ID NO: 14763 - DNA, 25 bp, Homo sapien
ccgggttatagagcccccaactctg

SEQ ID NO: 14764 - DNA, 25 bp, Homo sapien
tagagcccccaactctggatcgatc

SEQ ID NO: 14765 - DNA, 25 bp, Homo sapien
ctctgccgggcatgatcggaaacgg

SEQ ID NO: 14766 - DNA, 25 bp, Homo sapien
aggcctggcaactctccggtccctt

SEQ ID NO: 14767 - DNA, 25 bp, Homo sapien
ctctgcttcgagagtaggtgagcga

SEQ ID NO: 14768 - DNA, 25 bp, Homo sapien
tggacgtacggactctgcttcgaga

SEQ ID NO: 14769 - DNA, 25 bp, Homo sapien
ccgacggttggacgtacggactctg

SEQ ID NO: 14770 - DNA, 25 bp, Homo sapien
ttggctaatccggagcgctcggccc

SEQ ID NO: 14771 - DNA, 25 bp, Homo sapien
cgccctgtcattggctaatccggag

SEQ ID NO: 14772 - DNA, 25 bp, Homo sapien
ttttcgtacattgcccgccctgtca

SEQ ID NO: 14773 - DNA, 25 bp, Homo sapien
ctcccattggccttttcgtacattg

SEQ ID NO: 14774 - DNA, 25 bp, Homo sapien
actgcgacttcctggctgcgctcta

SEQ ID NO: 14775 - DNA, 25 bp, Homo sapien
atgacggccgtcagcttccaccagg

SEQ ID NO: 14776 - DNA, 25 bp, Homo sapien
cacctgcgcaggatctgcgagggcc

SEQ ID NO: 14777 - DNA, 25 bp, Homo sapien
tgttcggccacctagccgactgcga

SEQ ID NO: 14778 - DNA, 25 bp, Homo sapien
acggccgcatcaaccacgtgttcgg

SEQ ID NO: 14779 - DNA, 25 bp, Homo sapien
gacctgctgcaccaggccgtgggtc

SEQ ID NO: 14780 - DNA, 25 bp, Homo sapien
ggacttcaccttcgaccggcgcgtg

SEQ ID NO: 14781 - DNA, 25 bp, Homo sapien
gctggacgagggcagcctctgaacc

SEQ ID NO: 14782 - DNA, 25 bp, Homo sapien
gtcggcgtcggctgtccacgtgacc

SEQ ID NO: 14783 - DNA, 25 bp, Homo sapien
cccgctccctatgagttcagtcctg

SEQ ID NO: 14784 - DNA, 25 bp, Homo sapien
gggcctgccagcactcaaatatccg

SEQ ID NO: 14785 - DNA, 25 bp, Homo sapien
gcactcaaatatccgggacggcggt

SEQ ID NO: 14786 - DNA, 25 bp, Homo sapien
cccacgttatgggagaaggaatgca

SEQ ID NO: 14787 - DNA, 25 bp, Homo sapien
acgtcaaacgccaccgtcgtgggct

SEQ ID NO: 14788 - DNA, 25 bp, Homo sapien
aaggaatgcacgacgccgccgggcc

SEQ ID NO: 14789 - DNA, 25 bp, Homo sapien
aacgccaccgtcgtgggctcggaca

SEQ ID NO: 14790 - DNA, 25 bp, Homo sapien
gccgtcttcacggtgacctgcgccc

SEQ ID NO: 14791 - DNA, 25 bp, Homo sapien
agtttccgtggtctgtgagatgggt

SEQ ID NO: 14792 - DNA, 25 bp, Homo sapien
gtgacggcaacgcggccgccgtctt

SEQ ID NO: 14793 - DNA, 25 bp, Homo sapien
cgccacggccaggacagtgagtgcg

SEQ ID NO: 14794 - DNA, 25 bp, Homo sapien
ttcttcctgcgcgtggatcccggcg

SEQ ID NO: 14795 - DNA, 25 bp, Homo sapien
gctcctctgtgcagcctcggcctca

SEQ ID NO: 14796 - DNA, 25 bp, Homo sapien
actcacttcttcctgcgcgtggatc

SEQ ID NO: 14797 - DNA, 25 bp, Homo sapien
cagcgaaccgggtgccgggtcatgc

SEQ ID NO: 14798 - DNA, 25 bp, Homo sapien
gaggctgcagccacttgtgctgtga

SEQ ID NO: 14799 - DNA, 25 bp, Homo sapien
gggcaggctcagaggtattcctgta

SEQ ID NO: 14800 - DNA, 25 bp, Homo sapien
gaatactgtgtctctcgttggggta

SEQ ID NO: 14801 - DNA, 25 bp, Homo sapien
actcggggcagcgaatactgtgtct

SEQ ID NO: 14802 - DNA, 25 bp, Homo sapien
acttcatagtgctcgcccgactcgg

SEQ ID NO: 14803 - DNA, 25 bp, Homo sapien
agtgcagcaacgtgacttcatagtg

SEQ ID NO: 14804 - DNA, 25 bp, Homo sapien
ggtattcctgtagaaagtgcagcaa

SEQ ID NO: 14805 - DNA, 25 bp, Homo sapien
ggacaaagtgcctcactggggcccg

SEQ ID NO: 14806 - DNA, 25 bp, Homo sapien
agcaagtacttcgtgccgccgcagc

SEQ ID NO: 14807 - DNA, 25 bp, Homo sapien
tcgacgacgcctacatgggcatgtg

SEQ ID NO: 14808 - DNA, 25 bp, Homo sapien
ctgagcactacgagcgacgcgagct

SEQ ID NO: 14809 - DNA, 25 bp, Homo sapien
tccgcgacagctggagcaagtactt

SEQ ID NO: 14810 - DNA, 25 bp, Homo sapien
cgtgttcgtgcacaccgccaacgta

SEQ ID NO: 14811 - DNA, 25 bp, Homo sapien
gcacctgcacttgctcgactggctg

SEQ ID NO: 14812 - DNA, 25 bp, Homo sapien
agtgcgccgcctctttctattgggc

SEQ ID NO: 14813 - DNA, 25 bp, Homo sapien
taccgcgagttgctgctagtgcacc

SEQ ID NO: 14814 - DNA, 25 bp, Homo sapien
tcgtaggccatccagacggtgaccg

SEQ ID NO: 14815 - DNA, 25 bp, Homo sapien
cgcctcatagccgtgctggttgttc

SEQ ID NO: 14816 - DNA, 25 bp, Homo sapien
ctggttgttctcagggacgtccatg

SEQ ID NO: 14817 - DNA, 25 bp, Homo sapien
ctcagtgtaccctgtgtcgtaggcc

SEQ ID NO: 14818 - DNA, 25 bp, Homo sapien
agaaacaggcgtcgggtcctacagc

SEQ ID NO: 14819 - DNA, 25 bp, Homo sapien
gcgctcatgcacatggggccggcaa

SEQ ID NO: 14820 - DNA, 25 bp, Homo sapien
agcctcccacagagagctgctggcg

SEQ ID NO: 14821 - DNA, 25 bp, Homo sapien
gacgtccatgtagcgctcagtgtac

SEQ ID NO: 14822 - DNA, 25 bp, Homo sapien
ccgaccgcagatccagggtagcttc

SEQ ID NO: 14823 - DNA, 25 bp, Homo sapien
cagcttgtagacgtgcacgcagggc

SEQ ID NO: 14824 - DNA, 25 bp, Homo sapien
gccgctcagcttgtagacgtgcacg

SEQ ID NO: 14825 - DNA, 25 bp, Homo sapien
tgctagcccagaagcggggctgctt

SEQ ID NO: 14826 - DNA, 25 bp, Homo sapien
tccatcatgctagcccagaagcggg

SEQ ID NO: 14827 - DNA, 25 bp, Homo sapien
gcaggggctactcactggctgcctc

SEQ ID NO: 14828 - DNA, 25 bp, Homo sapien
gtggctgacgaacatgtcgaagttc

SEQ ID NO: 14829 - DNA, 25 bp, Homo sapien
ctcacgctgctgtagtggctgacga

SEQ ID NO: 14830 - DNA, 25 bp, Homo sapien
tggacaccaccaggcacgtaccaag

SEQ ID NO: 14831 - DNA, 25 bp, Homo sapien
gcgcctcacggtcgcggctccatgc

SEQ ID NO: 14832 - DNA, 25 bp, Homo sapien
cggctcaggcacctttgacccggaa

SEQ ID NO: 14833 - DNA, 25 bp, Homo sapien
tcaggcacctttgacccggaagttg

SEQ ID NO: 14834 - DNA, 25 bp, Homo sapien
gggattggacaccaccaggcacgta

SEQ ID NO: 14835 - DNA, 25 bp, Homo sapien
aggcacgtaccaaggcgtccgcggc

SEQ ID NO: 14836 - DNA, 25 bp, Homo sapien
gcggcctaaggtgcgtaacgcccca

SEQ ID NO: 14837 - DNA, 25 bp, Homo sapien
tttgacccggaagttgagcgaccca

SEQ ID NO: 14838 - DNA, 25 bp, Homo sapien
ccaggcactcggcagagagaacgcg

SEQ ID NO: 14839 - DNA, 25 bp, Homo sapien
attaccgtaattgcggtgggagagc

SEQ ID NO: 14840 - DNA, 25 bp, Homo sapien
ggctcccagctaattaccgtaattg

SEQ ID NO: 14841 - DNA, 25 bp, Homo sapien
cgttgccctggcaacgccgggatgc

SEQ ID NO: 14842 - DNA, 25 bp, Homo sapien
gatgcccagcaacaagtccgcggcg

SEQ ID NO: 14843 - DNA, 25 bp, Homo sapien
agagaacgcgcgtaggcgttgccct

SEQ ID NO: 14844 - DNA, 25 bp, Homo sapien
aagtccgcggcgtgtatcacgtgct

SEQ ID NO: 14845 - DNA, 25 bp, Homo sapien
cggcgagaggctcccagctaattac

SEQ ID NO: 14846 - DNA, 25 bp, Homo sapien
gccgccgcgtttaggcggcactgca

SEQ ID NO: 14847 - DNA, 25 bp, Homo sapien
ggagaacaggcacgcagatggcaga

SEQ ID NO: 14848 - DNA, 25 bp, Homo sapien
gtttgcaagcctggatcctggcgcg

SEQ ID NO: 14849 - DNA, 25 bp, Homo sapien
gggacgtttgcaagcctggatcctg

SEQ ID NO: 14850 - DNA, 25 bp, Homo sapien
catggcatggggacgtttgcaagcc

SEQ ID NO: 14851 - DNA, 25 bp, Homo sapien
cccgagatgtgcctgcgcatggcat

SEQ ID NO: 14852 - DNA, 25 bp, Homo sapien
acgctcgcctggcgtgggccacagt

SEQ ID NO: 14853 - DNA, 25 bp, Homo sapien
ggcggcactgcagctaatgacaccc

SEQ ID NO: 14854 - DNA, 25 bp, Homo sapien
acggccctgcatgactgcgccgagt

SEQ ID NO: 14855 - DNA, 25 bp, Homo sapien
agccattttgttccgcccgaggaga

SEQ ID NO: 14856 - DNA, 25 bp, Homo sapien
tgttccgcccgaggagaccctaaga

SEQ ID NO: 14857 - DNA, 25 bp, Homo sapien
ccgcccgaggagaccctaagatggc

SEQ ID NO: 14858 - DNA, 25 bp, Homo sapien
ccgtccgggctctgatcctccgtct

SEQ ID NO: 14859 - DNA, 25 bp, Homo sapien
caaggcccgcatggaacgtgacggc

SEQ ID NO: 14860 - DNA, 25 bp, Homo sapien
gcagccattttgttccgcccgagga

SEQ ID NO: 14861 - DNA, 25 bp, Homo sapien
cccgcatggaacgtgacggctacgg

SEQ ID NO: 14862 - DNA, 25 bp, Homo sapien
gtagcgcgctgagggcgctggctcc

SEQ ID NO: 14863 - DNA, 25 bp, Homo sapien
gcttctgcggagttgcccgcggacc

SEQ ID NO: 14864 - DNA, 25 bp, Homo sapien
agttgcccgcggaccgtagcgcgct

SEQ ID NO: 14865 - DNA, 25 bp, Homo sapien
ccggctgcgccactgggtcctgggg

SEQ ID NO: 14866 - DNA, 25 bp, Homo sapien
ggtttcggagtcctgccccgcagca

SEQ ID NO: 14867 - DNA, 25 bp, Homo sapien
gaggtcacggtttcggagtcctgcc

SEQ ID NO: 14868 - DNA, 25 bp, Homo sapien
cgtgaggtcacggtttcggagtcct

SEQ ID NO: 14869 - DNA, 25 bp, Homo sapien
gcacccatgcgctctcttcccaacc

SEQ ID NO: 14870 - DNA, 25 bp, Homo sapien
ggcaggtggttgtccgcccactcct

SEQ ID NO: 14871 - DNA, 25 bp, Homo sapien
accgcctccgacaattgggtggcca

SEQ ID NO: 14872 - DNA, 25 bp, Homo sapien
actttgtcttgtccacgccgctctg

SEQ ID NO: 14873 - DNA, 25 bp, Homo sapien
catgaccgattggacgccgccggtc

SEQ ID NO: 14874 - DNA, 25 bp, Homo sapien
gcccaagcgggagcccatgaccgat

SEQ ID NO: 14875 - DNA, 25 bp, Homo sapien
tggccacacttacccagttcggcat

SEQ ID NO: 14876 - DNA, 25 bp, Homo sapien
cccagttcggcatccgtaaggggca

SEQ ID NO: 14877 - DNA, 25 bp, Homo sapien
cgccggtcactacggactttgtctt

SEQ ID NO: 14878 - DNA, 25 bp, Homo sapien
cagctcgtagcgagtgtgcatgatc

SEQ ID NO: 14879 - DNA, 25 bp, Homo sapien
tatgtgggcatacagggcgaatacg

SEQ ID NO: 14880 - DNA, 25 bp, Homo sapien
gcgtgaagccctcgtactgtatgtg

SEQ ID NO: 14881 - DNA, 25 bp, Homo sapien
tgcctcagaagctcgctgctgtcca

SEQ ID NO: 14882 - DNA, 25 bp, Homo sapien
ctgacaaccttggtggtgttgaagc

SEQ ID NO: 14883 - DNA, 25 bp, Homo sapien
caacggcaggttgaaggtgctgaca

SEQ ID NO: 14884 - DNA, 25 bp, Homo sapien
gtgcatgatctcaccgtcctgcgtg

SEQ ID NO: 14885 - DNA, 25 bp, Homo sapien
gtcctgcgtgctgctgctcacggac

SEQ ID NO: 14886 - DNA, 25 bp, Homo sapien
tcattaggccgcacgtgacgagggc

SEQ ID NO: 14887 - DNA, 25 bp, Homo sapien
caccatcagggcaggtaatcacccc

SEQ ID NO: 14888 - DNA, 25 bp, Homo sapien
ctcattaggccgcacgtgacgaggg

SEQ ID NO: 14889 - DNA, 25 bp, Homo sapien
tgggcgccaaggccctcattaggcc

SEQ ID NO: 14890 - DNA, 25 bp, Homo sapien
ccggtccatccatggcgggcatggc

SEQ ID NO: 14891 - DNA, 25 bp, Homo sapien
ctgtccttcccaccgctttcatctg

SEQ ID NO: 14892 - DNA, 25 bp, Homo sapien
tccatccatggcgggcatggccagg

SEQ ID NO: 14893 - DNA, 25 bp, Homo sapien
cccaccgctttcatctgggcgccaa

SEQ ID NO: 14894 - DNA, 25 bp, Homo sapien
cggaaggctgcagtacccgcgcagc

SEQ ID NO: 14895 - DNA, 25 bp, Homo sapien
cacacgcgcactcagcgaagcaacc

SEQ ID NO: 14896 - DNA, 25 bp, Homo sapien
caagaagccgccgttatgggtcggc

SEQ ID NO: 14897 - DNA, 25 bp, Homo sapien
ctgggtgactctgggtcctggccac

SEQ ID NO: 14898 - DNA, 25 bp, Homo sapien
gccacccggtctctgaagctgggtt

SEQ ID NO: 14899 - DNA, 25 bp, Homo sapien
gtctctgaagctgggttgcacgcgt

SEQ ID NO: 14900 - DNA, 25 bp, Homo sapien
tgcacgcgtgtccaggtccacggaa

SEQ ID NO: 14901 - DNA, 25 bp, Homo sapien
gtgtccaggtccacggaaggctgca

SEQ ID NO: 14902 - DNA, 25 bp, Homo sapien
ttcgcgggaaaaaaatcagagcagc

SEQ ID NO: 14903 - DNA, 25 bp, Homo sapien
gcgattcaattgtcgcgcccgagcc

SEQ ID NO: 14904 - DNA, 25 bp, Homo sapien
tttgcaaaactttcccgcgcggcca

SEQ ID NO: 14905 - DNA, 25 bp, Homo sapien
agacaagctgttcgcggcgaccgga

SEQ ID NO: 14906 - DNA, 25 bp, Homo sapien
ccgccactgcgtcggccaatcagga

SEQ ID NO: 14907 - DNA, 25 bp, Homo sapien
ctgcggagccaataagaggcggctc

SEQ ID NO: 14908 - DNA, 25 bp, Homo sapien
ccacgcacgcggtttcatcgccatc

SEQ ID NO: 14909 - DNA, 25 bp, Homo sapien
cgcaggcagacaagctgttcgcggc

SEQ ID NO: 14910 - DNA, 25 bp, Homo sapien
cacctgaggttgtcgcagaggcgct

SEQ ID NO: 14911 - DNA, 25 bp, Homo sapien
gcagagttccgctgtcactagccct

SEQ ID NO: 14912 - DNA, 25 bp, Homo sapien
gtcctgtgtgctgggatgccctcgc

SEQ ID NO: 14913 - DNA, 25 bp, Homo sapien
ggttctgtctcctccgtgtctagga

SEQ ID NO: 14914 - DNA, 25 bp, Homo sapien
tccgtgtctaggatcctcctgcatc

SEQ ID NO: 14915 - DNA, 25 bp, Homo sapien
gatcctcctgcatccgtttttcctt

SEQ ID NO: 14916 - DNA, 25 bp, Homo sapien
tcttgcccgcacctgaggttgtcgc

SEQ ID NO: 14917 - DNA, 25 bp, Homo sapien
gaagggcagagttccgctgtcacta

SEQ ID NO: 14918 - DNA, 25 bp, Homo sapien
ggtattcaggctctgtgacgcgcat

SEQ ID NO: 14919 - DNA, 25 bp, Homo sapien
tctgtgacgcgcatccttggctgcg

SEQ ID NO: 14920 - DNA, 25 bp, Homo sapien
cctgggtattcaggctctgtgacgc

SEQ ID NO: 14921 - DNA, 25 bp, Homo sapien
atacgacgagtgagtcatggcaggt

SEQ ID NO: 14922 - DNA, 25 bp, Homo sapien
ccacgtgaaatacgacgagtgagtc

SEQ ID NO: 14923 - DNA, 25 bp, Homo sapien
ggaggacgtcatttaccacgtgaaa

SEQ ID NO: 14924 - DNA, 25 bp, Homo sapien
cgctggaggaggacgtcatttacca

SEQ ID NO: 14925 - DNA, 25 bp, Homo sapien
gtcgatgctcgggacacgaacatgg

SEQ ID NO: 14926 - DNA, 25 bp, Homo sapien
ccatcatcaagtggcaggacctgga

SEQ ID NO: 14927 - DNA, 25 bp, Homo sapien
ggaactctacgccaacgtggtgctg

SEQ ID NO: 14928 - DNA, 25 bp, Homo sapien
gatctccaggaagcgcgagaccagg

SEQ ID NO: 14929 - DNA, 25 bp, Homo sapien
ggcttggtcttagcacggggtctaa

SEQ ID NO: 14930 - DNA, 25 bp, Homo sapien
cctcggctcgtttcccattgaggga

SEQ ID NO: 14931 - DNA, 25 bp, Homo sapien
gccaggtggtcatgctcaactacaa

SEQ ID NO: 14932 - DNA, 25 bp, Homo sapien
cttctggtacgacgcggagatctcc

SEQ ID NO: 14933 - DNA, 25 bp, Homo sapien
gcgtggtccagatgaactccaggga

SEQ ID NO: 14934 - DNA, 25 bp, Homo sapien
gacgtgagttctgagccagcctttc

SEQ ID NO: 14935 - DNA, 25 bp, Homo sapien
cgactgtcggatcatcttcgtggac

SEQ ID NO: 14936 - DNA, 25 bp, Homo sapien
cttcaagattgagcggccgggtgaa

SEQ ID NO: 14937 - DNA, 25 bp, Homo sapien
tcctcgttccttgcagggatgattc

SEQ ID NO: 14938 - DNA, 25 bp, Homo sapien
gctcttgtcccgtctctggcttggc

SEQ ID NO: 14939 - DNA, 25 bp, Homo sapien
ctgcaaggacgacgtgaacagactc

SEQ ID NO: 14940 - DNA, 25 bp, Homo sapien
cttcgtggacgaagtcttcaagatt

SEQ ID NO: 14941 - DNA, 25 bp, Homo sapien
agggatgattctctgaacgactgtc

SEQ ID NO: 14942 - DNA, 25 bp, Homo sapien
ggctcacgctgttgttctttgtgtc

SEQ ID NO: 14943 - DNA, 25 bp, Homo sapien
agggctcacgctgttgttctttgtg

SEQ ID NO: 14944 - DNA, 25 bp, Homo sapien
ccagggctcacgctgttgttctttg

SEQ ID NO: 14945 - DNA, 25 bp, Homo sapien
tgccagggctcacgctgttgttctt

SEQ ID NO: 14946 - DNA, 25 bp, Homo sapien
cgcctgccagggctcacgctgttgt

SEQ ID NO: 14947 - DNA, 25 bp, Homo sapien
gtgaggcgggtccttcccacgtgcc

SEQ ID NO: 14948 - DNA, 25 bp, Homo sapien
acgctgttgttctttgtgtctgtgc

SEQ ID NO: 14949 - DNA, 25 bp, Homo sapien
gctgttgttctttgtgtctgtgcct

SEQ ID NO: 14950 - DNA, 25 bp, Homo sapien
cacatcgtcctcacagcgggactgg

SEQ ID NO: 14951 - DNA, 25 bp, Homo sapien
cccgtgggcaccatgtggcggttcc

SEQ ID NO: 14952 - DNA, 25 bp, Homo sapien
ctgtgtgggccgcaccaaggaatgt

SEQ ID NO: 14953 - DNA, 25 bp, Homo sapien
atgatgccagcgaggtggtactggc

SEQ ID NO: 14954 - DNA, 25 bp, Homo sapien
caccatgtggcggttccgagtccag

SEQ ID NO: 14955 - DNA, 25 bp, Homo sapien
ctgagtgccggaatgatgccagcga

SEQ ID NO: 14956 - DNA, 25 bp, Homo sapien
gtactgccctgagtgccggaatgat

SEQ ID NO: 14957 - DNA, 25 bp, Homo sapien
gggccgcaccaaggaatgtaccatc

SEQ ID NO: 14958 - DNA, 25 bp, Homo sapien
gcatctacaaggtgagtgccccttg

SEQ ID NO: 14959 - DNA, 25 bp, Homo sapien
tctgatggagctgacgctgatgccc

SEQ ID NO: 14960 - DNA, 25 bp, Homo sapien
atggagctgacgctgatgcccgctc

SEQ ID NO: 14961 - DNA, 25 bp, Homo sapien
gagctgacgctgatgcccgctctct

SEQ ID NO: 14962 - DNA, 25 bp, Homo sapien
agctgacgctgatgcccgctctctg

SEQ ID NO: 14963 - DNA, 25 bp, Homo sapien
cgctgatgcccgctctctgcaggtt

SEQ ID NO: 14964 - DNA, 25 bp, Homo sapien
ctgatgcccgctctctgcaggttgt

SEQ ID NO: 14965 - DNA, 25 bp, Homo sapien
ccggggctgcctctgatggagctga

SEQ ID NO: 14966 - DNA, 25 bp, Homo sapien
aggttgtgaaatactggcccgagaa

SEQ ID NO: 14967 - DNA, 25 bp, Homo sapien
aagtccgggtttctcgtgtggcgct

SEQ ID NO: 14968 - DNA, 25 bp, Homo sapien
ggtttctcgtgtggcgctaccttct

SEQ ID NO: 14969 - DNA, 25 bp, Homo sapien
tcgtgtggcgctaccttctgcggag

SEQ ID NO: 14970 - DNA, 25 bp, Homo sapien
cccgctgagggcaaccgctacgatg

SEQ ID NO: 14971 - DNA, 25 bp, Homo sapien
gcgcaatgtcaagggtggcaagaat

SEQ ID NO: 14972 - DNA, 25 bp, Homo sapien
ggcaaccgctacgatggcatctaca

SEQ ID NO: 14973 - DNA, 25 bp, Homo sapien
ggtggcaagaatagcaagtacgccc

SEQ ID NO: 14974 - DNA, 25 bp, Homo sapien
cggtaggctcgcacggctcactcgt

SEQ ID NO: 14975 - DNA, 25 bp, Homo sapien
agcggcagcccggtaggctcgcacg

SEQ ID NO: 14976 - DNA, 25 bp, Homo sapien
acggctcactcgtcgccctgatttg

SEQ ID NO: 14977 - DNA, 25 bp, Homo sapien
ggctcactcgtcgccctgatttgcg

SEQ ID NO: 14978 - DNA, 25 bp, Homo sapien
ggaagtcggcaggtgagaatctcgt

SEQ ID NO: 14979 - DNA, 25 bp, Homo sapien
ttgaggtcgtgtggacgtgggagcc

SEQ ID NO: 14980 - DNA, 25 bp, Homo sapien
tgagaatctcgtgggtgtggggtga

SEQ ID NO: 14981 - DNA, 25 bp, Homo sapien
gagcaggtgggcatctcgcgggtgt

SEQ ID NO: 14982 - DNA, 25 bp, Homo sapien
gtcactcaaggaccggccggcgagc

SEQ ID NO: 14983 - DNA, 25 bp, Homo sapien
tcatcagagaggacaagagcaacgc

SEQ ID NO: 14984 - DNA, 25 bp, Homo sapien
cgccggacatccaagaaaaccaagg

SEQ ID NO: 14985 - DNA, 25 bp, Homo sapien
cgccaagctgtggaatgaggtcctg

SEQ ID NO: 14986 - DNA, 25 bp, Homo sapien
agaggacaagagcaacgccaagctg

SEQ ID NO: 14987 - DNA, 25 bp, Homo sapien
cccagcagagcagcctcatcagaga

SEQ ID NO: 14988 - DNA, 25 bp, Homo sapien
aggtggagccctacagtctcacggc

SEQ ID NO: 14989 - DNA, 25 bp, Homo sapien
tgaggtcctggcgtcactcaaggac

SEQ ID NO: 14990 - DNA, 25 bp, Homo sapien
tccaatgagaacagagccggtcagc

SEQ ID NO: 14991 - DNA, 25 bp, Homo sapien
tgctgggtctcacgtactcagccgc

SEQ ID NO: 14992 - DNA, 25 bp, Homo sapien
cgtggatccggcagccaatggcagt

SEQ ID NO: 14993 - DNA, 25 bp, Homo sapien
cctgaggctcccttgtcaatccaag

SEQ ID NO: 14994 - DNA, 25 bp, Homo sapien
tcaagccaatactggctcctctctg

SEQ ID NO: 14995 - DNA, 25 bp, Homo sapien
ttgcgggcagtgattggcacctgcc

SEQ ID NO: 14996 - DNA, 25 bp, Homo sapien
ctgatgctgtgctgggtctcacgta

SEQ ID NO: 14997 - DNA, 25 bp, Homo sapien
ggtttcgaacctccagcctgcacgt

SEQ ID NO: 14998 - DNA, 25 bp, Homo sapien
ccacattcggggcagcgcttggttt

SEQ ID NO: 14999 - DNA, 25 bp, Homo sapien
ggacccgagctcgtgaactctgtca

SEQ ID NO: 15000 - DNA, 25 bp, Homo sapien
gagctcgtgaactctgtcagtgcca

SEQ ID NO: 15001 - DNA, 25 bp, Homo sapien
tgccactgacttggggcagtgtctc

SEQ ID NO: 15002 - DNA, 25 bp, Homo sapien
agtaaacgggtgatggccactgagc

SEQ ID NO: 15003 - DNA, 25 bp, Homo sapien
tgtgccatggcgctcgccaagggcc

SEQ ID NO: 15004 - DNA, 25 bp, Homo sapien
ctcgccaagggccagcatgtctgcg

SEQ ID NO: 15005 - DNA, 25 bp, Homo sapien
cacaggggcttcacgagccacattc

SEQ ID NO: 15006 - DNA, 25 bp, Homo sapien
tccgcgttcaacacaggggctggaa

SEQ ID NO: 15007 - DNA, 25 bp, Homo sapien
ggctggaatgagaccgctcctctga

SEQ ID NO: 15008 - DNA, 25 bp, Homo sapien
gcctccggctcgcaacgggcaaatg

SEQ ID NO: 15009 - DNA, 25 bp, Homo sapien
agtcccagctggatctccggccaga

SEQ ID NO: 15010 - DNA, 25 bp, Homo sapien
ccagtgattgctccgggaccacgaa

SEQ ID NO: 15011 - DNA, 25 bp, Homo sapien
tgggtgtctccgagtcgttttccta

SEQ ID NO: 15012 - DNA, 25 bp, Homo sapien
agtcgttttcctagtgcggacgcgc

SEQ ID NO: 15013 - DNA, 25 bp, Homo sapien
gatgcgcaccaaccgcagacagata

SEQ ID NO: 15014 - DNA, 25 bp, Homo sapien
ctcctggtatctgtcgtggtcctga

SEQ ID NO: 15015 - DNA, 25 bp, Homo sapien
gcatcctggagatccgctctgtaca

SEQ ID NO: 15016 - DNA, 25 bp, Homo sapien
cgtggtcatcaaagcagtgtcctca

SEQ ID NO: 15017 - DNA, 25 bp, Homo sapien
tgcacgaagcacagcggacagcagc

SEQ ID NO: 15018 - DNA, 25 bp, Homo sapien
tcaggcttctacgtggccatgaacc

SEQ ID NO: 15019 - DNA, 25 bp, Homo sapien
cgcagcgactctacaccgtggactg

SEQ ID NO: 15020 - DNA, 25 bp, Homo sapien
gcccatgttcctggcgctggacagg

SEQ ID NO: 15021 - DNA, 25 bp, Homo sapien
acacgtgggcgtcgtggtcatcaaa

SEQ ID NO: 15022 - DNA, 25 bp, Homo sapien
cctacatagagtcgcagggagccca

SEQ ID NO: 15023 - DNA, 25 bp, Homo sapien
ctgtggcgtccctgatacgtaaacc

SEQ ID NO: 15024 - DNA, 25 bp, Homo sapien
tgtcgcctcggccttagaaactagg

SEQ ID NO: 15025 - DNA, 25 bp, Homo sapien
ggacgcctctgcttctcgttagctg

SEQ ID NO: 15026 - DNA, 25 bp, Homo sapien
cctcgtgccttttatgctcagcaga

SEQ ID NO: 15027 - DNA, 25 bp, Homo sapien
tctctcgtcttcctccacaggtgtg

SEQ ID NO: 15028 - DNA, 25 bp, Homo sapien
cccagctgtaaaatcatgacgtttc

SEQ ID NO: 15029 - DNA, 25 bp, Homo sapien
tgacgtttcgcccaaccatggaaga

SEQ ID NO: 15030 - DNA, 25 bp, Homo sapien
ggcgagtttcctctaatagcactga

SEQ ID NO: 15031 - DNA, 25 bp, Homo sapien
cagactaggatcatgggcgagtttc

SEQ ID NO: 15032 - DNA, 25 bp, Homo sapien
gtggctcccagatgtctttactaca

SEQ ID NO: 15033 - DNA, 25 bp, Homo sapien
gacagatgagcaatgtagcccgagg

SEQ ID NO: 15034 - DNA, 25 bp, Homo sapien
tagcccgaggcgttctttcaagagc

SEQ ID NO: 15035 - DNA, 25 bp, Homo sapien
tttcaagagcagaggaatcgggagc

SEQ ID NO: 15036 - DNA, 25 bp, Homo sapien
tgtttggagcttcctgcgtggctcc

SEQ ID NO: 15037 - DNA, 25 bp, Homo sapien
tgaagaggcgaattcacggcttccc

SEQ ID NO: 15038 - DNA, 25 bp, Homo sapien
tcgggcctcttcacgcagtacaata

SEQ ID NO: 15039 - DNA, 25 bp, Homo sapien
ctggccaacagcgagaagtacgcgg

SEQ ID NO: 15040 - DNA, 25 bp, Homo sapien
tgacagtgggcgagtaccgccgcct

SEQ ID NO: 15041 - DNA, 25 bp, Homo sapien
gtacaatatccagaagaaggccatg

SEQ ID NO: 15042 - DNA, 25 bp, Homo sapien
acgacgtggtgatcccggcgcccat

SEQ ID NO: 15043 - DNA, 25 bp, Homo sapien
cgtatgatgacatcgacgacgtggt

SEQ ID NO: 15044 - DNA, 25 bp, Homo sapien
aagccgcggcagacgtatgatgaca

SEQ ID NO: 15045 - DNA, 25 bp, Homo sapien
aaggccatgacagtgggcgagtacc

SEQ ID NO: 15046 - DNA, 25 bp, Homo sapien
accttatcccgcgtggtgtttatcg

SEQ ID NO: 15047 - DNA, 25 bp, Homo sapien
tccaccgtatcctgcgtggtgttta

SEQ ID NO: 15048 - DNA, 25 bp, Homo sapien
tgtttatcggagtggggtgtccacc

SEQ ID NO: 15049 - DNA, 25 bp, Homo sapien
gggtgtccaccttatcccgtgctgt

SEQ ID NO: 15050 - DNA, 25 bp, Homo sapien
ggtgtccaccttatcccgtgctgtg

SEQ ID NO: 15051 - DNA, 25 bp, Homo sapien
atcccactctgtgtttatcggagtg

SEQ ID NO: 15052 - DNA, 25 bp, Homo sapien
tggggtgtccaccttatcccactct

SEQ ID NO: 15053 - DNA, 25 bp, Homo sapien
gtgtccaccttatcccgcgtggtgt

SEQ ID NO: 15054 - DNA, 25 bp, Homo sapien
ctatgacggctggagatcttccgga

SEQ ID NO: 15055 - DNA, 25 bp, Homo sapien
aactacctgcactttggggagccta

SEQ ID NO: 15056 - DNA, 25 bp, Homo sapien
ggcacaccgaggacatggacctgta

SEQ ID NO: 15057 - DNA, 25 bp, Homo sapien
tgtggaagaccaccttcgcctggca

SEQ ID NO: 15058 - DNA, 25 bp, Homo sapien
ccctacctgtacttcggcatgtgga

SEQ ID NO: 15059 - DNA, 25 bp, Homo sapien
caccatcatcgagggcgtgaacacg

SEQ ID NO: 15060 - DNA, 25 bp, Homo sapien
gagcctccggaccatcctggacatg

SEQ ID NO: 15061 - DNA, 25 bp, Homo sapien
agtcaatcccgggtacacggctggg

SEQ ID NO: 15062 - DNA, 25 bp, Homo sapien
ccggggccgcgctcatgcctggaat

SEQ ID NO: 15063 - DNA, 25 bp, Homo sapien
acttggggcaaagcgtggcctccca

SEQ ID NO: 15064 - DNA, 25 bp, Homo sapien
cgtccgaagcgcagatggagcccaa

SEQ ID NO: 15065 - DNA, 25 bp, Homo sapien
tcacctgcgtccgaagcgcagatgg

SEQ ID NO: 15066 - DNA, 25 bp, Homo sapien
gagctgtgcgcatcctcacctgcgt

SEQ ID NO: 15067 - DNA, 25 bp, Homo sapien
gggagaatgctgtacctcttcgtta

SEQ ID NO: 15068 - DNA, 25 bp, Homo sapien
ctccaagggccgctaggtggcgctc

SEQ ID NO: 15069 - DNA, 25 bp, Homo sapien
aaaagcacaatgagcaggaaggggc

SEQ ID NO: 15070 - DNA, 25 bp, Homo sapien
ctgcgagagccgagagctctgtctc

SEQ ID NO: 15071 - DNA, 25 bp, Homo sapien
cagtgtgacgacacctcgtggccca

SEQ ID NO: 15072 - DNA, 25 bp, Homo sapien
cacggatcctcagggtgctgaccca

SEQ ID NO: 15073 - DNA, 25 bp, Homo sapien
gtgtatgaagttcgcacggatcctc

SEQ ID NO: 15074 - DNA, 25 bp, Homo sapien
cctaattaaagtgggctggcggtgt

SEQ ID NO: 15075 - DNA, 25 bp, Homo sapien
ctcggcgagtctgctcctaattaaa

SEQ ID NO: 15076 - DNA, 25 bp, Homo sapien
gctccgctttgtcgggcattcctgt

SEQ ID NO: 15077 - DNA, 25 bp, Homo sapien
cgtgacatggcttgcctcggcgagt

SEQ ID NO: 15078 - DNA, 25 bp, Homo sapien
cgcgagcagaagaagcaaggctgtc

SEQ ID NO: 15079 - DNA, 25 bp, Homo sapien
gcgagatgacagtggcctgtccgct

SEQ ID NO: 15080 - DNA, 25 bp, Homo sapien
atgacagtggcctgtccgctggctg

SEQ ID NO: 15081 - DNA, 25 bp, Homo sapien
ggagcgcctgcctgcagagaacgcc

SEQ ID NO: 15082 - DNA, 25 bp, Homo sapien
ctgcctgcagagaacgcctttgctt

SEQ ID NO: 15083 - DNA, 25 bp, Homo sapien
agagaacgcctttgctttcattccc

SEQ ID NO: 15084 - DNA, 25 bp, Homo sapien
tggggcccatggcaaaggttcgccc

SEQ ID NO: 15085 - DNA, 25 bp, Homo sapien
atggcaaaggttcgcccacccgtcg

SEQ ID NO: 15086 - DNA, 25 bp, Homo sapien
cggctacagttcgagcgctggaatg

SEQ ID NO: 15087 - DNA, 25 bp, Homo sapien
cgcaaggtcatgtacttcctcgtca

SEQ ID NO: 15088 - DNA, 25 bp, Homo sapien
agcgcctgtcggacctggccaagat

SEQ ID NO: 15089 - DNA, 25 bp, Homo sapien
atagattggaatgaggccgacgccc

SEQ ID NO: 15090 - DNA, 25 bp, Homo sapien
ccactgccatcttctggcgcaagga

SEQ ID NO: 15091 - DNA, 25 bp, Homo sapien
tcgcagaactggacgcctgacctca

SEQ ID NO: 15092 - DNA, 25 bp, Homo sapien
ccagcggagtctgtgtaccgcctca

SEQ ID NO: 15093 - DNA, 25 bp, Homo sapien
aacctcatgacacgccagctgctgg

SEQ ID NO: 15094 - DNA, 25 bp, Homo sapien
tgcttttagtgtggagaaaagttgc

SEQ ID NO: 15095 - DNA, 25 bp, Homo sapien
gaaaagttgctggattcggcaaacc

SEQ ID NO: 15096 - DNA, 25 bp, Homo sapien
tgtactttgcaaaacctcaccgtgg

SEQ ID NO: 15097 - DNA, 25 bp, Homo sapien
ctttgcaaaacctcaccgtggtgtc

SEQ ID NO: 15098 - DNA, 25 bp, Homo sapien
ggtgtcagcagaagcaccgtggccc

SEQ ID NO: 15099 - DNA, 25 bp, Homo sapien
ctggtgctctcgcacacagctgtgc

SEQ ID NO: 15100 - DNA, 25 bp, Homo sapien
cggcaggcagtcatcattctcgttg

SEQ ID NO: 15101 - DNA, 25 bp, Homo sapien
ctcgttgaaatgcttttagtgtgga

SEQ ID NO: 15102 - DNA, 25 bp, Homo sapien
gctccagaaacacggccgggagtta

SEQ ID NO: 15103 - DNA, 25 bp, Homo sapien
aaaacgcggccctgagctatagaaa

SEQ ID NO: 15104 - DNA, 25 bp, Homo sapien
catgctcaccgctgcgagaacaacg

SEQ ID NO: 15105 - DNA, 25 bp, Homo sapien
gcgagaacaacgtggggtcctgcct

SEQ ID NO: 15106 - DNA, 25 bp, Homo sapien
gagaccgagacaacctccctgcagg

SEQ ID NO: 15107 - DNA, 25 bp, Homo sapien
aaacctcaaacgcacgccacgaggg

SEQ ID NO: 15108 - DNA, 25 bp, Homo sapien
caggctgaccaacgtgtgctggcta

SEQ ID NO: 15109 - DNA, 25 bp, Homo sapien
gggtgaaatacgcactggctcaggc

SEQ ID NO: 15110 - DNA, 25 bp, Homo sapien
ggaggccaacgcctcggtgttcctc

SEQ ID NO: 15111 - DNA, 25 bp, Homo sapien
cttctgcctacagccctgggagtca

SEQ ID NO: 15112 - DNA, 25 bp, Homo sapien
tctcagagaaaaggtcagagccaag

SEQ ID NO: 15113 - DNA, 25 bp, Homo sapien
cgtcggaaatatgcacacggtgtct

SEQ ID NO: 15114 - DNA, 25 bp, Homo sapien
gtcttttgttacagcagacgtcgga

SEQ ID NO: 15115 - DNA, 25 bp, Homo sapien
ctccagaaccgccagaaaataaacg

SEQ ID NO: 15116 - DNA, 25 bp, Homo sapien
cacggtgtctgaaactgttctcatg

SEQ ID NO: 15117 - DNA, 25 bp, Homo sapien
cgtagtaagccatcaactttgtggt

SEQ ID NO: 15118 - DNA, 25 bp, Homo sapien
agggtcgtgctctctcgttgaccga

SEQ ID NO: 15119 - DNA, 25 bp, Homo sapien
tcgtgctctctcgttgaccgagtga

SEQ ID NO: 15120 - DNA, 25 bp, Homo sapien
gggtcgtgctctctcgttgactgag

SEQ ID NO: 15121 - DNA, 25 bp, Homo sapien
tcgtgctctctcgttgactgagtga

SEQ ID NO: 15122 - DNA, 25 bp, Homo sapien
ggtcgtgctctctcgttgactgagt

SEQ ID NO: 15123 - DNA, 25 bp, Homo sapien
gtcgtgctctctcgttgactgagtg

SEQ ID NO: 15124 - DNA, 25 bp, Homo sapien
agggttgtgctctctcgttgaccga

SEQ ID NO: 15125 - DNA, 25 bp, Homo sapien
gagagcggccacactgcatcctttc

SEQ ID NO: 15126 - DNA, 25 bp, Homo sapien
ggcctcactgcagcgctgataatta

SEQ ID NO: 15127 - DNA, 25 bp, Homo sapien
tcgtccttcccacgcgttctgtgag

SEQ ID NO: 15128 - DNA, 25 bp, Homo sapien
aactggtttgttatcggcctcactg

SEQ ID NO: 15129 - DNA, 25 bp, Homo sapien
cagtaggtttcctaatgaactggtt

SEQ ID NO: 15130 - DNA, 25 bp, Homo sapien
ctgccgagcacttccagtaggtttc

SEQ ID NO: 15131 - DNA, 25 bp, Homo sapien
aattgttttgttgacgcggctgccg

SEQ ID NO: 15132 - DNA, 25 bp, Homo sapien
agccggcgcctaattgttttgttga

SEQ ID NO: 15133 - DNA, 25 bp, Homo sapien
gttctgtgagccatcagcgcagatg

SEQ ID NO: 15134 - DNA, 25 bp, Homo sapien
ctacactggagtcgctggtgacatc

SEQ ID NO: 15135 - DNA, 25 bp, Homo sapien
tgtggcatttctacactggagtcgc

SEQ ID NO: 15136 - DNA, 25 bp, Homo sapien
ggcatttctacactggagtcgctgg

SEQ ID NO: 15137 - DNA, 25 bp, Homo sapien
cactggagtcgctggtgacatcagt

SEQ ID NO: 15138 - DNA, 25 bp, Homo sapien
ggtgacatcagtggcgcctgttgcc

SEQ ID NO: 15139 - DNA, 25 bp, Homo sapien
catcagtggcgcctgttgccgcggt

SEQ ID NO: 15140 - DNA, 25 bp, Homo sapien
cgtgcgatgtggcatttctacactg

SEQ ID NO: 15141 - DNA, 25 bp, Homo sapien
agtcgctggtgacatcagtggcgcc

SEQ ID NO: 15142 - DNA, 25 bp, Homo sapien
gggcctcgctgaaggccaagctcct

SEQ ID NO: 15143 - DNA, 25 bp, Homo sapien
aggacatggtcaagatctccatgga

SEQ ID NO: 15144 - DNA, 25 bp, Homo sapien
aaggacctcacggtgctggaccaca

SEQ ID NO: 15145 - DNA, 25 bp, Homo sapien
ctcctccgcaggtgagttgccaagg

SEQ ID NO: 15146 - DNA, 25 bp, Homo sapien
agctcctggagtgcatcccgggcct

SEQ ID NO: 15147 - DNA, 25 bp, Homo sapien
cgcagtgcacgtgccggaaggacat

SEQ ID NO: 15148 - DNA, 25 bp, Homo sapien
ctccatggacgtgttcgtgcgcatc

SEQ ID NO: 15149 - DNA, 25 bp, Homo sapien
aagcagggcaaggacctcacggtgc

SEQ ID NO: 15150 - DNA, 25 bp, Homo sapien
atcccacctggtgtcagtcggcttc

SEQ ID NO: 15151 - DNA, 25 bp, Homo sapien
gtgtcagtcggcttcccatctccag

SEQ ID NO: 15152 - DNA, 25 bp, Homo sapien
tttcgttccgtttgtcgtctaggca

SEQ ID NO: 15153 - DNA, 25 bp, Homo sapien
catgagctgctgtttccctcggagc

SEQ ID NO: 15154 - DNA, 25 bp, Homo sapien
ggcattttccatgagctgctgtttc

SEQ ID NO: 15155 - DNA, 25 bp, Homo sapien
ccgtttgtcgtctaggcattttcca

SEQ ID NO: 15156 - DNA, 25 bp, Homo sapien
gctgtcgtaagtgtctttttcgttc

SEQ ID NO: 15157 - DNA, 25 bp, Homo sapien
ctgtgtctctgtcccgtggcacacg

SEQ ID NO: 15158 - DNA, 25 bp, Homo sapien
aggcgggcctcacgggtcccagaga

SEQ ID NO: 15159 - DNA, 25 bp, Homo sapien
actgcgccatctgcacgctcttcta

SEQ ID NO: 15160 - DNA, 25 bp, Homo sapien
cgcacggagccctactgcgccatct

SEQ ID NO: 15161 - DNA, 25 bp, Homo sapien
aagttcaacgcagcggctgcgcgca

SEQ ID NO: 15162 - DNA, 25 bp, Homo sapien
agaggaagttcaacgcagcggctgc

SEQ ID NO: 15163 - DNA, 25 bp, Homo sapien
ccaggccgagaggaagttcaacgca

SEQ ID NO: 15164 - DNA, 25 bp, Homo sapien
agcttccaggccgagaggaagttca

SEQ ID NO: 15165 - DNA, 25 bp, Homo sapien
ttctacccctactgccaggtgggca

SEQ ID NO: 15166 - DNA, 25 bp, Homo sapien
ctcggaaagggctgcccggccacat

SEQ ID NO: 15167 - DNA, 25 bp, Homo sapien
ctgagaaggaggcacccatagcctc

SEQ ID NO: 15168 - DNA, 25 bp, Homo sapien
tcacctctggcggtgagaacacgga

SEQ ID NO: 15169 - DNA, 25 bp, Homo sapien
ttaccctccaaaagccgtcagaaga

SEQ ID NO: 15170 - DNA, 25 bp, Homo sapien
gaccgctcatccctgagatgtgctt

SEQ ID NO: 15171 - DNA, 25 bp, Homo sapien
ctacaggccctacagactgagaagg

SEQ ID NO: 15172 - DNA, 25 bp, Homo sapien
tccctgagatgtgcttcacctctgg

SEQ ID NO: 15173 - DNA, 25 bp, Homo sapien
caactcctacatcggcgacgacggg

SEQ ID NO: 15174 - DNA, 25 bp, Homo sapien
gcccgcagcagatggcccggtttag

SEQ ID NO: 15175 - DNA, 25 bp, Homo sapien
ggcgttcaagacctacgccgtcctg

SEQ ID NO: 15176 - DNA, 25 bp, Homo sapien
ctgttagaagctgggcgggccacaa

SEQ ID NO: 15177 - DNA, 25 bp, Homo sapien
aagacctacgccgtcctgccggtga

SEQ ID NO: 15178 - DNA, 25 bp, Homo sapien
gcgggcgtcacctaagccgccgttg

SEQ ID NO: 15179 - DNA, 25 bp, Homo sapien
taccgccgcggtgccagtgaagccg

SEQ ID NO: 15180 - DNA, 25 bp, Homo sapien
gccaggtgccacgtttatcccgggc

SEQ ID NO: 15181 - DNA, 25 bp, Homo sapien
gtgcgcagcctgaaccaggcgttca

SEQ ID NO: 15182 - DNA, 25 bp, Homo sapien
atgcttccgaggcaccagtgactca

SEQ ID NO: 15183 - DNA, 25 bp, Homo sapien
taccggtgcttgtaacgatgaatta

SEQ ID NO: 15184 - DNA, 25 bp, Homo sapien
gaacgcagcctcttcattaccggtg

SEQ ID NO: 15185 - DNA, 25 bp, Homo sapien
tgcccgacgccttatggatcatctg

SEQ ID NO: 15186 - DNA, 25 bp, Homo sapien
atgcgtggtgcagtgataagtcctc

SEQ ID NO: 15187 - DNA, 25 bp, Homo sapien
gtgggcgtaaaaggcctcatgattc

SEQ ID NO: 15188 - DNA, 25 bp, Homo sapien
cagtgactcagtccacaaacgtggg

SEQ ID NO: 15189 - DNA, 25 bp, Homo sapien
cgaggcccgcttgtactgcttaatg

SEQ ID NO: 15190 - DNA, 25 bp, Homo sapien
tcgaaccaaacaccagtgcctgggc

SEQ ID NO: 15191 - DNA, 25 bp, Homo sapien
gtgacggccaagaacgcctgcccga

SEQ ID NO: 15192 - DNA, 25 bp, Homo sapien
ttcaaactgcggctcccaggaaggg

SEQ ID NO: 15193 - DNA, 25 bp, Homo sapien
cctgggccaggccagcactggatgt

SEQ ID NO: 15194 - DNA, 25 bp, Homo sapien
ggaacttcgaaccaaacaccagtgc

SEQ ID NO: 15195 - DNA, 25 bp, Homo sapien
cctgtggcctccgaggaaggacacc

SEQ ID NO: 15196 - DNA, 25 bp, Homo sapien
acagcgcgtggcgtgactggacctc

SEQ ID NO: 15197 - DNA, 25 bp, Homo sapien
cactggatgtgggtcttcaaactgc

SEQ ID NO: 15198 - DNA, 25 bp, Homo sapien
gacgactggccctatgtggtctcca

SEQ ID NO: 15199 - DNA, 25 bp, Homo sapien
cgcagacctgctacgaagtgaactt

SEQ ID NO: 15200 - DNA, 25 bp, Homo sapien
cgcaacgggctgtactaccgctgtc

SEQ ID NO: 15201 - DNA, 25 bp, Homo sapien
ggtcatcaccaagaaccgcaacggg

SEQ ID NO: 15202 - DNA, 25 bp, Homo sapien
ccaggtccaactcctgagggccgtg

SEQ ID NO: 15203 - DNA, 25 bp, Homo sapien
cacctgcctcaagcacaagtcgggg

SEQ ID NO: 15204 - DNA, 25 bp, Homo sapien
aacttcgacgatggctcctacagcg

SEQ ID NO: 15205 - DNA, 25 bp, Homo sapien
tgtggtctccatcacctgcctcaag

SEQ ID NO: 15206 - DNA, 25 bp, Homo sapien
cagcaccggcttctctttgtaagta

SEQ ID NO: 15207 - DNA, 25 bp, Homo sapien
cgttagctgtctccatcgtctgatt

SEQ ID NO: 15208 - DNA, 25 bp, Homo sapien
cgtctgattcttggatcccaggatg

SEQ ID NO: 15209 - DNA, 25 bp, Homo sapien
tccagcaaccttgagcagtggggtc

SEQ ID NO: 15210 - DNA, 25 bp, Homo sapien
cctggcgctttaacgctggtgtttc

SEQ ID NO: 15211 - DNA, 25 bp, Homo sapien
agagcagttttgctagccggccctg

SEQ ID NO: 15212 - DNA, 25 bp, Homo sapien
agcttggccttttcctgacgcacgg

SEQ ID NO: 15213 - DNA, 25 bp, Homo sapien
tgggatccgagttacctggccaagg

SEQ ID NO: 15214 - DNA, 25 bp, Homo sapien
tgcgatggtcccgaggccgcattaa

SEQ ID NO: 15215 - DNA, 25 bp, Homo sapien
cagctctttaccacgtcggttaagg

SEQ ID NO: 15216 - DNA, 25 bp, Homo sapien
gcattaaggaaaggtcccgcccgca

SEQ ID NO: 15217 - DNA, 25 bp, Homo sapien
ttctttgtaaacatcggagttcagc

SEQ ID NO: 15218 - DNA, 25 bp, Homo sapien
tctcccgccagacctgaatgaactg

SEQ ID NO: 15219 - DNA, 25 bp, Homo sapien
ctgaatgaactgaaatgatcgagtg

SEQ ID NO: 15220 - DNA, 25 bp, Homo sapien
gatcgagtgtcactgagtgcccagg

SEQ ID NO: 15221 - DNA, 25 bp, Homo sapien
ggagttcagctctttaccacgtcgg

SEQ ID NO: 15222 - DNA, 25 bp, Homo sapien
acgtgccgggcaagacgtcaccaca

SEQ ID NO: 15223 - DNA, 25 bp, Homo sapien
agatgcttctgagacgtgccgggca

SEQ ID NO: 15224 - DNA, 25 bp, Homo sapien
ccctcgagatgcttctgagacgtgc

SEQ ID NO: 15225 - DNA, 25 bp, Homo sapien
gaacatgtttccctcgcacgtgacc

SEQ ID NO: 15226 - DNA, 25 bp, Homo sapien
ccgcctgtccggaacacttggaaca

SEQ ID NO: 15227 - DNA, 25 bp, Homo sapien
aggacctcgatcacacaatcatgca

SEQ ID NO: 15228 - DNA, 25 bp, Homo sapien
gcggcaggacctcgatcacacaatc

SEQ ID NO: 15229 - DNA, 25 bp, Homo sapien
acaatcatgcaaacgcccgctgtgt

SEQ ID NO: 15230 - DNA, 25 bp, Homo sapien
cttgccacggaggactccgggcgga

SEQ ID NO: 15231 - DNA, 25 bp, Homo sapien
cgacaggagccagcgggacgccgca

SEQ ID NO: 15232 - DNA, 25 bp, Homo sapien
agaggccacctccaagccgcgggtg

SEQ ID NO: 15233 - DNA, 25 bp, Homo sapien
cgcttgctgtgaattcctgtcctcg

SEQ ID NO: 15234 - DNA, 25 bp, Homo sapien
gggcgttcgcttgctgtgaattcct

SEQ ID NO: 15235 - DNA, 25 bp, Homo sapien
tgggcaccccgcttgccacggagga

SEQ ID NO: 15236 - DNA, 25 bp, Homo sapien
tctcccgcagtcactgagcacgggg

SEQ ID NO: 15237 - DNA, 25 bp, Homo sapien
cgttcgcttgctgtgaattcctgtc

SEQ ID NO: 15238 - DNA, 25 bp, Homo sapien
cgtcgaattgttctcccacagcatg

SEQ ID NO: 15239 - DNA, 25 bp, Homo sapien
atctcccgcagcttggtcagcatca

SEQ ID NO: 15240 - DNA, 25 bp, Homo sapien
tcagcgctgtctgagccacagtctg

SEQ ID NO: 15241 - DNA, 25 bp, Homo sapien
ggccggccagtactggtgacacttc

SEQ ID NO: 15242 - DNA, 25 bp, Homo sapien
ggtcagcatcaccacgatcgtcgaa

SEQ ID NO: 15243 - DNA, 25 bp, Homo sapien
ccctgtgtcgcgatgtaggccttct

SEQ ID NO: 15244 - DNA, 25 bp, Homo sapien
cagaagtcttccgtggtctccgcca

SEQ ID NO: 15245 - DNA, 25 bp, Homo sapien
cacagcatgcgccagaagtcttccg

SEQ ID NO: 15246 - DNA, 25 bp, Homo sapien
atccgctcaagcatggcgtcgatga

SEQ ID NO: 15247 - DNA, 25 bp, Homo sapien
cgtggccatagacatcgactgtctt

SEQ ID NO: 15248 - DNA, 25 bp, Homo sapien
acctcatgagcgtcacgtggccata

SEQ ID NO: 15249 - DNA, 25 bp, Homo sapien
tcgatgacgataaagcagcctgtgc

SEQ ID NO: 15250 - DNA, 25 bp, Homo sapien
gcaggtcttgactctccgcaggaaa

SEQ ID NO: 15251 - DNA, 25 bp, Homo sapien
atggtccggccacgccgtaaactgg

SEQ ID NO: 15252 - DNA, 25 bp, Homo sapien
gtaaactggaactggcggacctcgc

SEQ ID NO: 15253 - DNA, 25 bp, Homo sapien
gacgtacctgcagtgaaccacgatg

SEQ ID NO: 15254 - DNA, 25 bp, Homo sapien
cgtgtcctccgggatgctcaggacc

SEQ ID NO: 15255 - DNA, 25 bp, Homo sapien
ggcgtcgagtcctcacggccaaact

SEQ ID NO: 15256 - DNA, 25 bp, Homo sapien
cggccaaactgcaggcggtagccca

SEQ ID NO: 15257 - DNA, 25 bp, Homo sapien
gccgcaagccggaacacatacgtgg

SEQ ID NO: 15258 - DNA, 25 bp, Homo sapien
cacggccaccgtgtatttgacgatg

SEQ ID NO: 15259 - DNA, 25 bp, Homo sapien
tcgcacttggaggtcataggccgtg

SEQ ID NO: 15260 - DNA, 25 bp, Homo sapien
ccttgtgcacgcctgatgccgtgta

SEQ ID NO: 15261 - DNA, 25 bp, Homo sapien
cgcctccagaatctgcgggtggcca

SEQ ID NO: 15262 - DNA, 25 bp, Homo sapien
tcgccggagacccacttctaaaagc

SEQ ID NO: 15263 - DNA, 25 bp, Homo sapien
gagacccacttctaaaagcaccacg

SEQ ID NO: 15264 - DNA, 25 bp, Homo sapien
cccgttagcaaaagggagctgcgga

SEQ ID NO: 15265 - DNA, 25 bp, Homo sapien
agctgcggatcgctcagaacaggcc

SEQ ID NO: 15266 - DNA, 25 bp, Homo sapien
ggcaagagtcgtgcaggctcacacc

SEQ ID NO: 15267 - DNA, 25 bp, Homo sapien
acgcacccgtgtacaggtctgcagg

SEQ ID NO: 15268 - DNA, 25 bp, Homo sapien
gatggccgctcgtcctggtcacgca

SEQ ID NO: 15269 - DNA, 25 bp, Homo sapien
tcgtgcaggctcacacccagggctg

SEQ ID NO: 15270 - DNA, 25 bp, Homo sapien
cctgagactttgtccgctgtgcagc

SEQ ID NO: 15271 - DNA, 25 bp, Homo sapien
taccgggaccacctcatctacgtga

SEQ ID NO: 15272 - DNA, 25 bp, Homo sapien
gcaacctgcttatccgctaccggga

SEQ ID NO: 15273 - DNA, 25 bp, Homo sapien
gggcatcttgcgcaacctgcttatc

SEQ ID NO: 15274 - DNA, 25 bp, Homo sapien
cacggcgtggaggacatgatccgcc

SEQ ID NO: 15275 - DNA, 25 bp, Homo sapien
gaacgcaacgcacatcaagcctatg

SEQ ID NO: 15276 - DNA, 25 bp, Homo sapien
gaacactggatctctccgcagaacg

SEQ ID NO: 15277 - DNA, 25 bp, Homo sapien
agagcacgctgacgttctggctccc

SEQ ID NO: 15278 - DNA, 25 bp, Homo sapien
aactgggcgctcttagcgctcacca

SEQ ID NO: 15279 - DNA, 25 bp, Homo sapien
gccggtgaataactgggcgctctta

SEQ ID NO: 15280 - DNA, 25 bp, Homo sapien
atgccgagtggctgccggtgaataa

SEQ ID NO: 15281 - DNA, 25 bp, Homo sapien
tccgattccaggatgccgagtggct

SEQ ID NO: 15282 - DNA, 25 bp, Homo sapien
gcagtgccactgtccgattccagga

SEQ ID NO: 15283 - DNA, 25 bp, Homo sapien
agcgccacagcacgcggatggccgt

SEQ ID NO: 15284 - DNA, 25 bp, Homo sapien
tagccgcggatctggccgtgctgcc

SEQ ID NO: 15285 - DNA, 25 bp, Homo sapien
cgcacgtagtggacctggtagccgc

SEQ ID NO: 15286 - DNA, 25 bp, Homo sapien
ggagcgcacgctgacacatttaacg

SEQ ID NO: 15287 - DNA, 25 bp, Homo sapien
tctgtgtgagcgacagtcgtgatgc

SEQ ID NO: 15288 - DNA, 25 bp, Homo sapien
cggtactgggtccacttctccaagg

SEQ ID NO: 15289 - DNA, 25 bp, Homo sapien
acttaccaaaatggccgtggagcgc

SEQ ID NO: 15290 - DNA, 25 bp, Homo sapien
ggatgccgttcacctccttgggttc

SEQ ID NO: 15291 - DNA, 25 bp, Homo sapien
cggcgggcgccaacttaccaaaatg

SEQ ID NO: 15292 - DNA, 25 bp, Homo sapien
caggtacttaccatcctcgtcggtg

SEQ ID NO: 15293 - DNA, 25 bp, Homo sapien
caaggcctccagcaggatctgagtg

SEQ ID NO: 15294 - DNA, 25 bp, Homo sapien
atacgcctggccctgagtctttgct

SEQ ID NO: 15295 - DNA, 25 bp, Homo sapien
gactgtccgttcagcccagagtggc

SEQ ID NO: 15296 - DNA, 25 bp, Homo sapien
cgaattcgggccgtggactgtccgt

SEQ ID NO: 15297 - DNA, 25 bp, Homo sapien
acctgcatgacatctcgggaaggga

SEQ ID NO: 15298 - DNA, 25 bp, Homo sapien
taggtcacgtccttcacaatccggc

SEQ ID NO: 15299 - DNA, 25 bp, Homo sapien
gaccgtgtaggtcacgtccttcaca

SEQ ID NO: 15300 - DNA, 25 bp, Homo sapien
aagccgctttctaggtgaccgtgta

SEQ ID NO: 15301 - DNA, 25 bp, Homo sapien
gagtctttgctgtcggttctcctgg

SEQ ID NO: 15302 - DNA, 25 bp, Homo sapien
cgtggtccctcccgcagagaagggc

SEQ ID NO: 15303 - DNA, 25 bp, Homo sapien
aaggcgtactccgtgttgggcttca

SEQ ID NO: 15304 - DNA, 25 bp, Homo sapien
ctggactgcagcgtgcgctgccgca

SEQ ID NO: 15305 - DNA, 25 bp, Homo sapien
caccacgtaggaagtcgtcgggtcg

SEQ ID NO: 15306 - DNA, 25 bp, Homo sapien
acacctactggactgcagcgtgcgc

SEQ ID NO: 15307 - DNA, 25 bp, Homo sapien
cgcgagacacctactggactgcagc

SEQ ID NO: 15308 - DNA, 25 bp, Homo sapien
tggatccgaggtcggggaacaaagc

SEQ ID NO: 15309 - DNA, 25 bp, Homo sapien
aggtcctccaccacgtaggaagtcg

SEQ ID NO: 15310 - DNA, 25 bp, Homo sapien
ctcctgagtgccctgacggcggaat

SEQ ID NO: 15311 - DNA, 25 bp, Homo sapien
cgcggttttgctacaacgttccgcg

SEQ ID NO: 15312 - DNA, 25 bp, Homo sapien
tggcctcctgaccatgtgactgtgg

SEQ ID NO: 15313 - DNA, 25 bp, Homo sapien
aagagggaccgcgtggcctcctgac

SEQ ID NO: 15314 - DNA, 25 bp, Homo sapien
tccaagggctcctcagcaaggctga

SEQ ID NO: 15315 - DNA, 25 bp, Homo sapien
gtcgggtcctgccagtgacaaaatg

SEQ ID NO: 15316 - DNA, 25 bp, Homo sapien
tcggagatcactgtggagcccacgc

SEQ ID NO: 15317 - DNA, 25 bp, Homo sapien
cagtgacaaaatgctccaagggctc

SEQ ID NO: 15318 - DNA, 25 bp, Homo sapien
tctttaatctgatacggcccgtctt

SEQ ID NO: 15319 - DNA, 25 bp, Homo sapien
tggtcagcaggctgtcgtccacgtt

SEQ ID NO: 15320 - DNA, 25 bp, Homo sapien
gtccacgttgtgcttctgccagttg

SEQ ID NO: 15321 - DNA, 25 bp, Homo sapien
tgctccggttccatggtgtagtaga

SEQ ID NO: 15322 - DNA, 25 bp, Homo sapien
cactgcacaatcatggtggtcgcgc

SEQ ID NO: 15323 - DNA, 25 bp, Homo sapien
ttgacggccgacacccagatctcgt

SEQ ID NO: 15324 - DNA, 25 bp, Homo sapien
atctcgtactccgagttggggctca

SEQ ID NO: 15325 - DNA, 25 bp, Homo sapien
cccgtcttggctcttggatttatat

SEQ ID NO: 15326 - DNA, 25 bp, Homo sapien
ccctggcatgatctcgtggctcatg

SEQ ID NO: 15327 - DNA, 25 bp, Homo sapien
tgcatccacttcacgtatggcatgg

SEQ ID NO: 15328 - DNA, 25 bp, Homo sapien
ttcacgtatggcatgggcgagccca

SEQ ID NO: 15329 - DNA, 25 bp, Homo sapien
atgatctcgtggctcatgggcagga

SEQ ID NO: 15330 - DNA, 25 bp, Homo sapien
atggcatgggcgagcccacggccac

SEQ ID NO: 15331 - DNA, 25 bp, Homo sapien
ccacggccacgcaggtgatgttcac

SEQ ID NO: 15332 - DNA, 25 bp, Homo sapien
cacgcaggtgatgttcacgttgccc

SEQ ID NO: 15333 - DNA, 25 bp, Homo sapien
cgttccgacccacgggcatgtcatc

SEQ ID NO: 15334 - DNA, 25 bp, Homo sapien
ccgacctgaatggagggtccaggca

SEQ ID NO: 15335 - DNA, 25 bp, Homo sapien
ctcttctcgtcaccgagtagccggg

SEQ ID NO: 15336 - DNA, 25 bp, Homo sapien
gtttccagctcttctcgtcaccgag

SEQ ID NO: 15337 - DNA, 25 bp, Homo sapien
gctctggtttccagctcttctcgtc

SEQ ID NO: 15338 - DNA, 25 bp, Homo sapien
ttggtcctcagcacgctccagctgg

SEQ ID NO: 15339 - DNA, 25 bp, Homo sapien
ccaggcaggttataaggggaccaca

SEQ ID NO: 15340 - DNA, 25 bp, Homo sapien
cccaattaccgacctgaatggaggg

SEQ ID NO: 15341 - DNA, 25 bp, Homo sapien
taaggggaccacaccagccttggtc

SEQ ID NO: 15342 - DNA, 25 bp, Homo sapien
gggcagcaaacaggctgtgtcaccc

SEQ ID NO: 15343 - DNA, 25 bp, Homo sapien
gtgggcactcattccaaccaggcgc

SEQ ID NO: 15344 - DNA, 25 bp, Homo sapien
gtcacgcgatctgggagccggcttt

SEQ ID NO: 15345 - DNA, 25 bp, Homo sapien
tttgtgtgcccacgcggtccaggaa

SEQ ID NO: 15346 - DNA, 25 bp, Homo sapien
tccaggaagcataaaggggtgatta

SEQ ID NO: 15347 - DNA, 25 bp, Homo sapien
taaaggggtgattatgacccaggcc

SEQ ID NO: 15348 - DNA, 25 bp, Homo sapien
cccaggccgggcagcaaacaggctg

SEQ ID NO: 15349 - DNA, 25 bp, Homo sapien
ggggcgagtgggcactcattccaac

SEQ ID NO: 15350 - DNA, 25 bp, Homo sapien
agcacagggccagattggaaacaga

SEQ ID NO: 15351 - DNA, 25 bp, Homo sapien
acacccaactacaggaggtcggaga

SEQ ID NO: 15352 - DNA, 25 bp, Homo sapien
gagcctccgcaggagtccatgaaac

SEQ ID NO: 15353 - DNA, 25 bp, Homo sapien
tccatgaaacactgagcgaaggggc

SEQ ID NO: 15354 - DNA, 25 bp, Homo sapien
tcccgaagacgtctcacggggagcc

SEQ ID NO: 15355 - DNA, 25 bp, Homo sapien
cccagctctgatcgtagccatggca

SEQ ID NO: 15356 - DNA, 25 bp, Homo sapien
tagccatggcaacgcatgaggaggc

SEQ ID NO: 15357 - DNA, 25 bp, Homo sapien
gtctcacggggagcctctacactgc

SEQ ID NO: 15358 - DNA, 25 bp, Homo sapien
cgccagcgcatcatccagttccagg

SEQ ID NO: 15359 - DNA, 25 bp, Homo sapien
gaagctgcaccagcagtaccgcctg

SEQ ID NO: 15360 - DNA, 25 bp, Homo sapien
ccgtgcaggcctatgcccggggcat

SEQ ID NO: 15361 - DNA, 25 bp, Homo sapien
tatgcccggggcatgatcgcccgca

SEQ ID NO: 15362 - DNA, 25 bp, Homo sapien
tgtgctcaccgtgcaggcctatgcc

SEQ ID NO: 15363 - DNA, 25 bp, Homo sapien
gcctctgggctgtgctcaccgtgca

SEQ ID NO: 15364 - DNA, 25 bp, Homo sapien
cgcgcctatctggtgcgcaaggcct

SEQ ID NO: 15365 - DNA, 25 bp, Homo sapien
gctgccgcgcctatctggtgcgcaa

SEQ ID NO: 15366 - DNA, 25 bp, Homo sapien
atacccctctgggtgtccaggagcg

SEQ ID NO: 15367 - DNA, 25 bp, Homo sapien
ctgaatttccgcaaactctcaatta

SEQ ID NO: 15368 - DNA, 25 bp, Homo sapien
ttacccacgtgacagcgcgacgatg

SEQ ID NO: 15369 - DNA, 25 bp, Homo sapien
atgcatgcgactgactgcggacgcg

SEQ ID NO: 15370 - DNA, 25 bp, Homo sapien
cagcctgcctcatccgagggtccca

SEQ ID NO: 15371 - DNA, 25 bp, Homo sapien
aaggaaggatgcatgcgactgactg

SEQ ID NO: 15372 - DNA, 25 bp, Homo sapien
acccacgtgacagcgcgacgatggg

SEQ ID NO: 15373 - DNA, 25 bp, Homo sapien
tctcaattacccacgtgacagcgcg

SEQ ID NO: 15374 - DNA, 25 bp, Homo sapien
tgcctcctccggcttctaggtatca

SEQ ID NO: 15375 - DNA, 25 bp, Homo sapien
tcccagcagccaaagtccgggtggt

SEQ ID NO: 15376 - DNA, 25 bp, Homo sapien
ggaggccagaatcccagcagccaaa

SEQ ID NO: 15377 - DNA, 25 bp, Homo sapien
agaggagcgggatggcttccttctc

SEQ ID NO: 15378 - DNA, 25 bp, Homo sapien
ctgccgctggtatcgcaggagcaga

SEQ ID NO: 15379 - DNA, 25 bp, Homo sapien
cagcagctgccgctggtatcgcagg

SEQ ID NO: 15380 - DNA, 25 bp, Homo sapien
ttctaggtatcatccctgctgctca

SEQ ID NO: 15381 - DNA, 25 bp, Homo sapien
gacacctcggacacccgcttcacta

SEQ ID NO: 15382 - DNA, 25 bp, Homo sapien
tccgagcacaatggccgtgcaggct

SEQ ID NO: 15383 - DNA, 25 bp, Homo sapien
gaggacactcactgcggctcgcgct

SEQ ID NO: 15384 - DNA, 25 bp, Homo sapien
tttttggctttacctggaggctggc

SEQ ID NO: 15385 - DNA, 25 bp, Homo sapien
gtgcaactggctgcagccgagcatc

SEQ ID NO: 15386 - DNA, 25 bp, Homo sapien
ggcagcttccaatgccgcgctctgg

SEQ ID NO: 15387 - DNA, 25 bp, Homo sapien
ggggcgacctcccataaggcaacga

SEQ ID NO: 15388 - DNA, 25 bp, Homo sapien
agccgagcatcctccgagcacaatg

SEQ ID NO: 15389 - DNA, 25 bp, Homo sapien
cgcttcacatcgtggctgttgcatg

SEQ ID NO: 15390 - DNA, 25 bp, Homo sapien
tcatcctgggctgcaacaagtcggc

SEQ ID NO: 15391 - DNA, 25 bp, Homo sapien
atgacccacgtctacgaggacttga

SEQ ID NO: 15392 - DNA, 25 bp, Homo sapien
ccgtgctggaagacaactcgagctc

SEQ ID NO: 15393 - DNA, 25 bp, Homo sapien
cctcgtggcagtcaaagccttgctg

SEQ ID NO: 15394 - DNA, 25 bp, Homo sapien
gcctccagtgggacctagcagcaca

SEQ ID NO: 15395 - DNA, 25 bp, Homo sapien
tgccgtccggagcacttaatgccta

SEQ ID NO: 15396 - DNA, 25 bp, Homo sapien
cggccttcaaagacacgacgcatgc

SEQ ID NO: 15397 - DNA, 25 bp, Homo sapien
ttaatgcctagagccagcagggtcc

SEQ ID NO: 15398 - DNA, 25 bp, Homo sapien
atgtccatcaaacccgtccctgcgg

SEQ ID NO: 15399 - DNA, 25 bp, Homo sapien
tcaacactcgccagagatgcgggaa

SEQ ID NO: 15400 - DNA, 25 bp, Homo sapien
tttccgtgcaaaaaacatgtccatc

SEQ ID NO: 15401 - DNA, 25 bp, Homo sapien
ggcaaaatacaattcctccagcttt

SEQ ID NO: 15402 - DNA, 25 bp, Homo sapien
tccggctgacacttttggcaaaata

SEQ ID NO: 15403 - DNA, 25 bp, Homo sapien
ggaaatattttctctccggctgaca

SEQ ID NO: 15404 - DNA, 25 bp, Homo sapien
ctccggggagagatggcagcctccc

SEQ ID NO: 15405 - DNA, 25 bp, Homo sapien
tgcccgtcaacactcgccagagatg

SEQ ID NO: 15406 - DNA, 25 bp, Homo sapien
caggaattgtccttggcactgcttc

SEQ ID NO: 15407 - DNA, 25 bp, Homo sapien
cggcccggccatcacagaagagaac

SEQ ID NO: 15408 - DNA, 25 bp, Homo sapien
tccaagaaaccaaccaagcagcgtg

SEQ ID NO: 15409 - DNA, 25 bp, Homo sapien
ccagcatttggtgccgtaacccgct

SEQ ID NO: 15410 - DNA, 25 bp, Homo sapien
tttctcgataaaccggtgcagaccc

SEQ ID NO: 15411 - DNA, 25 bp, Homo sapien
caacagcctcctaagcgtgagaatg

SEQ ID NO: 15412 - DNA, 25 bp, Homo sapien
ggtcaccagattagccgccgaggct

SEQ ID NO: 15413 - DNA, 25 bp, Homo sapien
tgcctcggtggaagtttcgctttca

SEQ ID NO: 15414 - DNA, 25 bp, Homo sapien
ggccgcctgaaggacagcgtattga

SEQ ID NO: 15415 - DNA, 25 bp, Homo sapien
gctggtcccagccagacccagaaaa

SEQ ID NO: 15416 - DNA, 25 bp, Homo sapien
attagattaactcggagaagctcgc

SEQ ID NO: 15417 - DNA, 25 bp, Homo sapien
aagacgatccgtcaggccgcctgaa

SEQ ID NO: 15418 - DNA, 25 bp, Homo sapien
cgctgcttaagcaattccctaatgg

SEQ ID NO: 15419 - DNA, 25 bp, Homo sapien
agcgtattgatttccacgttgcgaa

SEQ ID NO: 15420 - DNA, 25 bp, Homo sapien
tccacgttgcgaaaaaattaaatga

SEQ ID NO: 15421 - DNA, 25 bp, Homo sapien
agaagctcgccaagacgatccgtca

SEQ ID NO: 15422 - DNA, 25 bp, Homo sapien
gagggcgtacctggcagccaaaagc

SEQ ID NO: 15423 - DNA, 25 bp, Homo sapien
agctgctcctcgggacgcctaatcg

SEQ ID NO: 15424 - DNA, 25 bp, Homo sapien
gcgcgagctatttttagcagctgct

SEQ ID NO: 15425 - DNA, 25 bp, Homo sapien
tgcggcgcgagctatttttagcagc

SEQ ID NO: 15426 - DNA, 25 bp, Homo sapien
cagccgctaatgagcccggtgcggc

SEQ ID NO: 15427 - DNA, 25 bp, Homo sapien
aaagcccagccgctaatgagcccgg

SEQ ID NO: 15428 - DNA, 25 bp, Homo sapien
gcgtacctggcagccaaaagcccag

SEQ ID NO: 15429 - DNA, 25 bp, Homo sapien
gacgcctaatcgctccggccggctc

SEQ ID NO: 15430 - DNA, 25 bp, Homo sapien
tgtggtagcgcttccagcgcgacag

SEQ ID NO: 15431 - DNA, 25 bp, Homo sapien
accttgatgtggtagcgcttccagc

SEQ ID NO: 15432 - DNA, 25 bp, Homo sapien
tcgctgacgagcagcagcaccgagc

SEQ ID NO: 15433 - DNA, 25 bp, Homo sapien
gtgcaccttgatgtggtagcgcttc

SEQ ID NO: 15434 - DNA, 25 bp, Homo sapien
cagccgccgcgcgttgtagtagaag

SEQ ID NO: 15435 - DNA, 25 bp, Homo sapien
tcgcgcaccgtctggtggtcgtcca

SEQ ID NO: 15436 - DNA, 25 bp, Homo sapien
tctagaggcggagtggccactcagc

SEQ ID NO: 15437 - DNA, 25 bp, Homo sapien
gcggagtggccactcagcacagagc

SEQ ID NO: 15438 - DNA, 25 bp, Homo sapien
tgctcccggctagccgcgcctgcgt

SEQ ID NO: 15439 - DNA, 25 bp, Homo sapien
agaagggtctgcaaacactccgttc

SEQ ID NO: 15440 - DNA, 25 bp, Homo sapien
gtcctccacggacgacacaccttac

SEQ ID NO: 15441 - DNA, 25 bp, Homo sapien
cctagaagagaagaagggtctgcaa

SEQ ID NO: 15442 - DNA, 25 bp, Homo sapien
ggtctgcaaacactccgttcctggg

SEQ ID NO: 15443 - DNA, 25 bp, Homo sapien
taccttgccacctggcgtgctcccg

SEQ ID NO: 15444 - DNA, 25 bp, Homo sapien
gcgcctgcgtccatggcaccctgcc

SEQ ID NO: 15445 - DNA, 25 bp, Homo sapien
ccctctcgccacctagaagagaaga

SEQ ID NO: 15446 - DNA, 25 bp, Homo sapien
accactctccgaaagccggcggaga

SEQ ID NO: 15447 - DNA, 25 bp, Homo sapien
ggctccgctcgattcagctgggctg

SEQ ID NO: 15448 - DNA, 25 bp, Homo sapien
gcgattgtttccgtcgcagagccgc

SEQ ID NO: 15449 - DNA, 25 bp, Homo sapien
ctctggcgattgtttccgtcgcaga

SEQ ID NO: 15450 - DNA, 25 bp, Homo sapien
cccggcatctctggcgattgtttcc

SEQ ID NO: 15451 - DNA, 25 bp, Homo sapien
cattacctggtggggaaggctagcc

SEQ ID NO: 15452 - DNA, 25 bp, Homo sapien
ccaggcagggccggcattacctggt

SEQ ID NO: 15453 - DNA, 25 bp, Homo sapien
aggtgcagcacgctcgcgctctcgc

SEQ ID NO: 15454 - DNA, 25 bp, Homo sapien
tgaggacagcgaactaataaacctg

SEQ ID NO: 15455 - DNA, 25 bp, Homo sapien
gggccttctccttccgctcatggaa

SEQ ID NO: 15456 - DNA, 25 bp, Homo sapien
agctgcaggcgttcccgctgtagcc

SEQ ID NO: 15457 - DNA, 25 bp, Homo sapien
tggcactcgagctgcaggcgttccc

SEQ ID NO: 15458 - DNA, 25 bp, Homo sapien
gtgaacaccgctgccacgctggtct

SEQ ID NO: 15459 - DNA, 25 bp, Homo sapien
aagggaagccgctgttctgctggaa

SEQ ID NO: 15460 - DNA, 25 bp, Homo sapien
ggcgcatgctccatatcaaatttca

SEQ ID NO: 15461 - DNA, 25 bp, Homo sapien
ttccgctcatggaaggcctcgaggc

SEQ ID NO: 15462 - DNA, 25 bp, Homo sapien
cgccgcctaagaggaaaacgcactc

SEQ ID NO: 15463 - DNA, 25 bp, Homo sapien
ccgcgttgttctcactgcgcatgtg

SEQ ID NO: 15464 - DNA, 25 bp, Homo sapien
ccgtgtccaggttccgcttcttcag

SEQ ID NO: 15465 - DNA, 25 bp, Homo sapien
actctgtcaggcctaggtgattctg

SEQ ID NO: 15466 - DNA, 25 bp, Homo sapien
gcgccattttgtgctaggagcctga

SEQ ID NO: 15467 - DNA, 25 bp, Homo sapien
accgggatactagaacctacgcttg

SEQ ID NO: 15468 - DNA, 25 bp, Homo sapien
cgcatgtgcagttgcaaccgggata

SEQ ID NO: 15469 - DNA, 25 bp, Homo sapien
ccggcagctatagcggctctgaaca

SEQ ID NO: 15470 - DNA, 25 bp, Homo sapien
tgaacgcagtgaacgcgaacaacgc

SEQ ID NO: 15471 - DNA, 25 bp, Homo sapien
gcgaacaacgcatgcaggcgcagtg

SEQ ID NO: 15472 - DNA, 25 bp, Homo sapien
agcagatccatgctgcccttagcac

SEQ ID NO: 15473 - DNA, 25 bp, Homo sapien
agagaggctggccttccagcgccag

SEQ ID NO: 15474 - DNA, 25 bp, Homo sapien
agcgcgaacgcatgcacgtggagca

SEQ ID NO: 15475 - DNA, 25 bp, Homo sapien
ggcgccagcaggaactgcgctatga

SEQ ID NO: 15476 - DNA, 25 bp, Homo sapien
cgacctggaccggtaagcagatcca

SEQ ID NO: 15477 - DNA, 25 bp, Homo sapien
cccttagcacgtggcgttcagaatc

SEQ ID NO: 15478 - DNA, 25 bp, Homo sapien
gccgccgcaaggctgtctgggaaat

SEQ ID NO: 15479 - DNA, 25 bp, Homo sapien
cccgctttgttcagaggggaagcta

SEQ ID NO: 15480 - DNA, 25 bp, Homo sapien
ctgaagcctgaaggtgacccgaaaa

SEQ ID NO: 15481 - DNA, 25 bp, Homo sapien
tgtcttgcggctctgagactccaga

SEQ ID NO: 15482 - DNA, 25 bp, Homo sapien
tcttgcccgacgcaaggtcctctgg

SEQ ID NO: 15483 - DNA, 25 bp, Homo sapien
aggcctctggaaggtgtagtctttc

SEQ ID NO: 15484 - DNA, 25 bp, Homo sapien
tcgctcggatccacgcgcaaggaca

SEQ ID NO: 15485 - DNA, 25 bp, Homo sapien
cccggatttaagaagagtgtgccta

SEQ ID NO: 15486 - DNA, 25 bp, Homo sapien
ggctggactacctcgtgctgaacca

SEQ ID NO: 15487 - DNA, 25 bp, Homo sapien
tggccatcaccatgtgcgtcctggg

SEQ ID NO: 15488 - DNA, 25 bp, Homo sapien
caggacgtgaacgtggccatcacca

SEQ ID NO: 15489 - DNA, 25 bp, Homo sapien
ccaagtttgcgctggacggcttctt

SEQ ID NO: 15490 - DNA, 25 bp, Homo sapien
tgcccagcctgacggacagcaaggg

SEQ ID NO: 15491 - DNA, 25 bp, Homo sapien
actttgtgagctacgtgcaactgac

SEQ ID NO: 15492 - DNA, 25 bp, Homo sapien
gccgcctgcaggtaaactttgtgag

SEQ ID NO: 15493 - DNA, 25 bp, Homo sapien
ccctctatctcagggaccggtggtc

SEQ ID NO: 15494 - DNA, 25 bp, Homo sapien
tgcttaactagaatgcagggatccc

SEQ ID NO: 15495 - DNA, 25 bp, Homo sapien
tctcgacctgaaagaacgcgcgttc

SEQ ID NO: 15496 - DNA, 25 bp, Homo sapien
accgtgcaatccacgctggggcaga

SEQ ID NO: 15497 - DNA, 25 bp, Homo sapien
actccaggtgcgtcctgccagtgtt

SEQ ID NO: 15498 - DNA, 25 bp, Homo sapien
ggttctcacagctacccacagaggg

SEQ ID NO: 15499 - DNA, 25 bp, Homo sapien
gcgcgccatggagttactgaaggtc

SEQ ID NO: 15500 - DNA, 25 bp, Homo sapien
gagctgagcaacgtactggccgcca

SEQ ID NO: 15501 - DNA, 25 bp, Homo sapien
cggcgaaaagcgctaggcgttaata

SEQ ID NO: 15502 - DNA, 25 bp, Homo sapien
tcagttttcccgtcgtggtcagctc

SEQ ID NO: 15503 - DNA, 25 bp, Homo sapien
ctggcgttattctcggggtccgagc

SEQ ID NO: 15504 - DNA, 25 bp, Homo sapien
tgcaaaaccaggctcaccgggctta

SEQ ID NO: 15505 - DNA, 25 bp, Homo sapien
tcagtctcccgcatgtacaggacgg

SEQ ID NO: 15506 - DNA, 25 bp, Homo sapien
caggaagtagcactcggcacgccca

SEQ ID NO: 15507 - DNA, 25 bp, Homo sapien
gcgggacgatctccacggagcagca

SEQ ID NO: 15508 - DNA, 25 bp, Homo sapien
cagtggcagaagtaccgtccgggat

SEQ ID NO: 15509 - DNA, 25 bp, Homo sapien
gggcttagggatcccacctgggatc

SEQ ID NO: 15510 - DNA, 25 bp, Homo sapien
tacatgcgctccacggtgaacacgg

SEQ ID NO: 15511 - DNA, 25 bp, Homo sapien
cccacgaagtcctgcaggttctcgg

SEQ ID NO: 15512 - DNA, 25 bp, Homo sapien
ggcctcgccgctgacaatcttgtag

SEQ ID NO: 15513 - DNA, 25 bp, Homo sapien
tgtaggccgatttccgtaacacctg

SEQ ID NO: 15514 - DNA, 25 bp, Homo sapien
gcggtcagggcaacacaatgggcac

SEQ ID NO: 15515 - DNA, 25 bp, Homo sapien
cacttgcttctgcaggttgcggaca

SEQ ID NO: 15516 - DNA, 25 bp, Homo sapien
ctctcgcggcagtactgcttgatga

SEQ ID NO: 15517 - DNA, 25 bp, Homo sapien
gcggtgtcacgtcatacatgcgctc

SEQ ID NO: 15518 - DNA, 25 bp, Homo sapien
gccatagaagcagaggatcttgccc

SEQ ID NO: 15519 - DNA, 25 bp, Homo sapien
agcggaagtactctcggttcagggc

SEQ ID NO: 15520 - DNA, 25 bp, Homo sapien
ggcaatgaactcctgcagacagagg

SEQ ID NO: 15521 - DNA, 25 bp, Homo sapien
atgctggtcttacccacgccagggg

SEQ ID NO: 15522 - DNA, 25 bp, Homo sapien
agccgcggagctggctaacggcaat

SEQ ID NO: 15523 - DNA, 25 bp, Homo sapien
gctggctaacggcaatgaactcctg

SEQ ID NO: 15524 - DNA, 25 bp, Homo sapien
cccgacgctgaagcggaagtactct

SEQ ID NO: 15525 - DNA, 25 bp, Homo sapien
cgatggagcgagcaatgctggtctt

SEQ ID NO: 15526 - DNA, 25 bp, Homo sapien
ggtgactcccaaccgaaggctatga

SEQ ID NO: 15527 - DNA, 25 bp, Homo sapien
gcgctcaggagtgctgctcacaaca

SEQ ID NO: 15528 - DNA, 25 bp, Homo sapien
atggatgtggaccaagacacgcagc

SEQ ID NO: 15529 - DNA, 25 bp, Homo sapien
ggctatgaagccaccgaaaggcgga

SEQ ID NO: 15530 - DNA, 25 bp, Homo sapien
ggatcccactgaacccgcaacggtg

SEQ ID NO: 15531 - DNA, 25 bp, Homo sapien
gtgctggaaacgcatcctacggata

SEQ ID NO: 15532 - DNA, 25 bp, Homo sapien
gtacacggcccagaggatcccactg

SEQ ID NO: 15533 - DNA, 25 bp, Homo sapien
tacggatacttcacaggccctccag

SEQ ID NO: 15534 - DNA, 25 bp, Homo sapien
ctccgtggaaaagggaatgagagtc

SEQ ID NO: 15535 - DNA, 25 bp, Homo sapien
ccgcaacgcgaaataaatgggccca

SEQ ID NO: 15536 - DNA, 25 bp, Homo sapien
caacgcgaaataaatgggcccagac

SEQ ID NO: 15537 - DNA, 25 bp, Homo sapien
agaccaggttcctcgagggggctca

SEQ ID NO: 15538 - DNA, 25 bp, Homo sapien
ggggcgtctactgtgcagccaccac

SEQ ID NO: 15539 - DNA, 25 bp, Homo sapien
cacagccgcgctattgtacgccgcc

SEQ ID NO: 15540 - DNA, 25 bp, Homo sapien
aggcctgaccgcctagttcactggc

SEQ ID NO: 15541 - DNA, 25 bp, Homo sapien
gtgcgcgagctaccgcttcactttc

SEQ ID NO: 15542 - DNA, 25 bp, Homo sapien
ttcacctcctccgtgacctggaagt

SEQ ID NO: 15543 - DNA, 25 bp, Homo sapien
cgtgacctggaagtcctcgtggaca

SEQ ID NO: 15544 - DNA, 25 bp, Homo sapien
tcgtggacaacgttctctacctcca

SEQ ID NO: 15545 - DNA, 25 bp, Homo sapien
atgagcacctcagccgggagctcag

SEQ ID NO: 15546 - DNA, 25 bp, Homo sapien
aggggtgggctccatcgccagctcc

SEQ ID NO: 15547 - DNA, 25 bp, Homo sapien
ggcttgtgcttgttctccgcctccg

SEQ ID NO: 15548 - DNA, 25 bp, Homo sapien
cgctttgacttcctgcggggcttgt

SEQ ID NO: 15549 - DNA, 25 bp, Homo sapien
cctgcgtgacgcacggactcacttt

SEQ ID NO: 15550 - DNA, 25 bp, Homo sapien
tcagactctagactggccacgggtg

SEQ ID NO: 15551 - DNA, 25 bp, Homo sapien
caggtgcggaaacacatcggggatc

SEQ ID NO: 15552 - DNA, 25 bp, Homo sapien
gcggctcacacaactcgcgtcattt

SEQ ID NO: 15553 - DNA, 25 bp, Homo sapien
cgcgtggctcgaaacagccgcttca

SEQ ID NO: 15554 - DNA, 25 bp, Homo sapien
gcgcccgtacaaaacactggtagtg

SEQ ID NO: 15555 - DNA, 25 bp, Homo sapien
tcccgggactcattgatgcgcatgc

SEQ ID NO: 15556 - DNA, 25 bp, Homo sapien
cttcagcctgcacgtactcggattg

SEQ ID NO: 15557 - DNA, 25 bp, Homo sapien
tccggtctcccactttatgcgctga

SEQ ID NO: 15558 - DNA, 25 bp, Homo sapien
tggccatcagcgtctccaggtagtc

SEQ ID NO: 15559 - DNA, 25 bp, Homo sapien
ccgctcgttgatcctctgtgggagc

SEQ ID NO: 15560 - DNA, 25 bp, Homo sapien
caccggcacaggaaggacagccact

SEQ ID NO: 15561 - DNA, 25 bp, Homo sapien
gacagccactcgagcagaaagcgcc

SEQ ID NO: 15562 - DNA, 25 bp, Homo sapien
tccaggccgtagttggtgaagtccc

SEQ ID NO: 15563 - DNA, 25 bp, Homo sapien
acgagatgtcccagtgccgctgctc

SEQ ID NO: 15564 - DNA, 25 bp, Homo sapien
gccgctgctccttgatctccgtgaa

SEQ ID NO: 15565 - DNA, 25 bp, Homo sapien
ttgagtcagctctaaccagccgcgg

SEQ ID NO: 15566 - DNA, 25 bp, Homo sapien
cagcgaagcggcaggtcacgccgta

SEQ ID NO: 15567 - DNA, 25 bp, Homo sapien
agaaacacttagcagccgactcctg

SEQ ID NO: 15568 - DNA, 25 bp, Homo sapien
gcagcgatcaccgaagaaacactta

SEQ ID NO: 15569 - DNA, 25 bp, Homo sapien
ccgaaggtctcgaagagcacgcagc

SEQ ID NO: 15570 - DNA, 25 bp, Homo sapien
tttgtccaggccgttgcggatggac

SEQ ID NO: 15571 - DNA, 25 bp, Homo sapien
tgctcagctcgctcgaagcggacct

SEQ ID NO: 15572 - DNA, 25 bp, Homo sapien
cctgctgggcaccacagttttcctg

SEQ ID NO: 15573 - DNA, 25 bp, Homo sapien
cccacgtcgtgcagaaagcggcagc

SEQ ID NO: 15574 - DNA, 25 bp, Homo sapien
gcgcatgctcatgtcgttccaatga

SEQ ID NO: 15575 - DNA, 25 bp, Homo sapien
atgggcgccactcctcgttccaaag

SEQ ID NO: 15576 - DNA, 25 bp, Homo sapien
cccggcgactcactgacgcttaatg

SEQ ID NO: 15577 - DNA, 25 bp, Homo sapien
ccctagcatgcacgtggtgtccttc

SEQ ID NO: 15578 - DNA, 25 bp, Homo sapien
agcacatgcgccgtacgtccatatg

SEQ ID NO: 15579 - DNA, 25 bp, Homo sapien
atgacgccattgctcgctcgtgacg

SEQ ID NO: 15580 - DNA, 25 bp, Homo sapien
agcggagtctaagccaccacatttc

SEQ ID NO: 15581 - DNA, 25 bp, Homo sapien
caacgtgcacgatctcaggtacctc

SEQ ID NO: 15582 - DNA, 25 bp, Homo sapien
tgtggctgcgactcctttatctgtg

SEQ ID NO: 15583 - DNA, 25 bp, Homo sapien
cttatctcctggcttcaggacagga

SEQ ID NO: 15584 - DNA, 25 bp, Homo sapien
cggatttgtggctgcgactccttta

SEQ ID NO: 15585 - DNA, 25 bp, Homo sapien
gctgcgactcctttatctgtggctg

SEQ ID NO: 15586 - DNA, 25 bp, Homo sapien
actcctttatctgtggctgcagctg

SEQ ID NO: 15587 - DNA, 25 bp, Homo sapien
gctgcagctgctccttatctcctgg

SEQ ID NO: 15588 - DNA, 25 bp, Homo sapien
agctgctccttatctcctggcttca

SEQ ID NO: 15589 - DNA, 25 bp, Homo sapien
cccgggctcagtgcccgatgctgcc

SEQ ID NO: 15590 - DNA, 25 bp, Homo sapien
tagctgggcgtaggtcctcgcgtcc

SEQ ID NO: 15591 - DNA, 25 bp, Homo sapien
cggggtctccaaccacgtgtgtggt

SEQ ID NO: 15592 - DNA, 25 bp, Homo sapien
tgtggttgtttcagcgtgtgtgtcc

SEQ ID NO: 15593 - DNA, 25 bp, Homo sapien
caagcgtccacatggtgggcacatg

SEQ ID NO: 15594 - DNA, 25 bp, Homo sapien
gtccctgagtggaatggctgtagct

SEQ ID NO: 15595 - DNA, 25 bp, Homo sapien
ggcaaccgttttacaagcgtccaca

SEQ ID NO: 15596 - DNA, 25 bp, Homo sapien
tcccagaggaagaaccaactctttc

SEQ ID NO: 15597 - DNA, 25 bp, Homo sapien
actctttcaagtcgctgttgccggg

SEQ ID NO: 15598 - DNA, 25 bp, Homo sapien
gcggaccaagcccaggtggaccacg

SEQ ID NO: 15599 - DNA, 25 bp, Homo sapien
acgtcccaggcggaccaagcccagg

SEQ ID NO: 15600 - DNA, 25 bp, Homo sapien
aagcccaggcggaccacgtcccagg

SEQ ID NO: 15601 - DNA, 25 bp, Homo sapien
ggaccaagcccaggtggaccacgtc

SEQ ID NO: 15602 - DNA, 25 bp, Homo sapien
acgtcccaggcagaccaagcccagg

SEQ ID NO: 15603 - DNA, 25 bp, Homo sapien
tcccaggcggaccaagcccaggtgg

SEQ ID NO: 15604 - DNA, 25 bp, Homo sapien
gtcccaggcggaccaagcccaggtg

SEQ ID NO: 15605 - DNA, 25 bp, Homo sapien
acgtcccaggcggaccacgtcccag

SEQ ID NO: 15606 - DNA, 25 bp, Homo sapien
ggccatgggtcttagttcgccagaa

SEQ ID NO: 15607 - DNA, 25 bp, Homo sapien
gcttctttagtgaagggacttcttg

SEQ ID NO: 15608 - DNA, 25 bp, Homo sapien
ggtcagatcctcgatagaatgtggg

SEQ ID NO: 15609 - DNA, 25 bp, Homo sapien
ggcttcttcagcttctggggaagga

SEQ ID NO: 15610 - DNA, 25 bp, Homo sapien
gaggtctggcagaaaggtcagatcc

SEQ ID NO: 15611 - DNA, 25 bp, Homo sapien
agcgtcttggagctccggatttagg

SEQ ID NO: 15612 - DNA, 25 bp, Homo sapien
ccggatttaggcaagaggagccgtc

SEQ ID NO: 15613 - DNA, 25 bp, Homo sapien
tgcggctcttagacaccttcggagg

SEQ ID NO: 15614 - DNA, 25 bp, Homo sapien
tgtacacgtgagttattaaacaccg

SEQ ID NO: 15615 - DNA, 25 bp, Homo sapien
ggcgtgtacacgtgagttattaaac

SEQ ID NO: 15616 - DNA, 25 bp, Homo sapien
gtgggcgtgtacacgtgagttatta

SEQ ID NO: 15617 - DNA, 25 bp, Homo sapien
taaatgtttacacctggccggccgc

SEQ ID NO: 15618 - DNA, 25 bp, Homo sapien
gaggagcccagacggcgtcgagtgt

SEQ ID NO: 15619 - DNA, 25 bp, Homo sapien
ggcgcctgggaaccccatgagccga

SEQ ID NO: 15620 - DNA, 25 bp, Homo sapien
aggcccggaggtgctgacccgcatc

SEQ ID NO: 15621 - DNA, 25 bp, Homo sapien
tttcagtgctcggtgtaaatgttta

SEQ ID NO: 15622 - DNA, 25 bp, Homo sapien
gagatggccttcagcggtctttcca

SEQ ID NO: 15623 - DNA, 25 bp, Homo sapien
cctggacgctgacgctcgtctactt

SEQ ID NO: 15624 - DNA, 25 bp, Homo sapien
acgagctgcaactgctgagcgaaca

SEQ ID NO: 15625 - DNA, 25 bp, Homo sapien
cgtcctggagtttctagccaccttc

SEQ ID NO: 15626 - DNA, 25 bp, Homo sapien
acctgcacctcgctgggactgatgc

SEQ ID NO: 15627 - DNA, 25 bp, Homo sapien
gacttcttaagtgtgccgctcggga

SEQ ID NO: 15628 - DNA, 25 bp, Homo sapien
tccagctccacggttttacagtgtg

SEQ ID NO: 15629 - DNA, 25 bp, Homo sapien
ttcttctcgcttgtgcatggcctga

SEQ ID NO: 15630 - DNA, 25 bp, Homo sapien
acagacggggcgtgcggctgaccat

SEQ ID NO: 15631 - DNA, 25 bp, Homo sapien
tgaccatcccgtgcccgcaggctga

SEQ ID NO: 15632 - DNA, 25 bp, Homo sapien
gcaggctgaggatgcagcgctggaa

SEQ ID NO: 15633 - DNA, 25 bp, Homo sapien
agtgctctgcagctccgtgctgtcc

SEQ ID NO: 15634 - DNA, 25 bp, Homo sapien
tgcagctccgtgctgtccatctgga

SEQ ID NO: 15635 - DNA, 25 bp, Homo sapien
tccgtgctgtccatctggatgtgtc

SEQ ID NO: 15636 - DNA, 25 bp, Homo sapien
tccatctggatgtgtcgagagggcc

SEQ ID NO: 15637 - DNA, 25 bp, Homo sapien
tgcaccgcctgcctcgaaccctgga

SEQ ID NO: 15638 - DNA, 25 bp, Homo sapien
gggactctcgcgataactgtactga

SEQ ID NO: 15639 - DNA, 25 bp, Homo sapien
ccgcgaaagactgcgcgtgcgtaga

SEQ ID NO: 15640 - DNA, 25 bp, Homo sapien
gctaccacacggtgcacgagctgtc

SEQ ID NO: 15641 - DNA, 25 bp, Homo sapien
gaggtgtccttcctggacgcgcaca

SEQ ID NO: 15642 - DNA, 25 bp, Homo sapien
cggcctacgaggacgaggtgtcctt

SEQ ID NO: 15643 - DNA, 25 bp, Homo sapien
cgtctacgacctcgggctgcgacga

SEQ ID NO: 15644 - DNA, 25 bp, Homo sapien
cgacgagacggtgctgttccgctac

SEQ ID NO: 15645 - DNA, 25 bp, Homo sapien
actcgagctggctggtgattcatcc

SEQ ID NO: 15646 - DNA, 25 bp, Homo sapien
tcaccttgatgcttggcaggcctcg

SEQ ID NO: 15647 - DNA, 25 bp, Homo sapien
ccctgcggagtatggaaaaagcccg

SEQ ID NO: 15648 - DNA, 25 bp, Homo sapien
tatctccttccaccagctactaaaa

SEQ ID NO: 15649 - DNA, 25 bp, Homo sapien
gggatttacgacgagcccctgcgga

SEQ ID NO: 15650 - DNA, 25 bp, Homo sapien
cggagtatggaaaaagcccggctcg

SEQ ID NO: 15651 - DNA, 25 bp, Homo sapien
gtgtttagatttccccacggtgtca

SEQ ID NO: 15652 - DNA, 25 bp, Homo sapien
cacggtgtcaccttgatgcttggca

SEQ ID NO: 15653 - DNA, 25 bp, Homo sapien
gctactaaaaatacccgcacgctgc

SEQ ID NO: 15654 - DNA, 25 bp, Homo sapien
tgacctctcggtggtgcacgatgac

SEQ ID NO: 15655 - DNA, 25 bp, Homo sapien
gttgtacatgacctctcggtggtgc

SEQ ID NO: 15656 - DNA, 25 bp, Homo sapien
tggggttgtacatgacctctcggtg

SEQ ID NO: 15657 - DNA, 25 bp, Homo sapien
gctgccagcagtggcttggggactc

SEQ ID NO: 15658 - DNA, 25 bp, Homo sapien
cgtccatggctttcagctgccagca

SEQ ID NO: 15659 - DNA, 25 bp, Homo sapien
gtatccgtccatggctttcagctgc

SEQ ID NO: 15660 - DNA, 25 bp, Homo sapien
gaagtatccgtccatggctttcagc

SEQ ID NO: 15661 - DNA, 25 bp, Homo sapien
tacatgacctctcggtggtgcacga

SEQ ID NO: 15662 - DNA, 25 bp, Homo sapien
agctcctgcaggtaccgggccaggt

SEQ ID NO: 15663 - DNA, 25 bp, Homo sapien
ggcaggaacctctcgtagttgcttc

SEQ ID NO: 15664 - DNA, 25 bp, Homo sapien
cctccacagcttctcggtgatgtag

SEQ ID NO: 15665 - DNA, 25 bp, Homo sapien
gtccgtacacgtccaccttgagatg

SEQ ID NO: 15666 - DNA, 25 bp, Homo sapien
ccttggggctctggaagtcgtccac

SEQ ID NO: 15667 - DNA, 25 bp, Homo sapien
ccagccagccgtagggcgtgaagat

SEQ ID NO: 15668 - DNA, 25 bp, Homo sapien
gccaccagctcggtcttggccgaga

SEQ ID NO: 15669 - DNA, 25 bp, Homo sapien
ggctctggtagtagcgcaccctggc

SEQ ID NO: 15670 - DNA, 25 bp, Homo sapien
cctgtgggtacacactggagtcggc

SEQ ID NO: 15671 - DNA, 25 bp, Homo sapien
acacactggagtcggcagtgatgtt

SEQ ID NO: 15672 - DNA, 25 bp, Homo sapien
tacacactggagtcggcagtgatgt

SEQ ID NO: 15673 - DNA, 25 bp, Homo sapien
gtacacactggagtcggcagtgatg

SEQ ID NO: 15674 - DNA, 25 bp, Homo sapien
ctgtgggtacacactggagtcggca

SEQ ID NO: 15675 - DNA, 25 bp, Homo sapien
tgcctgtgggtacacactggagtcg

SEQ ID NO: 15676 - DNA, 25 bp, Homo sapien
agggcttccaggtgccggcagttgc

SEQ ID NO: 15677 - DNA, 25 bp, Homo sapien
ggtacacactggagtcggcagtgat

SEQ ID NO: 15678 - DNA, 25 bp, Homo sapien
cacagctcctggtctgagccgtcgg

SEQ ID NO: 15679 - DNA, 25 bp, Homo sapien
ggaaccagtcccagaagcggccatg

SEQ ID NO: 15680 - DNA, 25 bp, Homo sapien
atccgtggaagagggctaagagatc

SEQ ID NO: 15681 - DNA, 25 bp, Homo sapien
atttcaagctccactacccagggtg

SEQ ID NO: 15682 - DNA, 25 bp, Homo sapien
ggcgtgcggcctttaaatttcaagc

SEQ ID NO: 15683 - DNA, 25 bp, Homo sapien
gagccgtcggctcccttgaacacag

SEQ ID NO: 15684 - DNA, 25 bp, Homo sapien
caaccctggcggctagcccggaatg

SEQ ID NO: 15685 - DNA, 25 bp, Homo sapien
cccttgaacacagggaggcacctgg

SEQ ID NO: 15686 - DNA, 25 bp, Homo sapien
ccgggccaatcctggtgttagcttc

SEQ ID NO: 15687 - DNA, 25 bp, Homo sapien
gcaactttattgataggcgcggaca

SEQ ID NO: 15688 - DNA, 25 bp, Homo sapien
gacagatttcgctagtcccagctca

SEQ ID NO: 15689 - DNA, 25 bp, Homo sapien
tggccacacccagtgtcagaatctg

SEQ ID NO: 15690 - DNA, 25 bp, Homo sapien
gccctaggccggatgaagtacacag

SEQ ID NO: 15691 - DNA, 25 bp, Homo sapien
ccaggccgattcctagagggtgaaa

SEQ ID NO: 15692 - DNA, 25 bp, Homo sapien
cttgtccaatcctagagtgagccca

SEQ ID NO: 15693 - DNA, 25 bp, Homo sapien
gggacttgaccaatctgagactgta

SEQ ID NO: 15694 - DNA, 25 bp, Homo sapien
gcctgctgttgtccgagatgctgga

SEQ ID NO: 15695 - DNA, 25 bp, Homo sapien
ccaggtggacgggtgcgcggcccgc

SEQ ID NO: 15696 - DNA, 25 bp, Homo sapien
ggccgcaccccgttctgtcccacac

SEQ ID NO: 15697 - DNA, 25 bp, Homo sapien
ctgctgttgtccgagatgctggaag

SEQ ID NO: 15698 - DNA, 25 bp, Homo sapien
aggcctgctgttgtccgagatgctg

SEQ ID NO: 15699 - DNA, 25 bp, Homo sapien
cacacacgcagtggcctccctgggg

SEQ ID NO: 15700 - DNA, 25 bp, Homo sapien
ctgttgtccgagatgctggaaggag

SEQ ID NO: 15701 - DNA, 25 bp, Homo sapien
cgaggcctgctgttgtccgagatgc

SEQ ID NO: 15702 - DNA, 25 bp, Homo sapien
ttcctggacaacttcgactcctctg

SEQ ID NO: 15703 - DNA, 25 bp, Homo sapien
agcggcgtgagtgcctccatgaaca

SEQ ID NO: 15704 - DNA, 25 bp, Homo sapien
ttccaggactactacagcggcgtga

SEQ ID NO: 15705 - DNA, 25 bp, Homo sapien
cactggcggaattccaggactacta

SEQ ID NO: 15706 - DNA, 25 bp, Homo sapien
tcgactcctctgagaaggacgggca

SEQ ID NO: 15707 - DNA, 25 bp, Homo sapien
cgtcgtgacggtggacgacctccgc

SEQ ID NO: 15708 - DNA, 25 bp, Homo sapien
tccatgaacacggatgaggagttcg

SEQ ID NO: 15709 - DNA, 25 bp, Homo sapien
tctgttcccaggtcacactggcgga

SEQ ID NO: 15710 - DNA, 25 bp, Homo sapien
tcgacaactacttctgcggtgcgga

SEQ ID NO: 15711 - DNA, 25 bp, Homo sapien
gatcatcttcaacaacaaggtggtc

SEQ ID NO: 15712 - DNA, 25 bp, Homo sapien
tttcccggcaagagcctgagcagcg

SEQ ID NO: 15713 - DNA, 25 bp, Homo sapien
gcccgaggtccatcatcctggagta

SEQ ID NO: 15714 - DNA, 25 bp, Homo sapien
acttccgcgtgctcgtcgacaacta

SEQ ID NO: 15715 - DNA, 25 bp, Homo sapien
attgtgcccgtgtatggccacttcc

SEQ ID NO: 15716 - DNA, 25 bp, Homo sapien
ttcctggacaactgcacgtacgtgc

SEQ ID NO: 15717 - DNA, 25 bp, Homo sapien
caagccagtccacggggtgatgaca

SEQ ID NO: 15718 - DNA, 25 bp, Homo sapien
tggagcggacgaaacccttgcactc

SEQ ID NO: 15719 - DNA, 25 bp, Homo sapien
gcgggtcttgaagcactcgttttcc

SEQ ID NO: 15720 - DNA, 25 bp, Homo sapien
caggccctaaggtctatttacatcc

SEQ ID NO: 15721 - DNA, 25 bp, Homo sapien
atttacatccgtggccgaagcactg

SEQ ID NO: 15722 - DNA, 25 bp, Homo sapien
cgttcgccaggtccgccattttact

SEQ ID NO: 15723 - DNA, 25 bp, Homo sapien
ctaaggtttagtgaggcggcaccgc

SEQ ID NO: 15724 - DNA, 25 bp, Homo sapien
acgcgttgcctcctacctcagttta

SEQ ID NO: 15725 - DNA, 25 bp, Homo sapien
cgcgcgtgcgcacttaacaagccga

SEQ ID NO: 15726 - DNA, 25 bp, Homo sapien
tcccgctttaccaggggctcaccca

SEQ ID NO: 15727 - DNA, 25 bp, Homo sapien
acgttccgagaactgctccggcacg

SEQ ID NO: 15728 - DNA, 25 bp, Homo sapien
ggtcactgcgctcccgctttaccag

SEQ ID NO: 15729 - DNA, 25 bp, Homo sapien
aggaagtgcacgttccgagaactgc

SEQ ID NO: 15730 - DNA, 25 bp, Homo sapien
gcctcgctgccacgctgctcatcgc

SEQ ID NO: 15731 - DNA, 25 bp, Homo sapien
tgctcatcgcccatgtcatctgcgg

SEQ ID NO: 15732 - DNA, 25 bp, Homo sapien
tcgcccatgtcatctgcggagggag

SEQ ID NO: 15733 - DNA, 25 bp, Homo sapien
tgtccatcatcaggagggcacgaga

SEQ ID NO: 15734 - DNA, 25 bp, Homo sapien
gccgtcccacccaggagggtcctca

SEQ ID NO: 15735 - DNA, 25 bp, Homo sapien
gtgctccaccaggtagaacatgtac

SEQ ID NO: 15736 - DNA, 25 bp, Homo sapien
caccaggtagaacatgtactcgtcg

SEQ ID NO: 15737 - DNA, 25 bp, Homo sapien
ggaccctcaggggagcatggaaccc

SEQ ID NO: 15738 - DNA, 25 bp, Homo sapien
gccagacttcatggcagcaacacac

SEQ ID NO: 15739 - DNA, 25 bp, Homo sapien
acccagaggctgagtgatcctaaga

SEQ ID NO: 15740 - DNA, 25 bp, Homo sapien
tgatcctaagacgtgcaggcctacg

SEQ ID NO: 15741 - DNA, 25 bp, Homo sapien
acagcgatcggcgtctctccggtgg

SEQ ID NO: 15742 - DNA, 25 bp, Homo sapien
ctgggacgtgttctgcagcaccgcc

SEQ ID NO: 15743 - DNA, 25 bp, Homo sapien
tgtggaggaagtcacctgcacgttg

SEQ ID NO: 15744 - DNA, 25 bp, Homo sapien
tgacgacgcccacctgtaagccagg

SEQ ID NO: 15745 - DNA, 25 bp, Homo sapien
tctgggcgaaggcactgacgacgcc

SEQ ID NO: 15746 - DNA, 25 bp, Homo sapien
aaggcactgacgacgcccacctgta

SEQ ID NO: 15747 - DNA, 25 bp, Homo sapien
catctggttgatctgggacgtgttc

SEQ ID NO: 15748 - DNA, 25 bp, Homo sapien
gttcgcagggagagcctgttccgct

SEQ ID NO: 15749 - DNA, 25 bp, Homo sapien
acggtgtggaggaagtcacctgcac

SEQ ID NO: 15750 - DNA, 25 bp, Homo sapien
ggtgcgtgcgcccatcacgtgcact

SEQ ID NO: 15751 - DNA, 25 bp, Homo sapien
gtcacctcgcagtgccgtctgtaca

SEQ ID NO: 15752 - DNA, 25 bp, Homo sapien
agcagccgtgatccgggctacagcg

SEQ ID NO: 15753 - DNA, 25 bp, Homo sapien
gtgccctggaatcccaagggaggcc

SEQ ID NO: 15754 - DNA, 25 bp, Homo sapien
cacgtcaagtgagcagccgtgatcc

SEQ ID NO: 15755 - DNA, 25 bp, Homo sapien
cgtgcactcagcacacgtcaagtga

SEQ ID NO: 15756 - DNA, 25 bp, Homo sapien
gtgtgacgccgtcctgcagcaggaa

SEQ ID NO: 15757 - DNA, 25 bp, Homo sapien
ccttgacgtcgtgcagtgtgacgcc

SEQ ID NO: 15758 - DNA, 25 bp, Homo sapien
gcccgtcccagtgttaagatgccga

SEQ ID NO: 15759 - DNA, 25 bp, Homo sapien
caagagaatgtcagagcccagttta

SEQ ID NO: 15760 - DNA, 25 bp, Homo sapien
ggggacttcttctctgatgtctgaa

SEQ ID NO: 15761 - DNA, 25 bp, Homo sapien
atcacggtgatgactggggtccact

SEQ ID NO: 15762 - DNA, 25 bp, Homo sapien
atcggccagcacagaagtcaggatg

SEQ ID NO: 15763 - DNA, 25 bp, Homo sapien
tgccttttgataacgcctcatttta

SEQ ID NO: 15764 - DNA, 25 bp, Homo sapien
tggacctgtcctacatcactttctg

SEQ ID NO: 15765 - DNA, 25 bp, Homo sapien
attctgacttcgatggcccgtccca

SEQ ID NO: 15766 - DNA, 25 bp, Homo sapien
tcgaagtaagaagccgtgctgctgg

SEQ ID NO: 15767 - DNA, 25 bp, Homo sapien
ccgcgctggagacgatggggctccc

SEQ ID NO: 15768 - DNA, 25 bp, Homo sapien
atgagataggctcccgcgctggaga

SEQ ID NO: 15769 - DNA, 25 bp, Homo sapien
tccccccgtggatgagataggctcc

SEQ ID NO: 15770 - DNA, 25 bp, Homo sapien
cctggggcctcgaagtaagaagccg

SEQ ID NO: 15771 - DNA, 25 bp, Homo sapien
gcctcgaagtaagaagccgtgctgc

SEQ ID NO: 15772 - DNA, 25 bp, Homo sapien
gagtgtctggtgctgtccatccccc

SEQ ID NO: 15773 - DNA, 25 bp, Homo sapien
tggtgatgcccaccatgctgtggga

SEQ ID NO: 15774 - DNA, 25 bp, Homo sapien
ccaactttcccagcggtgcagcgag

SEQ ID NO: 15775 - DNA, 25 bp, Homo sapien
agccgccagaatggcccgggcgctt

SEQ ID NO: 15776 - DNA, 25 bp, Homo sapien
aaagaaatgagcatttggggtgtga

SEQ ID NO: 15777 - DNA, 25 bp, Homo sapien
ggggcccttgaaatagccactagga

SEQ ID NO: 15778 - DNA, 25 bp, Homo sapien
cttgaaatagccactaggatcggga

SEQ ID NO: 15779 - DNA, 25 bp, Homo sapien
atagccactaggatcgggaaatcca

SEQ ID NO: 15780 - DNA, 25 bp, Homo sapien
cactaggatcgggaaatccaacttt

SEQ ID NO: 15781 - DNA, 25 bp, Homo sapien
atccaactttcccagcggtgcagcg

SEQ ID NO: 15782 - DNA, 25 bp, Homo sapien
ctcagcgagtttgaaggtaagcgtg

SEQ ID NO: 15783 - DNA, 25 bp, Homo sapien
cggcgttccattggctgtctgcaga

SEQ ID NO: 15784 - DNA, 25 bp, Homo sapien
gcgcgagaccctacggcgttccatt

SEQ ID NO: 15785 - DNA, 25 bp, Homo sapien
agtctccacggctacagtctctatg

SEQ ID NO: 15786 - DNA, 25 bp, Homo sapien
ccgttggtaagtaacagtctccacg

SEQ ID NO: 15787 - DNA, 25 bp, Homo sapien
cccgcgttcagtcaataaggaaagt

SEQ ID NO: 15788 - DNA, 25 bp, Homo sapien
cccttgaaaaagagtgcgagactcg

SEQ ID NO: 15789 - DNA, 25 bp, Homo sapien
ttgtaaaaagtgaggcgacggcacc

SEQ ID NO: 15790 - DNA, 25 bp, Homo sapien
gtcatgtatcgaggctgctgccgca

SEQ ID NO: 15791 - DNA, 25 bp, Homo sapien
agacgtcagccagctgcaaggagga

SEQ ID NO: 15792 - DNA, 25 bp, Homo sapien
gactccgactgaccctgacctggga

SEQ ID NO: 15793 - DNA, 25 bp, Homo sapien
cgtgtcctctgtccgcagattcgtg

SEQ ID NO: 15794 - DNA, 25 bp, Homo sapien
cctaccggacctgcgcgtcatgtat

SEQ ID NO: 15795 - DNA, 25 bp, Homo sapien
gacgtatcggggctgctaccgcaat

SEQ ID NO: 15796 - DNA, 25 bp, Homo sapien
cggccttcccagaagagcgcgtgca

SEQ ID NO: 15797 - DNA, 25 bp, Homo sapien
ctaccgcaatgcgtgagggccaggc

SEQ ID NO: 15798 - DNA, 25 bp, Homo sapien
aggaaccctacctctcagcgatgta

SEQ ID NO: 15799 - DNA, 25 bp, Homo sapien
ctcatagcagcagagtgcggcaaca

SEQ ID NO: 15800 - DNA, 25 bp, Homo sapien
ggcgggaaacttttgaggaagctca

SEQ ID NO: 15801 - DNA, 25 bp, Homo sapien
cctgagggagttggagcacagcaat

SEQ ID NO: 15802 - DNA, 25 bp, Homo sapien
cattctaggaaaagcggcggaggtc

SEQ ID NO: 15803 - DNA, 25 bp, Homo sapien
ctccggaggagtactagaaaaatcg

SEQ ID NO: 15804 - DNA, 25 bp, Homo sapien
ttcccgttcagcacagcctcagtgt

SEQ ID NO: 15805 - DNA, 25 bp, Homo sapien
ctgaacgccgtcgaccatagagatg

SEQ ID NO: 15806 - DNA, 25 bp, Homo sapien
ctgcggctcagcaaggactaagtta

SEQ ID NO: 15807 - DNA, 25 bp, Homo sapien
tcctcactgtgcacgacatggtcgc

SEQ ID NO: 15808 - DNA, 25 bp, Homo sapien
acatggtcgcgagcacggccatcaa

SEQ ID NO: 15809 - DNA, 25 bp, Homo sapien
ggccatcaagtacgccaacaacatc

SEQ ID NO: 15810 - DNA, 25 bp, Homo sapien
cctacatcgagtaccaccagcagtg

SEQ ID NO: 15811 - DNA, 25 bp, Homo sapien
tctcggcgtcgagaagtctttcttc

SEQ ID NO: 15812 - DNA, 25 bp, Homo sapien
tctttcttcaaagtaccgccaggcg

SEQ ID NO: 15813 - DNA, 25 bp, Homo sapien
aggctgagctactcggaccacggag

SEQ ID NO: 15814 - DNA, 25 bp, Homo sapien
catggacactgctcttgaccagaca

SEQ ID NO: 15815 - DNA, 25 bp, Homo sapien
ctcgaggggctgaccagagttcaat

SEQ ID NO: 15816 - DNA, 25 bp, Homo sapien
gcgctagtctgagtagagcccgaga

SEQ ID NO: 15817 - DNA, 25 bp, Homo sapien
ctatcccgtcttatttggcaaaagc

SEQ ID NO: 15818 - DNA, 25 bp, Homo sapien
gtgttctgaaccattcgggaggctg

SEQ ID NO: 15819 - DNA, 25 bp, Homo sapien
ctgctgccacagaaacgcacatgga

SEQ ID NO: 15820 - DNA, 25 bp, Homo sapien
ctgccctttgtagtgttggctgacc

SEQ ID NO: 15821 - DNA, 25 bp, Homo sapien
cgtcgatccgctgctcagaaaggct

SEQ ID NO: 15822 - DNA, 25 bp, Homo sapien
tccgggaggaatcaaaaggcgcttc

SEQ ID NO: 15823 - DNA, 25 bp, Homo sapien
aggtcctgtcccagggacgccacag

SEQ ID NO: 15824 - DNA, 25 bp, Homo sapien
ctgaatgtcaccgaacgaggcggga

SEQ ID NO: 15825 - DNA, 25 bp, Homo sapien
caagcagaatccaccctgaatgtca

SEQ ID NO: 15826 - DNA, 25 bp, Homo sapien
ctcacggctcttggcgcaagcagaa

SEQ ID NO: 15827 - DNA, 25 bp, Homo sapien
gtctagagtctaagtccctgtcgga

SEQ ID NO: 15828 - DNA, 25 bp, Homo sapien
tcaaaaggcgcttcgcgtgtggctc

SEQ ID NO: 15829 - DNA, 25 bp, Homo sapien
cacacaaacgttccgggaggaatca

SEQ ID NO: 15830 - DNA, 25 bp, Homo sapien
tgtcgtctggcctcccgaagtcaga

SEQ ID NO: 15831 - DNA, 25 bp, Homo sapien
tcccggccacacgactcctggagag

SEQ ID NO: 15832 - DNA, 25 bp, Homo sapien
cagagctggcactgtcgtctggcct

SEQ ID NO: 15833 - DNA, 25 bp, Homo sapien
caggcccagccacgcggtcagacca

SEQ ID NO: 15834 - DNA, 25 bp, Homo sapien
ctcccgaagtcagaggtgatggcga

SEQ ID NO: 15835 - DNA, 25 bp, Homo sapien
tgcccagctagttacaagccagctc

SEQ ID NO: 15836 - DNA, 25 bp, Homo sapien
agctagttacaagccagctccaggc

SEQ ID NO: 15837 - DNA, 25 bp, Homo sapien
gagccctggtcccagagctggcact

SEQ ID NO: 15838 - DNA, 25 bp, Homo sapien
cttctcgcagcgcaggtggttcacg

SEQ ID NO: 15839 - DNA, 25 bp, Homo sapien
accgacacctctggctgggcacaga

SEQ ID NO: 15840 - DNA, 25 bp, Homo sapien
cacagacggccgcagcaaagtagcc

SEQ ID NO: 15841 - DNA, 25 bp, Homo sapien
cggccgcagcaaagtagcctcggtg

SEQ ID NO: 15842 - DNA, 25 bp, Homo sapien
cgcagcaaagtagcctcggtggagc

SEQ ID NO: 15843 - DNA, 25 bp, Homo sapien
cccgcaggagcttgtaccggaactc

SEQ ID NO: 15844 - DNA, 25 bp, Homo sapien
agcttgtaccggaactccgtggtgg

SEQ ID NO: 15845 - DNA, 25 bp, Homo sapien
ggttgttgaaggtgagcttctcgca

SEQ ID NO: 15846 - DNA, 25 bp, Homo sapien
cgcgcacgtcttccacgcgtgtatt

SEQ ID NO: 15847 - DNA, 25 bp, Homo sapien
ctctcagttgtcacgcgatggagcc

SEQ ID NO: 15848 - DNA, 25 bp, Homo sapien
taaagctttccacggcttgtcactc

SEQ ID NO: 15849 - DNA, 25 bp, Homo sapien
gcccgccatgttaaagctttccacg

SEQ ID NO: 15850 - DNA, 25 bp, Homo sapien
ttccacgcgtgtatttcctcaagtc

SEQ ID NO: 15851 - DNA, 25 bp, Homo sapien
cagttgtcacgcgatggagccgctg

SEQ ID NO: 15852 - DNA, 25 bp, Homo sapien
tatttcctcaagtctgagacgctcg

SEQ ID NO: 15853 - DNA, 25 bp, Homo sapien
cgcgtgtatttcctcaagtctgaga

SEQ ID NO: 15854 - DNA, 25 bp, Homo sapien
cccacataaaggcccgaggagcggc

SEQ ID NO: 15855 - DNA, 25 bp, Homo sapien
gccgcatcgactgacagccacctgg

SEQ ID NO: 15856 - DNA, 25 bp, Homo sapien
tagggcccgccgcatcgactgacag

SEQ ID NO: 15857 - DNA, 25 bp, Homo sapien
cccgggtcgcgcaccgatcacgggc

SEQ ID NO: 15858 - DNA, 25 bp, Homo sapien
cctcattgtctgtcaagcgccgccg

SEQ ID NO: 15859 - DNA, 25 bp, Homo sapien
acctgattgtccatggctggcgccc

SEQ ID NO: 15860 - DNA, 25 bp, Homo sapien
ctcctcacctgattgtccatggctg

SEQ ID NO: 15861 - DNA, 25 bp, Homo sapien
acctgggccaatcgacggcgcggac

SEQ ID NO: 15862 - DNA, 25 bp, Homo sapien
agcgcatcgtgtgcgtcatgggccc

SEQ ID NO: 15863 - DNA, 25 bp, Homo sapien
tatgacatctactcgcggctgctgc

SEQ ID NO: 15864 - DNA, 25 bp, Homo sapien
ctcattcccatcgtggtggagcaga

SEQ ID NO: 15865 - DNA, 25 bp, Homo sapien
agcggacactccagaacggcctggc

SEQ ID NO: 15866 - DNA, 25 bp, Homo sapien
gaagctgtagttccgccatcggacg

SEQ ID NO: 15867 - DNA, 25 bp, Homo sapien
gagcgagctcccaggcgcaaagcac

SEQ ID NO: 15868 - DNA, 25 bp, Homo sapien
agactcctggaagtgagcggcctag

SEQ ID NO: 15869 - DNA, 25 bp, Homo sapien
cggcgagcgcgcctatgacatctac

SEQ ID NO: 15870 - DNA, 25 bp, Homo sapien
ggaagtcaatcgctgccgcaggtac

SEQ ID NO: 15871 - DNA, 25 bp, Homo sapien
caggtaccgccaatggcttttggcg

SEQ ID NO: 15872 - DNA, 25 bp, Homo sapien
ccgctccgggattatggccgggact

SEQ ID NO: 15873 - DNA, 25 bp, Homo sapien
aagtcaatcgctgccgcaggtaccg

SEQ ID NO: 15874 - DNA, 25 bp, Homo sapien
cgcaggtaccgccaatggcttttgg

SEQ ID NO: 15875 - DNA, 25 bp, Homo sapien
ctgagggaagtcaatcgctgccgca

SEQ ID NO: 15876 - DNA, 25 bp, Homo sapien
actctgagggaagtcaatcgctgcc

SEQ ID NO: 15877 - DNA, 25 bp, Homo sapien
cgggcccttccgtgctgagccgcct

SEQ ID NO: 15878 - DNA, 25 bp, Homo sapien
ttacagtgcagaagaacgtggcggc

SEQ ID NO: 15879 - DNA, 25 bp, Homo sapien
ctagcagttacagtgcagaagaacg

SEQ ID NO: 15880 - DNA, 25 bp, Homo sapien
cgctgctagcagttacagtgcagaa

SEQ ID NO: 15881 - DNA, 25 bp, Homo sapien
ttacgctgctagcagttacagtgca

SEQ ID NO: 15882 - DNA, 25 bp, Homo sapien
tggtcaggtcgtcgagcgcatggat

SEQ ID NO: 15883 - DNA, 25 bp, Homo sapien
ggtgcgattacgctgctagcagtta

SEQ ID NO: 15884 - DNA, 25 bp, Homo sapien
ttggggtgcgattacgctgctagca

SEQ ID NO: 15885 - DNA, 25 bp, Homo sapien
ggggcggttacagcgcagtcgagcg

SEQ ID NO: 15886 - DNA, 25 bp, Homo sapien
cagaaatggaagttgctacgtaaca

SEQ ID NO: 15887 - DNA, 25 bp, Homo sapien
ttgctacgtaacagtacaagtttta

SEQ ID NO: 15888 - DNA, 25 bp, Homo sapien
caagttttaagactgtggtgatgtc

SEQ ID NO: 15889 - DNA, 25 bp, Homo sapien
ggtgatgtcatggtatgaaattttc

SEQ ID NO: 15890 - DNA, 25 bp, Homo sapien
tgaaattttcagtagatcaactatg

SEQ ID NO: 15891 - DNA, 25 bp, Homo sapien
attatccctttttggtggattctca

SEQ ID NO: 15892 - DNA, 25 bp, Homo sapien
caaagaacgtctctatatttatatt

SEQ ID NO: 15893 - DNA, 25 bp, Homo sapien
ttttgcaacttgcagaaatggaagt

SEQ ID NO: 15894 - DNA, 25 bp, Homo sapien
ggcaacaacaacgtcacctacatct

SEQ ID NO: 15895 - DNA, 25 bp, Homo sapien
cttcctgggccgctccatcggcgtg

SEQ ID NO: 15896 - DNA, 25 bp, Homo sapien
atctcctcgtgccacatgcgccagg

SEQ ID NO: 15897 - DNA, 25 bp, Homo sapien
tttgcggcaacaacaacgtcaccta

SEQ ID NO: 15898 - DNA, 25 bp, Homo sapien
cggccaggagctttgcggcaacaac

SEQ ID NO: 15899 - DNA, 25 bp, Homo sapien
cagcgcccactgcgtggtgtgtcga

SEQ ID NO: 15900 - DNA, 25 bp, Homo sapien
ccacagtcgtgcgtcgtggaccaga

SEQ ID NO: 15901 - DNA, 25 bp, Homo sapien
tgtgcccgcggccacagtcgtgcgt

SEQ ID NO: 15902 - DNA, 25 bp, Homo sapien
gcgtcgcgatggcaaccttcttagc

SEQ ID NO: 15903 - DNA, 25 bp, Homo sapien
gcgtcaccatagcaaccgaggccta

SEQ ID NO: 15904 - DNA, 25 bp, Homo sapien
gtgacgtcagcacccaaggaccgtg

SEQ ID NO: 15905 - DNA, 25 bp, Homo sapien
ggcgctcttgtatataacgcggtta

SEQ ID NO: 15906 - DNA, 25 bp, Homo sapien
cctaggccgagtctgagataaacta

SEQ ID NO: 15907 - DNA, 25 bp, Homo sapien
ccgcggtccctttttagactcagca

SEQ ID NO: 15908 - DNA, 25 bp, Homo sapien
agtcacttatgctcctcggcggcta

SEQ ID NO: 15909 - DNA, 25 bp, Homo sapien
cttcttagcgactgtggccacctca

SEQ ID NO: 15910 - DNA, 25 bp, Homo sapien
acttcacagacaagcccgggacaca

SEQ ID NO: 15911 - DNA, 25 bp, Homo sapien
tttccggcgctacccactaaggcag

SEQ ID NO: 15912 - DNA, 25 bp, Homo sapien
cttcgtttaacctctggacccagcg

SEQ ID NO: 15913 - DNA, 25 bp, Homo sapien
agaagtcccgcctgcgagtctcagc

SEQ ID NO: 15914 - DNA, 25 bp, Homo sapien
agacgttttcttcccaagtggccag

SEQ ID NO: 15915 - DNA, 25 bp, Homo sapien
gcaacacagtcacttggacacagga

SEQ ID NO: 15916 - DNA, 25 bp, Homo sapien
cggcgcagcacgacgacatgaacaa

SEQ ID NO: 15917 - DNA, 25 bp, Homo sapien
aaggtggcaacgatcttcacgccca

SEQ ID NO: 15918 - DNA, 25 bp, Homo sapien
ccgtgctgtagtccgacatggcgcg

SEQ ID NO: 15919 - DNA, 25 bp, Homo sapien
ggctcaacgcgggaacaaggcctcg

SEQ ID NO: 15920 - DNA, 25 bp, Homo sapien
ccaatcgcgagctctgtaggaggtg

SEQ ID NO: 15921 - DNA, 25 bp, Homo sapien
ccggacaccaatcgcgagctctgta

SEQ ID NO: 15922 - DNA, 25 bp, Homo sapien
cacggcgtcggcgaaagcgtccttg

SEQ ID NO: 15923 - DNA, 25 bp, Homo sapien
gtcctcccgtgctgtagtccgacat

SEQ ID NO: 15924 - DNA, 25 bp, Homo sapien
cgaaagcgtccttgcggattcccgg

SEQ ID NO: 15925 - DNA, 25 bp, Homo sapien
tgacggacgactccggcgggccaat

SEQ ID NO: 15926 - DNA, 25 bp, Homo sapien
gccttagagatcgagcgcttccgga

SEQ ID NO: 15927 - DNA, 25 bp, Homo sapien
ccatctagagcgtccagttctcttg

SEQ ID NO: 15928 - DNA, 25 bp, Homo sapien
agcgtccagttctcttgcaggactc

SEQ ID NO: 15929 - DNA, 25 bp, Homo sapien
ccagttctcttgcaggactcaagga

SEQ ID NO: 15930 - DNA, 25 bp, Homo sapien
cttgcaggactcaaggaaccagccc

SEQ ID NO: 15931 - DNA, 25 bp, Homo sapien
tcacgagtccagaaccgttccaaca

SEQ ID NO: 15932 - DNA, 25 bp, Homo sapien
tccaacaaccgggatcgagggatca

SEQ ID NO: 15933 - DNA, 25 bp, Homo sapien
caaccgggatcgagggatcacagcc

SEQ ID NO: 15934 - DNA, 25 bp, Homo sapien
ctcagtggtctcaggtctggtttca

SEQ ID NO: 15935 - DNA, 25 bp, Homo sapien
cgcggctgcaaagtcggtttcctat

SEQ ID NO: 15936 - DNA, 25 bp, Homo sapien
acgcggccatccttgttactgtcca

SEQ ID NO: 15937 - DNA, 25 bp, Homo sapien
tctggtattgcacagccgaggaaca

SEQ ID NO: 15938 - DNA, 25 bp, Homo sapien
ctgtcggggattgggtttcataatc

SEQ ID NO: 15939 - DNA, 25 bp, Homo sapien
tcgcttttcccagacgcacgcaaga

SEQ ID NO: 15940 - DNA, 25 bp, Homo sapien
ctcggccgcagaaacagaagatcca

SEQ ID NO: 15941 - DNA, 25 bp, Homo sapien
actgtccagctcctcgaacaggcga

SEQ ID NO: 15942 - DNA, 25 bp, Homo sapien
agctaggtcaaagacgcccgggcca

SEQ ID NO: 15943 - DNA, 25 bp, Homo sapien
cgctcctgggagttaatctttaatc

SEQ ID NO: 15944 - DNA, 25 bp, Homo sapien
tttaatcgctgacctctggcggctg

SEQ ID NO: 15945 - DNA, 25 bp, Homo sapien
tcagcgaggctcaggtgcacaagcc

SEQ ID NO: 15946 - DNA, 25 bp, Homo sapien
gctcgcaatgcaggtgtaaggtccc

SEQ ID NO: 15947 - DNA, 25 bp, Homo sapien
cgctcccacagatatgctcgcaatg

SEQ ID NO: 15948 - DNA, 25 bp, Homo sapien
cgccagttgtctctcctgtgggcct

SEQ ID NO: 15949 - DNA, 25 bp, Homo sapien
ctcccaggtgagtgactaaactttc

SEQ ID NO: 15950 - DNA, 25 bp, Homo sapien
gactggcgtgcactccaatgaggta

SEQ ID NO: 15951 - DNA, 25 bp, Homo sapien
ggctttttctcgtactctctgcgga

SEQ ID NO: 15952 - DNA, 25 bp, Homo sapien
gtattggcgtccacgttcagcacca

SEQ ID NO: 15953 - DNA, 25 bp, Homo sapien
taaaggtcgtctccaaggtattggc

SEQ ID NO: 15954 - DNA, 25 bp, Homo sapien
cagcgcctgcacgtcgttaaaggtc

SEQ ID NO: 15955 - DNA, 25 bp, Homo sapien
ttgcgattcattcaggaacccacga

SEQ ID NO: 15956 - DNA, 25 bp, Homo sapien
gctcaccagcagtagtccagcaggt

SEQ ID NO: 15957 - DNA, 25 bp, Homo sapien
tgggtagatccacgctcacctcggc

SEQ ID NO: 15958 - DNA, 25 bp, Homo sapien
cagctccgttaggttcctctgagga

SEQ ID NO: 15959 - DNA, 25 bp, Homo sapien
acgatgttctcgtcagtcacggcca

SEQ ID NO: 15960 - DNA, 25 bp, Homo sapien
gcaggactcttctctcggccaggag

SEQ ID NO: 15961 - DNA, 25 bp, Homo sapien
cccgcctcacggtgctgagtttgct

SEQ ID NO: 15962 - DNA, 25 bp, Homo sapien
gcagtagggttagagccaggaatca

SEQ ID NO: 15963 - DNA, 25 bp, Homo sapien
ctcacgttctcagggatggatggca

SEQ ID NO: 15964 - DNA, 25 bp, Homo sapien
ggcggggccagagttcaactctcca

SEQ ID NO: 15965 - DNA, 25 bp, Homo sapien
actctccaagaccttcgaaggggcg

SEQ ID NO: 15966 - DNA, 25 bp, Homo sapien
acactttgggcgagggcaccacgct

SEQ ID NO: 15967 - DNA, 25 bp, Homo sapien
gtctgacactttgggcgagggcacc

SEQ ID NO: 15968 - DNA, 25 bp, Homo sapien
tctgggaactcctcgcggatcttac

SEQ ID NO: 15969 - DNA, 25 bp, Homo sapien
cctgaaggcagtcgcagctctcggc

SEQ ID NO: 15970 - DNA, 25 bp, Homo sapien
gaaggcagtcgcagctctcggcctc

SEQ ID NO: 15971 - DNA, 25 bp, Homo sapien
tccttccggactacgtccaggacag

SEQ ID NO: 15972 - DNA, 25 bp, Homo sapien
tccggactacgtccaggacagcgtc

SEQ ID NO: 15973 - DNA, 25 bp, Homo sapien
ctgggaactcctcgcggatcttact

SEQ ID NO: 15974 - DNA, 25 bp, Homo sapien
aaccttcaaagccatagctgctgca

SEQ ID NO: 15975 - DNA, 25 bp, Homo sapien
agccatagctgctgcacggcttcct

SEQ ID NO: 15976 - DNA, 25 bp, Homo sapien
agcgaacagtagtgagtaaggagca

SEQ ID NO: 15977 - DNA, 25 bp, Homo sapien
caggagcctgcggatcacagagccg

SEQ ID NO: 15978 - DNA, 25 bp, Homo sapien
taccaccgcgacttcctcaaagagc

SEQ ID NO: 15979 - DNA, 25 bp, Homo sapien
cggctcgttagagtgattcaatttc

SEQ ID NO: 15980 - DNA, 25 bp, Homo sapien
gtgattcaatttcggtgaactgcca

SEQ ID NO: 15981 - DNA, 25 bp, Homo sapien
tttcggtgaactgccacctccagct

SEQ ID NO: 15982 - DNA, 25 bp, Homo sapien
cgagggtggaagatgcggcggagac

SEQ ID NO: 15983 - DNA, 25 bp, Homo sapien
agacggcggagcacggtccctgcgc

SEQ ID NO: 15984 - DNA, 25 bp, Homo sapien
cccgggagccgctatatgagcgggc

SEQ ID NO: 15985 - DNA, 25 bp, Homo sapien
gccgctatatgagcgggcggggcac

SEQ ID NO: 15986 - DNA, 25 bp, Homo sapien
gggcacgcgtcacggccggtcaccc

SEQ ID NO: 15987 - DNA, 25 bp, Homo sapien
cacggccggtcaccctcccgctccg

SEQ ID NO: 15988 - DNA, 25 bp, Homo sapien
caggtgcacgatctcccgcatggcg

SEQ ID NO: 15989 - DNA, 25 bp, Homo sapien
acgatctcccgcatggcggtggcgc

SEQ ID NO: 15990 - DNA, 25 bp, Homo sapien
ctggtgtgcctgatccccgtgtccg

SEQ ID NO: 15991 - DNA, 25 bp, Homo sapien
aggttcgaggcgtctgttcccaccg

SEQ ID NO: 15992 - DNA, 25 bp, Homo sapien
ctgttcccaccggggactacaatgg

SEQ ID NO: 15993 - DNA, 25 bp, Homo sapien
gtagccactgccatcatcggggccg

SEQ ID NO: 15994 - DNA, 25 bp, Homo sapien
atcatcggggccgtcatcctggcca

SEQ ID NO: 15995 - DNA, 25 bp, Homo sapien
atcggggccgtcatcctggccaagc

SEQ ID NO: 15996 - DNA, 25 bp, Homo sapien
cgcaccaggttcgaggcgtctgttc

SEQ ID NO: 15997 - DNA, 25 bp, Homo sapien
ggctctgcgctggtgtgcctgatcc

SEQ ID NO: 15998 - DNA, 25 bp, Homo sapien
gaacccgcgagccaaagccacgttg

SEQ ID NO: 15999 - DNA, 25 bp, Homo sapien
ccacgttggtgctggtgatcatcca

SEQ ID NO: 16000 - DNA, 25 bp, Homo sapien
tgagagccatgactaggcgagcttc

SEQ ID NO: 16001 - DNA, 25 bp, Homo sapien
ccgacgttctgttcccgcgcttaat

SEQ ID NO: 16002 - DNA, 25 bp, Homo sapien
gcttaatgccctgcccgatccagtt

SEQ ID NO: 16003 - DNA, 25 bp, Homo sapien
gccgtgaatgctcccaagtcctaga

SEQ ID NO: 16004 - DNA, 25 bp, Homo sapien
ggcgggcccatctttctcttgaacc

SEQ ID NO: 16005 - DNA, 25 bp, Homo sapien
ctcgggcgatttcttggcgttactt

SEQ ID NO: 16006 - DNA, 25 bp, Homo sapien
tgtcttcccgcagtctctcgtcatg

SEQ ID NO: 16007 - DNA, 25 bp, Homo sapien
ttctccatctagcaccgaggccggg

SEQ ID NO: 16008 - DNA, 25 bp, Homo sapien
agggacacctgttctacactcccgg

SEQ ID NO: 16009 - DNA, 25 bp, Homo sapien
ctctcgtcatggaatacgcctctga

SEQ ID NO: 16010 - DNA, 25 bp, Homo sapien
aaaagcggcgcgctgtgtcttcccg

SEQ ID NO: 16011 - DNA, 25 bp, Homo sapien
ggcctccttttgtagccaagcagct

SEQ ID NO: 16012 - DNA, 25 bp, Homo sapien
agaaaattccgcagagtcacgggga

SEQ ID NO: 16013 - DNA, 25 bp, Homo sapien
aatacgcctctgacgcttcactgga

SEQ ID NO: 16014 - DNA, 25 bp, Homo sapien
ggcagcttacccagggcgccacagt

SEQ ID NO: 16015 - DNA, 25 bp, Homo sapien
cgtccatcttcacactgaggccagg

SEQ ID NO: 16016 - DNA, 25 bp, Homo sapien
gcctgggcgtccatcttcacactga

SEQ ID NO: 16017 - DNA, 25 bp, Homo sapien
ccagggccgcttgctgcacctgagt

SEQ ID NO: 16018 - DNA, 25 bp, Homo sapien
cgaggctcggaactcggccttcggt

SEQ ID NO: 16019 - DNA, 25 bp, Homo sapien
tggctttgaccgtggacctgccacc

SEQ ID NO: 16020 - DNA, 25 bp, Homo sapien
cagtcttgggactcttccgggtgac

SEQ ID NO: 16021 - DNA, 25 bp, Homo sapien
aggctccgtttcacttgcgctgcac

SEQ ID NO: 16022 - DNA, 25 bp, Homo sapien
tccatttccatgtgtgcctaccttt

SEQ ID NO: 16023 - DNA, 25 bp, Homo sapien
ctggatgcacaccacgaggcagatc

SEQ ID NO: 16024 - DNA, 25 bp, Homo sapien
agcctgtgcgaagcgctggatgcac

SEQ ID NO: 16025 - DNA, 25 bp, Homo sapien
tggcctctttgtacccatctcattc

SEQ ID NO: 16026 - DNA, 25 bp, Homo sapien
agcggactctctacgctgcaaaggc

SEQ ID NO: 16027 - DNA, 25 bp, Homo sapien
tcccgaatcgttttcctggatgtca

SEQ ID NO: 16028 - DNA, 25 bp, Homo sapien
ggtcacgcgcctctctatgttttct

SEQ ID NO: 16029 - DNA, 25 bp, Homo sapien
gggaacaccagagccgagtcatctt

SEQ ID NO: 16030 - DNA, 25 bp, Homo sapien
cccagcacggacagagaaattcacg

SEQ ID NO: 16031 - DNA, 25 bp, Homo sapien
cagagaaattcacggcctagagggc

SEQ ID NO: 16032 - DNA, 25 bp, Homo sapien
tagagggctgcagtatcggaagaac

SEQ ID NO: 16033 - DNA, 25 bp, Homo sapien
atcggaagaacagaggtagatgtgc

SEQ ID NO: 16034 - DNA, 25 bp, Homo sapien
gaaaaggggccactcggatcttctc

SEQ ID NO: 16035 - DNA, 25 bp, Homo sapien
ctcggatcttctcaggctgggagga

SEQ ID NO: 16036 - DNA, 25 bp, Homo sapien
gggtcgccaggactactccgcagtc

SEQ ID NO: 16037 - DNA, 25 bp, Homo sapien
ggagagggtccagcaccgtcacctc

SEQ ID NO: 16038 - DNA, 25 bp, Homo sapien
tgtccattcgcttctccgtgagctg

SEQ ID NO: 16039 - DNA, 25 bp, Homo sapien
cgccgcagctctgtgatgtagttgc

SEQ ID NO: 16040 - DNA, 25 bp, Homo sapien
gttgcagcagtccaggaagaccttc

SEQ ID NO: 16041 - DNA, 25 bp, Homo sapien
aggaagaccttcttgcacgcctcgc

SEQ ID NO: 16042 - DNA, 25 bp, Homo sapien
tccggcgctggcacgagaacctcat

SEQ ID NO: 16043 - DNA, 25 bp, Homo sapien
aaaggctcccacctttgtccattcg

SEQ ID NO: 16044 - DNA, 25 bp, Homo sapien
aacctcatggggttctcccgcatgc

SEQ ID NO: 16045 - DNA, 25 bp, Homo sapien
ctcgcccagggagatgaaacgggtc

SEQ ID NO: 16046 - DNA, 25 bp, Homo sapien
ttaccgagcccacgcaggagtcctt

SEQ ID NO: 16047 - DNA, 25 bp, Homo sapien
accgagcccacgcaggagtccttga

SEQ ID NO: 16048 - DNA, 25 bp, Homo sapien
atcagcgtgtagtacgccaccaggc

SEQ ID NO: 16049 - DNA, 25 bp, Homo sapien
gcgagcccagggcacacttaccgag

SEQ ID NO: 16050 - DNA, 25 bp, Homo sapien
tgtagtacgccaccaggcggaagga

SEQ ID NO: 16051 - DNA, 25 bp, Homo sapien
tggccgctggcaccgatcagcgtgt

SEQ ID NO: 16052 - DNA, 25 bp, Homo sapien
ctggcaccgatcagcgtgtagtacg

SEQ ID NO: 16053 - DNA, 25 bp, Homo sapien
ttgacgtccacccacacggagtcgg

SEQ ID NO: 16054 - DNA, 25 bp, Homo sapien
cgatgagccaatcgccgcacggcgg

SEQ ID NO: 16055 - DNA, 25 bp, Homo sapien
ggacccggcaactccatccggagga

SEQ ID NO: 16056 - DNA, 25 bp, Homo sapien
gcggacgagaccactccaagccagg

SEQ ID NO: 16057 - DNA, 25 bp, Homo sapien
caccgtcagcgccagctggtggatg

SEQ ID NO: 16058 - DNA, 25 bp, Homo sapien
ggagtttccagtccgccaaccaatc

SEQ ID NO: 16059 - DNA, 25 bp, Homo sapien
gcgtcaccgacggacagcaccggtt

SEQ ID NO: 16060 - DNA, 25 bp, Homo sapien
ccggttccgaatgggagagccgata

SEQ ID NO: 16061 - DNA, 25 bp, Homo sapien
gcttctccgagacaaagttgcgcca

SEQ ID NO: 16062 - DNA, 25 bp, Homo sapien
aacggcaactcaggcaggtctagca

SEQ ID NO: 16063 - DNA, 25 bp, Homo sapien
cgctgttcaactgcagggcgtattc

SEQ ID NO: 16064 - DNA, 25 bp, Homo sapien
cgggacttctcgagaacaatggcca

SEQ ID NO: 16065 - DNA, 25 bp, Homo sapien
gcttgccactgcctcgtgtgacagg

SEQ ID NO: 16066 - DNA, 25 bp, Homo sapien
cccggagcagtcgagaaccgagtca

SEQ ID NO: 16067 - DNA, 25 bp, Homo sapien
tctgcggatcccagcgtctcaggga

SEQ ID NO: 16068 - DNA, 25 bp, Homo sapien
ccgagggatggcaaggcaaccttac

SEQ ID NO: 16069 - DNA, 25 bp, Homo sapien
ccgccgtcgccattttgaactggag

SEQ ID NO: 16070 - DNA, 25 bp, Homo sapien
tccgctctctctcgaagtttatctg

SEQ ID NO: 16071 - DNA, 25 bp, Homo sapien
gggcaggcggcttatcttacggccc

SEQ ID NO: 16072 - DNA, 25 bp, Homo sapien
ggcggctgagagaggtcacctattt

SEQ ID NO: 16073 - DNA, 25 bp, Homo sapien
ggcagaaggaatcctggggccaggc

SEQ ID NO: 16074 - DNA, 25 bp, Homo sapien
agtctcagcacgctcaggggcgaag

SEQ ID NO: 16075 - DNA, 25 bp, Homo sapien
gtcacctattttgggcgccctggcc

SEQ ID NO: 16076 - DNA, 25 bp, Homo sapien
ttatctgggagtctcagcacgctca

SEQ ID NO: 16077 - DNA, 25 bp, Homo sapien
ctctcgaagtttatctgggagtctc

SEQ ID NO: 16078 - DNA, 25 bp, Homo sapien
ggcttacgccaaacaactgcggtga

SEQ ID NO: 16079 - DNA, 25 bp, Homo sapien
cttctaggagcgcagagccttggcc

SEQ ID NO: 16080 - DNA, 25 bp, Homo sapien
gctgtggggtcccaaaatcgtgacc

SEQ ID NO: 16081 - DNA, 25 bp, Homo sapien
ccatgtcccatgtcaggatcagttc

SEQ ID NO: 16082 - DNA, 25 bp, Homo sapien
cagttcgaggtgctcgagcgccaca

SEQ ID NO: 16083 - DNA, 25 bp, Homo sapien
cgcaccgaagtggaacaggcttacg

SEQ ID NO: 16084 - DNA, 25 bp, Homo sapien
cgccgggaagccactccttctagga

SEQ ID NO: 16085 - DNA, 25 bp, Homo sapien
ttggcggtcctatgtcggagacctc

SEQ ID NO: 16086 - DNA, 25 bp, Homo sapien
ggaagccgtgctcaaagttcctgca

SEQ ID NO: 16087 - DNA, 25 bp, Homo sapien
tctttccatgcacacggaagccgtg

SEQ ID NO: 16088 - DNA, 25 bp, Homo sapien
gcctggatcaggtgaaagttctttc

SEQ ID NO: 16089 - DNA, 25 bp, Homo sapien
gtccgcaccttgttggcctggatca

SEQ ID NO: 16090 - DNA, 25 bp, Homo sapien
atgttggctcttccatgggctcagc

SEQ ID NO: 16091 - DNA, 25 bp, Homo sapien
gcagggcctcctccacattgaagtt

SEQ ID NO: 16092 - DNA, 25 bp, Homo sapien
tttcaccaactcgtacagcgcctgg

SEQ ID NO: 16093 - DNA, 25 bp, Homo sapien
ctgtctataccatccagcgagtggc

SEQ ID NO: 16094 - DNA, 25 bp, Homo sapien
tcgccctgaaatgtgtgtccctctc

SEQ ID NO: 16095 - DNA, 25 bp, Homo sapien
gctcgccctgaaatgtgtgtccctc

SEQ ID NO: 16096 - DNA, 25 bp, Homo sapien
cgccctgaaatgtgtgtccctctcg

SEQ ID NO: 16097 - DNA, 25 bp, Homo sapien
ccctgaaatgtgtgtccctctcggc

SEQ ID NO: 16098 - DNA, 25 bp, Homo sapien
ctgaaatgtgtgtccctctcggcgt

SEQ ID NO: 16099 - DNA, 25 bp, Homo sapien
tgaaatgtgtgtccctctcggcgtc

SEQ ID NO: 16100 - DNA, 25 bp, Homo sapien
cctcgctcgccctgaaatgtgtgtc

SEQ ID NO: 16101 - DNA, 25 bp, Homo sapien
tcgctcgccctgaaatgtgtgtccc

SEQ ID NO: 16102 - DNA, 25 bp, Homo sapien
gacttggtgacagccgggtcccagc

SEQ ID NO: 16103 - DNA, 25 bp, Homo sapien
gcctttgcttgtctgacttcgcgag

SEQ ID NO: 16104 - DNA, 25 bp, Homo sapien
cgtctgggctctcgagaaaggcctt

SEQ ID NO: 16105 - DNA, 25 bp, Homo sapien
agaaaggcctttgcttgtctgactt

SEQ ID NO: 16106 - DNA, 25 bp, Homo sapien
ttgcttgtctgacttcgcgagggtc

SEQ ID NO: 16107 - DNA, 25 bp, Homo sapien
ctgacttcgcgagggtcccggctct

SEQ ID NO: 16108 - DNA, 25 bp, Homo sapien
ggctctcgagaaaggcctttgcttg

SEQ ID NO: 16109 - DNA, 25 bp, Homo sapien
ctcgagaaaggcctttgcttgtctg

SEQ ID NO: 16110 - DNA, 25 bp, Homo sapien
tcggtcaaaccgaggctagcatcct

SEQ ID NO: 16111 - DNA, 25 bp, Homo sapien
cgtaccctcggcattgcctaacgga

SEQ ID NO: 16112 - DNA, 25 bp, Homo sapien
cccttggccatactgagcgagatca

SEQ ID NO: 16113 - DNA, 25 bp, Homo sapien
gcgagatcagtaagtcggtcaaacc

SEQ ID NO: 16114 - DNA, 25 bp, Homo sapien
aaaccgaggctagcatccttccgca

SEQ ID NO: 16115 - DNA, 25 bp, Homo sapien
gaggctagcatccttccgcagcctt

SEQ ID NO: 16116 - DNA, 25 bp, Homo sapien
aggtggtggccctagcctgcccagc

SEQ ID NO: 16117 - DNA, 25 bp, Homo sapien
ccatactgagcgagatcagtaagtc

SEQ ID NO: 16118 - DNA, 25 bp, Homo sapien
gtggacggccctgttcctatcaata

SEQ ID NO: 16119 - DNA, 25 bp, Homo sapien
agggtgctctgaagtctgcagtcca

SEQ ID NO: 16120 - DNA, 25 bp, Homo sapien
cttctcaaagcgttcagcgcgcgga

SEQ ID NO: 16121 - DNA, 25 bp, Homo sapien
ggccggaatcctggaagcaaggtca

SEQ ID NO: 16122 - DNA, 25 bp, Homo sapien
caggacagcccgttttgaggtggac

SEQ ID NO: 16123 - DNA, 25 bp, Homo sapien
cagaggactttgacccaacaggggc

SEQ ID NO: 16124 - DNA, 25 bp, Homo sapien
tccggttagaacctgcagggtgctc

SEQ ID NO: 16125 - DNA, 25 bp, Homo sapien
cgaggacgcgctggaacttctcaaa

SEQ ID NO: 16126 - DNA, 25 bp, Homo sapien
cctcgggctcttacgccaggctggg

SEQ ID NO: 16127 - DNA, 25 bp, Homo sapien
gtagctgcggcagctgtgacgtaag

SEQ ID NO: 16128 - DNA, 25 bp, Homo sapien
tgtgacgtaaggaggggtacgcttc

SEQ ID NO: 16129 - DNA, 25 bp, Homo sapien
tcagggcagggcaactccctcgggc

SEQ ID NO: 16130 - DNA, 25 bp, Homo sapien
gagacgtccgggaaaacgcgacagc

SEQ ID NO: 16131 - DNA, 25 bp, Homo sapien
cttcagtgacagcacgctggagcgg

SEQ ID NO: 16132 - DNA, 25 bp, Homo sapien
agacgtccgggaaaacgcgacagct

SEQ ID NO: 16133 - DNA, 25 bp, Homo sapien
tggcgggttttgtggagagacgtcc

SEQ ID NO: 16134 - DNA, 25 bp, Homo sapien
tatgaggacctcatgcgctcggagc

SEQ ID NO: 16135 - DNA, 25 bp, Homo sapien
agcccgtgtccatgccggtgcgtga

SEQ ID NO: 16136 - DNA, 25 bp, Homo sapien
tctcagcccaagatgacagagtatg

SEQ ID NO: 16137 - DNA, 25 bp, Homo sapien
tatgacaagcgctgctgctgcctgc

SEQ ID NO: 16138 - DNA, 25 bp, Homo sapien
ccagcagacggaggagaagtacact

SEQ ID NO: 16139 - DNA, 25 bp, Homo sapien
ggccggcaggtgcacgtccacctgt

SEQ ID NO: 16140 - DNA, 25 bp, Homo sapien
gagaagtacactgacacgctgggct

SEQ ID NO: 16141 - DNA, 25 bp, Homo sapien
gaaggcgacgagatctatgaggacc

SEQ ID NO: 16142 - DNA, 25 bp, Homo sapien
cagttaagcccgaagctgctgtttc

SEQ ID NO: 16143 - DNA, 25 bp, Homo sapien
aaactagaacacctcagccggaggc

SEQ ID NO: 16144 - DNA, 25 bp, Homo sapien
cctgacacgccgcattttgggctgg

SEQ ID NO: 16145 - DNA, 25 bp, Homo sapien
agaatctttcggtctccgcgagagg

SEQ ID NO: 16146 - DNA, 25 bp, Homo sapien
cgagaggtgcttcattccgtgagtc

SEQ ID NO: 16147 - DNA, 25 bp, Homo sapien
ttcattccgtgagtccgagtccaga

SEQ ID NO: 16148 - DNA, 25 bp, Homo sapien
tcgggctgtgcgctcagttaagccc

SEQ ID NO: 16149 - DNA, 25 bp, Homo sapien
gccagggcccaacctggttctatta

SEQ ID NO: 16150 - DNA, 25 bp, Homo sapien
ccgaaaagcggtggcactggcgcca

SEQ ID NO: 16151 - DNA, 25 bp, Homo sapien
ccggtcgaaggagctgatgccaagt

SEQ ID NO: 16152 - DNA, 25 bp, Homo sapien
aggatccgagctggaccgaaaagcg

SEQ ID NO: 16153 - DNA, 25 bp, Homo sapien
acaggcagcgccatggtaggacgcc

SEQ ID NO: 16154 - DNA, 25 bp, Homo sapien
actgaacgaactgagccgaggagcg

SEQ ID NO: 16155 - DNA, 25 bp, Homo sapien
cggagaaagccgaactgaacgaact

SEQ ID NO: 16156 - DNA, 25 bp, Homo sapien
cggcgaaatcggagaaaactgaagc

SEQ ID NO: 16157 - DNA, 25 bp, Homo sapien
gacgcggaaagagccgaactgaagc

SEQ ID NO: 16158 - DNA, 25 bp, Homo sapien
gccatgcacatccagcagctggaga

SEQ ID NO: 16159 - DNA, 25 bp, Homo sapien
aacgcaggacccgctgggactggtt

SEQ ID NO: 16160 - DNA, 25 bp, Homo sapien
cccggctggaccaccaggtcttcct

SEQ ID NO: 16161 - DNA, 25 bp, Homo sapien
ttcctgaagagcgacagcctgtgtc

SEQ ID NO: 16162 - DNA, 25 bp, Homo sapien
agagcgacagcctgtgtctgatgga

SEQ ID NO: 16163 - DNA, 25 bp, Homo sapien
tggccatgcacatccagcagctgga

SEQ ID NO: 16164 - DNA, 25 bp, Homo sapien
gcttcaccatgaccaacggggccca

SEQ ID NO: 16165 - DNA, 25 bp, Homo sapien
tgtctgatggaagggcggcgcttcc

SEQ ID NO: 16166 - DNA, 25 bp, Homo sapien
agagcgaccgcttcctgttgctcga

SEQ ID NO: 16167 - DNA, 25 bp, Homo sapien
gatgacttgccgagatcccacaagg

SEQ ID NO: 16168 - DNA, 25 bp, Homo sapien
tggacggatccggaaaacttgcgta

SEQ ID NO: 16169 - DNA, 25 bp, Homo sapien
ctcagcttccgtacactaggaggga

SEQ ID NO: 16170 - DNA, 25 bp, Homo sapien
ccgcttcttaaggtgcgccgccatg

SEQ ID NO: 16171 - DNA, 25 bp, Homo sapien
gagcttacctgaaccactttcgtga

SEQ ID NO: 16172 - DNA, 25 bp, Homo sapien
gatcggttctggatctttcccgcca

SEQ ID NO: 16173 - DNA, 25 bp, Homo sapien
gcctcgccactgtacggactgattt

SEQ ID NO: 16174 - DNA, 25 bp, Homo sapien
tgtcgcaagccggagatgaccagcg

SEQ ID NO: 16175 - DNA, 25 bp, Homo sapien
atcgccaagggacctgcgtttccga

SEQ ID NO: 16176 - DNA, 25 bp, Homo sapien
aaggcctgtgctcctccggactcgt

SEQ ID NO: 16177 - DNA, 25 bp, Homo sapien
acctgcgtttccgagatggcctgga

SEQ ID NO: 16178 - DNA, 25 bp, Homo sapien
tcaccaccttctcaaaaggcctgtg

SEQ ID NO: 16179 - DNA, 25 bp, Homo sapien
gagatgaccagcgactccttgttca

SEQ ID NO: 16180 - DNA, 25 bp, Homo sapien
cgatagcccgtgaagtgtcgcaagc

SEQ ID NO: 16181 - DNA, 25 bp, Homo sapien
gtcacattcccaacatcgccaaggg

SEQ ID NO: 16182 - DNA, 25 bp, Homo sapien
cacacgcgatgacgcctttggaata

SEQ ID NO: 16183 - DNA, 25 bp, Homo sapien
cctttggaatagaactgcgcagctc

SEQ ID NO: 16184 - DNA, 25 bp, Homo sapien
tacggcgcatatagaggctagaaag

SEQ ID NO: 16185 - DNA, 25 bp, Homo sapien
gaacagagtaccagagggccttccc

SEQ ID NO: 16186 - DNA, 25 bp, Homo sapien
gggagccgcaggcttcttctcttcg

SEQ ID NO: 16187 - DNA, 25 bp, Homo sapien
tccatgctgcggatctcttaggaga

SEQ ID NO: 16188 - DNA, 25 bp, Homo sapien
tcttaggagatatactgcgcacgca

SEQ ID NO: 16189 - DNA, 25 bp, Homo sapien
gctctttggagacatacggcgcata

SEQ ID NO: 16190 - DNA, 25 bp, Homo sapien
cggatggaactttggaaaaagctag

SEQ ID NO: 16191 - DNA, 25 bp, Homo sapien
aaaccgagcttgcaagggctcatca

SEQ ID NO: 16192 - DNA, 25 bp, Homo sapien
agcgcagcacaaagcccggggcgca

SEQ ID NO: 16193 - DNA, 25 bp, Homo sapien
agccggaggcctcagcgcagcacaa

SEQ ID NO: 16194 - DNA, 25 bp, Homo sapien
catccaccggggtggcttaggctgc

SEQ ID NO: 16195 - DNA, 25 bp, Homo sapien
cccgcaggtcgagtctgccacggat

SEQ ID NO: 16196 - DNA, 25 bp, Homo sapien
ctgccacggatggaactttggaaaa

SEQ ID NO: 16197 - DNA, 25 bp, Homo sapien
ggctcatcaagcatccaccggggtg

SEQ ID NO: 16198 - DNA, 25 bp, Homo sapien
accagcgcgtagttaaagaacagtc

SEQ ID NO: 16199 - DNA, 25 bp, Homo sapien
gccgagttccttgaggtgaaccatc

SEQ ID NO: 16200 - DNA, 25 bp, Homo sapien
cgttcgacaaactgcccgttgatga

SEQ ID NO: 16201 - DNA, 25 bp, Homo sapien
cgcggtacccggacagatgtctcca

SEQ ID NO: 16202 - DNA, 25 bp, Homo sapien
gatgtctccacactcctcgttgtca

SEQ ID NO: 16203 - DNA, 25 bp, Homo sapien
cggaatccaggatacgggaccagtc

SEQ ID NO: 16204 - DNA, 25 bp, Homo sapien
gggaccagtcgatagtggccaagta

SEQ ID NO: 16205 - DNA, 25 bp, Homo sapien
catcaggttgtagaggccgagttcc

SEQ ID NO: 16206 - DNA, 25 bp, Homo sapien
tgggataccctctcggggaagtgtc

SEQ ID NO: 16207 - DNA, 25 bp, Homo sapien
gcgtggtcatttcggacaccggtcc

SEQ ID NO: 16208 - DNA, 25 bp, Homo sapien
ctccactggtgtagctacaggagtg

SEQ ID NO: 16209 - DNA, 25 bp, Homo sapien
taccctctcggggaagtgtctcgga

SEQ ID NO: 16210 - DNA, 25 bp, Homo sapien
gcgcaggtcccgagttaccgctgga

SEQ ID NO: 16211 - DNA, 25 bp, Homo sapien
ccaagggcctccaggggtgtcctga

SEQ ID NO: 16212 - DNA, 25 bp, Homo sapien
agtctgagcgcacggctcctggcgc

SEQ ID NO: 16213 - DNA, 25 bp, Homo sapien
tggggctccactggtgtagctacag

SEQ ID NO: 16214 - DNA, 25 bp, Homo sapien
cgcggaccgacggactagctgactg

SEQ ID NO: 16215 - DNA, 25 bp, Homo sapien
ctacaaatactgagcggaggccctt

SEQ ID NO: 16216 - DNA, 25 bp, Homo sapien
gcgcggcttcgccagctacaaatac

SEQ ID NO: 16217 - DNA, 25 bp, Homo sapien
gtctcctcggatcagagcgcgcggc

SEQ ID NO: 16218 - DNA, 25 bp, Homo sapien
ccctacgcgatgcaggagctaccgt

SEQ ID NO: 16219 - DNA, 25 bp, Homo sapien
ctgctcgggcccgtaaacaacgcgg

SEQ ID NO: 16220 - DNA, 25 bp, Homo sapien
acccaaagatgacgcgtgtcgtgtc

SEQ ID NO: 16221 - DNA, 25 bp, Homo sapien
cgtgtctccggagcgacttgggctc

SEQ ID NO: 16222 - DNA, 25 bp, Homo sapien
ccctgtgttcaagttggagaaatga

SEQ ID NO: 16223 - DNA, 25 bp, Homo sapien
ccagtgcgctccctgtgttcaagtt

SEQ ID NO: 16224 - DNA, 25 bp, Homo sapien
ttcaagttggagaaatgacacctgg

SEQ ID NO: 16225 - DNA, 25 bp, Homo sapien
aatgtgcagacgcttctgaaagggc

SEQ ID NO: 16226 - DNA, 25 bp, Homo sapien
cttctgaaagggcaaagacgacgcc

SEQ ID NO: 16227 - DNA, 25 bp, Homo sapien
agacgacgccaaagaagacgccgga

SEQ ID NO: 16228 - DNA, 25 bp, Homo sapien
agacgccggagacctcgaatagggc

SEQ ID NO: 16229 - DNA, 25 bp, Homo sapien
aatgacacctggaaaaatgtgcaga

SEQ ID NO: 16230 - DNA, 25 bp, Homo sapien
agctgctagctactgtggatctggg

SEQ ID NO: 16231 - DNA, 25 bp, Homo sapien
tgcagaggtgcagacgatgcccgcc

SEQ ID NO: 16232 - DNA, 25 bp, Homo sapien
cttcaatgcatggaggctctaggcg

SEQ ID NO: 16233 - DNA, 25 bp, Homo sapien
gggtgcaggctgctccttcaatgca

SEQ ID NO: 16234 - DNA, 25 bp, Homo sapien
tcccagctgctagctactgtggatc

SEQ ID NO: 16235 - DNA, 25 bp, Homo sapien
gggatcgcgcatgcgctgctctcct

SEQ ID NO: 16236 - DNA, 25 bp, Homo sapien
tcaaaagtcgccctcaccctcgccg

SEQ ID NO: 16237 - DNA, 25 bp, Homo sapien
gcaggctgctccttcaatgcatgga

SEQ ID NO: 16238 - DNA, 25 bp, Homo sapien
cgagctgctgacctccaagatcctg

SEQ ID NO: 16239 - DNA, 25 bp, Homo sapien
gtcttcttggataacgagctgctga

SEQ ID NO: 16240 - DNA, 25 bp, Homo sapien
cccaggaaatggagcgagaacgtct

SEQ ID NO: 16241 - DNA, 25 bp, Homo sapien
cgagctgtctttttacggctctttc

SEQ ID NO: 16242 - DNA, 25 bp, Homo sapien
tgcgcactccaaaagcggggacagg

SEQ ID NO: 16243 - DNA, 25 bp, Homo sapien
cgcgaacatggggaatgcgcactcc

SEQ ID NO: 16244 - DNA, 25 bp, Homo sapien
cgaggcataaaaacggcgcagccca

SEQ ID NO: 16245 - DNA, 25 bp, Homo sapien
ccaagatcctgtctgtgctgcggcc

SEQ ID NO: 16246 - DNA, 25 bp, Homo sapien
ggcggaagacggaggcagctccaca

SEQ ID NO: 16247 - DNA, 25 bp, Homo sapien
agggctgagaccttcgcgggctacg

SEQ ID NO: 16248 - DNA, 25 bp, Homo sapien
cagcgccaacggccaggcggaagac

SEQ ID NO: 16249 - DNA, 25 bp, Homo sapien
atccagagcctgatctgcaggcagc

SEQ ID NO: 16250 - DNA, 25 bp, Homo sapien
acagtcgagggcatccagagcctga

SEQ ID NO: 16251 - DNA, 25 bp, Homo sapien
ttccacagtcgagggcatccagagc

SEQ ID NO: 16252 - DNA, 25 bp, Homo sapien
ttccttccacagtcgagggcatcca

SEQ ID NO: 16253 - DNA, 25 bp, Homo sapien
agcacacttccgcagggcgacccgt

SEQ ID NO: 16254 - DNA, 25 bp, Homo sapien
cagtagcccaagaagccgatgtaga

SEQ ID NO: 16255 - DNA, 25 bp, Homo sapien
tgcgatcatggtgacgccgtttcca

SEQ ID NO: 16256 - DNA, 25 bp, Homo sapien
aagtttcactttgctcgtccgcccg

SEQ ID NO: 16257 - DNA, 25 bp, Homo sapien
gcacgcgaagttccgggctactaag

SEQ ID NO: 16258 - DNA, 25 bp, Homo sapien
cctccgccggattaggttatcaatc

SEQ ID NO: 16259 - DNA, 25 bp, Homo sapien
aacgcttcccggtacgtgttgctgc

SEQ ID NO: 16260 - DNA, 25 bp, Homo sapien
ggtctcagaccacgaactacaagga

SEQ ID NO: 16261 - DNA, 25 bp, Homo sapien
cgtttccacttgaggcctggtctca

SEQ ID NO: 16262 - DNA, 25 bp, Homo sapien
aagcagttccggctgcagtcgacgc

SEQ ID NO: 16263 - DNA, 25 bp, Homo sapien
cgcagcttgtccagcggatccagac

SEQ ID NO: 16264 - DNA, 25 bp, Homo sapien
cgcaggcggtaatcgcccaccagga

SEQ ID NO: 16265 - DNA, 25 bp, Homo sapien
agcaggagcggcaacgcaacttcga

SEQ ID NO: 16266 - DNA, 25 bp, Homo sapien
ctgctgcgccgcctcaagaagcaga

SEQ ID NO: 16267 - DNA, 25 bp, Homo sapien
tgaccggtttgcacgtgcatttgca

SEQ ID NO: 16268 - DNA, 25 bp, Homo sapien
aagaagcagaacaccgcgccaggcg

SEQ ID NO: 16269 - DNA, 25 bp, Homo sapien
tggcctcagcccgataactagcatc

SEQ ID NO: 16270 - DNA, 25 bp, Homo sapien
ggccgcctggtacatgctgaggatt

SEQ ID NO: 16271 - DNA, 25 bp, Homo sapien
aagtgacagcgcctccgactgcatc

SEQ ID NO: 16272 - DNA, 25 bp, Homo sapien
ctgagaagtgacagcgcctccgact

SEQ ID NO: 16273 - DNA, 25 bp, Homo sapien
tcggccaggttgctgagaagtgaca

SEQ ID NO: 16274 - DNA, 25 bp, Homo sapien
aggcccactagccacggcgggaagc

SEQ ID NO: 16275 - DNA, 25 bp, Homo sapien
gagatggtgcccatgaggcccacta

SEQ ID NO: 16276 - DNA, 25 bp, Homo sapien
cctggtacatgctgaggattgagga

SEQ ID NO: 16277 - DNA, 25 bp, Homo sapien
tccgactgcatctgcgcctccatgg

SEQ ID NO: 16278 - DNA, 25 bp, Homo sapien
tgcgacggagtatcctgggcgaccc

SEQ ID NO: 16279 - DNA, 25 bp, Homo sapien
gacgccaggccgctcagcgacgcca

SEQ ID NO: 16280 - DNA, 25 bp, Homo sapien
ctgtacgactccagcgccgacgcca

SEQ ID NO: 16281 - DNA, 25 bp, Homo sapien
tgggccaaactctaggacctccggc

SEQ ID NO: 16282 - DNA, 25 bp, Homo sapien
agcttgggccaaactctaggacctc

SEQ ID NO: 16283 - DNA, 25 bp, Homo sapien
ccgtttcccagtctctgagcttggg

SEQ ID NO: 16284 - DNA, 25 bp, Homo sapien
cggggcctctgcgacggagtatcct

SEQ ID NO: 16285 - DNA, 25 bp, Homo sapien
cagtctctgagcttgggccaaactc

SEQ ID NO: 16286 - DNA, 25 bp, Homo sapien
tgcgcaccacgtcgcaccgggactt

SEQ ID NO: 16287 - DNA, 25 bp, Homo sapien
gacctgcggctgcacgagggcacca

SEQ ID NO: 16288 - DNA, 25 bp, Homo sapien
ctggcgaccgcgacaagttgcgcat

SEQ ID NO: 16289 - DNA, 25 bp, Homo sapien
gcttttcccaatggacccgcgctgg

SEQ ID NO: 16290 - DNA, 25 bp, Homo sapien
cacgctcgccatgcaggccggcaac

SEQ ID NO: 16291 - DNA, 25 bp, Homo sapien
ggctggacttcctcaaggcctcgca

SEQ ID NO: 16292 - DNA, 25 bp, Homo sapien
cctgcacctgcacgaggacgcgcac

SEQ ID NO: 16293 - DNA, 25 bp, Homo sapien
aaggcctcgcacttctcgctggggc

SEQ ID NO: 16294 - DNA, 25 bp, Homo sapien
ccctccctaggaggcgatccaggac

SEQ ID NO: 16295 - DNA, 25 bp, Homo sapien
gagttcaggaggccctgtcctcaaa

SEQ ID NO: 16296 - DNA, 25 bp, Homo sapien
ctcctgattcgaggtattgttccca

SEQ ID NO: 16297 - DNA, 25 bp, Homo sapien
aggttgggagccttcaatcgggcgg

SEQ ID NO: 16298 - DNA, 25 bp, Homo sapien
tccggcctagcgcacccatcccgcc

SEQ ID NO: 16299 - DNA, 25 bp, Homo sapien
agaaagagatagggccagggccaca

SEQ ID NO: 16300 - DNA, 25 bp, Homo sapien
gattcgaggtattgttcccacctcc

SEQ ID NO: 16301 - DNA, 25 bp, Homo sapien
gcagcccggggcgacctctaatcgt

SEQ ID NO: 16302 - DNA, 25 bp, Homo sapien
tttccagtcgaagacacgggagctg

SEQ ID NO: 16303 - DNA, 25 bp, Homo sapien
tccacagattttccagtcgaagaca

SEQ ID NO: 16304 - DNA, 25 bp, Homo sapien
tcccgtttccacagattttccagtc

SEQ ID NO: 16305 - DNA, 25 bp, Homo sapien
ctagaacgtgatcgcttgcctcctc

SEQ ID NO: 16306 - DNA, 25 bp, Homo sapien
cccgtccgctagaacgtgatcgctt

SEQ ID NO: 16307 - DNA, 25 bp, Homo sapien
acaggcccatctggtgccgcccggc

SEQ ID NO: 16308 - DNA, 25 bp, Homo sapien
agccgccattcgaggacgactctct

SEQ ID NO: 16309 - DNA, 25 bp, Homo sapien
ctgtgagccgccattcgaggacgac

SEQ ID NO: 16310 - DNA, 25 bp, Homo sapien
ttcgacctcgatccagatgtgattg

SEQ ID NO: 16311 - DNA, 25 bp, Homo sapien
ccctgattctcgatcctaacagcga

SEQ ID NO: 16312 - DNA, 25 bp, Homo sapien
ggaagtccttcagccacggtgccac

SEQ ID NO: 16313 - DNA, 25 bp, Homo sapien
tcagcaccgtggcatccacactggg

SEQ ID NO: 16314 - DNA, 25 bp, Homo sapien
ggcgctccacgctgctgaaacatcg

SEQ ID NO: 16315 - DNA, 25 bp, Homo sapien
cacctgcacgtgcattcgggcgagc

SEQ ID NO: 16316 - DNA, 25 bp, Homo sapien
ggcgagcgtccctatcgctgtcagc

SEQ ID NO: 16317 - DNA, 25 bp, Homo sapien
tcgggcagagctccaacttgcaaca

SEQ ID NO: 16318 - DNA, 25 bp, Homo sapien
gcagagctcgtcgttgccaaactca

SEQ ID NO: 16319 - DNA, 25 bp, Homo sapien
tttttctaagctccagcgctgactt

SEQ ID NO: 16320 - DNA, 25 bp, Homo sapien
aagggcagacggctcctagaacttg

SEQ ID NO: 16321 - DNA, 25 bp, Homo sapien
cagatcagctgatgccggagggttt

SEQ ID NO: 16322 - DNA, 25 bp, Homo sapien
ctagcgactgccttcgacccagagg

SEQ ID NO: 16323 - DNA, 25 bp, Homo sapien
cggcggagctcctagtctctttttt

SEQ ID NO: 16324 - DNA, 25 bp, Homo sapien
gcgctgacttttcacggtggagaaa

SEQ ID NO: 16325 - DNA, 25 bp, Homo sapien
tcacgtgaccgaggcacagatcagc

SEQ ID NO: 16326 - DNA, 25 bp, Homo sapien
tggttttcccagcagtagtattgta

SEQ ID NO: 16327 - DNA, 25 bp, Homo sapien
ctcagtatcttccaaggagcccgga

SEQ ID NO: 16328 - DNA, 25 bp, Homo sapien
agtcccagtgatgctctgtgccata

SEQ ID NO: 16329 - DNA, 25 bp, Homo sapien
ccaggactcttctgaaacgtgggta

SEQ ID NO: 16330 - DNA, 25 bp, Homo sapien
aacgtgggtatcagacgccttccgc

SEQ ID NO: 16331 - DNA, 25 bp, Homo sapien
ggagccgagtatctaggtgcccact

SEQ ID NO: 16332 - DNA, 25 bp, Homo sapien
ggggcattcagtcttcgacggagta

SEQ ID NO: 16333 - DNA, 25 bp, Homo sapien
tttccaagtaacgactcggagtctc

SEQ ID NO: 16334 - DNA, 25 bp, Homo sapien
ctatgagtatgacagcccgaagttg

SEQ ID NO: 16335 - DNA, 25 bp, Homo sapien
tgcggatctccaagtccgacttcta

SEQ ID NO: 16336 - DNA, 25 bp, Homo sapien
ggtgaatgcagctcccgacctctga

SEQ ID NO: 16337 - DNA, 25 bp, Homo sapien
gttcctgcaggatcatgcgcgcaca

SEQ ID NO: 16338 - DNA, 25 bp, Homo sapien
ggacttcgccatcgactggactgca

SEQ ID NO: 16339 - DNA, 25 bp, Homo sapien
tggcgaacctctcatcttcacactg

SEQ ID NO: 16340 - DNA, 25 bp, Homo sapien
acttacatcgtgctcaatgggcggc

SEQ ID NO: 16341 - DNA, 25 bp, Homo sapien
cgcccagacctcatttcgttggaaa

SEQ ID NO: 16342 - DNA, 25 bp, Homo sapien
cgaaaaccaattgccagtacccgtg

SEQ ID NO: 16343 - DNA, 25 bp, Homo sapien
ggggactgcagtcagctatttaaac

SEQ ID NO: 16344 - DNA, 25 bp, Homo sapien
gcgcatgcggagaaagccctctgaa

SEQ ID NO: 16345 - DNA, 25 bp, Homo sapien
tgtgagcgccgccattgctgcggca

SEQ ID NO: 16346 - DNA, 25 bp, Homo sapien
ccgtgcgagtcccttactatgtggg

SEQ ID NO: 16347 - DNA, 25 bp, Homo sapien
gagaaggcatttgagaagagtcacc

SEQ ID NO: 16348 - DNA, 25 bp, Homo sapien
accaacttgatccacatccgggatc

SEQ ID NO: 16349 - DNA, 25 bp, Homo sapien
cagtacccgtggcaattgtgagcgc

SEQ ID NO: 16350 - DNA, 25 bp, Homo sapien
cgggtcctttgttccttagcagtgc

SEQ ID NO: 16351 - DNA, 25 bp, Homo sapien
agccgtccgtattccgcagctggag

SEQ ID NO: 16352 - DNA, 25 bp, Homo sapien
tgcgcgcccttaagcagctagtcct

SEQ ID NO: 16353 - DNA, 25 bp, Homo sapien
acgcgcaccgtggagtggctaaata

SEQ ID NO: 16354 - DNA, 25 bp, Homo sapien
gctaaatatgcgcagctggtgctcg

SEQ ID NO: 16355 - DNA, 25 bp, Homo sapien
tcccagcatgagctctacgagaagg

SEQ ID NO: 16356 - DNA, 25 bp, Homo sapien
ggggaacaccattgcccttgtgcta

SEQ ID NO: 16357 - DNA, 25 bp, Homo sapien
ggctgctcgcacatcggagtactaa

SEQ ID NO: 16358 - DNA, 25 bp, Homo sapien
tggtggacgggtgctacgttaacaa

SEQ ID NO: 16359 - DNA, 25 bp, Homo sapien
gatggcggctacatcaacaatctgc

SEQ ID NO: 16360 - DNA, 25 bp, Homo sapien
ggcacctactcatggatggcggcta

SEQ ID NO: 16361 - DNA, 25 bp, Homo sapien
ttaacaacgtcccaggtcagcgagc

SEQ ID NO: 16362 - DNA, 25 bp, Homo sapien
cagggagactcgtcggacgccttac

SEQ ID NO: 16363 - DNA, 25 bp, Homo sapien
taacacgagtgaccgtccaccctgg

SEQ ID NO: 16364 - DNA, 25 bp, Homo sapien
tgggacgttgttaacacgagtgacc

SEQ ID NO: 16365 - DNA, 25 bp, Homo sapien
gccagcatgacgctgtcgggctacc

SEQ ID NO: 16366 - DNA, 25 bp, Homo sapien
gcgaggatctcctctcggtctcttc

SEQ ID NO: 16367 - DNA, 25 bp, Homo sapien
cagtacgatttctcgcgggccaagg

SEQ ID NO: 16368 - DNA, 25 bp, Homo sapien
tgctgctccgtgcacactgcagtga

SEQ ID NO: 16369 - DNA, 25 bp, Homo sapien
tgcccgagatcaagtcgctggacca

SEQ ID NO: 16370 - DNA, 25 bp, Homo sapien
ccgtgggaacaatagcgccggccgc

SEQ ID NO: 16371 - DNA, 25 bp, Homo sapien
gcgtccaagcctccaggtgagccgg

SEQ ID NO: 16372 - DNA, 25 bp, Homo sapien
tgcacgccttcttctcttttacaca

SEQ ID NO: 16373 - DNA, 25 bp, Homo sapien
gaggacctttctagtgcccgagatc

SEQ ID NO: 16374 - DNA, 25 bp, Homo sapien
ggggaatacaatcgagcggtcagca

SEQ ID NO: 16375 - DNA, 25 bp, Homo sapien
gtcagcaagctgagtgccgccttga

SEQ ID NO: 16376 - DNA, 25 bp, Homo sapien
tccgaggtgaaaatgaccagctttg

SEQ ID NO: 16377 - DNA, 25 bp, Homo sapien
ggtgagccaacctcacggcccaagg

SEQ ID NO: 16378 - DNA, 25 bp, Homo sapien
tgaggccatattcgccaagcaccgc

SEQ ID NO: 16379 - DNA, 25 bp, Homo sapien
tcagaagcgacggattgaggccata

SEQ ID NO: 16380 - DNA, 25 bp, Homo sapien
acaggcccaccaaagcaccagtgta

SEQ ID NO: 16381 - DNA, 25 bp, Homo sapien
gggacatgcagaggctcacggacca

SEQ ID NO: 16382 - DNA, 25 bp, Homo sapien
tgtgacgactcagccctggcacgaa

SEQ ID NO: 16383 - DNA, 25 bp, Homo sapien
acgacctcgataaggtgctgcggcc

SEQ ID NO: 16384 - DNA, 25 bp, Homo sapien
cgtgagcggttctgatgccgattcc

SEQ ID NO: 16385 - DNA, 25 bp, Homo sapien
ctgatgccgattccctgtgatctgc

SEQ ID NO: 16386 - DNA, 25 bp, Homo sapien
ctgtgatctgcaggctggcccaaga

SEQ ID NO: 16387 - DNA, 25 bp, Homo sapien
tgtgtccgcagtcccgatggcgact

SEQ ID NO: 16388 - DNA, 25 bp, Homo sapien
acttcacgcggcaggagtacgagcg

SEQ ID NO: 16389 - DNA, 25 bp, Homo sapien
ccagctgaagctgatggacgacctc

SEQ ID NO: 16390 - DNA, 25 bp, Homo sapien
ggacacctctggcagggcaagaaac

SEQ ID NO: 16391 - DNA, 25 bp, Homo sapien
cgtcgatgccttcaccatccaggga

SEQ ID NO: 16392 - DNA, 25 bp, Homo sapien
cagttccgggcgctctacacgctgt

SEQ ID NO: 16393 - DNA, 25 bp, Homo sapien
tcacgcccgccatggtggaaggcat

SEQ ID NO: 16394 - DNA, 25 bp, Homo sapien
tggaaggcatctacaagtacaactc

SEQ ID NO: 16395 - DNA, 25 bp, Homo sapien
gtacaactcggaccgcaagcgcttc

SEQ ID NO: 16396 - DNA, 25 bp, Homo sapien
cgccaagaccatgtccatgagcgtc

SEQ ID NO: 16397 - DNA, 25 bp, Homo sapien
atgtccatgagcgtcgatgccttca

SEQ ID NO: 16398 - DNA, 25 bp, Homo sapien
tccgcccagcatgtaagaccttttg

SEQ ID NO: 16399 - DNA, 25 bp, Homo sapien
aagaccttttgtgatccgacctccg

SEQ ID NO: 16400 - DNA, 25 bp, Homo sapien
agcctcgccgatcacacgggaatga

SEQ ID NO: 16401 - DNA, 25 bp, Homo sapien
ttctcggtttgtggccgttttgatc

SEQ ID NO: 16402 - DNA, 25 bp, Homo sapien
atccgtgcgtcgtggtcatatttcg

SEQ ID NO: 16403 - DNA, 25 bp, Homo sapien
cgcttaatttttccaatctgtgacg

SEQ ID NO: 16404 - DNA, 25 bp, Homo sapien
aatctgtgacgtggagcgttctgtc

SEQ ID NO: 16405 - DNA, 25 bp, Homo sapien
gttctgtcggcctgaccttggctac

SEQ ID NO: 16406 - DNA, 25 bp, Homo sapien
ggcactgcccgagaccttgagcatc

SEQ ID NO: 16407 - DNA, 25 bp, Homo sapien
tcaaagtccttccacgtctgccaga

SEQ ID NO: 16408 - DNA, 25 bp, Homo sapien
acgttgggccacttgaacagcgaga

SEQ ID NO: 16409 - DNA, 25 bp, Homo sapien
tggccatccctgtgcttccagaagg

SEQ ID NO: 16410 - DNA, 25 bp, Homo sapien
acggtgggtacctcaatggccttct

SEQ ID NO: 16411 - DNA, 25 bp, Homo sapien
ccgcccgcttgatgtagatgttgaa

SEQ ID NO: 16412 - DNA, 25 bp, Homo sapien
cccgcctcactcttggcatattttg

SEQ ID NO: 16413 - DNA, 25 bp, Homo sapien
ccatgaagttgacctgcgtgttgta

SEQ ID NO: 16414 - DNA, 25 bp, Homo sapien
cgcagcaagacgctgttgaggagca

SEQ ID NO: 16415 - DNA, 25 bp, Homo sapien
acatgtttgtcaggggcggagaccc

SEQ ID NO: 16416 - DNA, 25 bp, Homo sapien
ctgggagccgcgaacatgtttgtca

SEQ ID NO: 16417 - DNA, 25 bp, Homo sapien
cagctccaggtccacatcatctggg

SEQ ID NO: 16418 - DNA, 25 bp, Homo sapien
ctgatgagctgctcgaagcgggcca

SEQ ID NO: 16419 - DNA, 25 bp, Homo sapien
gttttggcgcagcaagacgctgttg

SEQ ID NO: 16420 - DNA, 25 bp, Homo sapien
ccactcgtgcacgtggtgtgggttt

SEQ ID NO: 16421 - DNA, 25 bp, Homo sapien
gcgacacgcttgtgccactcgtgca

SEQ ID NO: 16422 - DNA, 25 bp, Homo sapien
aacgctcgtcgttcaccacggtggc

SEQ ID NO: 16423 - DNA, 25 bp, Homo sapien
gcgagagaacaccagagcttgccca

SEQ ID NO: 16424 - DNA, 25 bp, Homo sapien
ccacattgagggactgtaccttgtc

SEQ ID NO: 16425 - DNA, 25 bp, Homo sapien
accttgtccggattctgggagatga

SEQ ID NO: 16426 - DNA, 25 bp, Homo sapien
atgaggtcgcacagctcgtgccaca

SEQ ID NO: 16427 - DNA, 25 bp, Homo sapien
aggcccacctggtagttggacttgc

SEQ ID NO: 16428 - DNA, 25 bp, Homo sapien
tgccggccttagacacgaaacgctc

SEQ ID NO: 16429 - DNA, 25 bp, Homo sapien
tgccagcatgcaccttctcgaaatg

SEQ ID NO: 16430 - DNA, 25 bp, Homo sapien
gggcttttccgactatcaccatccg

SEQ ID NO: 16431 - DNA, 25 bp, Homo sapien
ccaggaggcattgcagcgagttgct

SEQ ID NO: 16432 - DNA, 25 bp, Homo sapien
ggcgcgtcgagagcgaactccatct

SEQ ID NO: 16433 - DNA, 25 bp, Homo sapien
ggactggtagttctctctgggctcc

SEQ ID NO: 16434 - DNA, 25 bp, Homo sapien
tgtgcgctgccttccgggactggta

SEQ ID NO: 16435 - DNA, 25 bp, Homo sapien
acaggtgctcagtgggcccacgtac

SEQ ID NO: 16436 - DNA, 25 bp, Homo sapien
agtctcatggtaagacaggtgctca

SEQ ID NO: 16437 - DNA, 25 bp, Homo sapien
gcgaggctgggatagattagtctca

SEQ ID NO: 16438 - DNA, 25 bp, Homo sapien
ggcagtttcggcctaaatctccttg

SEQ ID NO: 16439 - DNA, 25 bp, Homo sapien
cgccagcgaccggaagcagaataga

SEQ ID NO: 16440 - DNA, 25 bp, Homo sapien
cggacaggcccacgttattgacttc

SEQ ID NO: 16441 - DNA, 25 bp, Homo sapien
gcgcgcttatgacgtctaccactga

SEQ ID NO: 16442 - DNA, 25 bp, Homo sapien
cggctcctctgtggactcacgaaga

SEQ ID NO: 16443 - DNA, 25 bp, Homo sapien
gtggttttctactcagacccgaaga

SEQ ID NO: 16444 - DNA, 25 bp, Homo sapien
ggctagacgcttcccttcgacagtg

SEQ ID NO: 16445 - DNA, 25 bp, Homo sapien
gagtcgcgccatcaccaccattttt

SEQ ID NO: 16446 - DNA, 25 bp, Homo sapien
tcttgcaggcacagaacctcccggg

SEQ ID NO: 16447 - DNA, 25 bp, Homo sapien
gtgtgcacctccagcgacttcgtgc

SEQ ID NO: 16448 - DNA, 25 bp, Homo sapien
ccaggaagtgtgtgtctgaactccc

SEQ ID NO: 16449 - DNA, 25 bp, Homo sapien
ctcccatctgtgagcgtgtcgtcga

SEQ ID NO: 16450 - DNA, 25 bp, Homo sapien
tgcttcgcacgcaagccaggaagtg

SEQ ID NO: 16451 - DNA, 25 bp, Homo sapien
gattattgccctgcgatcctgcttc

SEQ ID NO: 16452 - DNA, 25 bp, Homo sapien
ccggtgccagaacagaacaaaattg

SEQ ID NO: 16453 - DNA, 25 bp, Homo sapien
gtccgagcacctgaccctcgagggg

SEQ ID NO: 16454 - DNA, 25 bp, Homo sapien
ccggctcatcgtgtatgtcatgggc

SEQ ID NO: 16455 - DNA, 25 bp, Homo sapien
acaaggctggcatagaagcccgggc

SEQ ID NO: 16456 - DNA, 25 bp, Homo sapien
ctggcacaagaacaaggctggcata

SEQ ID NO: 16457 - DNA, 25 bp, Homo sapien
cccgcttcggtcactggcacaagaa

SEQ ID NO: 16458 - DNA, 25 bp, Homo sapien
tgagggcctcctgcctggactttct

SEQ ID NO: 16459 - DNA, 25 bp, Homo sapien
ccgcccacgcctgggtctgtgttag

SEQ ID NO: 16460 - DNA, 25 bp, Homo sapien
acaggaacctgtggcccttcgtatc

SEQ ID NO: 16461 - DNA, 25 bp, Homo sapien
catgtcagagatgagggccgcctac

SEQ ID NO: 16462 - DNA, 25 bp, Homo sapien
gctggaaataaacctggagatgatg

SEQ ID NO: 16463 - DNA, 25 bp, Homo sapien
agggactgatctagcgtctccaaga

SEQ ID NO: 16464 - DNA, 25 bp, Homo sapien
cgctcctgtgttccgggctgcaggc

SEQ ID NO: 16465 - DNA, 25 bp, Homo sapien
gtcaccggctgcacttgtggctccg

SEQ ID NO: 16466 - DNA, 25 bp, Homo sapien
tgctgtcgtgtgcagccctgaggtc

SEQ ID NO: 16467 - DNA, 25 bp, Homo sapien
atgatggagcggatctgagccctgc

SEQ ID NO: 16468 - DNA, 25 bp, Homo sapien
tgagccctgcgtggtttctttagta

SEQ ID NO: 16469 - DNA, 25 bp, Homo sapien
ctgcgtggtttctttagtaggcccg

SEQ ID NO: 16470 - DNA, 25 bp, Homo sapien
ggcccatccgcgtctcaaaggacga

SEQ ID NO: 16471 - DNA, 25 bp, Homo sapien
accgacagctgatgggaggaccaca

SEQ ID NO: 16472 - DNA, 25 bp, Homo sapien
gaagtcggcactggagcacacaaca

SEQ ID NO: 16473 - DNA, 25 bp, Homo sapien
cgcatctctttgcaagtgggaagtc

SEQ ID NO: 16474 - DNA, 25 bp, Homo sapien
tgcctgccgagggtataagactccc

SEQ ID NO: 16475 - DNA, 25 bp, Homo sapien
ggcgctttcgcaattgaaccgtctg

SEQ ID NO: 16476 - DNA, 25 bp, Homo sapien
acgaagggttcctgcgtgacacatc

SEQ ID NO: 16477 - DNA, 25 bp, Homo sapien
tggggtcggcttagcatccacacac

SEQ ID NO: 16478 - DNA, 25 bp, Homo sapien
ccaggaccagggtcatgactagcta

SEQ ID NO: 16479 - DNA, 25 bp, Homo sapien
actcgagactccatctccggggtct

SEQ ID NO: 16480 - DNA, 25 bp, Homo sapien
ccaaggtccaggagtgacagggtcc

SEQ ID NO: 16481 - DNA, 25 bp, Homo sapien
gagtgacagggtccgcttacgccct

SEQ ID NO: 16482 - DNA, 25 bp, Homo sapien
cccggaacagctcagtgcggacgtc

SEQ ID NO: 16483 - DNA, 25 bp, Homo sapien
agctcagtgcggacgtcctcacggc

SEQ ID NO: 16484 - DNA, 25 bp, Homo sapien
ccagggtcatgactagctaaaggtc

SEQ ID NO: 16485 - DNA, 25 bp, Homo sapien
gaacagctcagtgcggacgtcctca

SEQ ID NO: 16486 - DNA, 25 bp, Homo sapien
cgaggacgtcagcaccgagctgtac

SEQ ID NO: 16487 - DNA, 25 bp, Homo sapien
cagggaccgcgaggacgtcagcacc

SEQ ID NO: 16488 - DNA, 25 bp, Homo sapien
gtcctgaccttgagcccaaccaaaa

SEQ ID NO: 16489 - DNA, 25 bp, Homo sapien
gacctttagctagtcctgaccttga

SEQ ID NO: 16490 - DNA, 25 bp, Homo sapien
aagtgacccggcgggcatgcgtttt

SEQ ID NO: 16491 - DNA, 25 bp, Homo sapien
cctgtggtccctgagtctggccacg

SEQ ID NO: 16492 - DNA, 25 bp, Homo sapien
cgtctgagaccccagagatggagtc

SEQ ID NO: 16493 - DNA, 25 bp, Homo sapien
tcagcaccgagctgtaccgggcgct

SEQ ID NO: 16494 - DNA, 25 bp, Homo sapien
gggtgttgccggcattggcctccct

SEQ ID NO: 16495 - DNA, 25 bp, Homo sapien
cctcgtttgagccagcgagggacgt

SEQ ID NO: 16496 - DNA, 25 bp, Homo sapien
cgccctcgtttgagccagcgaggga

SEQ ID NO: 16497 - DNA, 25 bp, Homo sapien
ccatggttcgaacgggatggatgca

SEQ ID NO: 16498 - DNA, 25 bp, Homo sapien
tgttgccggcattggcctccctggg

SEQ ID NO: 16499 - DNA, 25 bp, Homo sapien
gcaagcgctcccatggttcgaacgg

SEQ ID NO: 16500 - DNA, 25 bp, Homo sapien
gctcccatggttcgaacgggatgga

SEQ ID NO: 16501 - DNA, 25 bp, Homo sapien
cagctggcgggcaagcgctcccatg

SEQ ID NO: 16502 - DNA, 25 bp, Homo sapien
acctggaggaggacacgtggatcct

SEQ ID NO: 16503 - DNA, 25 bp, Homo sapien
gactccaagtccatgcgctccatga

SEQ ID NO: 16504 - DNA, 25 bp, Homo sapien
tccatgaatggctcgcggcggaaca

SEQ ID NO: 16505 - DNA, 25 bp, Homo sapien
agtggctcctcgctagtgtccagct

SEQ ID NO: 16506 - DNA, 25 bp, Homo sapien
gtccatgcgctccatgaatggctcg

SEQ ID NO: 16507 - DNA, 25 bp, Homo sapien
aggtggtgcggtcactcagccacca

SEQ ID NO: 16508 - DNA, 25 bp, Homo sapien
ggtgcggtcactcagccaccaggca

SEQ ID NO: 16509 - DNA, 25 bp, Homo sapien
cggcggaacagtggctcctcgctag

SEQ ID NO: 16510 - DNA, 25 bp, Homo sapien
agcttctgtgcagcgccacggacat

SEQ ID NO: 16511 - DNA, 25 bp, Homo sapien
gctcaagatgtcctcgccgtgcgag

SEQ ID NO: 16512 - DNA, 25 bp, Homo sapien
ccacttccgggccatcgtgtggcag

SEQ ID NO: 16513 - DNA, 25 bp, Homo sapien
aaccagtactccgagctgctcaaga

SEQ ID NO: 16514 - DNA, 25 bp, Homo sapien
tgcccgtcaagaaccagtactccga

SEQ ID NO: 16515 - DNA, 25 bp, Homo sapien
agctgctcaagatgtcctcgccgtg

SEQ ID NO: 16516 - DNA, 25 bp, Homo sapien
agcgccacggacatgcccgtcaaga

SEQ ID NO: 16517 - DNA, 25 bp, Homo sapien
cgggccatcgtgtggcagcttctgt

SEQ ID NO: 16518 - DNA, 25 bp, Homo sapien
ttcgcagtcatctcctgcgcaggtg

SEQ ID NO: 16519 - DNA, 25 bp, Homo sapien
ggactgcaccgggaactcttgagcc

SEQ ID NO: 16520 - DNA, 25 bp, Homo sapien
tcgggctgtgacctcattccctgtc

SEQ ID NO: 16521 - DNA, 25 bp, Homo sapien
cgggcgccatggacaagatcttgga

SEQ ID NO: 16522 - DNA, 25 bp, Homo sapien
tcatacccggtcagcgtgaagcagg

SEQ ID NO: 16523 - DNA, 25 bp, Homo sapien
gccctgcctcaaagagctgttcgca

SEQ ID NO: 16524 - DNA, 25 bp, Homo sapien
ctgtacgtgtggatttgtgcatgcg

SEQ ID NO: 16525 - DNA, 25 bp, Homo sapien
ccgtggagttcctagagcaggccca

SEQ ID NO: 16526 - DNA, 25 bp, Homo sapien
tacatccgcgagctcaaggaccaga

SEQ ID NO: 16527 - DNA, 25 bp, Homo sapien
gggccagctgaaccactcggactca

SEQ ID NO: 16528 - DNA, 25 bp, Homo sapien
aaggccgcatccagggccagctgaa

SEQ ID NO: 16529 - DNA, 25 bp, Homo sapien
agcgcattgccgagctggagatcca

SEQ ID NO: 16530 - DNA, 25 bp, Homo sapien
ctgcagacgcagctcagcgaaagcc

SEQ ID NO: 16531 - DNA, 25 bp, Homo sapien
ctggctgcacagaacaaggggctgc

SEQ ID NO: 16532 - DNA, 25 bp, Homo sapien
ggagaagctgcagtacctggctgca

SEQ ID NO: 16533 - DNA, 25 bp, Homo sapien
tcggactcatcgcagtacatccgcg

SEQ ID NO: 16534 - DNA, 25 bp, Homo sapien
acagcgaaggtgtgcaagtcccagt

SEQ ID NO: 16535 - DNA, 25 bp, Homo sapien
ctaagactaatccacccagcggggc

SEQ ID NO: 16536 - DNA, 25 bp, Homo sapien
tctggctcagtggaaggtctccacc

SEQ ID NO: 16537 - DNA, 25 bp, Homo sapien
actcgtccaggggagacagtagttc

SEQ ID NO: 16538 - DNA, 25 bp, Homo sapien
taggtcaaagctgtgggtaggtccc

SEQ ID NO: 16539 - DNA, 25 bp, Homo sapien
aaggtcccgcctccttgtctaagct

SEQ ID NO: 16540 - DNA, 25 bp, Homo sapien
atggtgcacagaccgtcagcagagc

SEQ ID NO: 16541 - DNA, 25 bp, Homo sapien
ccttcagtctcgtagatggtgcaca

SEQ ID NO: 16542 - DNA, 25 bp, Homo sapien
ccgaggcgctgctcactgatttccg

SEQ ID NO: 16543 - DNA, 25 bp, Homo sapien
acgggtcttgccttggtacccgatg

SEQ ID NO: 16544 - DNA, 25 bp, Homo sapien
cttgccttggtacccgatggagagg

SEQ ID NO: 16545 - DNA, 25 bp, Homo sapien
aagaaagcggtcctagtgctggggc

SEQ ID NO: 16546 - DNA, 25 bp, Homo sapien
ctgcgtccttccttgggggtgtgac

SEQ ID NO: 16547 - DNA, 25 bp, Homo sapien
cagtcctttcggcttgggctgcgag

SEQ ID NO: 16548 - DNA, 25 bp, Homo sapien
aggcgctgctcactgatttccgggg

SEQ ID NO: 16549 - DNA, 25 bp, Homo sapien
tcgcagagcctgcagtcctttcggc

SEQ ID NO: 16550 - DNA, 25 bp, Homo sapien
atggacactcaaacctcggcctcgg

SEQ ID NO: 16551 - DNA, 25 bp, Homo sapien
ctcttgttgtccatcttgcacctga

SEQ ID NO: 16552 - DNA, 25 bp, Homo sapien
aaccggtccgcatcccaggttctgg

SEQ ID NO: 16553 - DNA, 25 bp, Homo sapien
tttccctaaagcgaagaggccctgc

SEQ ID NO: 16554 - DNA, 25 bp, Homo sapien
ggctccaattcaggaccgatctcca

SEQ ID NO: 16555 - DNA, 25 bp, Homo sapien
cgctcctcacagagtcgcctggggt

SEQ ID NO: 16556 - DNA, 25 bp, Homo sapien
gcctgaggaacccagatagtcaacg

SEQ ID NO: 16557 - DNA, 25 bp, Homo sapien
ttgcacctgaagagacaaaccggtc

SEQ ID NO: 16558 - DNA, 25 bp, Homo sapien
gacccaggagttgggcccagcgtcc

SEQ ID NO: 16559 - DNA, 25 bp, Homo sapien
cagcgtccctcccggaacggtgagt

SEQ ID NO: 16560 - DNA, 25 bp, Homo sapien
tgccctgactcaccctcgcggcccg

SEQ ID NO: 16561 - DNA, 25 bp, Homo sapien
ccagagacccaggagttgggcccag

SEQ ID NO: 16562 - DNA, 25 bp, Homo sapien
cggcagctccgctcccagagaccca

SEQ ID NO: 16563 - DNA, 25 bp, Homo sapien
tgcaaagggaaacctggcccacgag

SEQ ID NO: 16564 - DNA, 25 bp, Homo sapien
aggccgtcccgacacaccaggagct

SEQ ID NO: 16565 - DNA, 25 bp, Homo sapien
acggtgagtaggtggctctttgcct

SEQ ID NO: 16566 - DNA, 25 bp, Homo sapien
tcctgacgtcaagaatgacttcgcc

SEQ ID NO: 16567 - DNA, 25 bp, Homo sapien
atgctgcacctcatcgatcagtacg

SEQ ID NO: 16568 - DNA, 25 bp, Homo sapien
ccgtcttcctgtccgaggtcagcga

SEQ ID NO: 16569 - DNA, 25 bp, Homo sapien
ccgaggtcagcgaaagccgtctaaa

SEQ ID NO: 16570 - DNA, 25 bp, Homo sapien
ttcgacagaagctgcagcgcaatgc

SEQ ID NO: 16571 - DNA, 25 bp, Homo sapien
tggacgcccgagaagcttcgacaga

SEQ ID NO: 16572 - DNA, 25 bp, Homo sapien
agccgtctaaagcagctcaatctca

SEQ ID NO: 16573 - DNA, 25 bp, Homo sapien
gctcaatctcaaccacgagtggacg

SEQ ID NO: 16574 - DNA, 25 bp, Homo sapien
ctgccgctttgggaacgaggttcca

SEQ ID NO: 16575 - DNA, 25 bp, Homo sapien
tgctaccactctcgtcatctcaggg

SEQ ID NO: 16576 - DNA, 25 bp, Homo sapien
cgtccctgttgacctgatgctacca

SEQ ID NO: 16577 - DNA, 25 bp, Homo sapien
gaggatcgacctcaacctggatatc

SEQ ID NO: 16578 - DNA, 25 bp, Homo sapien
tcgagctctaggtggcgtcatcctt

SEQ ID NO: 16579 - DNA, 25 bp, Homo sapien
aagaatggtgtttcctcgcagcgcc

SEQ ID NO: 16580 - DNA, 25 bp, Homo sapien
cgcccaccgtcctcagaagaatggt

SEQ ID NO: 16581 - DNA, 25 bp, Homo sapien
ctcgctaagcatgcgcgccgttttc

SEQ ID NO: 16582 - DNA, 25 bp, Homo sapien
cggaagacagcaggccgcgatcaga

SEQ ID NO: 16583 - DNA, 25 bp, Homo sapien
cccgacagacactgtgaacggaaga

SEQ ID NO: 16584 - DNA, 25 bp, Homo sapien
ctgtgaacggaagacagcaggccgc

SEQ ID NO: 16585 - DNA, 25 bp, Homo sapien
ccgcgatcagagtcgctgttcattc

SEQ ID NO: 16586 - DNA, 25 bp, Homo sapien
cagagtcgctgttcattcagccgca

SEQ ID NO: 16587 - DNA, 25 bp, Homo sapien
gctgttcattcagccgcagcctctg

SEQ ID NO: 16588 - DNA, 25 bp, Homo sapien
agtcccgcagccaccatgcacgctc

SEQ ID NO: 16589 - DNA, 25 bp, Homo sapien
gtccttcgccactcccacgcgcccg

SEQ ID NO: 16590 - DNA, 25 bp, Homo sapien
gggcgacaccgacctgctctccgca

SEQ ID NO: 16591 - DNA, 25 bp, Homo sapien
tctccgcagcgtctgacggggccgt

SEQ ID NO: 16592 - DNA, 25 bp, Homo sapien
ctctgctttgttgccctggtcccac

SEQ ID NO: 16593 - DNA, 25 bp, Homo sapien
acgcatggcggctctaaccgacgcg

SEQ ID NO: 16594 - DNA, 25 bp, Homo sapien
atggcggctctaaccgacgcgacct

SEQ ID NO: 16595 - DNA, 25 bp, Homo sapien
gacgcgacctcacggctttcattcc

SEQ ID NO: 16596 - DNA, 25 bp, Homo sapien
tttcattccaccctaatctcacggc

SEQ ID NO: 16597 - DNA, 25 bp, Homo sapien
tggcgctcacgcctgaacatgctcg

SEQ ID NO: 16598 - DNA, 25 bp, Homo sapien
gagctggactcaggtctctcttggg

SEQ ID NO: 16599 - DNA, 25 bp, Homo sapien
gacgcagcctatcgtggtcaccgtg

SEQ ID NO: 16600 - DNA, 25 bp, Homo sapien
ggcggctagccacttgtatgcgtag

SEQ ID NO: 16601 - DNA, 25 bp, Homo sapien
agacgcggaccatgcgatcttgtgg

SEQ ID NO: 16602 - DNA, 25 bp, Homo sapien
tgctgggcctcacatgctaggtgct

SEQ ID NO: 16603 - DNA, 25 bp, Homo sapien
ggccactaaggggacacatttctgg

SEQ ID NO: 16604 - DNA, 25 bp, Homo sapien
gcaagggtccatctctgccgacaga

SEQ ID NO: 16605 - DNA, 25 bp, Homo sapien
ctggcagtggaaagaggatactctc

SEQ ID NO: 16606 - DNA, 25 bp, Homo sapien
cttctctttcgacctgcgcaccatg

SEQ ID NO: 16607 - DNA, 25 bp, Homo sapien
accgctactactgcgagtcgtgtgc

SEQ ID NO: 16608 - DNA, 25 bp, Homo sapien
agctgacagcagaaaaccgctacta

SEQ ID NO: 16609 - DNA, 25 bp, Homo sapien
tggacctggttaactacttcctgtc

SEQ ID NO: 16610 - DNA, 25 bp, Homo sapien
cgagtcgtgtgcctccctgcaggat

SEQ ID NO: 16611 - DNA, 25 bp, Homo sapien
gagccaagggccgtgctacctcatc

SEQ ID NO: 16612 - DNA, 25 bp, Homo sapien
tcctcacactgctgcgcttctcttt

SEQ ID NO: 16613 - DNA, 25 bp, Homo sapien
gctccgtcctggacctggttaacta

SEQ ID NO: 16614 - DNA, 25 bp, Homo sapien
catggtccggagatacacccagcta

SEQ ID NO: 16615 - DNA, 25 bp, Homo sapien
ggagatacacccagctaccaattcg

SEQ ID NO: 16616 - DNA, 25 bp, Homo sapien
atgcagaccgatggaagaggctagt

SEQ ID NO: 16617 - DNA, 25 bp, Homo sapien
caattcgggaccaggaccaacagga

SEQ ID NO: 16618 - DNA, 25 bp, Homo sapien
cccggcatgcagaccgatggaagag

SEQ ID NO: 16619 - DNA, 25 bp, Homo sapien
ctccctggacctcggacctgatgag

SEQ ID NO: 16620 - DNA, 25 bp, Homo sapien
gacctcggacctgatgaggccacga

SEQ ID NO: 16621 - DNA, 25 bp, Homo sapien
cagctaccaattcgggaccaggacc

SEQ ID NO: 16622 - DNA, 25 bp, Homo sapien
cagctagtgcgactcctgcaggcgc

SEQ ID NO: 16623 - DNA, 25 bp, Homo sapien
cgagaagcggcagctagtgcgactc

SEQ ID NO: 16624 - DNA, 25 bp, Homo sapien
tgcctctttctgagcggcatgaagc

SEQ ID NO: 16625 - DNA, 25 bp, Homo sapien
ttctgagcggcatgaagccacctcc

SEQ ID NO: 16626 - DNA, 25 bp, Homo sapien
atgaagccacctcccaggcggcgag

SEQ ID NO: 16627 - DNA, 25 bp, Homo sapien
ctatctgggcgaggtgaccggtccc

SEQ ID NO: 16628 - DNA, 25 bp, Homo sapien
gtagctccgcccatcggagaagcga

SEQ ID NO: 16629 - DNA, 25 bp, Homo sapien
gagaagcgaccttacagcgcctgcc

SEQ ID NO: 16630 - DNA, 25 bp, Homo sapien
aatgaactgggagtaagatgctgcc

SEQ ID NO: 16631 - DNA, 25 bp, Homo sapien
ctgggagtaagatgctgccgagtcc

SEQ ID NO: 16632 - DNA, 25 bp, Homo sapien
tgaactgggagtaagatgctgccga

SEQ ID NO: 16633 - DNA, 25 bp, Homo sapien
ctgccgagtccgggcgaaaagcaac

SEQ ID NO: 16634 - DNA, 25 bp, Homo sapien
gctaaacgggcggaatgaactggga

SEQ ID NO: 16635 - DNA, 25 bp, Homo sapien
gcgagggctaaacgggcggaatgaa

SEQ ID NO: 16636 - DNA, 25 bp, Homo sapien
agcctcggggtaatgcgtgggtgag

SEQ ID NO: 16637 - DNA, 25 bp, Homo sapien
actgggagtaagatgctgccgagtc

SEQ ID NO: 16638 - DNA, 25 bp, Homo sapien
cacacaacaggtgcgaaagcgcggc

SEQ ID NO: 16639 - DNA, 25 bp, Homo sapien
cgaaggcgaacaccgtgcgctgctc

SEQ ID NO: 16640 - DNA, 25 bp, Homo sapien
gcaccacgagcaggcagagcacgaa

SEQ ID NO: 16641 - DNA, 25 bp, Homo sapien
ggatgcgcacgcagcgcaccatcaa

SEQ ID NO: 16642 - DNA, 25 bp, Homo sapien
cgagcgcctccttgtggtcggtcca

SEQ ID NO: 16643 - DNA, 25 bp, Homo sapien
cgtagtcgaactgcccgcgctcgag

SEQ ID NO: 16644 - DNA, 25 bp, Homo sapien
tcacaccaacgcgtagtcgaactgc

SEQ ID NO: 16645 - DNA, 25 bp, Homo sapien
ctcccgcccgggattcagagtcggg

SEQ ID NO: 16646 - DNA, 25 bp, Homo sapien
ttgagctcgtcctggtctcggcaga

SEQ ID NO: 16647 - DNA, 25 bp, Homo sapien
agagcccgcagtcttgttcccagag

SEQ ID NO: 16648 - DNA, 25 bp, Homo sapien
ttcccagaggtctggagttgccgca

SEQ ID NO: 16649 - DNA, 25 bp, Homo sapien
gtgcctctgtgcctgatgacccagg

SEQ ID NO: 16650 - DNA, 25 bp, Homo sapien
tggctccggcaccacactcagagaa

SEQ ID NO: 16651 - DNA, 25 bp, Homo sapien
ctcagagaatctgctcggtgctgga

SEQ ID NO: 16652 - DNA, 25 bp, Homo sapien
agctggtcttgcagccgtcctggca

SEQ ID NO: 16653 - DNA, 25 bp, Homo sapien
ggcagagcgcccacacgtacagcat

SEQ ID NO: 16654 - DNA, 25 bp, Homo sapien
gggatgactcactcacccagcaagt

SEQ ID NO: 16655 - DNA, 25 bp, Homo sapien
cctgcgaggtccagggatgactcac

SEQ ID NO: 16656 - DNA, 25 bp, Homo sapien
cctccgacatctctgtcttggagaa

SEQ ID NO: 16657 - DNA, 25 bp, Homo sapien
aggatctccgtgagcacctccgaca

SEQ ID NO: 16658 - DNA, 25 bp, Homo sapien
gttctcgcactgtttcagaaaccgg

SEQ ID NO: 16659 - DNA, 25 bp, Homo sapien
tcagaaaccggtccttgtcaaaggc

SEQ ID NO: 16660 - DNA, 25 bp, Homo sapien
caagtcggtgaccttgtccgtaagg

SEQ ID NO: 16661 - DNA, 25 bp, Homo sapien
atgcccggatgaacgcgttgtcgct

SEQ ID NO: 16662 - DNA, 25 bp, Homo sapien
gtcccaggacgctgtcgtcaatttc

SEQ ID NO: 16663 - DNA, 25 bp, Homo sapien
cgtgaaggctctactgagacagaca

SEQ ID NO: 16664 - DNA, 25 bp, Homo sapien
gattttccggccgagatcactttta

SEQ ID NO: 16665 - DNA, 25 bp, Homo sapien
gccctccttgattttccggccgaga

SEQ ID NO: 16666 - DNA, 25 bp, Homo sapien
tttggataccgactcggccgactgc

SEQ ID NO: 16667 - DNA, 25 bp, Homo sapien
ggctgcatgccctagcccaggactg

SEQ ID NO: 16668 - DNA, 25 bp, Homo sapien
tctgtgctcctgtggtacgcggcac

SEQ ID NO: 16669 - DNA, 25 bp, Homo sapien
cgtcaatttccttcttcacggactc

SEQ ID NO: 16670 - DNA, 25 bp, Homo sapien
cagatctgtgattgggcgcgactac

SEQ ID NO: 16671 - DNA, 25 bp, Homo sapien
cttggcatttaaccgcgagctgtga

SEQ ID NO: 16672 - DNA, 25 bp, Homo sapien
cggctaccattctctctcctgtata

SEQ ID NO: 16673 - DNA, 25 bp, Homo sapien
ccgccatgttggagaatcgtgtgac

SEQ ID NO: 16674 - DNA, 25 bp, Homo sapien
gagccctccgattgggtccgtcata

SEQ ID NO: 16675 - DNA, 25 bp, Homo sapien
cacttgcggtgattcggctacagaa

SEQ ID NO: 16676 - DNA, 25 bp, Homo sapien
ctctcggtagagaacttggcattta

SEQ ID NO: 16677 - DNA, 25 bp, Homo sapien
ccgaccacaaggacggattcgattg

SEQ ID NO: 16678 - DNA, 25 bp, Homo sapien
ccgctcatgtgatcgacgcccatgg

SEQ ID NO: 16679 - DNA, 25 bp, Homo sapien
tgacgccagagagcccgctcatgtg

SEQ ID NO: 16680 - DNA, 25 bp, Homo sapien
cgtttcctggcacgttgacgccaga

SEQ ID NO: 16681 - DNA, 25 bp, Homo sapien
tgaaaatgcaccagccggaggaggc

SEQ ID NO: 16682 - DNA, 25 bp, Homo sapien
aggcctggacgcatgctgaccatgg

SEQ ID NO: 16683 - DNA, 25 bp, Homo sapien
tggtgacggcaccaaacggcccaaa

SEQ ID NO: 16684 - DNA, 25 bp, Homo sapien
cctggcagacagagagcaagcgtca

SEQ ID NO: 16685 - DNA, 25 bp, Homo sapien
cgcggatcactttcacattggtgac

SEQ ID NO: 16686 - DNA, 25 bp, Homo sapien
tctacgaggacgagaccaaaggtac

SEQ ID NO: 16687 - DNA, 25 bp, Homo sapien
ctctgggcatcaaagtctacgagga

SEQ ID NO: 16688 - DNA, 25 bp, Homo sapien
cgtcgagaaggtgcccaggcatccc

SEQ ID NO: 16689 - DNA, 25 bp, Homo sapien
cgtgactctcgtgccagccatgtac

SEQ ID NO: 16690 - DNA, 25 bp, Homo sapien
ccagccatgtactcggttgagatca

SEQ ID NO: 16691 - DNA, 25 bp, Homo sapien
cccgattcgatgtgaagcagatgac

SEQ ID NO: 16692 - DNA, 25 bp, Homo sapien
gagaccagggtgctgtccagcacca

SEQ ID NO: 16693 - DNA, 25 bp, Homo sapien
acgtgtgctcccagcgtgtgggtct

SEQ ID NO: 16694 - DNA, 25 bp, Homo sapien
cctgctccgagatgtccggctctgg

SEQ ID NO: 16695 - DNA, 25 bp, Homo sapien
tctggaacgtgagcataccctgacc

SEQ ID NO: 16696 - DNA, 25 bp, Homo sapien
ccaggcacttgcaccaacgacagga

SEQ ID NO: 16697 - DNA, 25 bp, Homo sapien
aacgtgagcataccctgaccagcca

SEQ ID NO: 16698 - DNA, 25 bp, Homo sapien
tgccaccggcctcacccgacgccca

SEQ ID NO: 16699 - DNA, 25 bp, Homo sapien
acggtggtcgcttcctgctccgaga

SEQ ID NO: 16700 - DNA, 25 bp, Homo sapien
cttgcaccaacgacaggaaggatga

SEQ ID NO: 16701 - DNA, 25 bp, Homo sapien
tccggctctggaacgtgagcatacc

SEQ ID NO: 16702 - DNA, 25 bp, Homo sapien
ggcagtgagccgtagcggagaggct

SEQ ID NO: 16703 - DNA, 25 bp, Homo sapien
tgagccgtagcggagaggctggccc

SEQ ID NO: 16704 - DNA, 25 bp, Homo sapien
cgccgcttccccacgctcgcagcca

SEQ ID NO: 16705 - DNA, 25 bp, Homo sapien
cccacccagagcaagaggcggagga

SEQ ID NO: 16706 - DNA, 25 bp, Homo sapien
cactggccgcagcaacgggacgggt

SEQ ID NO: 16707 - DNA, 25 bp, Homo sapien
caacgggacgggtgagagcacctgc

SEQ ID NO: 16708 - DNA, 25 bp, Homo sapien
gacgggtgagagcacctgcccccga

SEQ ID NO: 16709 - DNA, 25 bp, Homo sapien
tgcccccgacgcgtcttaactgctc

SEQ ID NO: 16710 - DNA, 25 bp, Homo sapien
ctgggtgtagcccacgttacactcg

SEQ ID NO: 16711 - DNA, 25 bp, Homo sapien
agcccacgttacactcgcagcggta

SEQ ID NO: 16712 - DNA, 25 bp, Homo sapien
ggctgctggtgcattcgtctacatc

SEQ ID NO: 16713 - DNA, 25 bp, Homo sapien
gcattcgtctacatctgaggggaga

SEQ ID NO: 16714 - DNA, 25 bp, Homo sapien
ggaccctgagccctagcacgagcag

SEQ ID NO: 16715 - DNA, 25 bp, Homo sapien
actcgccgcgcacgtcctgggtgta

SEQ ID NO: 16716 - DNA, 25 bp, Homo sapien
ccggggatgttgacgcagtcaccgt

SEQ ID NO: 16717 - DNA, 25 bp, Homo sapien
agccctagcacgagcagggcagtga

SEQ ID NO: 16718 - DNA, 25 bp, Homo sapien
ccgagtgaaaaactccgatggactg

SEQ ID NO: 16719 - DNA, 25 bp, Homo sapien
tgcacctcttagctcccggggcggg

SEQ ID NO: 16720 - DNA, 25 bp, Homo sapien
gaacgcaaagccgagaggccgaccc

SEQ ID NO: 16721 - DNA, 25 bp, Homo sapien
aaactccgatggactggagggatgt

SEQ ID NO: 16722 - DNA, 25 bp, Homo sapien
gagggcgcgtttgcacctcttagct

SEQ ID NO: 16723 - DNA, 25 bp, Homo sapien
tttgcacctcttagctcccggggcg

SEQ ID NO: 16724 - DNA, 25 bp, Homo sapien
gggctccgagtgaaaaactccgatg

SEQ ID NO: 16725 - DNA, 25 bp, Homo sapien
gcgtttgcacctcttagctcccggg

SEQ ID NO: 16726 - DNA, 25 bp, Homo sapien
tggacagatgagcagagccagagca

SEQ ID NO: 16727 - DNA, 25 bp, Homo sapien
ccctgtgcaccatccaactgcgcgc

SEQ ID NO: 16728 - DNA, 25 bp, Homo sapien
ctcggggtacccagggtggccgctg

SEQ ID NO: 16729 - DNA, 25 bp, Homo sapien
cctggactggccctccaacagggcc

SEQ ID NO: 16730 - DNA, 25 bp, Homo sapien
ctcaccgcctcggttggcccccgcg

SEQ ID NO: 16731 - DNA, 25 bp, Homo sapien
ggtacccagggtggccgctgaggcc

SEQ ID NO: 16732 - DNA, 25 bp, Homo sapien
cgcagcctttgcccggtgccctcac

SEQ ID NO: 16733 - DNA, 25 bp, Homo sapien
ctgtgcaccatccaactgcgcgccc

SEQ ID NO: 16734 - DNA, 25 bp, Homo sapien
agccagagcatctcgggcagaagag

SEQ ID NO: 16735 - DNA, 25 bp, Homo sapien
agactagaaacgctaggctggaccc

SEQ ID NO: 16736 - DNA, 25 bp, Homo sapien
acagacagcgaacaggggtgaagcc

SEQ ID NO: 16737 - DNA, 25 bp, Homo sapien
aaacgctaggctggacccgggccag

SEQ ID NO: 16738 - DNA, 25 bp, Homo sapien
cgcgcagcggacaatactgggttca

SEQ ID NO: 16739 - DNA, 25 bp, Homo sapien
agcggacaatactgggttcaaaggg

SEQ ID NO: 16740 - DNA, 25 bp, Homo sapien
agagataaggcgcagactagaaacg

SEQ ID NO: 16741 - DNA, 25 bp, Homo sapien
gcagagccagagcatctcgggcaga

SEQ ID NO: 16742 - DNA, 25 bp, Homo sapien
tgcccaggcggggataatgtcattt

SEQ ID NO: 16743 - DNA, 25 bp, Homo sapien
agccagcgagggctttttaggccca

SEQ ID NO: 16744 - DNA, 25 bp, Homo sapien
cggccgcgtagacggcttctgagaa

SEQ ID NO: 16745 - DNA, 25 bp, Homo sapien
ttctgagaaccgcttaaacacgtca

SEQ ID NO: 16746 - DNA, 25 bp, Homo sapien
aagcccgagctaacccatcaggcgg

SEQ ID NO: 16747 - DNA, 25 bp, Homo sapien
gataatgtcatttggcctggttgga

SEQ ID NO: 16748 - DNA, 25 bp, Homo sapien
atttggcctggttggaccagccagc

SEQ ID NO: 16749 - DNA, 25 bp, Homo sapien
aacacgtcattccaagcccgagcta

SEQ ID NO: 16750 - DNA, 25 bp, Homo sapien
tcccacaagcgatgaagtccaagtc

SEQ ID NO: 16751 - DNA, 25 bp, Homo sapien
agcctgctaagagctttcctgacca

SEQ ID NO: 16752 - DNA, 25 bp, Homo sapien
tgcagggccggagcaaaaccgttaa

SEQ ID NO: 16753 - DNA, 25 bp, Homo sapien
tcatgaactgacgtgcggtgcagcc

SEQ ID NO: 16754 - DNA, 25 bp, Homo sapien
tcctgaccacgctggtatgaagggc

SEQ ID NO: 16755 - DNA, 25 bp, Homo sapien
cggtcggacaatctgagcctgctaa

SEQ ID NO: 16756 - DNA, 25 bp, Homo sapien
cctgcgtgattagcggtcggacaat

SEQ ID NO: 16757 - DNA, 25 bp, Homo sapien
atggggtcttcctagcaccagtgcg

SEQ ID NO: 16758 - DNA, 25 bp, Homo sapien
gccatcttccgtccgcgatactgaa

SEQ ID NO: 16759 - DNA, 25 bp, Homo sapien
gttccctttaacgatctgtattctg

SEQ ID NO: 16760 - DNA, 25 bp, Homo sapien
ggagccgattctcatttcatcacgg

SEQ ID NO: 16761 - DNA, 25 bp, Homo sapien
tgatgtgacctctaccctgccctaa

SEQ ID NO: 16762 - DNA, 25 bp, Homo sapien
gccggcgacctaaaccctgatgtga

SEQ ID NO: 16763 - DNA, 25 bp, Homo sapien
gccgggtctgaacccagcttctttc

SEQ ID NO: 16764 - DNA, 25 bp, Homo sapien
atcacggggttctgatggttccctt

SEQ ID NO: 16765 - DNA, 25 bp, Homo sapien
gggcggtgctagaacgtcctataaa

SEQ ID NO: 16766 - DNA, 25 bp, Homo sapien
tgtctccgtccatggatccgggcga

SEQ ID NO: 16767 - DNA, 25 bp, Homo sapien
tgtgccgtctctcttcttcatgatg

SEQ ID NO: 16768 - DNA, 25 bp, Homo sapien
tctcctgagtcaaggagggcgcctc

SEQ ID NO: 16769 - DNA, 25 bp, Homo sapien
tgtggccgttcccatttaacgatga

SEQ ID NO: 16770 - DNA, 25 bp, Homo sapien
ccttttcggcacagctccacggggt

SEQ ID NO: 16771 - DNA, 25 bp, Homo sapien
aaaggcgctcactctccgttgagga

SEQ ID NO: 16772 - DNA, 25 bp, Homo sapien
gcccagaccacgctgccagtagagg

SEQ ID NO: 16773 - DNA, 25 bp, Homo sapien
ccaacaaactgcaggctcttgggtc

SEQ ID NO: 16774 - DNA, 25 bp, Homo sapien
ttatcaaggccttcgccctaactga

SEQ ID NO: 16775 - DNA, 25 bp, Homo sapien
gggcggttccatccgctacccattg

SEQ ID NO: 16776 - DNA, 25 bp, Homo sapien
aaaacaccatttccgtgacacgctc

SEQ ID NO: 16777 - DNA, 25 bp, Homo sapien
cacctgggacttccaatgtgggagg

SEQ ID NO: 16778 - DNA, 25 bp, Homo sapien
aagtccggggactgattatcaaggc

SEQ ID NO: 16779 - DNA, 25 bp, Homo sapien
gaggctctccaagccgcccagtggg

SEQ ID NO: 16780 - DNA, 25 bp, Homo sapien
ctacccattgtctgcgggtccgggg

SEQ ID NO: 16781 - DNA, 25 bp, Homo sapien
cccgcaagctggcaatttacctgaa

SEQ ID NO: 16782 - DNA, 25 bp, Homo sapien
tgcgtcctgggacgagatgaatgtc

SEQ ID NO: 16783 - DNA, 25 bp, Homo sapien
tgagcggatcctcacacgactgtga

SEQ ID NO: 16784 - DNA, 25 bp, Homo sapien
atccgattctttccagcggcttctg

SEQ ID NO: 16785 - DNA, 25 bp, Homo sapien
ggcttctgcaaccaagcgggtctta

SEQ ID NO: 16786 - DNA, 25 bp, Homo sapien
cgctcccaggctacctaagaggatg

SEQ ID NO: 16787 - DNA, 25 bp, Homo sapien
cgtgcagtccaagtcgccgcgcttt

SEQ ID NO: 16788 - DNA, 25 bp, Homo sapien
gatgaatgtcctggcgcacggactc

SEQ ID NO: 16789 - DNA, 25 bp, Homo sapien
tacctaagaggatgagcggtgctcc

SEQ ID NO: 16790 - DNA, 25 bp, Homo sapien
gacccgcgaggatacagaaagccac

SEQ ID NO: 16791 - DNA, 25 bp, Homo sapien
agagtcaactctctcggtctccaga

SEQ ID NO: 16792 - DNA, 25 bp, Homo sapien
tctcggtctccagaagccatcaata

SEQ ID NO: 16793 - DNA, 25 bp, Homo sapien
agttcacgagcagaccggcttggga

SEQ ID NO: 16794 - DNA, 25 bp, Homo sapien
ctcggcggcccacctgtgacaggtg

SEQ ID NO: 16795 - DNA, 25 bp, Homo sapien
atagcgcctcaacttcttctcggga

SEQ ID NO: 16796 - DNA, 25 bp, Homo sapien
tcaacttcttctcgggaggcgattt

SEQ ID NO: 16797 - DNA, 25 bp, Homo sapien
cgacactgtatttagttcacgagca

SEQ ID NO: 16798 - DNA, 25 bp, Homo sapien
ccaggacttggcgtgttgttacatg

SEQ ID NO: 16799 - DNA, 25 bp, Homo sapien
cgaaccagagccgtgcacttgtgcc

SEQ ID NO: 16800 - DNA, 25 bp, Homo sapien
ctcctccgaggtggacgaactcatc

SEQ ID NO: 16801 - DNA, 25 bp, Homo sapien
gagagacaggacagacccgcttttc

SEQ ID NO: 16802 - DNA, 25 bp, Homo sapien
gcaccgttgtaaatgctgctccatc

SEQ ID NO: 16803 - DNA, 25 bp, Homo sapien
cccaggacctcgacatgaagaagca

SEQ ID NO: 16804 - DNA, 25 bp, Homo sapien
aggccgcctccagggaagagaatca

SEQ ID NO: 16805 - DNA, 25 bp, Homo sapien
ggtgctgggccttcaagataccatc

SEQ ID NO: 16806 - DNA, 25 bp, Homo sapien
gcgcgcgctgacctatgacgtcatc

SEQ ID NO: 16807 - DNA, 25 bp, Homo sapien
cactcgccgctgataggccattcaa

SEQ ID NO: 16808 - DNA, 25 bp, Homo sapien
tggcgcgtccgtcacttcaaaaagg

SEQ ID NO: 16809 - DNA, 25 bp, Homo sapien
tagtcgggtaggttctcaatcaagc

SEQ ID NO: 16810 - DNA, 25 bp, Homo sapien
ttcccggacaggtcctctgatagtc

SEQ ID NO: 16811 - DNA, 25 bp, Homo sapien
agcatcgtagcattacctggacgta

SEQ ID NO: 16812 - DNA, 25 bp, Homo sapien
cgtcatcgggacgttaagcatcgta

SEQ ID NO: 16813 - DNA, 25 bp, Homo sapien
gctctcacgaggcttgtcctgattg

SEQ ID NO: 16814 - DNA, 25 bp, Homo sapien
catcaaggcgcagatctgggacacc

SEQ ID NO: 16815 - DNA, 25 bp, Homo sapien
tggggattcacagaacctcgccttc

SEQ ID NO: 16816 - DNA, 25 bp, Homo sapien
ttcccgcccagtggtgctcatcggg

SEQ ID NO: 16817 - DNA, 25 bp, Homo sapien
aagagcaacctgctgtcgcgcttca

SEQ ID NO: 16818 - DNA, 25 bp, Homo sapien
ttcacccgcaacgagttcaacctgg

SEQ ID NO: 16819 - DNA, 25 bp, Homo sapien
gttcaacctggagagcaagagcacc

SEQ ID NO: 16820 - DNA, 25 bp, Homo sapien
caagagcaccatcggcgtggagttc

SEQ ID NO: 16821 - DNA, 25 bp, Homo sapien
cagcatccaggtggacggcaagacc

SEQ ID NO: 16822 - DNA, 25 bp, Homo sapien
gcgggaccacgcagacagcaacatc

SEQ ID NO: 16823 - DNA, 25 bp, Homo sapien
caacaagagtgacctgcgccacctg

SEQ ID NO: 16824 - DNA, 25 bp, Homo sapien
cgcagacagcaacatcgtcatcatg

SEQ ID NO: 16825 - DNA, 25 bp, Homo sapien
ccttcgcaggtgagcagacggagac

SEQ ID NO: 16826 - DNA, 25 bp, Homo sapien
ctgacctatgagaacgtggagcgct

SEQ ID NO: 16827 - DNA, 25 bp, Homo sapien
gacatcgccaagcacctgacctatg

SEQ ID NO: 16828 - DNA, 25 bp, Homo sapien
ccctgctggtgtacgacatcgccaa

SEQ ID NO: 16829 - DNA, 25 bp, Homo sapien
tcgtcatcatgctggtgggcaacaa

SEQ ID NO: 16830 - DNA, 25 bp, Homo sapien
ttttccttggccgactctagggagc

SEQ ID NO: 16831 - DNA, 25 bp, Homo sapien
gtttgctgcacccatgaaactcggg

SEQ ID NO: 16832 - DNA, 25 bp, Homo sapien
tgcagtgctgccagaacctgtgacc

SEQ ID NO: 16833 - DNA, 25 bp, Homo sapien
agaagcccaacaagctgcagtgctg

SEQ ID NO: 16834 - DNA, 25 bp, Homo sapien
accacggacggacagaagcccaaca

SEQ ID NO: 16835 - DNA, 25 bp, Homo sapien
acaacgtggtggacatcagcgtgcc

SEQ ID NO: 16836 - DNA, 25 bp, Homo sapien
tcacagaaacagatcgcagaccgcg

SEQ ID NO: 16837 - DNA, 25 bp, Homo sapien
cagaaccgtgctctgggccaaagcc

SEQ ID NO: 16838 - DNA, 25 bp, Homo sapien
gtcgctattggtccgcggcgctgtc

SEQ ID NO: 16839 - DNA, 25 bp, Homo sapien
tgcccggacgcaggtgccggccgga

SEQ ID NO: 16840 - DNA, 25 bp, Homo sapien
ctgtgcggcccaagtcgtccctgtg

SEQ ID NO: 16841 - DNA, 25 bp, Homo sapien
gtgcggcccaagtcgtccctgtggc

SEQ ID NO: 16842 - DNA, 25 bp, Homo sapien
ccaagtcgtccctgtggcctccggc

SEQ ID NO: 16843 - DNA, 25 bp, Homo sapien
ccgcctcttagggcgggacgtgcaa

SEQ ID NO: 16844 - DNA, 25 bp, Homo sapien
acgtgcaaggcgattggcgaatgca

SEQ ID NO: 16845 - DNA, 25 bp, Homo sapien
cgattggcgaatgcaggcgagaggc

SEQ ID NO: 16846 - DNA, 25 bp, Homo sapien
gtgcagcacgcgtctcgagctctgc

SEQ ID NO: 16847 - DNA, 25 bp, Homo sapien
cactgtgctgcgacatggtgtgttt

SEQ ID NO: 16848 - DNA, 25 bp, Homo sapien
cgacatggtgtgtttcctgttcatc

SEQ ID NO: 16849 - DNA, 25 bp, Homo sapien
tgtttcctgttcatcacaccgctgg

SEQ ID NO: 16850 - DNA, 25 bp, Homo sapien
cgctggccgccatctcaggctggtt

SEQ ID NO: 16851 - DNA, 25 bp, Homo sapien
atctcaggctggttgtgcctgcgcg

SEQ ID NO: 16852 - DNA, 25 bp, Homo sapien
gtgggtctcattgccctcaccatcg

SEQ ID NO: 16853 - DNA, 25 bp, Homo sapien
ttcaccatctatgtcctctggacgc

SEQ ID NO: 16854 - DNA, 25 bp, Homo sapien
ttcccgtaccgcctgctcagggtag

SEQ ID NO: 16855 - DNA, 25 bp, Homo sapien
aagcgatcaacagctgccggtctgc

SEQ ID NO: 16856 - DNA, 25 bp, Homo sapien
tcaacggtaaccgagcgagggaagc

SEQ ID NO: 16857 - DNA, 25 bp, Homo sapien
gtctgttttctgatccgtaacgtgg

SEQ ID NO: 16858 - DNA, 25 bp, Homo sapien
gggtgagtatcccacggtcctttgc

SEQ ID NO: 16859 - DNA, 25 bp, Homo sapien
acaaagcccagacgcggagaaaatg

SEQ ID NO: 16860 - DNA, 25 bp, Homo sapien
gtgcagcccgttcgctcacacaaag

SEQ ID NO: 16861 - DNA, 25 bp, Homo sapien
cgcagtcagcccgagtcaacggtaa

SEQ ID NO: 16862 - DNA, 25 bp, Homo sapien
cctccagcattgagcgcatgggcca

SEQ ID NO: 16863 - DNA, 25 bp, Homo sapien
gcgtggcaacttcggaggaagcttc

SEQ ID NO: 16864 - DNA, 25 bp, Homo sapien
ccatcgaccgtgtgggccagaccat

SEQ ID NO: 16865 - DNA, 25 bp, Homo sapien
ccatcgagcgcatgggcctgagcat

SEQ ID NO: 16866 - DNA, 25 bp, Homo sapien
atgggcgccaacaatctggagcgga

SEQ ID NO: 16867 - DNA, 25 bp, Homo sapien
atgggcgccaacagcctcgagcgca

SEQ ID NO: 16868 - DNA, 25 bp, Homo sapien
tgccagctttgaccgtgccatcgag

SEQ ID NO: 16869 - DNA, 25 bp, Homo sapien
ccatcgagatggagcgtggcaactt

SEQ ID NO: 16870 - DNA, 25 bp, Homo sapien
tggttggttttccaggggatctgcc

SEQ ID NO: 16871 - DNA, 25 bp, Homo sapien
tgccgaggaagcgtgacttccatgg

SEQ ID NO: 16872 - DNA, 25 bp, Homo sapien
ccgcagaagtcgacatcatcgtaca

SEQ ID NO: 16873 - DNA, 25 bp, Homo sapien
tccacgtaccgcagaagtcgacatc

SEQ ID NO: 16874 - DNA, 25 bp, Homo sapien
agtgtccacgtaccgcagaagtcga

SEQ ID NO: 16875 - DNA, 25 bp, Homo sapien
tcccagagtgtccacgtaccgcaga

SEQ ID NO: 16876 - DNA, 25 bp, Homo sapien
gaggaagcgtgacttccatggaccc

SEQ ID NO: 16877 - DNA, 25 bp, Homo sapien
aagtcgacatcatcgtacacctccg

SEQ ID NO: 16878 - DNA, 25 bp, Homo sapien
catgcgtacttgtgacccaggctta

SEQ ID NO: 16879 - DNA, 25 bp, Homo sapien
agaagcgcacggaccgcagcaggca

SEQ ID NO: 16880 - DNA, 25 bp, Homo sapien
gtcccgcacgctcagtttggctgaa

SEQ ID NO: 16881 - DNA, 25 bp, Homo sapien
atggacaggacactaggcaaacgcc

SEQ ID NO: 16882 - DNA, 25 bp, Homo sapien
agaaaccacgtgcagttggcagctg

SEQ ID NO: 16883 - DNA, 25 bp, Homo sapien
cgcgacaattgtaaacctacgaaca

SEQ ID NO: 16884 - DNA, 25 bp, Homo sapien
cgcttacgtcatcacgctacgggga

SEQ ID NO: 16885 - DNA, 25 bp, Homo sapien
gcagctctgctctaaggcactccag

SEQ ID NO: 16886 - DNA, 25 bp, Homo sapien
gccgggcgcactcacatttgccttt

SEQ ID NO: 16887 - DNA, 25 bp, Homo sapien
gggtcgatcatcatcttcgtgtgaa

SEQ ID NO: 16888 - DNA, 25 bp, Homo sapien
tagcgttggggtcgatcatcatctt

SEQ ID NO: 16889 - DNA, 25 bp, Homo sapien
acgtgtcttagcgttggggtcgatc

SEQ ID NO: 16890 - DNA, 25 bp, Homo sapien
cattgctggtgaactcgatcacctc

SEQ ID NO: 16891 - DNA, 25 bp, Homo sapien
cggcacagcatctcctcattgctgg

SEQ ID NO: 16892 - DNA, 25 bp, Homo sapien
atcttcgtgtgaaccacgatctccc

SEQ ID NO: 16893 - DNA, 25 bp, Homo sapien
actcacatttgcctttggggtcccg

SEQ ID NO: 16894 - DNA, 25 bp, Homo sapien
cctctacgtgcagcgggacatagta

SEQ ID NO: 16895 - DNA, 25 bp, Homo sapien
tccggagagccctcagctcagattc

SEQ ID NO: 16896 - DNA, 25 bp, Homo sapien
tcagccttcggagcattcggcaagc

SEQ ID NO: 16897 - DNA, 25 bp, Homo sapien
tgcgacttcaccaaaggccacgatg

SEQ ID NO: 16898 - DNA, 25 bp, Homo sapien
ccctgagcacaaagcaagaggcatc

SEQ ID NO: 16899 - DNA, 25 bp, Homo sapien
atgcccgcaagccaacaggggtgtc

SEQ ID NO: 16900 - DNA, 25 bp, Homo sapien
gctgctgaccaagctgagcctgatc

SEQ ID NO: 16901 - DNA, 25 bp, Homo sapien
tgatgcctaccagccgtacctgagc

SEQ ID NO: 16902 - DNA, 25 bp, Homo sapien
ggcctcttgggaagcacgctgactt

SEQ ID NO: 16903 - DNA, 25 bp, Homo sapien
cggaggcttcttgggaaagtcactc

SEQ ID NO: 16904 - DNA, 25 bp, Homo sapien
agtctgagcggcctcgctgaactca

SEQ ID NO: 16905 - DNA, 25 bp, Homo sapien
cacggacttcttagggaggccaccg

SEQ ID NO: 16906 - DNA, 25 bp, Homo sapien
gtacacgttgaactcaggctgcgca

SEQ ID NO: 16907 - DNA, 25 bp, Homo sapien
tcgagggagatcaccgaagaactca

SEQ ID NO: 16908 - DNA, 25 bp, Homo sapien
cttggagagcgctttgaattcggcc

SEQ ID NO: 16909 - DNA, 25 bp, Homo sapien
cgcaggcttcttgggaaaggtactc

SEQ ID NO: 16910 - DNA, 25 bp, Homo sapien
tcggaaacgcgaacaacggtgtgca

SEQ ID NO: 16911 - DNA, 25 bp, Homo sapien
gcactctcgcagctaggagggtcca

SEQ ID NO: 16912 - DNA, 25 bp, Homo sapien
ctcctggcccgcaatgagggtaacc

SEQ ID NO: 16913 - DNA, 25 bp, Homo sapien
aaccggaccggcacctgcaagtgac

SEQ ID NO: 16914 - DNA, 25 bp, Homo sapien
ccggcctcagagctgttcagcgcga

SEQ ID NO: 16915 - DNA, 25 bp, Homo sapien
cccgagtctgagattcctgggcgcc

SEQ ID NO: 16916 - DNA, 25 bp, Homo sapien
cctttgtgtatttggcgcctccgta

SEQ ID NO: 16917 - DNA, 25 bp, Homo sapien
gagctgtagtcatggtgcgcctccc

SEQ ID NO: 16918 - DNA, 25 bp, Homo sapien
cccagaagacccgtgcgccaaggat

SEQ ID NO: 16919 - DNA, 25 bp, Homo sapien
ccgcgcaaacatgcaggtgcttgaa

SEQ ID NO: 16920 - DNA, 25 bp, Homo sapien
gtcaagttcagagtcagggcgagcc

SEQ ID NO: 16921 - DNA, 25 bp, Homo sapien
cctgtatttcgggacggtggcattt

SEQ ID NO: 16922 - DNA, 25 bp, Homo sapien
ggcgcaggtgccagtcatttttaag

SEQ ID NO: 16923 - DNA, 25 bp, Homo sapien
gcccgctccgaggtgaacggtgaaa

SEQ ID NO: 16924 - DNA, 25 bp, Homo sapien
tgtgtgctcccacacgatgcggctc

SEQ ID NO: 16925 - DNA, 25 bp, Homo sapien
cctagttcagtttctcccgggtctg

SEQ ID NO: 16926 - DNA, 25 bp, Homo sapien
ggcgctctccgagtgacagccagcg

SEQ ID NO: 16927 - DNA, 25 bp, Homo sapien
acacggctcggcctcttgtttctgc

SEQ ID NO: 16928 - DNA, 25 bp, Homo sapien
cggacgctggtgcaatcttgctatc

SEQ ID NO: 16929 - DNA, 25 bp, Homo sapien
gcagtcagcgcgcacttcagcagac

SEQ ID NO: 16930 - DNA, 25 bp, Homo sapien
cacttcagcagactccgtgcacgga

SEQ ID NO: 16931 - DNA, 25 bp, Homo sapien
gtgcacggagatccgggatgacctc

SEQ ID NO: 16932 - DNA, 25 bp, Homo sapien
gcctcgagcagtgtggacaatcttg

SEQ ID NO: 16933 - DNA, 25 bp, Homo sapien
gttcgcgctcacgtcagcgccattt

SEQ ID NO: 16934 - DNA, 25 bp, Homo sapien
cctagttccgcgcagactcactgga

SEQ ID NO: 16935 - DNA, 25 bp, Homo sapien
ttgagcactgccaagtcgccgaagc

SEQ ID NO: 16936 - DNA, 25 bp, Homo sapien
cttcacccgaaactgtagtctatgg

SEQ ID NO: 16937 - DNA, 25 bp, Homo sapien
gcttgcacagaaggctgacaaactc

SEQ ID NO: 16938 - DNA, 25 bp, Homo sapien
tcggtcttgaagacgctctccagga

SEQ ID NO: 16939 - DNA, 25 bp, Homo sapien
ctctccaggaagctgtcggcggcat

SEQ ID NO: 16940 - DNA, 25 bp, Homo sapien
tgaagaagtcgtcctgtcgcgtgct

SEQ ID NO: 16941 - DNA, 25 bp, Homo sapien
actcactggagctcttgggcagccc

SEQ ID NO: 16942 - DNA, 25 bp, Homo sapien
tcgtacttggtgaccgaatcggcga

SEQ ID NO: 16943 - DNA, 25 bp, Homo sapien
caggccttctggatggttcgggcaa

SEQ ID NO: 16944 - DNA, 25 bp, Homo sapien
ctcgtacttccggacagccacgtgg

SEQ ID NO: 16945 - DNA, 25 bp, Homo sapien
gagctcctgatacagctcctccagg

SEQ ID NO: 16946 - DNA, 25 bp, Homo sapien
ccgctccttcttgttcagcaggatg

SEQ ID NO: 16947 - DNA, 25 bp, Homo sapien
gttccgattgatgctgttgcgcctc

SEQ ID NO: 16948 - DNA, 25 bp, Homo sapien
ttcgggcaaagccatcgaactttcg

SEQ ID NO: 16949 - DNA, 25 bp, Homo sapien
tcttgcccaggaactgacgcagctc

SEQ ID NO: 16950 - DNA, 25 bp, Homo sapien
ctctgcaggaatttggcgaactggc

SEQ ID NO: 16951 - DNA, 25 bp, Homo sapien
ggctccatgttgaccgcccgaagca

SEQ ID NO: 16952 - DNA, 25 bp, Homo sapien
tgaccgcccgaagcaggtgctggac

SEQ ID NO: 16953 - DNA, 25 bp, Homo sapien
gtgctggacgccctggcgttcgtcc

SEQ ID NO: 16954 - DNA, 25 bp, Homo sapien
cacgtctcgggggtcagaatggcat

SEQ ID NO: 16955 - DNA, 25 bp, Homo sapien
tcagaatggcatacctgagggcgga

SEQ ID NO: 16956 - DNA, 25 bp, Homo sapien
tgggagtgctcatagcagacaggcc

SEQ ID NO: 16957 - DNA, 25 bp, Homo sapien
ctcacctctgcaggaatttggcgaa

SEQ ID NO: 16958 - DNA, 25 bp, Homo sapien
cagtggaagcgctccttgctgccct

SEQ ID NO: 16959 - DNA, 25 bp, Homo sapien
acgttgtggctctgccagtggaagc

SEQ ID NO: 16960 - DNA, 25 bp, Homo sapien
acgccgctctgcttcacgttgtggc

SEQ ID NO: 16961 - DNA, 25 bp, Homo sapien
gaagaagcaccatgtcatccacgcc

SEQ ID NO: 16962 - DNA, 25 bp, Homo sapien
cttcggtgatctggggaagaagcac

SEQ ID NO: 16963 - DNA, 25 bp, Homo sapien
gcggcaatggcgtcttcggtgatct

SEQ ID NO: 16964 - DNA, 25 bp, Homo sapien
ccatgaagcgcttccggaggttggc

SEQ ID NO: 16965 - DNA, 25 bp, Homo sapien
cgaagatgtagtcgtccatgaagcg

SEQ ID NO: 16966 - DNA, 25 bp, Homo sapien
cctgtgctcagcacctgctgcttct

SEQ ID NO: 16967 - DNA, 25 bp, Homo sapien
cctcatccaacgttgtcccgtagcg

SEQ ID NO: 16968 - DNA, 25 bp, Homo sapien
gtgccttctcctcatccaacgttgt

SEQ ID NO: 16969 - DNA, 25 bp, Homo sapien
ctccaggacccgtgccttctcctca

SEQ ID NO: 16970 - DNA, 25 bp, Homo sapien
cgtagccttgcacccgccctgtgct

SEQ ID NO: 16971 - DNA, 25 bp, Homo sapien
aaaagccgtcgtagccttgcacccg

SEQ ID NO: 16972 - DNA, 25 bp, Homo sapien
cacgaaaaagccgtcgtagccttgc

SEQ ID NO: 16973 - DNA, 25 bp, Homo sapien
cgacagagatcacgaaaaagccgtc

SEQ ID NO: 16974 - DNA, 25 bp, Homo sapien
agacgcggcgctggcacacgaccga

SEQ ID NO: 16975 - DNA, 25 bp, Homo sapien
ggcatgcgctgtcgtccagcgcctt

SEQ ID NO: 16976 - DNA, 25 bp, Homo sapien
ggctgtcgcacttggcctcacactg

SEQ ID NO: 16977 - DNA, 25 bp, Homo sapien
cgccgcactgtgcagagcactgcga

SEQ ID NO: 16978 - DNA, 25 bp, Homo sapien
ggtggtctgcgctcttgcaaaggac

SEQ ID NO: 16979 - DNA, 25 bp, Homo sapien
ctcttgcaaaggaccacgcggtggc

SEQ ID NO: 16980 - DNA, 25 bp, Homo sapien
gcgtttcgtgctcagggtgctgccc

SEQ ID NO: 16981 - DNA, 25 bp, Homo sapien
ggcggctgacctcagaccagtcgag

SEQ ID NO: 16982 - DNA, 25 bp, Homo sapien
gccgccctctccgtgtagaagttga

SEQ ID NO: 16983 - DNA, 25 bp, Homo sapien
tctccgtgtagaagttgaagccttc

SEQ ID NO: 16984 - DNA, 25 bp, Homo sapien
atgtccaccgtgtctggacggcagg

SEQ ID NO: 16985 - DNA, 25 bp, Homo sapien
tgaagccttccgctaggcacgtgag

SEQ ID NO: 16986 - DNA, 25 bp, Homo sapien
tgacgcaaatgtccaccgtgtctgg

SEQ ID NO: 16987 - DNA, 25 bp, Homo sapien
cttgcattcgccactgacgcaaatg

SEQ ID NO: 16988 - DNA, 25 bp, Homo sapien
ggcacttgtcctcccgcaggtcgga

SEQ ID NO: 16989 - DNA, 25 bp, Homo sapien
cacgtgagcgagcaggccttcacgc

SEQ ID NO: 16990 - DNA, 25 bp, Homo sapien
cgcagcactgctggaataaaacacg

SEQ ID NO: 16991 - DNA, 25 bp, Homo sapien
ccctaatccgggctggaatcctctg

SEQ ID NO: 16992 - DNA, 25 bp, Homo sapien
tcctctggcaccagacgcccggcgg

SEQ ID NO: 16993 - DNA, 25 bp, Homo sapien
ctaatccgggctggaatcctctggc

SEQ ID NO: 16994 - DNA, 25 bp, Homo sapien
ggccaaaggaccttgccgtgcgatg

SEQ ID NO: 16995 - DNA, 25 bp, Homo sapien
ggaccttgccgtgcgatgcctccat

SEQ ID NO: 16996 - DNA, 25 bp, Homo sapien
gccgtgcgatgcctccatggagctc

SEQ ID NO: 16997 - DNA, 25 bp, Homo sapien
ataaaacacgccagagaagcagggc

SEQ ID NO: 16998 - DNA, 25 bp, Homo sapien
tggccacagccgagggagcacaaat

SEQ ID NO: 16999 - DNA, 25 bp, Homo sapien
acagacccgtttgtagcaccactgg

SEQ ID NO: 17000 - DNA, 25 bp, Homo sapien
catgcgaacagagtcaggttacgta

SEQ ID NO: 17001 - DNA, 25 bp, Homo sapien
tgcaccggttgctcttgctcagaca

SEQ ID NO: 17002 - DNA, 25 bp, Homo sapien
cgtggccagaaccaagggacgcata

SEQ ID NO: 17003 - DNA, 25 bp, Homo sapien
tgtagacaggaccacgataagcgtg

SEQ ID NO: 17004 - DNA, 25 bp, Homo sapien
ccaatgagggagagagcaaacagta

SEQ ID NO: 17005 - DNA, 25 bp, Homo sapien
ccagagccgtgggaatcattacacg

SEQ ID NO: 17006 - DNA, 25 bp, Homo sapien
ctcattgacgctgcagcttctctcg

SEQ ID NO: 17007 - DNA, 25 bp, Homo sapien
gaacgctgtggccaggccaatgtcc

SEQ ID NO: 17008 - DNA, 25 bp, Homo sapien
tctcgtgggcaatggtgaacgctgt

SEQ ID NO: 17009 - DNA, 25 bp, Homo sapien
gcccgatctcgtgggcaatggtgaa

SEQ ID NO: 17010 - DNA, 25 bp, Homo sapien
tggcctcacgtgtgcccgatctcgt

SEQ ID NO: 17011 - DNA, 25 bp, Homo sapien
cgccgtcatggttcatgccgaatct

SEQ ID NO: 17012 - DNA, 25 bp, Homo sapien
ggccaatgtcctcattgacgctgca

SEQ ID NO: 17013 - DNA, 25 bp, Homo sapien
tggttcatgccgaatctggggaaag

SEQ ID NO: 17014 - DNA, 25 bp, Homo sapien
tcccgtgtccagtactccacggaga

SEQ ID NO: 17015 - DNA, 25 bp, Homo sapien
cagcagtgccccgttgtggtccacg

SEQ ID NO: 17016 - DNA, 25 bp, Homo sapien
ccactttgtagaagaggcgggactc

SEQ ID NO: 17017 - DNA, 25 bp, Homo sapien
ctgggcgaggccactttgtagaaga

SEQ ID NO: 17018 - DNA, 25 bp, Homo sapien
tcaggttcagcaggaagtgggtgct

SEQ ID NO: 17019 - DNA, 25 bp, Homo sapien
cgtgccctgccagtagacgggagct

SEQ ID NO: 17020 - DNA, 25 bp, Homo sapien
tccacggagacgtgccctgccagta

SEQ ID NO: 17021 - DNA, 25 bp, Homo sapien
agtactccacggagacgtgccctgc

SEQ ID NO: 17022 - DNA, 25 bp, Homo sapien
acaaacacacactggcagcgacaca

SEQ ID NO: 17023 - DNA, 25 bp, Homo sapien
gacccacaaaagacgcaggacgcct

SEQ ID NO: 17024 - DNA, 25 bp, Homo sapien
cagagaccggcgctcgggcactgta

SEQ ID NO: 17025 - DNA, 25 bp, Homo sapien
ctcactgaccaactcaggggaagtg

SEQ ID NO: 17026 - DNA, 25 bp, Homo sapien
gacagacggctgtggcctcactgac

SEQ ID NO: 17027 - DNA, 25 bp, Homo sapien
gccgctaattaaaggccctgagccc

SEQ ID NO: 17028 - DNA, 25 bp, Homo sapien
tccctgccggagagcagacaaaggc

SEQ ID NO: 17029 - DNA, 25 bp, Homo sapien
tcgggcactgtagacccacaaaaga

SEQ ID NO: 17030 - DNA, 25 bp, Homo sapien
acacaaagtcccactgaatcacgca

SEQ ID NO: 17031 - DNA, 25 bp, Homo sapien
ggcgtgatcagtggcgcgcgcactt

SEQ ID NO: 17032 - DNA, 25 bp, Homo sapien
tggcgcgcgcacttgcggacctcag

SEQ ID NO: 17033 - DNA, 25 bp, Homo sapien
ttgcggacctcaggcaccgaccgga

SEQ ID NO: 17034 - DNA, 25 bp, Homo sapien
accgaccggagtcgcacagcgggat

SEQ ID NO: 17035 - DNA, 25 bp, Homo sapien
aggcaccgaccggagtcgcacagcg

SEQ ID NO: 17036 - DNA, 25 bp, Homo sapien
cggagtcgcacagcgggatgccctc

SEQ ID NO: 17037 - DNA, 25 bp, Homo sapien
ggacctcaggcaccgaccggagtcg

SEQ ID NO: 17038 - DNA, 25 bp, Homo sapien
tgcctcgccgatgaacgtctgcagc

SEQ ID NO: 17039 - DNA, 25 bp, Homo sapien
acccaccgcagagaagcacgttttg

SEQ ID NO: 17040 - DNA, 25 bp, Homo sapien
tccggacactggaacagctccttgc

SEQ ID NO: 17041 - DNA, 25 bp, Homo sapien
agggaccctgttcctcgtactgctc

SEQ ID NO: 17042 - DNA, 25 bp, Homo sapien
gggcagcttcagagtccgcttgtac

SEQ ID NO: 17043 - DNA, 25 bp, Homo sapien
aagcgaccctcgaagccggtgaaga

SEQ ID NO: 17044 - DNA, 25 bp, Homo sapien
caccgactgcgatgccacgtacatg

SEQ ID NO: 17045 - DNA, 25 bp, Homo sapien
ctccactagcttctcgcggttggtg

SEQ ID NO: 17046 - DNA, 25 bp, Homo sapien
cagcccgaggcctcatgaaccgaaa

SEQ ID NO: 17047 - DNA, 25 bp, Homo sapien
gcggggccaaaagcgccgactcgcg

SEQ ID NO: 17048 - DNA, 25 bp, Homo sapien
cgaggcctcatgaaccgaaacacgg

SEQ ID NO: 17049 - DNA, 25 bp, Homo sapien
gctgacctaagctcacagcccgagg

SEQ ID NO: 17050 - DNA, 25 bp, Homo sapien
gcagcttcgtgctgacctaagctca

SEQ ID NO: 17051 - DNA, 25 bp, Homo sapien
ggagcaagcagcagcttcgtgctga

SEQ ID NO: 17052 - DNA, 25 bp, Homo sapien
agcctcgcagagtcgagcgtgttgg

SEQ ID NO: 17053 - DNA, 25 bp, Homo sapien
tcatgaaccgaaacacggctccctg

SEQ ID NO: 17054 - DNA, 25 bp, Homo sapien
gacatttccacactcgccgcagata

SEQ ID NO: 17055 - DNA, 25 bp, Homo sapien
tgccctgtgcaaactaacgtctctt

SEQ ID NO: 17056 - DNA, 25 bp, Homo sapien
tgcacgcgttccaggagaaccctta

SEQ ID NO: 17057 - DNA, 25 bp, Homo sapien
cgcttcagcggtgccgacatttcca

SEQ ID NO: 17058 - DNA, 25 bp, Homo sapien
tagcagggccaacttccaccaggtc

SEQ ID NO: 17059 - DNA, 25 bp, Homo sapien
agcgagaagcactcacggaagattc

SEQ ID NO: 17060 - DNA, 25 bp, Homo sapien
gctacggaggatgaaggctacattc

SEQ ID NO: 17061 - DNA, 25 bp, Homo sapien
gctccagtcgtacctcaagcagagg

SEQ ID NO: 17062 - DNA, 25 bp, Homo sapien
ttgtcgatgggcagcgtgacattcc

SEQ ID NO: 17063 - DNA, 25 bp, Homo sapien
tggggctcagtctgcagcgccacct

SEQ ID NO: 17064 - DNA, 25 bp, Homo sapien
tgccagccagcaagtggggctcagt

SEQ ID NO: 17065 - DNA, 25 bp, Homo sapien
agccggcgcccaaagacagtgacct

SEQ ID NO: 17066 - DNA, 25 bp, Homo sapien
actccaccaggttgaggccgttgtc

SEQ ID NO: 17067 - DNA, 25 bp, Homo sapien
tgacattcctcttgcccacggtggg

SEQ ID NO: 17068 - DNA, 25 bp, Homo sapien
atgggcagcgtgacattcctcttgc

SEQ ID NO: 17069 - DNA, 25 bp, Homo sapien
gcagcagccgcaaggagccatcggc

SEQ ID NO: 17070 - DNA, 25 bp, Homo sapien
atggcccgtctcgttttctgcggca

SEQ ID NO: 17071 - DNA, 25 bp, Homo sapien
gcggcagccatgaggtgcctcacta

SEQ ID NO: 17072 - DNA, 25 bp, Homo sapien
ctgggcgttttcctgcttcatctca

SEQ ID NO: 17073 - DNA, 25 bp, Homo sapien
gcactacgccaagatcatgagccta

SEQ ID NO: 17074 - DNA, 25 bp, Homo sapien
gcttatgaccggttcgtggccatct

SEQ ID NO: 17075 - DNA, 25 bp, Homo sapien
cgccatgatggcttatgaccggttc

SEQ ID NO: 17076 - DNA, 25 bp, Homo sapien
cgtggacagcgtcataatcgccatg

SEQ ID NO: 17077 - DNA, 25 bp, Homo sapien
gaggtgcctcactacttctgcgacc

SEQ ID NO: 17078 - DNA, 25 bp, Homo sapien
acgccagactggacctcccgtatga

SEQ ID NO: 17079 - DNA, 25 bp, Homo sapien
ggggtgcgtttagatctcgcgatca

SEQ ID NO: 17080 - DNA, 25 bp, Homo sapien
taaagagctaggcatccagacgagg

SEQ ID NO: 17081 - DNA, 25 bp, Homo sapien
cctatctggcggtgaggactaagag

SEQ ID NO: 17082 - DNA, 25 bp, Homo sapien
tcccagtcgtgtaagccctgctttc

SEQ ID NO: 17083 - DNA, 25 bp, Homo sapien
tatgaacttctcttcgcatcggcgg

SEQ ID NO: 17084 - DNA, 25 bp, Homo sapien
cggcgaattctttcggcctgttggg

SEQ ID NO: 17085 - DNA, 25 bp, Homo sapien
tcgcgatcagcgatatgaaaagctg

SEQ ID NO: 17086 - DNA, 25 bp, Homo sapien
tcagcccttaggagccacgcaagaa

SEQ ID NO: 17087 - DNA, 25 bp, Homo sapien
gccttccgctggaagtccaacttta

SEQ ID NO: 17088 - DNA, 25 bp, Homo sapien
tgcgggaaatcctttggcgatctcg

SEQ ID NO: 17089 - DNA, 25 bp, Homo sapien
atcgtcaagaaacccgtggaatgtc

SEQ ID NO: 17090 - DNA, 25 bp, Homo sapien
tgtcacgactgtgggaaagctttcc

SEQ ID NO: 17091 - DNA, 25 bp, Homo sapien
cggaggcacatgagcgttcaccttg

SEQ ID NO: 17092 - DNA, 25 bp, Homo sapien
gctttcagcgcgagttcaaacctca

SEQ ID NO: 17093 - DNA, 25 bp, Homo sapien
cgatctctgcgggaaagctttcagc

SEQ ID NO: 17094 - DNA, 25 bp, Homo sapien
tccgcgtcgggagttcaaatcccgc

SEQ ID NO: 17095 - DNA, 25 bp, Homo sapien
cactcggcaaagttggcaaaggcgc

SEQ ID NO: 17096 - DNA, 25 bp, Homo sapien
cgacgctctctaggccccggcagac

SEQ ID NO: 17097 - DNA, 25 bp, Homo sapien
cccagcactcggcaaagttggcaaa

SEQ ID NO: 17098 - DNA, 25 bp, Homo sapien
cccagttcgcgccaggcgggtccgc

SEQ ID NO: 17099 - DNA, 25 bp, Homo sapien
actcggcaaagttggcaaaggcgcg

SEQ ID NO: 17100 - DNA, 25 bp, Homo sapien
ccagcactcggcaaagttggcaaag

SEQ ID NO: 17101 - DNA, 25 bp, Homo sapien
agcactcggcaaagttggcaaaggc

SEQ ID NO: 17102 - DNA, 25 bp, Homo sapien
gtctataactcggagccgttgggtc

SEQ ID NO: 17103 - DNA, 25 bp, Homo sapien
ccgtccctagcgcacgcggcctccc

SEQ ID NO: 17104 - DNA, 25 bp, Homo sapien
ccaataggcgcctgcgatttctctg

SEQ ID NO: 17105 - DNA, 25 bp, Homo sapien
acgtgtgcgggcgtctccgccattt

SEQ ID NO: 17106 - DNA, 25 bp, Homo sapien
ccgccattttgtgagtctataactc

SEQ ID NO: 17107 - DNA, 25 bp, Homo sapien
ttcggccttgaggaataaccgcctc

SEQ ID NO: 17108 - DNA, 25 bp, Homo sapien
gtcggttcctgctattccggcgcct

SEQ ID NO: 17109 - DNA, 25 bp, Homo sapien
gccgttgggtcggttcctgctattc

SEQ ID NO: 17110 - DNA, 25 bp, Homo sapien
caaggctgtcgactcgcgcatgcgc

SEQ ID NO: 17111 - DNA, 25 bp, Homo sapien
tgattcctctttcggcgctgcaaat

SEQ ID NO: 17112 - DNA, 25 bp, Homo sapien
atgcgcagaagcacacttctgattc

SEQ ID NO: 17113 - DNA, 25 bp, Homo sapien
cgtagggtgacaaggctgtcgactc

SEQ ID NO: 17114 - DNA, 25 bp, Homo sapien
tttcggcgctgcaaatggcgtatgg

SEQ ID NO: 17115 - DNA, 25 bp, Homo sapien
aaaatgttcctcagacgcgggcgga

SEQ ID NO: 17116 - DNA, 25 bp, Homo sapien
agcgggcggaggcaaaaatgttcct

SEQ ID NO: 17117 - DNA, 25 bp, Homo sapien
ggaggcagcccttagaccgccgatt

SEQ ID NO: 17118 - DNA, 25 bp, Homo sapien
ccggtgcagccacgcgagagtagaa

SEQ ID NO: 17119 - DNA, 25 bp, Homo sapien
agccacagtcaggtctgtcctcagg

SEQ ID NO: 17120 - DNA, 25 bp, Homo sapien
ctaggtggtcctagcctttgcgcgt

SEQ ID NO: 17121 - DNA, 25 bp, Homo sapien
gccatcttaacagcgcgttcccgtt

SEQ ID NO: 17122 - DNA, 25 bp, Homo sapien
cccagtgaaatggagcctgtcccgt

SEQ ID NO: 17123 - DNA, 25 bp, Homo sapien
tgcactttcgggcatttcgagcatc

SEQ ID NO: 17124 - DNA, 25 bp, Homo sapien
tcgagcatcttgtgggctctcccaa

SEQ ID NO: 17125 - DNA, 25 bp, Homo sapien
gcatgcgcataacggccgccatctt

SEQ ID NO: 17126 - DNA, 25 bp, Homo sapien
gtcctcagggcgaatccgccaaatg

SEQ ID NO: 17127 - DNA, 25 bp, Homo sapien
atccgccaaatgtgcgagctgggca

SEQ ID NO: 17128 - DNA, 25 bp, Homo sapien
ctgagaaagggttgctgtcccagca

SEQ ID NO: 17129 - DNA, 25 bp, Homo sapien
ttgctgtcccagcaggccaggtcca

SEQ ID NO: 17130 - DNA, 25 bp, Homo sapien
ggctatcgcggcgtttcttctcaga

SEQ ID NO: 17131 - DNA, 25 bp, Homo sapien
ggcgtttcttctcagaggccgccgg

SEQ ID NO: 17132 - DNA, 25 bp, Homo sapien
tgccattccgggcattggttcccgg

SEQ ID NO: 17133 - DNA, 25 bp, Homo sapien
ggctttggttcctcccggcactgct

SEQ ID NO: 17134 - DNA, 25 bp, Homo sapien
cttccgtttccaggcatgagggcaa

SEQ ID NO: 17135 - DNA, 25 bp, Homo sapien
gctagtagagagatcccagcgtccc

SEQ ID NO: 17136 - DNA, 25 bp, Homo sapien
acctgcaggaggctaccctttgacc

SEQ ID NO: 17137 - DNA, 25 bp, Homo sapien
tgcacgcggagtacggcattcactt

SEQ ID NO: 17138 - DNA, 25 bp, Homo sapien
gcattcacttccgtttccgggagcg

SEQ ID NO: 17139 - DNA, 25 bp, Homo sapien
gtgacctggaatgggctgagaaaca

SEQ ID NO: 17140 - DNA, 25 bp, Homo sapien
ctgagaaacaggagccacgagagcc

SEQ ID NO: 17141 - DNA, 25 bp, Homo sapien
gccgcgactttccaaagctagtaga

SEQ ID NO: 17142 - DNA, 25 bp, Homo sapien
tttgaagcggcaatcaccgtgtttg

SEQ ID NO: 17143 - DNA, 25 bp, Homo sapien
tccgacctcgccaaagctgtattaa

SEQ ID NO: 17144 - DNA, 25 bp, Homo sapien
agcggagcaggcaaggtctctctaa

SEQ ID NO: 17145 - DNA, 25 bp, Homo sapien
cgcagtgacaactcgagtggctttt

SEQ ID NO: 17146 - DNA, 25 bp, Homo sapien
gaagcgcccttacgacagatcccga

SEQ ID NO: 17147 - DNA, 25 bp, Homo sapien
aacacagcagcgctccgtgacgtca

SEQ ID NO: 17148 - DNA, 25 bp, Homo sapien
ttgcaaaaatcgtgaggaagcgccc

SEQ ID NO: 17149 - DNA, 25 bp, Homo sapien
tgtattaagcccaaacgccaccagg

SEQ ID NO: 17150 - DNA, 25 bp, Homo sapien
ccggatgatctagggcacaaacatg

SEQ ID NO: 17151 - DNA, 25 bp, Homo sapien
ccggcgttatctggggacactgaat

SEQ ID NO: 17152 - DNA, 25 bp, Homo sapien
tgttgctgttgagcagccagttctc

SEQ ID NO: 17153 - DNA, 25 bp, Homo sapien
tgctgttgagcagccagttctcctg

SEQ ID NO: 17154 - DNA, 25 bp, Homo sapien
ttcagggagttaatggaggccgcgt

SEQ ID NO: 17155 - DNA, 25 bp, Homo sapien
caggccgcccggatgatctagggca

SEQ ID NO: 17156 - DNA, 25 bp, Homo sapien
tagggcacaaacatggcggtcagcg

SEQ ID NO: 17157 - DNA, 25 bp, Homo sapien
cgccagccaaagaccttggtccggg

SEQ ID NO: 17158 - DNA, 25 bp, Homo sapien
cggagtcaatcgaacgcgaacggca

SEQ ID NO: 17159 - DNA, 25 bp, Homo sapien
attaccctgggtcgattgtgacctc

SEQ ID NO: 17160 - DNA, 25 bp, Homo sapien
cctctgtaaggaggttcctcgatta

SEQ ID NO: 17161 - DNA, 25 bp, Homo sapien
caatggcctcttcgacgtggcctca

SEQ ID NO: 17162 - DNA, 25 bp, Homo sapien
ttttgaagacgggaacacacggctg

SEQ ID NO: 17163 - DNA, 25 bp, Homo sapien
ggcctcagaacgcttggacactttt

SEQ ID NO: 17164 - DNA, 25 bp, Homo sapien
cgtcacttccgtttggggcattgga

SEQ ID NO: 17165 - DNA, 25 bp, Homo sapien
ttcacaaacgttgccttggagactt

SEQ ID NO: 17166 - DNA, 25 bp, Homo sapien
aaacgctgctttggaggcctttgga

SEQ ID NO: 17167 - DNA, 25 bp, Homo sapien
gggcgcacagatgaaaacaccctgc

SEQ ID NO: 17168 - DNA, 25 bp, Homo sapien
ggccagtgaggccttaactctgaaa

SEQ ID NO: 17169 - DNA, 25 bp, Homo sapien
aaaaagactctcaggcgctcacagc

SEQ ID NO: 17170 - DNA, 25 bp, Homo sapien
ctcacagccggcgtcacaaaaggaa

SEQ ID NO: 17171 - DNA, 25 bp, Homo sapien
ggactagggtttctgccgtgtaata

SEQ ID NO: 17172 - DNA, 25 bp, Homo sapien
cggaacactcagaaatcgccaggtc

SEQ ID NO: 17173 - DNA, 25 bp, Homo sapien
acaccctgcggacaccgtaactata

SEQ ID NO: 17174 - DNA, 25 bp, Homo sapien
tggactccaccacgataaaggcgaa

SEQ ID NO: 17175 - DNA, 25 bp, Homo sapien
actggccgcgcaaggaggaccgaca

SEQ ID NO: 17176 - DNA, 25 bp, Homo sapien
cctgggttcgagtttcagccacata

SEQ ID NO: 17177 - DNA, 25 bp, Homo sapien
tcctgactgggacccactgagcctg

SEQ ID NO: 17178 - DNA, 25 bp, Homo sapien
cagccacataggacccagtcaaaca

SEQ ID NO: 17179 - DNA, 25 bp, Homo sapien
cgcggagtcgggacaaacacacttc

SEQ ID NO: 17180 - DNA, 25 bp, Homo sapien
atggcactgaccatgcggagccagc

SEQ ID NO: 17181 - DNA, 25 bp, Homo sapien
cacagaaattgtagtttcttcccgg

SEQ ID NO: 17182 - DNA, 25 bp, Homo sapien
gaccgccaaggaggtggaactcacc

SEQ ID NO: 17183 - DNA, 25 bp, Homo sapien
aggctcctaggcgacagcgcgcaat

SEQ ID NO: 17184 - DNA, 25 bp, Homo sapien
cagactccaccaccataaaggcgaa

SEQ ID NO: 17185 - DNA, 25 bp, Homo sapien
aaaccgcactgacggagaggagcca

SEQ ID NO: 17186 - DNA, 25 bp, Homo sapien
cgcttcaacactctggccgggcgag

SEQ ID NO: 17187 - DNA, 25 bp, Homo sapien
ggctcgtgggctccagtttcagcca

SEQ ID NO: 17188 - DNA, 25 bp, Homo sapien
gctccagtttcagccacgtaggacc

SEQ ID NO: 17189 - DNA, 25 bp, Homo sapien
ggcgacagcgcgcaatcattccttt

SEQ ID NO: 17190 - DNA, 25 bp, Homo sapien
taaagatggcggtggcacactgacg

SEQ ID NO: 17191 - DNA, 25 bp, Homo sapien
taaacggcactgaccatgctgagcc

SEQ ID NO: 17192 - DNA, 25 bp, Homo sapien
tcccgacgcagccagacggactgtg

SEQ ID NO: 17193 - DNA, 25 bp, Homo sapien
agcgagtgaaactaggcggatctga

SEQ ID NO: 17194 - DNA, 25 bp, Homo sapien
agccacagccggtaaagatggcggt

SEQ ID NO: 17195 - DNA, 25 bp, Homo sapien
caggtagaactcaccacagcggggt

SEQ ID NO: 17196 - DNA, 25 bp, Homo sapien
ccacaataaaggttaaacggcactg

SEQ ID NO: 17197 - DNA, 25 bp, Homo sapien
ggcggaggcggaacaaacacacttc

SEQ ID NO: 17198 - DNA, 25 bp, Homo sapien
cagagtggtctattagggccgctca

SEQ ID NO: 17199 - DNA, 25 bp, Homo sapien
ggtataatctcagcctctccgtatg

SEQ ID NO: 17200 - DNA, 25 bp, Homo sapien
tctccgtatgcaggagctggtttcc

SEQ ID NO: 17201 - DNA, 25 bp, Homo sapien
tttgccattcctcaagctgcaggta

SEQ ID NO: 17202 - DNA, 25 bp, Homo sapien
cgccacgtccacagagcaggcttgg

SEQ ID NO: 17203 - DNA, 25 bp, Homo sapien
gaagccgctaatcgcacagtctttg

SEQ ID NO: 17204 - DNA, 25 bp, Homo sapien
tggtctggttcccttcaagcacctc

SEQ ID NO: 17205 - DNA, 25 bp, Homo sapien
gcacgctgcgcatcgacttttccaa

SEQ ID NO: 17206 - DNA, 25 bp, Homo sapien
agacctacctgacgcgagcacagca

SEQ ID NO: 17207 - DNA, 25 bp, Homo sapien
cccgactttcgcgaggactgacagc

SEQ ID NO: 17208 - DNA, 25 bp, Homo sapien
gcacagcaggccaagtatctctaag

SEQ ID NO: 17209 - DNA, 25 bp, Homo sapien
cagcttcggataaacttcaactctc

SEQ ID NO: 17210 - DNA, 25 bp, Homo sapien
agtacacttgctccctccgaaatca

SEQ ID NO: 17211 - DNA, 25 bp, Homo sapien
ccgaaatcaaggacaaccatgggta

SEQ ID NO: 17212 - DNA, 25 bp, Homo sapien
ccatgggtaaacctcgctcaggctc

SEQ ID NO: 17213 - DNA, 25 bp, Homo sapien
ctcgcggagccagtaccggaaaaga

SEQ ID NO: 17214 - DNA, 25 bp, Homo sapien
gaggcgtcacctaaggcttcgattg

SEQ ID NO: 17215 - DNA, 25 bp, Homo sapien
gcgcgtctcagacctagcagaagtc

SEQ ID NO: 17216 - DNA, 25 bp, Homo sapien
cctgcctaggttgagcatgagcgct

SEQ ID NO: 17217 - DNA, 25 bp, Homo sapien
tcgattgcagacagcgggatgctca

SEQ ID NO: 17218 - DNA, 25 bp, Homo sapien
ggaatacgtatagctgcgcgccggc

SEQ ID NO: 17219 - DNA, 25 bp, Homo sapien
ttccggttgcgcacggcattaagtg

SEQ ID NO: 17220 - DNA, 25 bp, Homo sapien
aagtcccgttttctcgcatcccagg

SEQ ID NO: 17221 - DNA, 25 bp, Homo sapien
tcgatattgggaacgacgccggacc

SEQ ID NO: 17222 - DNA, 25 bp, Homo sapien
ttatgccgccatgtacgagtatgcg

SEQ ID NO: 17223 - DNA, 25 bp, Homo sapien
cttctgattccgctccagggtttca

SEQ ID NO: 17224 - DNA, 25 bp, Homo sapien
agaggctactgctggggaaaccgtt

SEQ ID NO: 17225 - DNA, 25 bp, Homo sapien
ctccgcaactctggggagaagtctt

SEQ ID NO: 17226 - DNA, 25 bp, Homo sapien
agaagtcttagtttccgcgcagcca

SEQ ID NO: 17227 - DNA, 25 bp, Homo sapien
ttccgcgcagccaaacgcgattgga

SEQ ID NO: 17228 - DNA, 25 bp, Homo sapien
tttcctctgcgcttatgccgccatg

SEQ ID NO: 17229 - DNA, 25 bp, Homo sapien
tccgggtggctaagccgcacctgaa

SEQ ID NO: 17230 - DNA, 25 bp, Homo sapien
cctcatcgagtacccgccccgtcta

SEQ ID NO: 17231 - DNA, 25 bp, Homo sapien
caccgagttctcgtcccagtctccc

SEQ ID NO: 17232 - DNA, 25 bp, Homo sapien
tctccctcaccgagttctcgtccca

SEQ ID NO: 17233 - DNA, 25 bp, Homo sapien
cactgaggtcccgcctctgacagcc

SEQ ID NO: 17234 - DNA, 25 bp, Homo sapien
tcccttcactgagatcccgccctct

SEQ ID NO: 17235 - DNA, 25 bp, Homo sapien
ccgtctatccttcatcaagtctcca

SEQ ID NO: 17236 - DNA, 25 bp, Homo sapien
cccgtcctccgtcatcgagtctccg

SEQ ID NO: 17237 - DNA, 25 bp, Homo sapien
gccaccgtctctccttcatcgagtc

SEQ ID NO: 17238 - DNA, 25 bp, Homo sapien
gagagggacttaccgttcgccgcga

SEQ ID NO: 17239 - DNA, 25 bp, Homo sapien
ccctccgcccggcaagtggcccaag

SEQ ID NO: 17240 - DNA, 25 bp, Homo sapien
aagtggcccaagcaggcatccgcaa

SEQ ID NO: 17241 - DNA, 25 bp, Homo sapien
gcccaagcaggcatccgcaacggaa

SEQ ID NO: 17242 - DNA, 25 bp, Homo sapien
agcaggcatccgcaacggaaggaca

SEQ ID NO: 17243 - DNA, 25 bp, Homo sapien
catccgcaacggaaggacaatttta

SEQ ID NO: 17244 - DNA, 25 bp, Homo sapien
caaaccctcaaaagtaggaagagag

SEQ ID NO: 17245 - DNA, 25 bp, Homo sapien
gaagagagagggacttaccgttcgc

SEQ ID NO: 17246 - DNA, 25 bp, Homo sapien
attcatgcggcttgtacgaggatgc

SEQ ID NO: 17247 - DNA, 25 bp, Homo sapien
cccacctggtcgcaaaggctggtgc

SEQ ID NO: 17248 - DNA, 25 bp, Homo sapien
caggggaaaccgttggttcagctgc

SEQ ID NO: 17249 - DNA, 25 bp, Homo sapien
accgttggttcagctgcggttcctg

SEQ ID NO: 17250 - DNA, 25 bp, Homo sapien
ggtgccgctctgatcacgcgcactt

SEQ ID NO: 17251 - DNA, 25 bp, Homo sapien
tcctccacgaccctggggagaagtc

SEQ ID NO: 17252 - DNA, 25 bp, Homo sapien
agaagtcccagtttccgcgcagccg

SEQ ID NO: 17253 - DNA, 25 bp, Homo sapien
ttcctctgcattcatgcggcttgta

SEQ ID NO: 17254 - DNA, 25 bp, Homo sapien
tcccgtagccggtcgagaaatttga

SEQ ID NO: 17255 - DNA, 25 bp, Homo sapien
ctctcgctgggaagtgattcggtcc

SEQ ID NO: 17256 - DNA, 25 bp, Homo sapien
ggccgcgactgggaactaagaccaa

SEQ ID NO: 17257 - DNA, 25 bp, Homo sapien
taagaccaagtccagaaggcggggc

SEQ ID NO: 17258 - DNA, 25 bp, Homo sapien
cggagccagagaacggaaccaagtc

SEQ ID NO: 17259 - DNA, 25 bp, Homo sapien
ctgcagacgagaaccacgccttgga

SEQ ID NO: 17260 - DNA, 25 bp, Homo sapien
gtagaggctcggacaaccgctggaa

SEQ ID NO: 17261 - DNA, 25 bp, Homo sapien
cgagtccggcagttcgaccaaagtc

SEQ ID NO: 17262 - DNA, 25 bp, Homo sapien
agaacttgtcccagtgttgaccaca

SEQ ID NO: 17263 - DNA, 25 bp, Homo sapien
actgcagacccggaagaacttgtcc

SEQ ID NO: 17264 - DNA, 25 bp, Homo sapien
agcgttaactgcgaccggggttcag

SEQ ID NO: 17265 - DNA, 25 bp, Homo sapien
ttccggttcctagcgttaactgcga

SEQ ID NO: 17266 - DNA, 25 bp, Homo sapien
gcgcgacacctgtcaagccttggga

SEQ ID NO: 17267 - DNA, 25 bp, Homo sapien
tcggagaaagctgtcgcgacccagc

SEQ ID NO: 17268 - DNA, 25 bp, Homo sapien
taccacaggcgcgacacctgtcaag

SEQ ID NO: 17269 - DNA, 25 bp, Homo sapien
agcaaacacaccacagactgcagac

SEQ ID NO: 17270 - DNA, 25 bp, Homo sapien
ttgctgcggcattagccaatccata

SEQ ID NO: 17271 - DNA, 25 bp, Homo sapien
ccggctgatacctctcggcctaatg

SEQ ID NO: 17272 - DNA, 25 bp, Homo sapien
gcagagcgcgtctagccaataggca

SEQ ID NO: 17273 - DNA, 25 bp, Homo sapien
gccagaaagccaatccggaccgtta

SEQ ID NO: 17274 - DNA, 25 bp, Homo sapien
tcgcttcggaccactcaggagccga

SEQ ID NO: 17275 - DNA, 25 bp, Homo sapien
ccataagctctatcccgcctgggtg

SEQ ID NO: 17276 - DNA, 25 bp, Homo sapien
accagccagactcttccgcatggga

SEQ ID NO: 17277 - DNA, 25 bp, Homo sapien
tcgggagttttttggcgctcgctaa

SEQ ID NO: 17278 - DNA, 25 bp, Homo sapien
ccacgttgctctggtacttgttata

SEQ ID NO: 17279 - DNA, 25 bp, Homo sapien
gaacagggagccgttgtacaccacg

SEQ ID NO: 17280 - DNA, 25 bp, Homo sapien
gggcacgtccgtgtactcgtaactg

SEQ ID NO: 17281 - DNA, 25 bp, Homo sapien
cgcgagcggaagtggtatttgacca

SEQ ID NO: 17282 - DNA, 25 bp, Homo sapien
ccatgaagtccatgtcggagaagcc

SEQ ID NO: 17283 - DNA, 25 bp, Homo sapien
accgcagatcatgaaggcctcgcca

SEQ ID NO: 17284 - DNA, 25 bp, Homo sapien
ggtcacgtagagcacaccgcagatc

SEQ ID NO: 17285 - DNA, 25 bp, Homo sapien
atactggttgtggaagggcacgtcc

SEQ ID NO: 17286 - DNA, 25 bp, Homo sapien
tcccacgactaccaagggcagtttc

SEQ ID NO: 17287 - DNA, 25 bp, Homo sapien
ccagggccagcagacgaaattgttt

SEQ ID NO: 17288 - DNA, 25 bp, Homo sapien
aaggatccttcggtcatttcgtgcc

SEQ ID NO: 17289 - DNA, 25 bp, Homo sapien
tcccgggcactgagaccactctaag

SEQ ID NO: 17290 - DNA, 25 bp, Homo sapien
gtcaccaagggtctcctttagctgg

SEQ ID NO: 17291 - DNA, 25 bp, Homo sapien
tcgtgcgctcccatgaatcgggtca

SEQ ID NO: 17292 - DNA, 25 bp, Homo sapien
tggctacctaaaacctcggacagcg

SEQ ID NO: 17293 - DNA, 25 bp, Homo sapien
cctggcgggctcctcttataaagcg

SEQ ID NO: 17294 - DNA, 25 bp, Homo sapien
cctcttaccacgagccgggtgctgt

SEQ ID NO: 17295 - DNA, 25 bp, Homo sapien
agcgaggccgtgcactaacagactc

SEQ ID NO: 17296 - DNA, 25 bp, Homo sapien
tgcactaacagactcgatctccctt

SEQ ID NO: 17297 - DNA, 25 bp, Homo sapien
tcacgcctgtaatcgtccttagaga

SEQ ID NO: 17298 - DNA, 25 bp, Homo sapien
tccttagagactgacttgtgccaca

SEQ ID NO: 17299 - DNA, 25 bp, Homo sapien
agcagcgctgtctctgccggcatgt

SEQ ID NO: 17300 - DNA, 25 bp, Homo sapien
tgaaggtgcttctcttaccgtgtgc

SEQ ID NO: 17301 - DNA, 25 bp, Homo sapien
gtgcttctcttaccgtgtgcccgtc

SEQ ID NO: 17302 - DNA, 25 bp, Homo sapien
gtcagtcactctcacgtgagtcccg

SEQ ID NO: 17303 - DNA, 25 bp, Homo sapien
cattcagctccagcgagatggcggg

SEQ ID NO: 17304 - DNA, 25 bp, Homo sapien
agaggaagtcaagggtaagcaaccg

SEQ ID NO: 17305 - DNA, 25 bp, Homo sapien
ccgaagaggaagtcaagggtaagca

SEQ ID NO: 17306 - DNA, 25 bp, Homo sapien
aaactgggcatctcggccccgaaga

SEQ ID NO: 17307 - DNA, 25 bp, Homo sapien
gcttcagaaactgggcatctcggcc

SEQ ID NO: 17308 - DNA, 25 bp, Homo sapien
tggagggcttcagaaactgggcatc

SEQ ID NO: 17309 - DNA, 25 bp, Homo sapien
gccatggaggggttgagaaccccaa

SEQ ID NO: 17310 - DNA, 25 bp, Homo sapien
acctgaggacaggacttggcagcgc

SEQ ID NO: 17311 - DNA, 25 bp, Homo sapien
ggggcatttcccacgttgcaggtgg

SEQ ID NO: 17312 - DNA, 25 bp, Homo sapien
ctccgggggcatttcccacgttgca

SEQ ID NO: 17313 - DNA, 25 bp, Homo sapien
gcccgtcacgtgtttgtaaatttca

SEQ ID NO: 17314 - DNA, 25 bp, Homo sapien
tgcccgtcacgtgtttgtaaatttc

SEQ ID NO: 17315 - DNA, 25 bp, Homo sapien
ggccattccgggagcgggtcgcgga

SEQ ID NO: 17316 - DNA, 25 bp, Homo sapien
gaggacaggacttggcagcgccccc

SEQ ID NO: 17317 - DNA, 25 bp, Homo sapien
ctgaggacaggacttggcagcgccc

SEQ ID NO: 17318 - DNA, 25 bp, Homo sapien
cagctccaagctcagcgatgtgagc

SEQ ID NO: 17319 - DNA, 25 bp, Homo sapien
ttgcggtgcagctcgtggcacacga

SEQ ID NO: 17320 - DNA, 25 bp, Homo sapien
acctcaccatcaggcaggtgcgggt

SEQ ID NO: 17321 - DNA, 25 bp, Homo sapien
gggaccggacctcaccatcaggcag

SEQ ID NO: 17322 - DNA, 25 bp, Homo sapien
gcgcagccctggttggggtcaatcc

SEQ ID NO: 17323 - DNA, 25 bp, Homo sapien
ccctccacgactggaagcgggactg

SEQ ID NO: 17324 - DNA, 25 bp, Homo sapien
ctcagcgatgtgagcgaggccagca

SEQ ID NO: 17325 - DNA, 25 bp, Homo sapien
gccgtgaagttgcaaaaaaccctga

SEQ ID NO: 17326 - DNA, 25 bp, Homo sapien
ccttgtccttacctgtgcggcagaa

SEQ ID NO: 17327 - DNA, 25 bp, Homo sapien
tgcggcagaattcctcggcctcctg

SEQ ID NO: 17328 - DNA, 25 bp, Homo sapien
ggcctcctgcggcacaatgtccttg

SEQ ID NO: 17329 - DNA, 25 bp, Homo sapien
gagccaagctcacctgcgcctgagg

SEQ ID NO: 17330 - DNA, 25 bp, Homo sapien
ctcgctggagctgtacgatttctgc

SEQ ID NO: 17331 - DNA, 25 bp, Homo sapien
aaacagggtcctcgccgcactcagg

SEQ ID NO: 17332 - DNA, 25 bp, Homo sapien
gagcggtaaggcttcctctccttca

SEQ ID NO: 17333 - DNA, 25 bp, Homo sapien
caatgtccttgacgcggctgccata

SEQ ID NO: 17334 - DNA, 25 bp, Homo sapien
ctcctctcagggtccgcgggaaact

SEQ ID NO: 17335 - DNA, 25 bp, Homo sapien
gcgctcgccagaaaacgcactcaca

SEQ ID NO: 17336 - DNA, 25 bp, Homo sapien
cccgagctgtcacacccacaaatca

SEQ ID NO: 17337 - DNA, 25 bp, Homo sapien
ccacaaatcacccagagtcagatac

SEQ ID NO: 17338 - DNA, 25 bp, Homo sapien
gtcagatactcatgcgcccacatca

SEQ ID NO: 17339 - DNA, 25 bp, Homo sapien
tcttttagagcctctctgagtcgtg

SEQ ID NO: 17340 - DNA, 25 bp, Homo sapien
tctgagtcgtggaccctgggtccca

SEQ ID NO: 17341 - DNA, 25 bp, Homo sapien
tagagcctctctgagtcgtggaccc

SEQ ID NO: 17342 - DNA, 25 bp, Homo sapien
gccacgtggacttgcgcaccagcag

SEQ ID NO: 17343 - DNA, 25 bp, Homo sapien
ccaagtacgagaggccacgtggact

SEQ ID NO: 17344 - DNA, 25 bp, Homo sapien
tctggtgtccaagtacgagaggcca

SEQ ID NO: 17345 - DNA, 25 bp, Homo sapien
tcgagcactggcattcctgagggag

SEQ ID NO: 17346 - DNA, 25 bp, Homo sapien
tccctcgagcactggcattcctgag

SEQ ID NO: 17347 - DNA, 25 bp, Homo sapien
tgcaaactcccgatcccagggaggg

SEQ ID NO: 17348 - DNA, 25 bp, Homo sapien
tcggtgcaaactcccgatcccaggg

SEQ ID NO: 17349 - DNA, 25 bp, Homo sapien
cgcccgcgccttctcggtgcaaact

SEQ ID NO: 17350 - DNA, 25 bp, Homo sapien
gacacgccggccgatggtttctcga

SEQ ID NO: 17351 - DNA, 25 bp, Homo sapien
ccgatggtttctcgagtgctgtctg

SEQ ID NO: 17352 - DNA, 25 bp, Homo sapien
atggtttctcgagtgctgtctgtgg

SEQ ID NO: 17353 - DNA, 25 bp, Homo sapien
tcgagtgctgtctgtggtactgatc

SEQ ID NO: 17354 - DNA, 25 bp, Homo sapien
gagtgctgtctgtggtactgatcca

SEQ ID NO: 17355 - DNA, 25 bp, Homo sapien
gctgtctgtggtactgatccacgtt

SEQ ID NO: 17356 - DNA, 25 bp, Homo sapien
cattccaacactcagaccacggtgg

SEQ ID NO: 17357 - DNA, 25 bp, Homo sapien
ttccaacactcagaccacggtggtg

SEQ ID NO: 17358 - DNA, 25 bp, Homo sapien
aattcggcagcgaccacacgggagt

SEQ ID NO: 17359 - DNA, 25 bp, Homo sapien
ggctctgatgaggaaattcggcagc

SEQ ID NO: 17360 - DNA, 25 bp, Homo sapien
atgggaaggtatcctccaagaaggc

SEQ ID NO: 17361 - DNA, 25 bp, Homo sapien
gcctccgggagaagtttcatgggaa

SEQ ID NO: 17362 - DNA, 25 bp, Homo sapien
ccaacgccctgtggggactttggct

SEQ ID NO: 17363 - DNA, 25 bp, Homo sapien
tcaaaggtcagaggccagagataac

SEQ ID NO: 17364 - DNA, 25 bp, Homo sapien
ggacatgtgaccgactgcagaggcc

SEQ ID NO: 17365 - DNA, 25 bp, Homo sapien
ctccatcgtgtacggtgaggctgca

SEQ ID NO: 17366 - DNA, 25 bp, Homo sapien
gccagctcgcggaacttgacgtcca

SEQ ID NO: 17367 - DNA, 25 bp, Homo sapien
tccaggcgggcgatgagactgctct

SEQ ID NO: 17368 - DNA, 25 bp, Homo sapien
tcgcggaacttgacgtccagctggt

SEQ ID NO: 17369 - DNA, 25 bp, Homo sapien
tgcagctcgcgtaacagctcctcgt

SEQ ID NO: 17370 - DNA, 25 bp, Homo sapien
tcgcgtaacagctcctcgtggcggc

SEQ ID NO: 17371 - DNA, 25 bp, Homo sapien
ctccagcacacagcgcccgtgaact

SEQ ID NO: 17372 - DNA, 25 bp, Homo sapien
gcagcagctgtagcgcacgcagcca

SEQ ID NO: 17373 - DNA, 25 bp, Homo sapien
aggctgcgaggttacctgctgctgc

SEQ ID NO: 17374 - DNA, 25 bp, Homo sapien
acgggtcgcaacatccggcagctca

SEQ ID NO: 17375 - DNA, 25 bp, Homo sapien
gaaccggcggattcgtttctctgca

SEQ ID NO: 17376 - DNA, 25 bp, Homo sapien
gtctccctagaaacaggcacccgtg

SEQ ID NO: 17377 - DNA, 25 bp, Homo sapien
acaggcacccgtgtctccatagcaa

SEQ ID NO: 17378 - DNA, 25 bp, Homo sapien
acacagcagcatgggacagtcaggg

SEQ ID NO: 17379 - DNA, 25 bp, Homo sapien
ggcgctgaccctttgtctctcgtcg

SEQ ID NO: 17380 - DNA, 25 bp, Homo sapien
cgttcgtgttcacgcgaggctgcac

SEQ ID NO: 17381 - DNA, 25 bp, Homo sapien
gcgaacccgcactcgttcgtgttca

SEQ ID NO: 17382 - DNA, 25 bp, Homo sapien
tcgcgggatgaagaagctgctccag

SEQ ID NO: 17383 - DNA, 25 bp, Homo sapien
tgttatgtcctacacacaggggcgc

SEQ ID NO: 17384 - DNA, 25 bp, Homo sapien
ggcgaccacaacatcacagagctgc

SEQ ID NO: 17385 - DNA, 25 bp, Homo sapien
agtcccaacggtgggctgacgcttc

SEQ ID NO: 17386 - DNA, 25 bp, Homo sapien
ctgcagctcatcaaggtccaggagg

SEQ ID NO: 17387 - DNA, 25 bp, Homo sapien
atgttccacagttttggtgaggccg

SEQ ID NO: 17388 - DNA, 25 bp, Homo sapien
tgcacccggatcttggtgacccgcg

SEQ ID NO: 17389 - DNA, 25 bp, Homo sapien
aggcagagcctgacggcgaccacaa

SEQ ID NO: 17390 - DNA, 25 bp, Homo sapien
gccctgcatgcttttcagagttaga

SEQ ID NO: 17391 - DNA, 25 bp, Homo sapien
cctgaccaaggactacggcaactca

SEQ ID NO: 17392 - DNA, 25 bp, Homo sapien
tccgcagtggccgataaagcaaacc

SEQ ID NO: 17393 - DNA, 25 bp, Homo sapien
ggcagcttacctgtcctggatgcta

SEQ ID NO: 17394 - DNA, 25 bp, Homo sapien
cgtacgcatggtttatcgccctgca

SEQ ID NO: 17395 - DNA, 25 bp, Homo sapien
tgcgaattttatttggtcccgtaga

SEQ ID NO: 17396 - DNA, 25 bp, Homo sapien
ggcatccgcctcgttttatggtttg

SEQ ID NO: 17397 - DNA, 25 bp, Homo sapien
tgactttgctgaacggagctgctcc

SEQ ID NO: 17398 - DNA, 25 bp, Homo sapien
ggcctgcatcaagtgtctggggaca

SEQ ID NO: 17399 - DNA, 25 bp, Homo sapien
tgtgccctaccacatcatgcgggtg

SEQ ID NO: 17400 - DNA, 25 bp, Homo sapien
ttcagcatccggaagcagcgcccat

SEQ ID NO: 17401 - DNA, 25 bp, Homo sapien
ttctctgtccagctggcagtcagcg

SEQ ID NO: 17402 - DNA, 25 bp, Homo sapien
tggagcgcttcctcttcacctgcaa

SEQ ID NO: 17403 - DNA, 25 bp, Homo sapien
ctggcggcctacagagcgtatagcc

SEQ ID NO: 17404 - DNA, 25 bp, Homo sapien
gccgtgctacgcagcccaggcatga

SEQ ID NO: 17405 - DNA, 25 bp, Homo sapien
ccaggcatgactgtggccgagaagc

SEQ ID NO: 17406 - DNA, 25 bp, Homo sapien
gtggtcgtagccaaagccggacacc

SEQ ID NO: 17407 - DNA, 25 bp, Homo sapien
ctcacgcgtgtcctctgacaagttg

SEQ ID NO: 17408 - DNA, 25 bp, Homo sapien
aagagctcctgcaggtcggtctcac

SEQ ID NO: 17409 - DNA, 25 bp, Homo sapien
attggccagtggtcttgtccttagc

SEQ ID NO: 17410 - DNA, 25 bp, Homo sapien
gcctgcccaccttggattggccagt

SEQ ID NO: 17411 - DNA, 25 bp, Homo sapien
gcgaccctaggacaagtgaccctca

SEQ ID NO: 17412 - DNA, 25 bp, Homo sapien
gcacgagctaggacaggcgacccta

SEQ ID NO: 17413 - DNA, 25 bp, Homo sapien
gtgtgcacgcttcggggataattac

SEQ ID NO: 17414 - DNA, 25 bp, Homo sapien
cccgccaagaaggactcactaggtg

SEQ ID NO: 17415 - DNA, 25 bp, Homo sapien
acattttgccctgaaagcggagcca

SEQ ID NO: 17416 - DNA, 25 bp, Homo sapien
cagcttatgtaattgcccgcgatgc

SEQ ID NO: 17417 - DNA, 25 bp, Homo sapien
gctcgcatcacagttccgggtaatc

SEQ ID NO: 17418 - DNA, 25 bp, Homo sapien
cttgtctttcgagaaccgggagctc

SEQ ID NO: 17419 - DNA, 25 bp, Homo sapien
ccttctacaaagcagcggggtgatc

SEQ ID NO: 17420 - DNA, 25 bp, Homo sapien
tcatccacatggacgcgggtgcata

SEQ ID NO: 17421 - DNA, 25 bp, Homo sapien
cgggtaatcaccgaggcagcttatg

SEQ ID NO: 17422 - DNA, 25 bp, Homo sapien
aaagtattctccacgcagcccaagc

SEQ ID NO: 17423 - DNA, 25 bp, Homo sapien
cggggaacacctggagttggcaaca

SEQ ID NO: 17424 - DNA, 25 bp, Homo sapien
ccaactgggcttcgaactgcggaaa

SEQ ID NO: 17425 - DNA, 25 bp, Homo sapien
aacgaagattaagtcagccaggccc

SEQ ID NO: 17426 - DNA, 25 bp, Homo sapien
gcgatcgccgactcactcaaagtct

SEQ ID NO: 17427 - DNA, 25 bp, Homo sapien
gtaggcatcgcaaaaagtattctcc

SEQ ID NO: 17428 - DNA, 25 bp, Homo sapien
gcgaaaacgagacttccggtgccgc

SEQ ID NO: 17429 - DNA, 25 bp, Homo sapien
ctcaaagtctccagtaggcatcgca

SEQ ID NO: 17430 - DNA, 25 bp, Homo sapien
caggttgatgtctgcgtggtagctc

SEQ ID NO: 17431 - DNA, 25 bp, Homo sapien
tggacttgtgggtgttctcaggcct

SEQ ID NO: 17432 - DNA, 25 bp, Homo sapien
ggccgcccatggagtacacctggac

SEQ ID NO: 17433 - DNA, 25 bp, Homo sapien
acacctggacgcactcgggcaggtc

SEQ ID NO: 17434 - DNA, 25 bp, Homo sapien
catactccacggtgcagcggccctg

SEQ ID NO: 17435 - DNA, 25 bp, Homo sapien
tgcacagccttgaagtccaccacgg

SEQ ID NO: 17436 - DNA, 25 bp, Homo sapien
ctcctcgtcgctccagtagagcagg

SEQ ID NO: 17437 - DNA, 25 bp, Homo sapien
ctccagtagagcaggttgatgtctg

SEQ ID NO: 17438 - DNA, 25 bp, Homo sapien
ccacggtccattttggcgccaaaca

SEQ ID NO: 17439 - DNA, 25 bp, Homo sapien
taccaaacggagagaggcgataccc

SEQ ID NO: 17440 - DNA, 25 bp, Homo sapien
ccaccgctgcttgaagaaggggacc

SEQ ID NO: 17441 - DNA, 25 bp, Homo sapien
gcctagtttctagccaccagggagc

SEQ ID NO: 17442 - DNA, 25 bp, Homo sapien
ggaaacgaacccaaagcttgctgta

SEQ ID NO: 17443 - DNA, 25 bp, Homo sapien
tcgtccaagctccacggtttgctgg

SEQ ID NO: 17444 - DNA, 25 bp, Homo sapien
tcctgtgcgaccaagctggagtcaa

SEQ ID NO: 17445 - DNA, 25 bp, Homo sapien
gccgccatcgagatgcacagctttg

SEQ ID NO: 17446 - DNA, 25 bp, Homo sapien
gaacttgctgtttcgggccaccgca

SEQ ID NO: 17447 - DNA, 25 bp, Homo sapien
ccgcaatgagcaccagaaggttttc

SEQ ID NO: 17448 - DNA, 25 bp, Homo sapien
gaaggttttccaccacaatggcgca

SEQ ID NO: 17449 - DNA, 25 bp, Homo sapien
ggttgcccagaaacaggtacattgc

SEQ ID NO: 17450 - DNA, 25 bp, Homo sapien
tcagcctcagcgtgacagagccaga

SEQ ID NO: 17451 - DNA, 25 bp, Homo sapien
tacagcttgaccttggcaatggcca

SEQ ID NO: 17452 - DNA, 25 bp, Homo sapien
tggtcaccacgcacagcacataatg

SEQ ID NO: 17453 - DNA, 25 bp, Homo sapien
cgcctagcacgatggtgaccgtctt

SEQ ID NO: 17454 - DNA, 25 bp, Homo sapien
ctccagtcgaaagcgctcggattca

SEQ ID NO: 17455 - DNA, 25 bp, Homo sapien
ttttgccctcgctcagccggagtca

SEQ ID NO: 17456 - DNA, 25 bp, Homo sapien
ccgaggcagaaagcccgacgtccga

SEQ ID NO: 17457 - DNA, 25 bp, Homo sapien
tgagccacgcagtcactttctcttt

SEQ ID NO: 17458 - DNA, 25 bp, Homo sapien
gacccatccctgagccggagttgaa

SEQ ID NO: 17459 - DNA, 25 bp, Homo sapien
gtgagtcaacccgtgcctgagaagg

SEQ ID NO: 17460 - DNA, 25 bp, Homo sapien
ccgcctcgagattctgggaagactg

SEQ ID NO: 17461 - DNA, 25 bp, Homo sapien
gcccggagcatctgacaaggacaga

SEQ ID NO: 17462 - DNA, 25 bp, Homo sapien
aggggtcgtctctcactttcgccca

SEQ ID NO: 17463 - DNA, 25 bp, Homo sapien
cgcgaggctccagtggccttgacct

SEQ ID NO: 17464 - DNA, 25 bp, Homo sapien
cccttgcagggcctgagttccctgg

SEQ ID NO: 17465 - DNA, 25 bp, Homo sapien
cagcgcgtgcgaccgagaacccgga

SEQ ID NO: 17466 - DNA, 25 bp, Homo sapien
gcggcgacagagaggtctgaccctt

SEQ ID NO: 17467 - DNA, 25 bp, Homo sapien
tcccggagcccgtgctgcgcaaagt

SEQ ID NO: 17468 - DNA, 25 bp, Homo sapien
tgcgcaaagtcgagctcccggtacc

SEQ ID NO: 17469 - DNA, 25 bp, Homo sapien
cagtgcaggcctgggtcgagtcctt

SEQ ID NO: 17470 - DNA, 25 bp, Homo sapien
cgccgcccgattgctttagcttgga

SEQ ID NO: 17471 - DNA, 25 bp, Homo sapien
ttaagagtacccagcctcgacgtgg

SEQ ID NO: 17472 - DNA, 25 bp, Homo sapien
gtggccaagcaaacacccgctcata

SEQ ID NO: 17473 - DNA, 25 bp, Homo sapien
cctcgtcaagatccaagctagctgc

SEQ ID NO: 17474 - DNA, 25 bp, Homo sapien
cgcttctcgagaaatgcccgtgtca

SEQ ID NO: 17475 - DNA, 25 bp, Homo sapien
cctcgcagcctggagtctcagttta

SEQ ID NO: 17476 - DNA, 25 bp, Homo sapien
cggtgtagaccgtgattcaagctta

SEQ ID NO: 17477 - DNA, 25 bp, Homo sapien
tctccggggaagttggcagtattta

SEQ ID NO: 17478 - DNA, 25 bp, Homo sapien
aggaaatacactttgcgctgccacg

SEQ ID NO: 17479 - DNA, 25 bp, Homo sapien
tacactgatgctcggtgaggcaccc

SEQ ID NO: 17480 - DNA, 25 bp, Homo sapien
cctcaatctcgacggcctggtggtc

SEQ ID NO: 17481 - DNA, 25 bp, Homo sapien
ctggatctggccaacgtgaccttga

SEQ ID NO: 17482 - DNA, 25 bp, Homo sapien
tgggtgtcttaccagctgctcgacg

SEQ ID NO: 17483 - DNA, 25 bp, Homo sapien
ttggagcctccggtcttaaagggca

SEQ ID NO: 17484 - DNA, 25 bp, Homo sapien
gtgaccttgacctacgagtttgctg

SEQ ID NO: 17485 - DNA, 25 bp, Homo sapien
agccgggtcatctattccgaaagcc

SEQ ID NO: 17486 - DNA, 25 bp, Homo sapien
cgggccagagcgaatgaccaagagc

SEQ ID NO: 17487 - DNA, 25 bp, Homo sapien
gccatcatgagccacttggcgcgca

SEQ ID NO: 17488 - DNA, 25 bp, Homo sapien
catggcgatgacctgcagcagccgc

SEQ ID NO: 17489 - DNA, 25 bp, Homo sapien
ccggagccttggacatggcgatgac

SEQ ID NO: 17490 - DNA, 25 bp, Homo sapien
tggtccacgtcgctgaccgacgagc

SEQ ID NO: 17491 - DNA, 25 bp, Homo sapien
tcttgcggaagtagccctcggcctc

SEQ ID NO: 17492 - DNA, 25 bp, Homo sapien
ttctgccgctttattgagcatccgc

SEQ ID NO: 17493 - DNA, 25 bp, Homo sapien
accaagagccggacctcggtttctg

SEQ ID NO: 17494 - DNA, 25 bp, Homo sapien
cactgtgtggccaccaatgcgcatg

SEQ ID NO: 17495 - DNA, 25 bp, Homo sapien
acgcgggcacttaccactgtgtggc

SEQ ID NO: 17496 - DNA, 25 bp, Homo sapien
tacctgcccaagtcaccagacgtgg

SEQ ID NO: 17497 - DNA, 25 bp, Homo sapien
gcgccaccggagatggatgaatcta

SEQ ID NO: 17498 - DNA, 25 bp, Homo sapien
tcctggcacccggtatctacgtctg

SEQ ID NO: 17499 - DNA, 25 bp, Homo sapien
ttaggcaggatctgtgggacaaccc

SEQ ID NO: 17500 - DNA, 25 bp, Homo sapien
gggctgcccagaacgcattacttgg

SEQ ID NO: 17501 - DNA, 25 bp, Homo sapien
ctccgtggccaaaacagtcgtcgtg

SEQ ID NO: 17502 - DNA, 25 bp, Homo sapien
gcccgctgcaccctgggtaaataca

SEQ ID NO: 17503 - DNA, 25 bp, Homo sapien
cttcaccaaggccaggagcttagcg

SEQ ID NO: 17504 - DNA, 25 bp, Homo sapien
ggagccgagcggattctaatttaga

SEQ ID NO: 17505 - DNA, 25 bp, Homo sapien
acgctgagtagacacgtgcccgctg

SEQ ID NO: 17506 - DNA, 25 bp, Homo sapien
ggctcgagctcacacacgctgagta

SEQ ID NO: 17507 - DNA, 25 bp, Homo sapien
gtcccttgttctcgcgtggatgtca

SEQ ID NO: 17508 - DNA, 25 bp, Homo sapien
ggagtcaaaagcatcaccctcggtc

SEQ ID NO: 17509 - DNA, 25 bp, Homo sapien
tttgggaagggcaacccagcatccc

SEQ ID NO: 17510 - DNA, 25 bp, Homo sapien
acccgggagaacgtgaccatctaca

SEQ ID NO: 17511 - DNA, 25 bp, Homo sapien
agcgctcggagttagttcaaacttg

SEQ ID NO: 17512 - DNA, 25 bp, Homo sapien
gctgcactctggacggactgtttcc

SEQ ID NO: 17513 - DNA, 25 bp, Homo sapien
tgagtcctgatgtcaccctcgaagg

SEQ ID NO: 17514 - DNA, 25 bp, Homo sapien
ctccgtgccttgaggatgataatac

SEQ ID NO: 17515 - DNA, 25 bp, Homo sapien
cgcacggactgggactgtttgaaaa

SEQ ID NO: 17516 - DNA, 25 bp, Homo sapien
gagccaatttctcgtgtcgcgccga

SEQ ID NO: 17517 - DNA, 25 bp, Homo sapien
tctgttccaagtcccggtgttcaaa

SEQ ID NO: 17518 - DNA, 25 bp, Homo sapien
ggtggtctcccatcgatcgttgtgg

SEQ ID NO: 17519 - DNA, 25 bp, Homo sapien
caacagcacactgagcgtggcaggc

SEQ ID NO: 17520 - DNA, 25 bp, Homo sapien
aacttcacgttgacctgccgcgcgg

SEQ ID NO: 17521 - DNA, 25 bp, Homo sapien
tgcgcccaggaggaaacttcacgtt

SEQ ID NO: 17522 - DNA, 25 bp, Homo sapien
ggggccctcaacatcggcctgtcga

SEQ ID NO: 17523 - DNA, 25 bp, Homo sapien
accggccagtggtggccgaacttgc

SEQ ID NO: 17524 - DNA, 25 bp, Homo sapien
ttctgtgcccttcagaccggccagt

SEQ ID NO: 17525 - DNA, 25 bp, Homo sapien
cggcctgtcgagcaacaacagcaca

SEQ ID NO: 17526 - DNA, 25 bp, Homo sapien
tccaccgcctgcaagaagggcgagt

SEQ ID NO: 17527 - DNA, 25 bp, Homo sapien
cggagggcgaggtcttcgccataca

SEQ ID NO: 17528 - DNA, 25 bp, Homo sapien
gccggcctggccttctacgtgcagt

SEQ ID NO: 17529 - DNA, 25 bp, Homo sapien
caagaagggcgagtacaacgtgcag

SEQ ID NO: 17530 - DNA, 25 bp, Homo sapien
cgaggtcttcgccatacagctgaca

SEQ ID NO: 17531 - DNA, 25 bp, Homo sapien
gtcttcgccatacagctgacatcgg

SEQ ID NO: 17532 - DNA, 25 bp, Homo sapien
atacagctgacatcggcgtgagccc

SEQ ID NO: 17533 - DNA, 25 bp, Homo sapien
ctcaggcgaggccgtgtgtctgaac

SEQ ID NO: 17534 - DNA, 25 bp, Homo sapien
gcgccagaagctttgctggcattga

SEQ ID NO: 17535 - DNA, 25 bp, Homo sapien
cacccgatgaaacccacctgggagg

SEQ ID NO: 17536 - DNA, 25 bp, Homo sapien
cagctgagagcgaccagcctcggcg

SEQ ID NO: 17537 - DNA, 25 bp, Homo sapien
tcttggtagaggatgcgatgagccc

SEQ ID NO: 17538 - DNA, 25 bp, Homo sapien
gcttttttcaggtcatccgcgcacc

SEQ ID NO: 17539 - DNA, 25 bp, Homo sapien
ctttctggcttttttcaggtcatcc

SEQ ID NO: 17540 - DNA, 25 bp, Homo sapien
gtccgggattggctcggcctccatt

SEQ ID NO: 17541 - DNA, 25 bp, Homo sapien
ctcggcggcacctttcctctttctg

SEQ ID NO: 17542 - DNA, 25 bp, Homo sapien
tcacgtgactcaccgactgagcatg

SEQ ID NO: 17543 - DNA, 25 bp, Homo sapien
cccaggtacctgtcgcttgaaactt

SEQ ID NO: 17544 - DNA, 25 bp, Homo sapien
cgcgagcctggaaaacacggttcgg

SEQ ID NO: 17545 - DNA, 25 bp, Homo sapien
atctgacggattaacgctgcccgcc

SEQ ID NO: 17546 - DNA, 25 bp, Homo sapien
tcgcttgaaactttctggttgtccc

SEQ ID NO: 17547 - DNA, 25 bp, Homo sapien
gcctgcagtagaaccctggcactca

SEQ ID NO: 17548 - DNA, 25 bp, Homo sapien
ggcggccatgacatgcatcacgtga

SEQ ID NO: 17549 - DNA, 25 bp, Homo sapien
cccgccggcatctgacggattaacg

SEQ ID NO: 17550 - DNA, 25 bp, Homo sapien
cctccgccatctcagccgtctcata

SEQ ID NO: 17551 - DNA, 25 bp, Homo sapien
cctctgcccgcacaggctcaccgtg

SEQ ID NO: 17552 - DNA, 25 bp, Homo sapien
tgagagcggccagcatactgcggcc

SEQ ID NO: 17553 - DNA, 25 bp, Homo sapien
cccaggggcgcagaaggagactcgc

SEQ ID NO: 17554 - DNA, 25 bp, Homo sapien
cagaaggagactcgcaggtggctgc

SEQ ID NO: 17555 - DNA, 25 bp, Homo sapien
gcagcgatgagagcggccagcatac

SEQ ID NO: 17556 - DNA, 25 bp, Homo sapien
caccgcgaagcccttcagctgccca

SEQ ID NO: 17557 - DNA, 25 bp, Homo sapien
agggacaggccgtccgcctgctgct

SEQ ID NO: 17558 - DNA, 25 bp, Homo sapien
tacgatagtcaccacgcccagggtc

SEQ ID NO: 17559 - DNA, 25 bp, Homo sapien
ccgtcgtcactctcggtagcattta

SEQ ID NO: 17560 - DNA, 25 bp, Homo sapien
tggacgctactgttcctgtgcaaga

SEQ ID NO: 17561 - DNA, 25 bp, Homo sapien
gcactgcaggacgtgtctcgtttta

SEQ ID NO: 17562 - DNA, 25 bp, Homo sapien
gtgctccctgaagacgtacattaag

SEQ ID NO: 17563 - DNA, 25 bp, Homo sapien
tcgcagcgacgctactcagtggatg

SEQ ID NO: 17564 - DNA, 25 bp, Homo sapien
aggagcgtctaatctttccagggca

SEQ ID NO: 17565 - DNA, 25 bp, Homo sapien
ccattgcttctgtcggctgcataga

SEQ ID NO: 17566 - DNA, 25 bp, Homo sapien
cggatggcacgtggcaccaagcaaa

SEQ ID NO: 17567 - DNA, 25 bp, Homo sapien
gcacgcggtagtactcgtggccttc

SEQ ID NO: 17568 - DNA, 25 bp, Homo sapien
cacggccttggctaggccaaagtcc

SEQ ID NO: 17569 - DNA, 25 bp, Homo sapien
tgcagataggccatgccctggggac

SEQ ID NO: 17570 - DNA, 25 bp, Homo sapien
ccaaacagttcggaggtcagtgcaa

SEQ ID NO: 17571 - DNA, 25 bp, Homo sapien
tgagagcagactgcaccggatcgct

SEQ ID NO: 17572 - DNA, 25 bp, Homo sapien
gatcgctcaggccagcccaagctga

SEQ ID NO: 17573 - DNA, 25 bp, Homo sapien
accagcctgtcgttgtccagcagca

SEQ ID NO: 17574 - DNA, 25 bp, Homo sapien
ggtcggatcgtagcagtacaagctg

SEQ ID NO: 17575 - DNA, 25 bp, Homo sapien
ttggtcggatcgtagcagtacaagc

SEQ ID NO: 17576 - DNA, 25 bp, Homo sapien
cggatcgtagcagtacaagctgacc

SEQ ID NO: 17577 - DNA, 25 bp, Homo sapien
tcgtagcagtacaagctgaccttgc

SEQ ID NO: 17578 - DNA, 25 bp, Homo sapien
caagctgaccttgccgaagtgaccc

SEQ ID NO: 17579 - DNA, 25 bp, Homo sapien
ctgaccttgccgaagtgaccctggt

SEQ ID NO: 17580 - DNA, 25 bp, Homo sapien
cttgccgaagtgaccctggtcggga

SEQ ID NO: 17581 - DNA, 25 bp, Homo sapien
tcgttggtcggatcgtagcagtaca

SEQ ID NO: 17582 - DNA, 25 bp, Homo sapien
agtctgccttgagggctttcaccgc

SEQ ID NO: 17583 - DNA, 25 bp, Homo sapien
accatctcgccagtgccgtcgttgg

SEQ ID NO: 17584 - DNA, 25 bp, Homo sapien
caagtctctaggactcgccgggtcc

SEQ ID NO: 17585 - DNA, 25 bp, Homo sapien
cttggtcctcgcagcagcccttgta

SEQ ID NO: 17586 - DNA, 25 bp, Homo sapien
gcagcagcccttgtacttgatgatg

SEQ ID NO: 17587 - DNA, 25 bp, Homo sapien
tacttgatgatgtgctcgtggtaga

SEQ ID NO: 17588 - DNA, 25 bp, Homo sapien
ccgcagtctgccttgagggctttca

SEQ ID NO: 17589 - DNA, 25 bp, Homo sapien
gcgcagaatgtcaatctcctgcttc

SEQ ID NO: 17590 - DNA, 25 bp, Homo sapien
cctgaccctaggacacagctgcatg

SEQ ID NO: 17591 - DNA, 25 bp, Homo sapien
ggcaccaggtgctcccatccaagtg

SEQ ID NO: 17592 - DNA, 25 bp, Homo sapien
tgttctccctgctcgtcaccattgg

SEQ ID NO: 17593 - DNA, 25 bp, Homo sapien
tttttgccatggtggcggcactctc

SEQ ID NO: 17594 - DNA, 25 bp, Homo sapien
actctcattggtcctggggctcatt

SEQ ID NO: 17595 - DNA, 25 bp, Homo sapien
ccctccgtgctgtggaattgggtca

SEQ ID NO: 17596 - DNA, 25 bp, Homo sapien
cctcacctcggtgttcaaagctgca

SEQ ID NO: 17597 - DNA, 25 bp, Homo sapien
atgcgctgtcgcttctgctattggc

SEQ ID NO: 17598 - DNA, 25 bp, Homo sapien
agccggcatacacgtccacagggtg

SEQ ID NO: 17599 - DNA, 25 bp, Homo sapien
tacgccgcaggaaggagttgaagtt

SEQ ID NO: 17600 - DNA, 25 bp, Homo sapien
ggatcacgtccgtcaccagggctgt

SEQ ID NO: 17601 - DNA, 25 bp, Homo sapien
aacccgtggccagctggatcacgtc

SEQ ID NO: 17602 - DNA, 25 bp, Homo sapien
cggagcagatgtcctgcgtgatgta

SEQ ID NO: 17603 - DNA, 25 bp, Homo sapien
ggtcttcctgtaagaggcgtccagc

SEQ ID NO: 17604 - DNA, 25 bp, Homo sapien
tccgagatgaccgagttgaagtaca

SEQ ID NO: 17605 - DNA, 25 bp, Homo sapien
actgcgtgatctgcgtgagcccgca

SEQ ID NO: 17606 - DNA, 25 bp, Homo sapien
gtggttcaccttccgcttcgacttg

SEQ ID NO: 17607 - DNA, 25 bp, Homo sapien
atcgtcctcgaaacagcagcccttg

SEQ ID NO: 17608 - DNA, 25 bp, Homo sapien
cttgtccagcgccagcttgatgttg

SEQ ID NO: 17609 - DNA, 25 bp, Homo sapien
ttgctggacgccgagtcaatgaagc

SEQ ID NO: 17610 - DNA, 25 bp, Homo sapien
ggctcaagggctcgttcaaggtcaa

SEQ ID NO: 17611 - DNA, 25 bp, Homo sapien
ggtacagtaggtttcccaccactgc

SEQ ID NO: 17612 - DNA, 25 bp, Homo sapien
ggcaagcaagactgccgcctccgtg

SEQ ID NO: 17613 - DNA, 25 bp, Homo sapien
gcgcggccagacttcggctttgcaa

SEQ ID NO: 17614 - DNA, 25 bp, Homo sapien
ctctggggagtcgtctgtcccttac

SEQ ID NO: 17615 - DNA, 25 bp, Homo sapien
tacccaatccctgcaccggagatgg

SEQ ID NO: 17616 - DNA, 25 bp, Homo sapien
ggacggcctatcaactctggggagt

SEQ ID NO: 17617 - DNA, 25 bp, Homo sapien
tgtccacgttccagggcatgctctt

SEQ ID NO: 17618 - DNA, 25 bp, Homo sapien
gcacaccttgctgaagccgtctttg

SEQ ID NO: 17619 - DNA, 25 bp, Homo sapien
ggttgcaggctctctggctgcgcat

SEQ ID NO: 17620 - DNA, 25 bp, Homo sapien
ccctgaccaggcattgggtgcgcat

SEQ ID NO: 17621 - DNA, 25 bp, Homo sapien
ggtggtgacgaagccatgagcatca

SEQ ID NO: 17622 - DNA, 25 bp, Homo sapien
ttactctaagcatgcagggcctcga

SEQ ID NO: 17623 - DNA, 25 bp, Homo sapien
agccttgggccaggattatctcaga

SEQ ID NO: 17624 - DNA, 25 bp, Homo sapien
taccaggataataggccgtgttgca

SEQ ID NO: 17625 - DNA, 25 bp, Homo sapien
ttatctcagattaaagggtgctccc

SEQ ID NO: 17626 - DNA, 25 bp, Homo sapien
gggctttccttgtcgtcacagtctg

SEQ ID NO: 17627 - DNA, 25 bp, Homo sapien
agagtctagcccacggcgcgtattc

SEQ ID NO: 17628 - DNA, 25 bp, Homo sapien
gcgcctgatgactcctcggactttc

SEQ ID NO: 17629 - DNA, 25 bp, Homo sapien
ccggggctctaaggactccattact

SEQ ID NO: 17630 - DNA, 25 bp, Homo sapien
cccaacagctcggaggagacgcttc

SEQ ID NO: 17631 - DNA, 25 bp, Homo sapien
gccctctagtgaccacggctatttc

SEQ ID NO: 17632 - DNA, 25 bp, Homo sapien
tttggcttggtcttgtaggaggccc

SEQ ID NO: 17633 - DNA, 25 bp, Homo sapien
cactgatggcagatgcgtttggctt

SEQ ID NO: 17634 - DNA, 25 bp, Homo sapien
tgggagctcccagttttttctgcgg

SEQ ID NO: 17635 - DNA, 25 bp, Homo sapien
cagagcgcacccgtcttcgggaacg

SEQ ID NO: 17636 - DNA, 25 bp, Homo sapien
atgaagaggagtcgcagtgccctgt

SEQ ID NO: 17637 - DNA, 25 bp, Homo sapien
accacattggtggtgcgtcagtccg

SEQ ID NO: 17638 - DNA, 25 bp, Homo sapien
gacgtcctccgacactacagtcaga

SEQ ID NO: 17639 - DNA, 25 bp, Homo sapien
agaccacgtagggatgcacatcctc

SEQ ID NO: 17640 - DNA, 25 bp, Homo sapien
cctccaaataggtagcacatgtgcg

SEQ ID NO: 17641 - DNA, 25 bp, Homo sapien
ctcgccatgatggaccgactgactg

SEQ ID NO: 17642 - DNA, 25 bp, Homo sapien
cgactgactgacactctggcaacca

SEQ ID NO: 17643 - DNA, 25 bp, Homo sapien
aaccagtccggtgtctgcttccaga

SEQ ID NO: 17644 - DNA, 25 bp, Homo sapien
agcgcttgagaacacattcacagtc

SEQ ID NO: 17645 - DNA, 25 bp, Homo sapien
tttgaagacagacgagttccagcgc

SEQ ID NO: 17646 - DNA, 25 bp, Homo sapien
tgcttattgagcgtcctggagagcg

SEQ ID NO: 17647 - DNA, 25 bp, Homo sapien
agggacgccgccagtcccggagcaa

SEQ ID NO: 17648 - DNA, 25 bp, Homo sapien
agtcccggagcaaagcaaagtcgcc

SEQ ID NO: 17649 - DNA, 25 bp, Homo sapien
cgcccggtattattattttatgctt

SEQ ID NO: 17650 - DNA, 25 bp, Homo sapien
ttttatgcttattgagcgtcctgga

SEQ ID NO: 17651 - DNA, 25 bp, Homo sapien
aggaacctggccgaaaagttgcagc

SEQ ID NO: 17652 - DNA, 25 bp, Homo sapien
ctggacgacgaggaaggcacagcct

SEQ ID NO: 17653 - DNA, 25 bp, Homo sapien
aaagttgcagccgtggagttcccgt

SEQ ID NO: 17654 - DNA, 25 bp, Homo sapien
tcgagcgggcccagctcgacgtcag

SEQ ID NO: 17655 - DNA, 25 bp, Homo sapien
gtgcagacccgggaacgctcgaccg

SEQ ID NO: 17656 - DNA, 25 bp, Homo sapien
cgatcagagacctcgagcgggccca

SEQ ID NO: 17657 - DNA, 25 bp, Homo sapien
ggcgatcagcgatcagagacctcga

SEQ ID NO: 17658 - DNA, 25 bp, Homo sapien
gcgcacggcgatcagcgatcagaga

SEQ ID NO: 17659 - DNA, 25 bp, Homo sapien
gacgacggcgcttggctcccatgcg

SEQ ID NO: 17660 - DNA, 25 bp, Homo sapien
aggccgcagacaccttgggcctggc

SEQ ID NO: 17661 - DNA, 25 bp, Homo sapien
aagtgtgcgtccgactccgcaggac

SEQ ID NO: 17662 - DNA, 25 bp, Homo sapien
ttgaggggatccaggcctcacaacg

SEQ ID NO: 17663 - DNA, 25 bp, Homo sapien
cctcacaacgtcttgagagtggccc

SEQ ID NO: 17664 - DNA, 25 bp, Homo sapien
ggctacagcagaatagggacccagc

SEQ ID NO: 17665 - DNA, 25 bp, Homo sapien
gggacccagcgcactcgcagaacga

SEQ ID NO: 17666 - DNA, 25 bp, Homo sapien
ttcccgactacgattggctggtgta

SEQ ID NO: 17667 - DNA, 25 bp, Homo sapien
ggctggtgtaattgtcatcacttga

SEQ ID NO: 17668 - DNA, 25 bp, Homo sapien
tcatcacttgaaaaggcagccaatg

SEQ ID NO: 17669 - DNA, 25 bp, Homo sapien
tcgttcctagtctcttcggcagacc

SEQ ID NO: 17670 - DNA, 25 bp, Homo sapien
cgccgacggcatagatgtggccatc

SEQ ID NO: 17671 - DNA, 25 bp, Homo sapien
gtcggactgcaggatctcgcacttc

SEQ ID NO: 17672 - DNA, 25 bp, Homo sapien
ccgtcactggggttgtaagcctcca

SEQ ID NO: 17673 - DNA, 25 bp, Homo sapien
agggtgagctcctcgaagatcttga

SEQ ID NO: 17674 - DNA, 25 bp, Homo sapien
ctgcatctgcaggaagttcggcgtc

SEQ ID NO: 17675 - DNA, 25 bp, Homo sapien
gcctggacgtagaaccgtcgctgtt

SEQ ID NO: 17676 - DNA, 25 bp, Homo sapien
cgtacttgacccagttgatgcaggc

SEQ ID NO: 17677 - DNA, 25 bp, Homo sapien
cgtcgctgttcgcagtcgtacttga

SEQ ID NO: 17678 - DNA, 25 bp, Homo sapien
aaggagcggcgattctcccgccctt

SEQ ID NO: 17679 - DNA, 25 bp, Homo sapien
cctgccttaccttggctgtagggga

SEQ ID NO: 17680 - DNA, 25 bp, Homo sapien
gggaccgcgacccagtccaggagat

SEQ ID NO: 17681 - DNA, 25 bp, Homo sapien
ggcacgcgaccctgagcgcgcttag

SEQ ID NO: 17682 - DNA, 25 bp, Homo sapien
ggcgcccgccgtgtcacaataaaag

SEQ ID NO: 17683 - DNA, 25 bp, Homo sapien
tcaccatgactaagcagagccgggc

SEQ ID NO: 17684 - DNA, 25 bp, Homo sapien
agcgcgcgcaggtcaccatgactaa

SEQ ID NO: 17685 - DNA, 25 bp, Homo sapien
aacaaaaatatccacccaggtcgcg

SEQ ID NO: 17686 - DNA, 25 bp, Homo sapien
ggcacgccacgtcgagcaacagcag

SEQ ID NO: 17687 - DNA, 25 bp, Homo sapien
ttcagaagtgagttggccatggcca

SEQ ID NO: 17688 - DNA, 25 bp, Homo sapien
ctagattctctagcacgatgaaggc

SEQ ID NO: 17689 - DNA, 25 bp, Homo sapien
agtgagtgccacgaagacgcctccc

SEQ ID NO: 17690 - DNA, 25 bp, Homo sapien
gcgtagagtgcacagatagcggcca

SEQ ID NO: 17691 - DNA, 25 bp, Homo sapien
agatccgacaacgtgaggctgccca

SEQ ID NO: 17692 - DNA, 25 bp, Homo sapien
gtccaggcgacccaggcaattccag

SEQ ID NO: 17693 - DNA, 25 bp, Homo sapien
tggcgtccgagcaccaacaacacgg

SEQ ID NO: 17694 - DNA, 25 bp, Homo sapien
cgggcgacacccagcactcggagga

SEQ ID NO: 17695 - DNA, 25 bp, Homo sapien
atgtgaccctgcactgcaccgacgg

SEQ ID NO: 17696 - DNA, 25 bp, Homo sapien
acctcgctgaggaatgtgaccctgc

SEQ ID NO: 17697 - DNA, 25 bp, Homo sapien
agcacaggtgccagtgctgccagga

SEQ ID NO: 17698 - DNA, 25 bp, Homo sapien
ctgcccacaggtactcgctcgaggg

SEQ ID NO: 17699 - DNA, 25 bp, Homo sapien
ggtactcgctcgagggcaacacggt

SEQ ID NO: 17700 - DNA, 25 bp, Homo sapien
acccagcactcggaggaggcggaac

SEQ ID NO: 17701 - DNA, 25 bp, Homo sapien
ttcagctacaccgaggtggaagagt

SEQ ID NO: 17702 - DNA, 25 bp, Homo sapien
gccgctcgctggtgcgcgtttccat

SEQ ID NO: 17703 - DNA, 25 bp, Homo sapien
gactgtctccgtgtctctcacggtc

SEQ ID NO: 17704 - DNA, 25 bp, Homo sapien
tttcggggtctctgactgtctccgt

SEQ ID NO: 17705 - DNA, 25 bp, Homo sapien
ggctctttgtctgggcgcgtcctcc

SEQ ID NO: 17706 - DNA, 25 bp, Homo sapien
ctccttggtggagatcatggtgccg

SEQ ID NO: 17707 - DNA, 25 bp, Homo sapien
cttgttcttctccttggtggagatc

SEQ ID NO: 17708 - DNA, 25 bp, Homo sapien
aagcgtcatgctgtccttcgggatc

SEQ ID NO: 17709 - DNA, 25 bp, Homo sapien
cgcccggagcatcggagacaaaaga

SEQ ID NO: 17710 - DNA, 25 bp, Homo sapien
ggcgactggcacaggcgagccctca

SEQ ID NO: 17711 - DNA, 25 bp, Homo sapien
ccaaaggtccagtgcagtccactca

SEQ ID NO: 17712 - DNA, 25 bp, Homo sapien
ggtccagtgcagtccactcactctg

SEQ ID NO: 17713 - DNA, 25 bp, Homo sapien
gtccactcactctgcgccctggtcg

SEQ ID NO: 17714 - DNA, 25 bp, Homo sapien
cgcagtcgcgctgccttgaaccgag

SEQ ID NO: 17715 - DNA, 25 bp, Homo sapien
ccagcctgtgccactcgccgcggca

SEQ ID NO: 17716 - DNA, 25 bp, Homo sapien
tcccagggacgctccatcgcggtgg

SEQ ID NO: 17717 - DNA, 25 bp, Homo sapien
ccttgaaccgagtgagcggacgccg

SEQ ID NO: 17718 - DNA, 25 bp, Homo sapien
ctgcaggtgcgcagtcagtctcacc

SEQ ID NO: 17719 - DNA, 25 bp, Homo sapien
cctgccaggaggtcagtcctgggcc

SEQ ID NO: 17720 - DNA, 25 bp, Homo sapien
ctgctgcctccgataagggcctgaa

SEQ ID NO: 17721 - DNA, 25 bp, Homo sapien
ctggcccgctaagatggcgatggct

SEQ ID NO: 17722 - DNA, 25 bp, Homo sapien
ggcgcgtccatgaactcagtgtcgc

SEQ ID NO: 17723 - DNA, 25 bp, Homo sapien
tgagccggacgaagtggacaagttc

SEQ ID NO: 17724 - DNA, 25 bp, Homo sapien
aaggccaagttcctgacagcctgga

SEQ ID NO: 17725 - DNA, 25 bp, Homo sapien
cctggaacaacgtcaagtacggtga

SEQ ID NO: 17726 - DNA, 25 bp, Homo sapien
gcaggtcgtcgatgatgtcctcgta

SEQ ID NO: 17727 - DNA, 25 bp, Homo sapien
gccggtaatactcatccaggtactc

SEQ ID NO: 17728 - DNA, 25 bp, Homo sapien
ccaggtactcctcgaacgtcttgtc

SEQ ID NO: 17729 - DNA, 25 bp, Homo sapien
ctcgcgctttttcttcctcggctgg

SEQ ID NO: 17730 - DNA, 25 bp, Homo sapien
gtcgtagtcggcgtccatctgccag

SEQ ID NO: 17731 - DNA, 25 bp, Homo sapien
acttgaagcgacagggcaggtcgtc

SEQ ID NO: 17732 - DNA, 25 bp, Homo sapien
cgctttttcttcctcggctggctgg

SEQ ID NO: 17733 - DNA, 25 bp, Homo sapien
tgtcctcgtagtccagccggtaata

SEQ ID NO: 17734 - DNA, 25 bp, Homo sapien
cgcccgcatccacttgtaaacgagg

SEQ ID NO: 17735 - DNA, 25 bp, Homo sapien
tccgttccgacagcgaaaaccgctg

SEQ ID NO: 17736 - DNA, 25 bp, Homo sapien
tggcgccctgggaattactattctc

SEQ ID NO: 17737 - DNA, 25 bp, Homo sapien
taaacgaggcgtaccgctgctaacc

SEQ ID NO: 17738 - DNA, 25 bp, Homo sapien
actgcgggacacagacgggatgccc

SEQ ID NO: 17739 - DNA, 25 bp, Homo sapien
gctcgtcgcttgagtccgactcgga

SEQ ID NO: 17740 - DNA, 25 bp, Homo sapien
cgtagcgatccttcactgcgggaca

SEQ ID NO: 17741 - DNA, 25 bp, Homo sapien
gtagcggttgtaccgcgcggcaaac

SEQ ID NO: 17742 - DNA, 25 bp, Homo sapien
tggcaaccggtggaccgccggcaat

SEQ ID NO: 17743 - DNA, 25 bp, Homo sapien
ggctggtttaactgacccagggaga

SEQ ID NO: 17744 - DNA, 25 bp, Homo sapien
cctgattggtcagagtgtggcaacc

SEQ ID NO: 17745 - DNA, 25 bp, Homo sapien
gaaacgcgtcgctcctgattggtca

SEQ ID NO: 17746 - DNA, 25 bp, Homo sapien
cacagggcctgcataaccagtggct

SEQ ID NO: 17747 - DNA, 25 bp, Homo sapien
cgctactgtgtagcggcaccgcgtt

SEQ ID NO: 17748 - DNA, 25 bp, Homo sapien
gttttcttacaaactcgctactgtg

SEQ ID NO: 17749 - DNA, 25 bp, Homo sapien
catgtcgacactggcggcctgcaaa

SEQ ID NO: 17750 - DNA, 25 bp, Homo sapien
cttatttcaaaacgggctgcgattc

SEQ ID NO: 17751 - DNA, 25 bp, Homo sapien
tgagcttgatggtaccgacgatttc

SEQ ID NO: 17752 - DNA, 25 bp, Homo sapien
tcctgacagaaacaccttgagcttg

SEQ ID NO: 17753 - DNA, 25 bp, Homo sapien
ccgcagctctggcattcctgacaga

SEQ ID NO: 17754 - DNA, 25 bp, Homo sapien
gtcattgaggcccagccgcagctct

SEQ ID NO: 17755 - DNA, 25 bp, Homo sapien
agctcgaagagcacgcggtcattga

SEQ ID NO: 17756 - DNA, 25 bp, Homo sapien
ccctaaatgcttacggccagtgagc

SEQ ID NO: 17757 - DNA, 25 bp, Homo sapien
cgatttcgctcagaaggacgctgcc

SEQ ID NO: 17758 - DNA, 25 bp, Homo sapien
ttccttcttcctgcggaagcgcctg

SEQ ID NO: 17759 - DNA, 25 bp, Homo sapien
agagcccaggtgtgtgcgtcttaaa

SEQ ID NO: 17760 - DNA, 25 bp, Homo sapien
tgtcggccaacttgaagatggctgc

SEQ ID NO: 17761 - DNA, 25 bp, Homo sapien
tgaatccctgggagcgagacctcac

SEQ ID NO: 17762 - DNA, 25 bp, Homo sapien
cgtccagaatgaagacagccgaggc

SEQ ID NO: 17763 - DNA, 25 bp, Homo sapien
agcgctgtcggccaacttgaagatg

SEQ ID NO: 17764 - DNA, 25 bp, Homo sapien
accttgcccttaacgtccagaatga

SEQ ID NO: 17765 - DNA, 25 bp, Homo sapien
cacctgtccgtctcccaactcctca

SEQ ID NO: 17766 - DNA, 25 bp, Homo sapien
ccatggaggacgagcggaaaaacgg

SEQ ID NO: 17767 - DNA, 25 bp, Homo sapien
gccctctcgaggctcccattggagg

SEQ ID NO: 17768 - DNA, 25 bp, Homo sapien
acatctgagaccctaggcaccggcg

SEQ ID NO: 17769 - DNA, 25 bp, Homo sapien
ggggacatctgagaccctaggcacc

SEQ ID NO: 17770 - DNA, 25 bp, Homo sapien
agcctacggtaggagccgcctccgg

SEQ ID NO: 17771 - DNA, 25 bp, Homo sapien
cgcatccgacactgcgcggatccca

SEQ ID NO: 17772 - DNA, 25 bp, Homo sapien
cggagcctacggtaggagccgcctc

SEQ ID NO: 17773 - DNA, 25 bp, Homo sapien
tgagaccctaggcaccggcgctgcg

SEQ ID NO: 17774 - DNA, 25 bp, Homo sapien
gacgagcggccccactactacggga

SEQ ID NO: 17775 - DNA, 25 bp, Homo sapien
ctccctccagactcgggagggtcga

SEQ ID NO: 17776 - DNA, 25 bp, Homo sapien
agtgcctccctccagactcgggagg

SEQ ID NO: 17777 - DNA, 25 bp, Homo sapien
agccgccgccagtcgcgcggtcagt

SEQ ID NO: 17778 - DNA, 25 bp, Homo sapien
gtcccttagtctgggcagctgccca

SEQ ID NO: 17779 - DNA, 25 bp, Homo sapien
ctcccgggtcccttagtctgggcag

SEQ ID NO: 17780 - DNA, 25 bp, Homo sapien
ttcccagggtgaagccgcagggttc

SEQ ID NO: 17781 - DNA, 25 bp, Homo sapien
tactacgggaaacacggtaggcagc

SEQ ID NO: 17782 - DNA, 25 bp, Homo sapien
tgctactgagttcggccggtccgag

SEQ ID NO: 17783 - DNA, 25 bp, Homo sapien
gaggctcagcgaagctccaaaacca

SEQ ID NO: 17784 - DNA, 25 bp, Homo sapien
accaattttacggactgtactactg

SEQ ID NO: 17785 - DNA, 25 bp, Homo sapien
tgtactactgatccacctgtcgggg

SEQ ID NO: 17786 - DNA, 25 bp, Homo sapien
ctctacccgcagtttgacgaaaatg

SEQ ID NO: 17787 - DNA, 25 bp, Homo sapien
cgaaaatggtcgtttccagatgctt

SEQ ID NO: 17788 - DNA, 25 bp, Homo sapien
ctgagtaatcagagccaaagcgtta

SEQ ID NO: 17789 - DNA, 25 bp, Homo sapien
gtaggatttcctcgctaagctccac

SEQ ID NO: 17790 - DNA, 25 bp, Homo sapien
gttcgcattagctcctgttgcgggg

SEQ ID NO: 17791 - DNA, 25 bp, Homo sapien
cccacggttcgcattagctcctgtt

SEQ ID NO: 17792 - DNA, 25 bp, Homo sapien
tactactgggccctgcgcaagccgg

SEQ ID NO: 17793 - DNA, 25 bp, Homo sapien
ttggcgcgctcatcctggccattgt

SEQ ID NO: 17794 - DNA, 25 bp, Homo sapien
tggccattgtgcagatcatccgtgt

SEQ ID NO: 17795 - DNA, 25 bp, Homo sapien
atcatccgtgtgatactcgagtacc

SEQ ID NO: 17796 - DNA, 25 bp, Homo sapien
cagcggctgaaaggtacgtcccacc

SEQ ID NO: 17797 - DNA, 25 bp, Homo sapien
ctcgagtacctggatcagcggctga

SEQ ID NO: 17798 - DNA, 25 bp, Homo sapien
gatttcagggacatagaacggggtc

SEQ ID NO: 17799 - DNA, 25 bp, Homo sapien
tcggatttcagggacatagaacggg

SEQ ID NO: 17800 - DNA, 25 bp, Homo sapien
ttcagggacatagaacggggtccca

SEQ ID NO: 17801 - DNA, 25 bp, Homo sapien
cagggacatagaacggggtcccatc

SEQ ID NO: 17802 - DNA, 25 bp, Homo sapien
catagaacggggtcccatccgtgga

SEQ ID NO: 17803 - DNA, 25 bp, Homo sapien
cctggtagcggtcagcccggctgca

SEQ ID NO: 17804 - DNA, 25 bp, Homo sapien
gtcccatccgtggacccacccgcca

SEQ ID NO: 17805 - DNA, 25 bp, Homo sapien
cctcggatttcagggacatagaacg

SEQ ID NO: 17806 - DNA, 25 bp, Homo sapien
tcacgtggtaatggccgctcaaaaa

SEQ ID NO: 17807 - DNA, 25 bp, Homo sapien
cggccgttaactctcttccattgtg

SEQ ID NO: 17808 - DNA, 25 bp, Homo sapien
cgccgacaaggtaagcgtcaatgtg

SEQ ID NO: 17809 - DNA, 25 bp, Homo sapien
ctcgccattgcagttggacccagca

SEQ ID NO: 17810 - DNA, 25 bp, Homo sapien
tgtcacatgatggagcaacctatcg

SEQ ID NO: 17811 - DNA, 25 bp, Homo sapien
ttagcgaaaaccagagcgtgccctc

SEQ ID NO: 17812 - DNA, 25 bp, Homo sapien
gacgcttgccttgcatcacgtggta

SEQ ID NO: 17813 - DNA, 25 bp, Homo sapien
ctcgtcacgtgatggaggactccca

SEQ ID NO: 17814 - DNA, 25 bp, Homo sapien
gggcaatacctaccatctgggtcta

SEQ ID NO: 17815 - DNA, 25 bp, Homo sapien
agggcatcacgaccgaacagctgga

SEQ ID NO: 17816 - DNA, 25 bp, Homo sapien
cacgcaggccaccatgaagggcatc

SEQ ID NO: 17817 - DNA, 25 bp, Homo sapien
gagcagctacccaggcttccctgga

SEQ ID NO: 17818 - DNA, 25 bp, Homo sapien
cggcccacgtggttccgacagtcaa

SEQ ID NO: 17819 - DNA, 25 bp, Homo sapien
cgctttcccgggctccagaacggat

SEQ ID NO: 17820 - DNA, 25 bp, Homo sapien
ggttgccgcatctgcctgggcaata

SEQ ID NO: 17821 - DNA, 25 bp, Homo sapien
tccagaacggatcgcgtggtcacgt

SEQ ID NO: 17822 - DNA, 25 bp, Homo sapien
ggtccacaacatcgcctaccaggtg

SEQ ID NO: 17823 - DNA, 25 bp, Homo sapien
acagtgacaacacggccgcgctgca

SEQ ID NO: 17824 - DNA, 25 bp, Homo sapien
gcctaccaggtgagccagtgcccgg

SEQ ID NO: 17825 - DNA, 25 bp, Homo sapien
ctgcagctcatgagcgccgtccgca

SEQ ID NO: 17826 - DNA, 25 bp, Homo sapien
ccgtccgcaccagcatcgtggagaa

SEQ ID NO: 17827 - DNA, 25 bp, Homo sapien
catcgtggagaagcgcttcccggac

SEQ ID NO: 17828 - DNA, 25 bp, Homo sapien
agcgcttcccggacttcgtgcggga

SEQ ID NO: 17829 - DNA, 25 bp, Homo sapien
tgcacgcactgctgcacagtgacaa

SEQ ID NO: 17830 - DNA, 25 bp, Homo sapien
gtgtcgcctgagaaccggatgaggc

SEQ ID NO: 17831 - DNA, 25 bp, Homo sapien
agagctgccacctggacctgccgca

SEQ ID NO: 17832 - DNA, 25 bp, Homo sapien
tgcaggacgccttcagctccatcgg

SEQ ID NO: 17833 - DNA, 25 bp, Homo sapien
ggtcaacaaactgcaggacgccttc

SEQ ID NO: 17834 - DNA, 25 bp, Homo sapien
gctgatcccgctggtcaacaaactg

SEQ ID NO: 17835 - DNA, 25 bp, Homo sapien
aacggctacagacgccgcggggcca

SEQ ID NO: 17836 - DNA, 25 bp, Homo sapien
gtaactgcggcgcttgcgtgcccgc

SEQ ID NO: 17837 - DNA, 25 bp, Homo sapien
ccctgggcagaggactccctgcagg

SEQ ID NO: 17838 - DNA, 25 bp, Homo sapien
cgccggcaacaggaacgtgaactca

SEQ ID NO: 17839 - DNA, 25 bp, Homo sapien
cgtgaactcaccgtcctggattggc

SEQ ID NO: 17840 - DNA, 25 bp, Homo sapien
cagtggcttctgtatgttgtccgta

SEQ ID NO: 17841 - DNA, 25 bp, Homo sapien
gcggcccgaatgaatgcctgatgtg

SEQ ID NO: 17842 - DNA, 25 bp, Homo sapien
ggccgctggtggaggaaaattacaa

SEQ ID NO: 17843 - DNA, 25 bp, Homo sapien
acctccacgtggttttcccagagtg

SEQ ID NO: 17844 - DNA, 25 bp, Homo sapien
cgcggactggtagaaacactgcttc

SEQ ID NO: 17845 - DNA, 25 bp, Homo sapien
atccgggtcaccctctggtctgcaa

SEQ ID NO: 17846 - DNA, 25 bp, Homo sapien
cgcctcactcgaaagcagccgttaa

SEQ ID NO: 17847 - DNA, 25 bp, Homo sapien
cggtggagccacctcacaaagcggc

SEQ ID NO: 17848 - DNA, 25 bp, Homo sapien
tcacaaagcggcgaccgttctcgcg

SEQ ID NO: 17849 - DNA, 25 bp, Homo sapien
ggccctgcgctaccgtgtcggtgtt

SEQ ID NO: 17850 - DNA, 25 bp, Homo sapien
tcaccatcggcgacgcgaacggcga

SEQ ID NO: 17851 - DNA, 25 bp, Homo sapien
cgaacggcgagatccagcggcacgc

SEQ ID NO: 17852 - DNA, 25 bp, Homo sapien
gcatcgccctctacagccgtgagta

SEQ ID NO: 17853 - DNA, 25 bp, Homo sapien
cgaaagcagccgttaatgaggcgcc

SEQ ID NO: 17854 - DNA, 25 bp, Homo sapien
cggtgacgccgtctcccttccttct

SEQ ID NO: 17855 - DNA, 25 bp, Homo sapien
agctagcgtgtgagtcgccatcctc

SEQ ID NO: 17856 - DNA, 25 bp, Homo sapien
gcacggggattgtccaaggtaacga

SEQ ID NO: 17857 - DNA, 25 bp, Homo sapien
ctccataatgagcacggggattgtc

SEQ ID NO: 17858 - DNA, 25 bp, Homo sapien
ccactcccggatgggctccataatg

SEQ ID NO: 17859 - DNA, 25 bp, Homo sapien
ggggattgtcaatcacacccactcc

SEQ ID NO: 17860 - DNA, 25 bp, Homo sapien
tgtgagtcgccatcctctgtccggc

SEQ ID NO: 17861 - DNA, 25 bp, Homo sapien
gccaacacggggattgtcaatcaca

SEQ ID NO: 17862 - DNA, 25 bp, Homo sapien
atcaggagtttcttcccggagcaag

SEQ ID NO: 17863 - DNA, 25 bp, Homo sapien
gacagagaccggtcaggcacacttc

SEQ ID NO: 17864 - DNA, 25 bp, Homo sapien
tgcacccacggaggcttgaactcgt

SEQ ID NO: 17865 - DNA, 25 bp, Homo sapien
tcagacctgacagcaacatccggcg

SEQ ID NO: 17866 - DNA, 25 bp, Homo sapien
ctctttctatcctctcccgttggga

SEQ ID NO: 17867 - DNA, 25 bp, Homo sapien
ccgggctcttaacgtcgggtatcag

SEQ ID NO: 17868 - DNA, 25 bp, Homo sapien
aaccgcgagtccgaagccttcgtgc

SEQ ID NO: 17869 - DNA, 25 bp, Homo sapien
ttccggtaaagttggcgcttgcgca

SEQ ID NO: 17870 - DNA, 25 bp, Homo sapien
acgcctgtcgggattatcagtcatc

SEQ ID NO: 17871 - DNA, 25 bp, Homo sapien
ggacagccaatcacgcctggtttta

SEQ ID NO: 17872 - DNA, 25 bp, Homo sapien
gaagggccgtcttttccagtgcgcc

SEQ ID NO: 17873 - DNA, 25 bp, Homo sapien
gttcatttcgcacgacgcagcggtt

SEQ ID NO: 17874 - DNA, 25 bp, Homo sapien
cgcagcggttgggaacacagacatt

SEQ ID NO: 17875 - DNA, 25 bp, Homo sapien
cacagacattttcggagctggagcc

SEQ ID NO: 17876 - DNA, 25 bp, Homo sapien
ttcagcttcagctgcagcggacctc

SEQ ID NO: 17877 - DNA, 25 bp, Homo sapien
tgcgcctccgagcagtagatgttgc

SEQ ID NO: 17878 - DNA, 25 bp, Homo sapien
cagtggcgtccgctctgcgcatgct

SEQ ID NO: 17879 - DNA, 25 bp, Homo sapien
tttcgtgaagagaagcgagacgccc

SEQ ID NO: 17880 - DNA, 25 bp, Homo sapien
attacagcggctgcaacaataggca

SEQ ID NO: 17881 - DNA, 25 bp, Homo sapien
agagaagcgagacgcccattctgcc

SEQ ID NO: 17882 - DNA, 25 bp, Homo sapien
cgagggtcaagaagcccagccggca

SEQ ID NO: 17883 - DNA, 25 bp, Homo sapien
caataggcaggcgttggggcttttc

SEQ ID NO: 17884 - DNA, 25 bp, Homo sapien
agggttcctatttccgagcctcagg

SEQ ID NO: 17885 - DNA, 25 bp, Homo sapien
cggcggcttctttgtttcgtgaaga

SEQ ID NO: 17886 - DNA, 25 bp, Homo sapien
caggagcgcgagtacaggtgagggc

SEQ ID NO: 17887 - DNA, 25 bp, Homo sapien
gatcctgcaggagcgcgagtacagg

SEQ ID NO: 17888 - DNA, 25 bp, Homo sapien
gcccgtgatgccaccgcagacccag

SEQ ID NO: 17889 - DNA, 25 bp, Homo sapien
gtgatgccaccgcagacccagtccc

SEQ ID NO: 17890 - DNA, 25 bp, Homo sapien
gtgccactgcaccagaagcagagcc

SEQ ID NO: 17891 - DNA, 25 bp, Homo sapien
tgccactgcaccagaagcagagccg

SEQ ID NO: 17892 - DNA, 25 bp, Homo sapien
gcggggcctcgaccctgtggagatc

SEQ ID NO: 17893 - DNA, 25 bp, Homo sapien
cgcctcgcccgtgatgccaccgcag

SEQ ID NO: 17894 - DNA, 25 bp, Homo sapien
ctccggtcaggaccgggctgcatca

SEQ ID NO: 17895 - DNA, 25 bp, Homo sapien
ggctgcatcagccttgcgtggaaac

SEQ ID NO: 17896 - DNA, 25 bp, Homo sapien
gccctggcctgtgcttttgagtccc

SEQ ID NO: 17897 - DNA, 25 bp, Homo sapien
ttgcgccacctacggttggtacagg

SEQ ID NO: 17898 - DNA, 25 bp, Homo sapien
tgaagccgttaccagttgcgccacc

SEQ ID NO: 17899 - DNA, 25 bp, Homo sapien
aacagatcctgacggggaagcccac

SEQ ID NO: 17900 - DNA, 25 bp, Homo sapien
gtcacctgcgatccctgaagccgtt

SEQ ID NO: 17901 - DNA, 25 bp, Homo sapien
agccttgcgtggaaacagatcctga

SEQ ID NO: 17902 - DNA, 25 bp, Homo sapien
ggagaagatcctagctgcagccaag

SEQ ID NO: 17903 - DNA, 25 bp, Homo sapien
agcaggatgaggtgagcccagcacc

SEQ ID NO: 17904 - DNA, 25 bp, Homo sapien
ttcgaccagaagtcctccagccatg

SEQ ID NO: 17905 - DNA, 25 bp, Homo sapien
tgcagccaagtacaagctcaacgtg

SEQ ID NO: 17906 - DNA, 25 bp, Homo sapien
atccaggccggcatgttcgaccaga

SEQ ID NO: 17907 - DNA, 25 bp, Homo sapien
tacaagctcaacgtggaccagaagg

SEQ ID NO: 17908 - DNA, 25 bp, Homo sapien
gagcccaccgcatcgggcagcagaa

SEQ ID NO: 17909 - DNA, 25 bp, Homo sapien
gcctctgcaccgtcaacagcgtgga

SEQ ID NO: 17910 - DNA, 25 bp, Homo sapien
gtcaaccagatgatcgcccggcacg

SEQ ID NO: 17911 - DNA, 25 bp, Homo sapien
aggtgcccgacgacgagaccgtcaa

SEQ ID NO: 17912 - DNA, 25 bp, Homo sapien
cttataggaggaagacgaggtgccc

SEQ ID NO: 17913 - DNA, 25 bp, Homo sapien
gacagtttgcaatcttataggagga

SEQ ID NO: 17914 - DNA, 25 bp, Homo sapien
ggcactgacagtttgcaatcttata

SEQ ID NO: 17915 - DNA, 25 bp, Homo sapien
tcagcggcactgacagtttgcaatc

SEQ ID NO: 17916 - DNA, 25 bp, Homo sapien
cctcctcagcggcactgacagtttg

SEQ ID NO: 17917 - DNA, 25 bp, Homo sapien
cgacgagaccgtcaaccagatgatc

SEQ ID NO: 17918 - DNA, 25 bp, Homo sapien
tcccgccaccgcaaggaggtggact

SEQ ID NO: 17919 - DNA, 25 bp, Homo sapien
cgccaccgcaaggaggtggactaca

SEQ ID NO: 17920 - DNA, 25 bp, Homo sapien
agatgttcggccgtggctcccgcca

SEQ ID NO: 17921 - DNA, 25 bp, Homo sapien
cgtggatcatcaaggacgacgcgga

SEQ ID NO: 17922 - DNA, 25 bp, Homo sapien
ccctcgtggatcatcaaggacgacg

SEQ ID NO: 17923 - DNA, 25 bp, Homo sapien
tcatggaggaggacgagctcccctc

SEQ ID NO: 17924 - DNA, 25 bp, Homo sapien
gaggaggcccgcaaccccaagcgga

SEQ ID NO: 17925 - DNA, 25 bp, Homo sapien
gcatggacctggaccgcaggcgcga

SEQ ID NO: 17926 - DNA, 25 bp, Homo sapien
ccctgggattgcgtcgcggcctctg

SEQ ID NO: 17927 - DNA, 25 bp, Homo sapien
aggaggtccggcagaagaaatcatc

SEQ ID NO: 17928 - DNA, 25 bp, Homo sapien
ttactactattgaccctgaaggcca

SEQ ID NO: 17929 - DNA, 25 bp, Homo sapien
ggctgtcctattttactactattga

SEQ ID NO: 17930 - DNA, 25 bp, Homo sapien
ggtgctggctgtcctattttactac

SEQ ID NO: 17931 - DNA, 25 bp, Homo sapien
gaaatcatcacggaagcgcaagcga

SEQ ID NO: 17932 - DNA, 25 bp, Homo sapien
gcctctgcttgtcgacctgggtgct

SEQ ID NO: 17933 - DNA, 25 bp, Homo sapien
cgcaagcgagacagcgacgccggct

SEQ ID NO: 17934 - DNA, 25 bp, Homo sapien
gctcggtccgtcaaagtgaagatca

SEQ ID NO: 17935 - DNA, 25 bp, Homo sapien
cctccagctcggtccgtcaaagtga

SEQ ID NO: 17936 - DNA, 25 bp, Homo sapien
tcaaggctgtctttccctcccggtc

SEQ ID NO: 17937 - DNA, 25 bp, Homo sapien
tgcattcccagagctcaaggctgtc

SEQ ID NO: 17938 - DNA, 25 bp, Homo sapien
ggggtgctgcattcccagagctcaa

SEQ ID NO: 17939 - DNA, 25 bp, Homo sapien
tgaagatcaagcttggccggaagga

SEQ ID NO: 17940 - DNA, 25 bp, Homo sapien
gtcccgagccaagccggtcgtgagt

SEQ ID NO: 17941 - DNA, 25 bp, Homo sapien
tccgtcaaagtgaagatcaagcttg

SEQ ID NO: 17942 - DNA, 25 bp, Homo sapien
acgagtcgccctccgttatcctggg

SEQ ID NO: 17943 - DNA, 25 bp, Homo sapien
tgccatcctgagttgggtgcagtcc

SEQ ID NO: 17944 - DNA, 25 bp, Homo sapien
cccgaattccattgggtgtagtcca

SEQ ID NO: 17945 - DNA, 25 bp, Homo sapien
gcgcggaagtctgagcctcaccttg

SEQ ID NO: 17946 - DNA, 25 bp, Homo sapien
tcctccgcggttcctgtcacaaagg

SEQ ID NO: 17947 - DNA, 25 bp, Homo sapien
aatggcttcggttcagctgtccaag

SEQ ID NO: 17948 - DNA, 25 bp, Homo sapien
gtgtagtccaacaggccaccctcga

SEQ ID NO: 17949 - DNA, 25 bp, Homo sapien
ctcgcttcttcagaggctgtgaatg

SEQ ID NO: 17950 - DNA, 25 bp, Homo sapien
gctcccaggacgagtttcgctgcca

SEQ ID NO: 17951 - DNA, 25 bp, Homo sapien
cccgactgcaaggacaaatctgacg

SEQ ID NO: 17952 - DNA, 25 bp, Homo sapien
cggccttcgagttccactgcctaag

SEQ ID NO: 17953 - DNA, 25 bp, Homo sapien
gctgtaggggtctttacgtgttcca

SEQ ID NO: 17954 - DNA, 25 bp, Homo sapien
ccgactgcgaagatggctcggatga

SEQ ID NO: 17955 - DNA, 25 bp, Homo sapien
tctgtgactcagaccgggactgctt

SEQ ID NO: 17956 - DNA, 25 bp, Homo sapien
tcgctgccacgatgggaagtgcatc

SEQ ID NO: 17957 - DNA, 25 bp, Homo sapien
gcatctctcggcagttcgtctgtga

SEQ ID NO: 17958 - DNA, 25 bp, Homo sapien
tccctatccgtaaaggtcctgagcc

SEQ ID NO: 17959 - DNA, 25 bp, Homo sapien
cccaggagcaggatgtccttccagg

SEQ ID NO: 17960 - DNA, 25 bp, Homo sapien
cggggtgcagagatcagaccctgca

SEQ ID NO: 17961 - DNA, 25 bp, Homo sapien
gcgcacatcagctggagcaggttga

SEQ ID NO: 17962 - DNA, 25 bp, Homo sapien
cttcctggacgggtgtggttcccag

SEQ ID NO: 17963 - DNA, 25 bp, Homo sapien
cgtggaacagcctcgcggggtcaca

SEQ ID NO: 17964 - DNA, 25 bp, Homo sapien
accctcctggtcttgtgcgtgggtg

SEQ ID NO: 17965 - DNA, 25 bp, Homo sapien
ccggctttggccaaggtgccttcct

SEQ ID NO: 17966 - DNA, 25 bp, Homo sapien
acctctgcaggtcgacacgttttcc

SEQ ID NO: 17967 - DNA, 25 bp, Homo sapien
gcctgccagacgtgtgtcacaactc

SEQ ID NO: 17968 - DNA, 25 bp, Homo sapien
gacgccctctgatgccgcagagaaa

SEQ ID NO: 17969 - DNA, 25 bp, Homo sapien
ctgaaaacgaatctgccggtccaca

SEQ ID NO: 17970 - DNA, 25 bp, Homo sapien
cgagatgtgctcaacccaggactga

SEQ ID NO: 17971 - DNA, 25 bp, Homo sapien
cttacaggtgctcacaaggactcca

SEQ ID NO: 17972 - DNA, 25 bp, Homo sapien
acgttttccttcatggccgcacgaa

SEQ ID NO: 17973 - DNA, 25 bp, Homo sapien
caggccgtgggaacaagcaaacgca

SEQ ID NO: 17974 - DNA, 25 bp, Homo sapien
tgaggccgagccgaatttcaccaaa

SEQ ID NO: 17975 - DNA, 25 bp, Homo sapien
gtggccacagtcacagctgctcttg

SEQ ID NO: 17976 - DNA, 25 bp, Homo sapien
agcacgtcggaagtgtactcgtttc

SEQ ID NO: 17977 - DNA, 25 bp, Homo sapien
ggataaacggtctacacggccattc

SEQ ID NO: 17978 - DNA, 25 bp, Homo sapien
cggcttctcccgcagtgacttgaga

SEQ ID NO: 17979 - DNA, 25 bp, Homo sapien
agtcagtgacattcgggacccgcga

SEQ ID NO: 17980 - DNA, 25 bp, Homo sapien
gccactccagagacggacctagata

SEQ ID NO: 17981 - DNA, 25 bp, Homo sapien
gctaccgcttcagtggcttttggga

SEQ ID NO: 17982 - DNA, 25 bp, Homo sapien
tggctcacctcctctatgtcgcgga

SEQ ID NO: 17983 - DNA, 25 bp, Homo sapien
tcggcaccgtcttgcgtttccagca

SEQ ID NO: 17984 - DNA, 25 bp, Homo sapien
gcaaatttgactgtccgcggggccc

SEQ ID NO: 17985 - DNA, 25 bp, Homo sapien
cttccagaagaggttgctttccatt

SEQ ID NO: 17986 - DNA, 25 bp, Homo sapien
cgtcagtcataagcaatggccaata

SEQ ID NO: 17987 - DNA, 25 bp, Homo sapien
tcatcggtgatgaccaatcggcgca

SEQ ID NO: 17988 - DNA, 25 bp, Homo sapien
ggaggctccgttatccttcccgatg

SEQ ID NO: 17989 - DNA, 25 bp, Homo sapien
aagcggctgtttatttctccatagg

SEQ ID NO: 17990 - DNA, 25 bp, Homo sapien
tgagatgtcacagctgggcacggcc

SEQ ID NO: 17991 - DNA, 25 bp, Homo sapien
ggagactcacgcgatctgtgagtga

SEQ ID NO: 17992 - DNA, 25 bp, Homo sapien
cgatctccttgtggccgtgctcaca

SEQ ID NO: 17993 - DNA, 25 bp, Homo sapien
tgctcacaggcgcacatgagggccg

SEQ ID NO: 17994 - DNA, 25 bp, Homo sapien
gagccgtcatcatcttgcacgttga

SEQ ID NO: 17995 - DNA, 25 bp, Homo sapien
tgcacgttgacatctgcctcacagg

SEQ ID NO: 17996 - DNA, 25 bp, Homo sapien
gccagcagggctttgacaacgtcca

SEQ ID NO: 17997 - DNA, 25 bp, Homo sapien
tgcacctggttggagactcacgcga

SEQ ID NO: 17998 - DNA, 25 bp, Homo sapien
ctgcaccacggggaagttggcatga

SEQ ID NO: 17999 - DNA, 25 bp, Homo sapien
cggaacgtgaccaggtgccgccgca

SEQ ID NO: 18000 - DNA, 25 bp, Homo sapien
gctcaccgctgtcgagcagctgctg

SEQ ID NO: 18001 - DNA, 25 bp, Homo sapien
ttggcatgagacacggagtagtgca

SEQ ID NO: 18002 - DNA, 25 bp, Homo sapien
ctgtgttgccgttgctgtcggcgat

SEQ ID NO: 18003 - DNA, 25 bp, Homo sapien
tgtcggcgatgttgaccacgtagtc

SEQ ID NO: 18004 - DNA, 25 bp, Homo sapien
tgttgaccacgtagtccagcagccg

SEQ ID NO: 18005 - DNA, 25 bp, Homo sapien
ccgcgcagacatggcccggaacgtg

SEQ ID NO: 18006 - DNA, 25 bp, Homo sapien
cagcagcacttctcggtggctcagg

SEQ ID NO: 18007 - DNA, 25 bp, Homo sapien
acgacgttctcctcatccaggtggg

SEQ ID NO: 18008 - DNA, 25 bp, Homo sapien
gagcccacaacgtgcggacgcagga

SEQ ID NO: 18009 - DNA, 25 bp, Homo sapien
tggctcaggtgtttctgaacaacta

SEQ ID NO: 18010 - DNA, 25 bp, Homo sapien
ctacgacgcggagaacaaactgaac

SEQ ID NO: 18011 - DNA, 25 bp, Homo sapien
cacttctgcggaggcaccttgatcc

SEQ ID NO: 18012 - DNA, 25 bp, Homo sapien
cgcgcactgcctgcgggacatgtga

SEQ ID NO: 18013 - DNA, 25 bp, Homo sapien
tgaacgtggtgctcggagcccacaa

SEQ ID NO: 18014 - DNA, 25 bp, Homo sapien
catgatagatcgcacgcctgccggg

SEQ ID NO: 18015 - DNA, 25 bp, Homo sapien
ttccgtttcatgatagatcgcacgc

SEQ ID NO: 18016 - DNA, 25 bp, Homo sapien
tcttggcggccacccaccacttacc

SEQ ID NO: 18017 - DNA, 25 bp, Homo sapien
tgctgtgagagtccttcagggccag

SEQ ID NO: 18018 - DNA, 25 bp, Homo sapien
gggccagactccgaactggcgccat

SEQ ID NO: 18019 - DNA, 25 bp, Homo sapien
tccttcagggccagactccgaactg

SEQ ID NO: 18020 - DNA, 25 bp, Homo sapien
ccacgaactggaggctcctccggtg

SEQ ID NO: 18021 - DNA, 25 bp, Homo sapien
aacctcctctttccgtttcatgata

SEQ ID NO: 18022 - DNA, 25 bp, Homo sapien
tggagcaccgagagcttcacctgga

SEQ ID NO: 18023 - DNA, 25 bp, Homo sapien
gtgtggcccttctcgatgtcatcca

SEQ ID NO: 18024 - DNA, 25 bp, Homo sapien
cactggcattggagcacagcgactc

SEQ ID NO: 18025 - DNA, 25 bp, Homo sapien
tgtggacagtcctgaactccgtggt

SEQ ID NO: 18026 - DNA, 25 bp, Homo sapien
aggcatgcccaagtcccgttctcga

SEQ ID NO: 18027 - DNA, 25 bp, Homo sapien
tgggtctccagcacagcgaccttgg

SEQ ID NO: 18028 - DNA, 25 bp, Homo sapien
agcgccttcttgagctgggtctcca

SEQ ID NO: 18029 - DNA, 25 bp, Homo sapien
gcgggtctccagagcaccatactga

SEQ ID NO: 18030 - DNA, 25 bp, Homo sapien
ctccaagtctggaaagtttgggcac

SEQ ID NO: 18031 - DNA, 25 bp, Homo sapien
tcccgggctaatggcaaacagctgc

SEQ ID NO: 18032 - DNA, 25 bp, Homo sapien
tgagaccagcgaggtcgtgtcccag

SEQ ID NO: 18033 - DNA, 25 bp, Homo sapien
tcgttgagaccagcgaggtcgtgtc

SEQ ID NO: 18034 - DNA, 25 bp, Homo sapien
cgcggggacagacactccaagtctg

SEQ ID NO: 18035 - DNA, 25 bp, Homo sapien
caagaccggcctgcacatcgcggag

SEQ ID NO: 18036 - DNA, 25 bp, Homo sapien
gggatcccgggctaatggcaaacag

SEQ ID NO: 18037 - DNA, 25 bp, Homo sapien
accggcctgcacatcgcggaggtcg

SEQ ID NO: 18038 - DNA, 25 bp, Homo sapien
gtcttacgcttgtgttgctcgggca

SEQ ID NO: 18039 - DNA, 25 bp, Homo sapien
tgcggtcaaagtaggtcacccggtc

SEQ ID NO: 18040 - DNA, 25 bp, Homo sapien
tgcgaagcccatagttgcggtcaaa

SEQ ID NO: 18041 - DNA, 25 bp, Homo sapien
atccggcgtgaacggcgtgcagaac

SEQ ID NO: 18042 - DNA, 25 bp, Homo sapien
tggcacacacggatgcgagtcttga

SEQ ID NO: 18043 - DNA, 25 bp, Homo sapien
cccggtccttgagctcgtaggtatc

SEQ ID NO: 18044 - DNA, 25 bp, Homo sapien
gtaggtatcaaagtacggttccaca

SEQ ID NO: 18045 - DNA, 25 bp, Homo sapien
tgcagaacaggaatgtgcgaagccc

SEQ ID NO: 18046 - DNA, 25 bp, Homo sapien
agaggtggcgtcagaccctggtccc

SEQ ID NO: 18047 - DNA, 25 bp, Homo sapien
tgcaaccaggtcagccgaaggtccg

SEQ ID NO: 18048 - DNA, 25 bp, Homo sapien
atgtcgtcggagatggcggactcct

SEQ ID NO: 18049 - DNA, 25 bp, Homo sapien
gcggactcctctagcacgttggatg

SEQ ID NO: 18050 - DNA, 25 bp, Homo sapien
ctagcacgttggatgagatgttctg

SEQ ID NO: 18051 - DNA, 25 bp, Homo sapien
ctggccactcacctggaaggaaacg

SEQ ID NO: 18052 - DNA, 25 bp, Homo sapien
gcgtgcaccatgcactgggcggcct

SEQ ID NO: 18053 - DNA, 25 bp, Homo sapien
gccatgttctgcaaccaggtcagcc

SEQ ID NO: 18054 - DNA, 25 bp, Homo sapien
tctgtccaggctggccggcgctcta

SEQ ID NO: 18055 - DNA, 25 bp, Homo sapien
tgttggccaagtgcacggccgtcca

SEQ ID NO: 18056 - DNA, 25 bp, Homo sapien
agctgcccagcgctgctcacgatgt

SEQ ID NO: 18057 - DNA, 25 bp, Homo sapien
tccgagtcagagtcccggtccagct

SEQ ID NO: 18058 - DNA, 25 bp, Homo sapien
actcaggggcggcacagttcggcca

SEQ ID NO: 18059 - DNA, 25 bp, Homo sapien
ggaccaagatgaaacagggagactc

SEQ ID NO: 18060 - DNA, 25 bp, Homo sapien
ctctaggggagggaatgacaatgac

SEQ ID NO: 18061 - DNA, 25 bp, Homo sapien
cgggtgcagaactgctcggccgcca

SEQ ID NO: 18062 - DNA, 25 bp, Homo sapien
tgcgagggccaacgaaaccttctgg

SEQ ID NO: 18063 - DNA, 25 bp, Homo sapien
accgccctaggaaagcgagatcttg

SEQ ID NO: 18064 - DNA, 25 bp, Homo sapien
aacctgaagttttcggccgctgagc

SEQ ID NO: 18065 - DNA, 25 bp, Homo sapien
tggagtcgcatttagccgcacagca

SEQ ID NO: 18066 - DNA, 25 bp, Homo sapien
gccaagcctggcgactattcatgtc

SEQ ID NO: 18067 - DNA, 25 bp, Homo sapien
tggggcatagtccaacagctggctc

SEQ ID NO: 18068 - DNA, 25 bp, Homo sapien
cggggtaaatctcgcacaggctttc

SEQ ID NO: 18069 - DNA, 25 bp, Homo sapien
ttgtcagagaaccttccggcgcctg

SEQ ID NO: 18070 - DNA, 25 bp, Homo sapien
ccgcgcgtcacggaggcagaacggc

SEQ ID NO: 18071 - DNA, 25 bp, Homo sapien
actacctgttgatcttgtgcgcgaa

SEQ ID NO: 18072 - DNA, 25 bp, Homo sapien
acactacctgttgatcttgtgcgcg

SEQ ID NO: 18073 - DNA, 25 bp, Homo sapien
ggccacactacctgttgatcttgtg

SEQ ID NO: 18074 - DNA, 25 bp, Homo sapien
cgcggccacactacctgttgatctt

SEQ ID NO: 18075 - DNA, 25 bp, Homo sapien
cccgacgcgactcccatctgggacc

SEQ ID NO: 18076 - DNA, 25 bp, Homo sapien
ctacctgttgatcttgtgcgcgaag

SEQ ID NO: 18077 - DNA, 25 bp, Homo sapien
aggcagaacggcagccgccatcgcg

SEQ ID NO: 18078 - DNA, 25 bp, Homo sapien
acccgggcacatttggacgtgtttg

SEQ ID NO: 18079 - DNA, 25 bp, Homo sapien
cgggcacatttggacgtgtttggca

SEQ ID NO: 18080 - DNA, 25 bp, Homo sapien
tagatgcggctttgcagagaagctg

SEQ ID NO: 18081 - DNA, 25 bp, Homo sapien
tttccggccagttccttccaggagc

SEQ ID NO: 18082 - DNA, 25 bp, Homo sapien
ttccggccagttccttccaggagct

SEQ ID NO: 18083 - DNA, 25 bp, Homo sapien
aggagctgctcccacgtctacagcg

SEQ ID NO: 18084 - DNA, 25 bp, Homo sapien
ggcacccgggcacatttggacgtgt

SEQ ID NO: 18085 - DNA, 25 bp, Homo sapien
tgtagatgcggctttgcagagaagc

SEQ ID NO: 18086 - DNA, 25 bp, Homo sapien
cctgcaggggttccgcctgtgaact

SEQ ID NO: 18087 - DNA, 25 bp, Homo sapien
ccgagtcttgggcggggctttcaga

SEQ ID NO: 18088 - DNA, 25 bp, Homo sapien
agcctgcagccacccggatcccgcg

SEQ ID NO: 18089 - DNA, 25 bp, Homo sapien
gcagccgcagaagccagcagcctgc

SEQ ID NO: 18090 - DNA, 25 bp, Homo sapien
tgaactcgctgcggcttggccctgg

SEQ ID NO: 18091 - DNA, 25 bp, Homo sapien
ggttccgcctgtgaactcgctgcgg

SEQ ID NO: 18092 - DNA, 25 bp, Homo sapien
caggggttccgcctgtgaactcgct

SEQ ID NO: 18093 - DNA, 25 bp, Homo sapien
cacagacctgctcggatgcggaggg

SEQ ID NO: 18094 - DNA, 25 bp, Homo sapien
cgcggctactaagcgcagctgaagc

SEQ ID NO: 18095 - DNA, 25 bp, Homo sapien
tccacgggcttttatccaattacgc

SEQ ID NO: 18096 - DNA, 25 bp, Homo sapien
ccctcctgggtattgactaatcgta

SEQ ID NO: 18097 - DNA, 25 bp, Homo sapien
atcgggtcgtagatctgcacctttc

SEQ ID NO: 18098 - DNA, 25 bp, Homo sapien
ccaaatgggctgaatctggtacctc

SEQ ID NO: 18099 - DNA, 25 bp, Homo sapien
cccggattccgagaacagaggcgtc

SEQ ID NO: 18100 - DNA, 25 bp, Homo sapien
cgaggacaccgatcccaccgttagg

SEQ ID NO: 18101 - DNA, 25 bp, Homo sapien
ttaggaaccgggacctcaatccgca

SEQ ID NO: 18102 - DNA, 25 bp, Homo sapien
ttgaaggagacagccctaacgcctg

SEQ ID NO: 18103 - DNA, 25 bp, Homo sapien
cgtgatgagcaaactagcgcgcgga

SEQ ID NO: 18104 - DNA, 25 bp, Homo sapien
aaccaatcggggagcttgcgaacgc

SEQ ID NO: 18105 - DNA, 25 bp, Homo sapien
cacgtgcacgttctgatcctgaggg

SEQ ID NO: 18106 - DNA, 25 bp, Homo sapien
acgcgcaccagtcggagaggtttta

SEQ ID NO: 18107 - DNA, 25 bp, Homo sapien
aggactcgccacaccttaaatttga

SEQ ID NO: 18108 - DNA, 25 bp, Homo sapien
ggccatttggttctgcagtccgtcg

SEQ ID NO: 18109 - DNA, 25 bp, Homo sapien
agtccgtcgtttcgcagattgaaca

SEQ ID NO: 18110 - DNA, 25 bp, Homo sapien
tcttctgccggccacataacatttg

SEQ ID NO: 18111 - DNA, 25 bp, Homo sapien
gccggccacataacatttgcacttt

SEQ ID NO: 18112 - DNA, 25 bp, Homo sapien
taacatttgcactttcgtccctcgc

SEQ ID NO: 18113 - DNA, 25 bp, Homo sapien
ccggcatctgcttcgtaagtaaccg

SEQ ID NO: 18114 - DNA, 25 bp, Homo sapien
atctgcttcgtaagtaaccgtgccc

SEQ ID NO: 18115 - DNA, 25 bp, Homo sapien
caggagctcaatgtcaccgtggtca

SEQ ID NO: 18116 - DNA, 25 bp, Homo sapien
ccagccaacctcagtgcctccgtcg

SEQ ID NO: 18117 - DNA, 25 bp, Homo sapien
tgtcaccgtggtcaccttcttctgc

SEQ ID NO: 18118 - DNA, 25 bp, Homo sapien
ctggctggcagtccgtctgtccatc

SEQ ID NO: 18119 - DNA, 25 bp, Homo sapien
cggcggcctcgacgcggtgagagga

SEQ ID NO: 18120 - DNA, 25 bp, Homo sapien
cccgcctccaagatcacggaggccc

SEQ ID NO: 18121 - DNA, 25 bp, Homo sapien
atgcaaatgagacgcccggaggccc

SEQ ID NO: 18122 - DNA, 25 bp, Homo sapien
ccctccacctcggagtctgcgcggc

SEQ ID NO: 18123 - DNA, 25 bp, Homo sapien
gaccgcgtctcggtcttcgcgtctg

SEQ ID NO: 18124 - DNA, 25 bp, Homo sapien
ctatgcaaatgagacgcccggaggc

SEQ ID NO: 18125 - DNA, 25 bp, Homo sapien
cagcctggctggcagtccgtctgtc

SEQ ID NO: 18126 - DNA, 25 bp, Homo sapien
acctacacagcggtgagcttcggga

SEQ ID NO: 18127 - DNA, 25 bp, Homo sapien
cgaccagcagctaggaagccgccag

SEQ ID NO: 18128 - DNA, 25 bp, Homo sapien
actgaccagggtgcctgcgctggca

SEQ ID NO: 18129 - DNA, 25 bp, Homo sapien
tgtgcaggctggacagcgaccagca

SEQ ID NO: 18130 - DNA, 25 bp, Homo sapien
ctttgtcactgaccagggtgcctgc

SEQ ID NO: 18131 - DNA, 25 bp, Homo sapien
aggtcccgaccgctttgtcactgac

SEQ ID NO: 18132 - DNA, 25 bp, Homo sapien
gatcggccaggtcccgaccgctttg

SEQ ID NO: 18133 - DNA, 25 bp, Homo sapien
gaccatcttcgccaacgcggggcag

SEQ ID NO: 18134 - DNA, 25 bp, Homo sapien
acgtgactctcgtgttccgcgtgaa

SEQ ID NO: 18135 - DNA, 25 bp, Homo sapien
cccgcagatgtacgtgactctcgtg

SEQ ID NO: 18136 - DNA, 25 bp, Homo sapien
tccacttgggttcggcgacttgcct

SEQ ID NO: 18137 - DNA, 25 bp, Homo sapien
tagcccagaaaggagcgtccacttg

SEQ ID NO: 18138 - DNA, 25 bp, Homo sapien
tggccatgcgctctagcccagaaag

SEQ ID NO: 18139 - DNA, 25 bp, Homo sapien
cgcgtggccgagtaccgaaaccact

SEQ ID NO: 18140 - DNA, 25 bp, Homo sapien
cgaaaccactggtcggacgtgctgg

SEQ ID NO: 18141 - DNA, 25 bp, Homo sapien
tgttccgcgtgaagggctcccgcct

SEQ ID NO: 18142 - DNA, 25 bp, Homo sapien
cccaatgcgactccaggtaaccgtg

SEQ ID NO: 18143 - DNA, 25 bp, Homo sapien
ccgattggtcagagctacgcggcga

SEQ ID NO: 18144 - DNA, 25 bp, Homo sapien
gctgctcggtacaccaggatctgga

SEQ ID NO: 18145 - DNA, 25 bp, Homo sapien
agcgctgctatttgctgcggcccta

SEQ ID NO: 18146 - DNA, 25 bp, Homo sapien
tcttcctgacacgaaggcctcttca

SEQ ID NO: 18147 - DNA, 25 bp, Homo sapien
agcagaggcgttctagccaatggtg

SEQ ID NO: 18148 - DNA, 25 bp, Homo sapien
ccgggatattgagtaacaggtagac

SEQ ID NO: 18149 - DNA, 25 bp, Homo sapien
gaccggaacgactctagacccaatg

SEQ ID NO: 18150 - DNA, 25 bp, Homo sapien
cgtaatttctagacgccgcgcccaa

SEQ ID NO: 18151 - DNA, 25 bp, Homo sapien
tttcccgcaggacgcgaagagatca

SEQ ID NO: 18152 - DNA, 25 bp, Homo sapien
caatcgagaggcgttgagccgtaaa

SEQ ID NO: 18153 - DNA, 25 bp, Homo sapien
taagcgaataagtggccgtaatttc

SEQ ID NO: 18154 - DNA, 25 bp, Homo sapien
ggcgcctggacctcctctaagcgaa

SEQ ID NO: 18155 - DNA, 25 bp, Homo sapien
cagggagctaagctgataaatagtc

SEQ ID NO: 18156 - DNA, 25 bp, Homo sapien
cgcgaagagatcagggagctaagct

SEQ ID NO: 18157 - DNA, 25 bp, Homo sapien
ttgagccgtaaatcagcaccacttc

SEQ ID NO: 18158 - DNA, 25 bp, Homo sapien
gacgtccacctcgtagcggatgtga

SEQ ID NO: 18159 - DNA, 25 bp, Homo sapien
ggttgctcagcacacactcggtgcg

SEQ ID NO: 18160 - DNA, 25 bp, Homo sapien
aaacggtgccctagaattgcaatgg

SEQ ID NO: 18161 - DNA, 25 bp, Homo sapien
cgggacccgggcaatttaatatctg

SEQ ID NO: 18162 - DNA, 25 bp, Homo sapien
tggaacggtcttcagcaccagggta

SEQ ID NO: 18163 - DNA, 25 bp, Homo sapien
agagcacttacctacttcattgatg

SEQ ID NO: 18164 - DNA, 25 bp, Homo sapien
atgacacggtgatatcgcggagcgc

SEQ ID NO: 18165 - DNA, 25 bp, Homo sapien
gttcaacaggcttgcgaggacatta

SEQ ID NO: 18166 - DNA, 25 bp, Homo sapien
ttcaagacctcgagctcgggactgc

SEQ ID NO: 18167 - DNA, 25 bp, Homo sapien
cgggcctcaaacagcaggggacata

SEQ ID NO: 18168 - DNA, 25 bp, Homo sapien
ccctcgatttggaggcgttgttatc

SEQ ID NO: 18169 - DNA, 25 bp, Homo sapien
gcaggtttccctccagtgaccacga

SEQ ID NO: 18170 - DNA, 25 bp, Homo sapien
cgctcggtgaagcacagaagctctt

SEQ ID NO: 18171 - DNA, 25 bp, Homo sapien
cggatcggactcactcgagctggta

SEQ ID NO: 18172 - DNA, 25 bp, Homo sapien
ggggcaagtttctcgccttactgtc

SEQ ID NO: 18173 - DNA, 25 bp, Homo sapien
tgagctctatcctcgggagacagcc

SEQ ID NO: 18174 - DNA, 25 bp, Homo sapien
ggtgctccgagcacggaacccagca

SEQ ID NO: 18175 - DNA, 25 bp, Homo sapien
gcccgcaacacacctgggcgatgcg

SEQ ID NO: 18176 - DNA, 25 bp, Homo sapien
caagcccggtgctccgagcacggaa

SEQ ID NO: 18177 - DNA, 25 bp, Homo sapien
agcacacagccggtcacggtgttga

SEQ ID NO: 18178 - DNA, 25 bp, Homo sapien
cacagccggtcacggtgttgaactg

SEQ ID NO: 18179 - DNA, 25 bp, Homo sapien
tcacggtgttgaactgggccacggt

SEQ ID NO: 18180 - DNA, 25 bp, Homo sapien
tccctctgcgaccacacggagccca

SEQ ID NO: 18181 - DNA, 25 bp, Homo sapien
ggcgatgcggatccacttctccagc

SEQ ID NO: 18182 - DNA, 25 bp, Homo sapien
cagctccgccctcaactggtcgctt

SEQ ID NO: 18183 - DNA, 25 bp, Homo sapien
gccgctcggactcgggccgagtcct

SEQ ID NO: 18184 - DNA, 25 bp, Homo sapien
ggactcagggcaccaaaggggcaca

SEQ ID NO: 18185 - DNA, 25 bp, Homo sapien
ctgcagcggtgcctggacgcacagg

SEQ ID NO: 18186 - DNA, 25 bp, Homo sapien
gggagacactgtacaccgcgccgtc

SEQ ID NO: 18187 - DNA, 25 bp, Homo sapien
gccctcaactggtcgcttccggccc

SEQ ID NO: 18188 - DNA, 25 bp, Homo sapien
gcggcctgtgctcggctctccagct

SEQ ID NO: 18189 - DNA, 25 bp, Homo sapien
cgccgcagggagacactgtacaccg

SEQ ID NO: 18190 - DNA, 25 bp, Homo sapien
aggaaccagtcgcttcactgggtca

SEQ ID NO: 18191 - DNA, 25 bp, Homo sapien
ccagggcaagttcagattgggagca

SEQ ID NO: 18192 - DNA, 25 bp, Homo sapien
ttcagattgggagcagataccgtcc

SEQ ID NO: 18193 - DNA, 25 bp, Homo sapien
cttaccagggccagctctttgcctg

SEQ ID NO: 18194 - DNA, 25 bp, Homo sapien
attgggagcagataccgtccgacgg

SEQ ID NO: 18195 - DNA, 25 bp, Homo sapien
atccctaagaggaaccagtcgcttc

SEQ ID NO: 18196 - DNA, 25 bp, Homo sapien
gcgcttggagtttctggacctgcgg

SEQ ID NO: 18197 - DNA, 25 bp, Homo sapien
gggactccagggcaagttcagattg

SEQ ID NO: 18198 - DNA, 25 bp, Homo sapien
cggtgcttcttgtgactttcgatta

SEQ ID NO: 18199 - DNA, 25 bp, Homo sapien
gacccagctggggagatttactgtg

SEQ ID NO: 18200 - DNA, 25 bp, Homo sapien
atttactgtgggaacgtctggcccg

SEQ ID NO: 18201 - DNA, 25 bp, Homo sapien
atttattgcgcaactctgaggccgg

SEQ ID NO: 18202 - DNA, 25 bp, Homo sapien
acctccgagagcgacggtgcttctt

SEQ ID NO: 18203 - DNA, 25 bp, Homo sapien
ttcgattaatttctgggaacggatc

SEQ ID NO: 18204 - DNA, 25 bp, Homo sapien
atcttgagtgatgcgcgggtcacta

SEQ ID NO: 18205 - DNA, 25 bp, Homo sapien
gtgtcaggacgagtctaggacctcc

SEQ ID NO: 18206 - DNA, 25 bp, Homo sapien
gacagaagcagctcttccccgaaca

SEQ ID NO: 18207 - DNA, 25 bp, Homo sapien
ccctctacgtggactggatccgttc

SEQ ID NO: 18208 - DNA, 25 bp, Homo sapien
tggactggatccgttccacgctgcg

SEQ ID NO: 18209 - DNA, 25 bp, Homo sapien
tccgttccacgctgcgccgtgtgga

SEQ ID NO: 18210 - DNA, 25 bp, Homo sapien
tggctccaaaccctcgaggcggatc

SEQ ID NO: 18211 - DNA, 25 bp, Homo sapien
tccaaaccctcgaggcggatctttg

SEQ ID NO: 18212 - DNA, 25 bp, Homo sapien
ggtagccctctacgtggactggatc

SEQ ID NO: 18213 - DNA, 25 bp, Homo sapien
cctcgaggcggatctttggacagaa

SEQ ID NO: 18214 - DNA, 25 bp, Homo sapien
tgcagttgttgcttctcctgcttca

SEQ ID NO: 18215 - DNA, 25 bp, Homo sapien
ccaactgcgcgaaggtgtcgccctg

SEQ ID NO: 18216 - DNA, 25 bp, Homo sapien
tcttgagcgtctccaactgcgcgaa

SEQ ID NO: 18217 - DNA, 25 bp, Homo sapien
caacgtctgctcgttctcgctcttg

SEQ ID NO: 18218 - DNA, 25 bp, Homo sapien
cagctcccgctgcagttgttgcttc

SEQ ID NO: 18219 - DNA, 25 bp, Homo sapien
tcggcttgcagtttctgctggctgc

SEQ ID NO: 18220 - DNA, 25 bp, Homo sapien
caaggcgcgctccagctggtccttg

SEQ ID NO: 18221 - DNA, 25 bp, Homo sapien
ccagctggtccttggcctcggcgtg

SEQ ID NO: 18222 - DNA, 25 bp, Homo sapien
tgcggtggatactgacctttgctcc

SEQ ID NO: 18223 - DNA, 25 bp, Homo sapien
cgctgcgccgccattaagagctagc

SEQ ID NO: 18224 - DNA, 25 bp, Homo sapien
tgagaagccgccactcccaagatgg

SEQ ID NO: 18225 - DNA, 25 bp, Homo sapien
cactttggggtcacgtgctcattcc

SEQ ID NO: 18226 - DNA, 25 bp, Homo sapien
cgttctcattggctgaggctgcata

SEQ ID NO: 18227 - DNA, 25 bp, Homo sapien
taaggtttcacagtcctgcccaaga

SEQ ID NO: 18228 - DNA, 25 bp, Homo sapien
tgtttccatggagatcacccgcgtt

SEQ ID NO: 18229 - DNA, 25 bp, Homo sapien
ccgcatctctcggttgccaggtaac

SEQ ID NO: 18230 - DNA, 25 bp, Homo sapien
gaagcacccaccgaagacgaccatg

SEQ ID NO: 18231 - DNA, 25 bp, Homo sapien
cctcctgtgcgggaaagagaccatg

SEQ ID NO: 18232 - DNA, 25 bp, Homo sapien
tggtgaccagcaccacagagcccag

SEQ ID NO: 18233 - DNA, 25 bp, Homo sapien
cacagagcccagtcgctgcgagtac

SEQ ID NO: 18234 - DNA, 25 bp, Homo sapien
agtcgctgcgagtacctcatggagc

SEQ ID NO: 18235 - DNA, 25 bp, Homo sapien
cgggaaagagaccatggtgaccagc

SEQ ID NO: 18236 - DNA, 25 bp, Homo sapien
acgaccatgacgagctctagctgga

SEQ ID NO: 18237 - DNA, 25 bp, Homo sapien
catggagctgatgacgccagccgcc

SEQ ID NO: 18238 - DNA, 25 bp, Homo sapien
ccacagtgaactccggcgtggctga

SEQ ID NO: 18239 - DNA, 25 bp, Homo sapien
tgaagtaaatgtcccggtgtcagga

SEQ ID NO: 18240 - DNA, 25 bp, Homo sapien
agtccaattagcagccgcgacccgg

SEQ ID NO: 18241 - DNA, 25 bp, Homo sapien
gagcacactctacgccaggcaaaca

SEQ ID NO: 18242 - DNA, 25 bp, Homo sapien
gctgcgcccaggtaatttgagcaaa

SEQ ID NO: 18243 - DNA, 25 bp, Homo sapien
gccgcgtcacgagtcagccaaagat

SEQ ID NO: 18244 - DNA, 25 bp, Homo sapien
cggcacctcctagggccggaagctt

SEQ ID NO: 18245 - DNA, 25 bp, Homo sapien
cgcggtgacacgctagctaccagca

SEQ ID NO: 18246 - DNA, 25 bp, Homo sapien
atgaccttgacgttggtgactgccc

SEQ ID NO: 18247 - DNA, 25 bp, Homo sapien
ccatcgatggcgatcggcgagaacc

SEQ ID NO: 18248 - DNA, 25 bp, Homo sapien
gccaggccgctcataccatcgatgg

SEQ ID NO: 18249 - DNA, 25 bp, Homo sapien
tctgcctccggtgacaggttgtaca

SEQ ID NO: 18250 - DNA, 25 bp, Homo sapien
ccttgcacttgttggtggtgaaatc

SEQ ID NO: 18251 - DNA, 25 bp, Homo sapien
ggccgcctcgtcatagttggtcatg

SEQ ID NO: 18252 - DNA, 25 bp, Homo sapien
ttgtacacgaagatgcaccagccgg

SEQ ID NO: 18253 - DNA, 25 bp, Homo sapien
catggtcacgaagccgaaacccttg

SEQ ID NO: 18254 - DNA, 25 bp, Homo sapien
gagctggatccttctagggttcaaa

SEQ ID NO: 18255 - DNA, 25 bp, Homo sapien
tgtggccctagtcttctgcagaagg

SEQ ID NO: 18256 - DNA, 25 bp, Homo sapien
ggcaccagtgtagaccacctcaaga

SEQ ID NO: 18257 - DNA, 25 bp, Homo sapien
accttccagaggtgttgtccactga

SEQ ID NO: 18258 - DNA, 25 bp, Homo sapien
tagtggcctgaatatgcgaccttcc

SEQ ID NO: 18259 - DNA, 25 bp, Homo sapien
ggttgccagatttgggccctccttc

SEQ ID NO: 18260 - DNA, 25 bp, Homo sapien
ggtcccgtgtgttcaagtcctctcc

SEQ ID NO: 18261 - DNA, 25 bp, Homo sapien
aggaaactccgcactgctccgaagg

SEQ ID NO: 18262 - DNA, 25 bp, Homo sapien
tgcgccgatgtacctccaggtggtt

SEQ ID NO: 18263 - DNA, 25 bp, Homo sapien
tcccgcagcgatcgcacgtgaagtt

SEQ ID NO: 18264 - DNA, 25 bp, Homo sapien
cgtgaagttgtactgcacctccgca

SEQ ID NO: 18265 - DNA, 25 bp, Homo sapien
cacctccgcagtgtgcttcttcatg

SEQ ID NO: 18266 - DNA, 25 bp, Homo sapien
tcttcatgtgccagttgagcgacgc

SEQ ID NO: 18267 - DNA, 25 bp, Homo sapien
ccaggtggttcttcctcttgaagga

SEQ ID NO: 18268 - DNA, 25 bp, Homo sapien
ccgcaggtctcgcaggtgaattcac

SEQ ID NO: 18269 - DNA, 25 bp, Homo sapien
tgccggcactggtagccacagatct

SEQ ID NO: 18270 - DNA, 25 bp, Homo sapien
ccgttgttaggagccagaccggaag

SEQ ID NO: 18271 - DNA, 25 bp, Homo sapien
ttgaattcggagaaccagaggcgcc

SEQ ID NO: 18272 - DNA, 25 bp, Homo sapien
ccagggcgccaaaaggagaccaaga

SEQ ID NO: 18273 - DNA, 25 bp, Homo sapien
cgcctgcagattctggaggggtctc

SEQ ID NO: 18274 - DNA, 25 bp, Homo sapien
gccgcacgtcgtacttcttccggga

SEQ ID NO: 18275 - DNA, 25 bp, Homo sapien
cggccaggcagtacgagacccaggc

SEQ ID NO: 18276 - DNA, 25 bp, Homo sapien
caccctaggattgggcagtcggaac

SEQ ID NO: 18277 - DNA, 25 bp, Homo sapien
tacttcttccgggactcgagccgtc

SEQ ID NO: 18278 - DNA, 25 bp, Homo sapien
ctctcgcgaggtcatctgcaaaatg

SEQ ID NO: 18279 - DNA, 25 bp, Homo sapien
gcggattccaaatcctgcccggttg

SEQ ID NO: 18280 - DNA, 25 bp, Homo sapien
cactacgaaaggtcatggcgccctg

SEQ ID NO: 18281 - DNA, 25 bp, Homo sapien
gctggcacaagacaggcggcctttc

SEQ ID NO: 18282 - DNA, 25 bp, Homo sapien
cgacttgcggcgtgacctctcgcga

SEQ ID NO: 18283 - DNA, 25 bp, Homo sapien
aaatcctgcccggttgccgacttgc

SEQ ID NO: 18284 - DNA, 25 bp, Homo sapien
acgaaaggtcatggcgccctggccc

SEQ ID NO: 18285 - DNA, 25 bp, Homo sapien
agcccagcagttcgcgttcgcctac

SEQ ID NO: 18286 - DNA, 25 bp, Homo sapien
ttcgcaggctggcatgactgcgcca

SEQ ID NO: 18287 - DNA, 25 bp, Homo sapien
gcatgactgcgccagggaccaagcg

SEQ ID NO: 18288 - DNA, 25 bp, Homo sapien
gggaccaagcggcagatcttcgagc

SEQ ID NO: 18289 - DNA, 25 bp, Homo sapien
gcatggagcactgcgacacgctcaa

SEQ ID NO: 18290 - DNA, 25 bp, Homo sapien
tgcgacacgctcaatgtcagcctgc

SEQ ID NO: 18291 - DNA, 25 bp, Homo sapien
tgtcagcctgcagatgggcagcaac

SEQ ID NO: 18292 - DNA, 25 bp, Homo sapien
gtatgggctgccacgccaggtctac

SEQ ID NO: 18293 - DNA, 25 bp, Homo sapien
gggacacgccgtcaaggcccaggac

SEQ ID NO: 18294 - DNA, 25 bp, Homo sapien
atagtgacttccgactcctgccgga

SEQ ID NO: 18295 - DNA, 25 bp, Homo sapien
gccggtgcgtatttgcctgtaccta

SEQ ID NO: 18296 - DNA, 25 bp, Homo sapien
taaacgcacggagtagaggaacttc

SEQ ID NO: 18297 - DNA, 25 bp, Homo sapien
cgttcacccgggagatagtgacttc

SEQ ID NO: 18298 - DNA, 25 bp, Homo sapien
cggacagcccagcaaataggccctg

SEQ ID NO: 18299 - DNA, 25 bp, Homo sapien
tgagcgcacgcgtactcaaatagca

SEQ ID NO: 18300 - DNA, 25 bp, Homo sapien
actcaaatagcagcgctccgacgga

SEQ ID NO: 18301 - DNA, 25 bp, Homo sapien
tctccagctgcgaaagctccgttca

SEQ ID NO: 18302 - DNA, 25 bp, Homo sapien
acgcgtggcccttcatggtgtccct

SEQ ID NO: 18303 - DNA, 25 bp, Homo sapien
cgcatcttcgaaaacggctacgacc

SEQ ID NO: 18304 - DNA, 25 bp, Homo sapien
gagcccataacctctcgcggcggga

SEQ ID NO: 18305 - DNA, 25 bp, Homo sapien
gttcgccgtgcagcgcatcttcgaa

SEQ ID NO: 18306 - DNA, 25 bp, Homo sapien
aacttcgtcatgtcggccgcgcact

SEQ ID NO: 18307 - DNA, 25 bp, Homo sapien
cctgattgcgcccaacttcgtcatg

SEQ ID NO: 18308 - DNA, 25 bp, Homo sapien
acatcgtgattctccaggtgccgcc

SEQ ID NO: 18309 - DNA, 25 bp, Homo sapien
cgtaaacttgctcaacgacatcgtg

SEQ ID NO: 18310 - DNA, 25 bp, Homo sapien
cacgtcccgcggacattcaggagtc

SEQ ID NO: 18311 - DNA, 25 bp, Homo sapien
gctttaagcaggcagcggccgatcc

SEQ ID NO: 18312 - DNA, 25 bp, Homo sapien
tgcagatccgcaggcgatcgcactc

SEQ ID NO: 18313 - DNA, 25 bp, Homo sapien
ctgcagcagcaacaaacgggaagga

SEQ ID NO: 18314 - DNA, 25 bp, Homo sapien
gtcaccctgcgaagtgcttggtccc

SEQ ID NO: 18315 - DNA, 25 bp, Homo sapien
tgaggccactggctcacagatctcc

SEQ ID NO: 18316 - DNA, 25 bp, Homo sapien
tctcattcaacgctgaggccactgg

SEQ ID NO: 18317 - DNA, 25 bp, Homo sapien
acccgggagagagctctcattcaac

SEQ ID NO: 18318 - DNA, 25 bp, Homo sapien
ggccgggccatcaggccatacaagt

SEQ ID NO: 18319 - DNA, 25 bp, Homo sapien
tgctcgcctgtgagcatatttcgtc

SEQ ID NO: 18320 - DNA, 25 bp, Homo sapien
gcccgtctctctttcacgggtgaga

SEQ ID NO: 18321 - DNA, 25 bp, Homo sapien
tcgcccattccaggccagaagcagg

SEQ ID NO: 18322 - DNA, 25 bp, Homo sapien
atatttcgtcgaatcccggctgggc

SEQ ID NO: 18323 - DNA, 25 bp, Homo sapien
tccagttcttgcgagtggttgttcc

SEQ ID NO: 18324 - DNA, 25 bp, Homo sapien
tacaagtgctgcgaaagcggcctcg

SEQ ID NO: 18325 - DNA, 25 bp, Homo sapien
gcagcctactcttggcggaagcgga

SEQ ID NO: 18326 - DNA, 25 bp, Homo sapien
tccttcgtcgccaaactgctgcttg

SEQ ID NO: 18327 - DNA, 25 bp, Homo sapien
gccagtccagtctcgttggctaaga

SEQ ID NO: 18328 - DNA, 25 bp, Homo sapien
taagactgcccgtaggtagcgactc

SEQ ID NO: 18329 - DNA, 25 bp, Homo sapien
tcttcagtcgattaaggcgggcagc

SEQ ID NO: 18330 - DNA, 25 bp, Homo sapien
cgtttaacagcctttgcagcaggtc

SEQ ID NO: 18331 - DNA, 25 bp, Homo sapien
agcagcttggtcaggctatgcctca

SEQ ID NO: 18332 - DNA, 25 bp, Homo sapien
ccggcactggccgaaacgaaatgca

SEQ ID NO: 18333 - DNA, 25 bp, Homo sapien
gctgcagcctccgataccgtttaac

SEQ ID NO: 18334 - DNA, 25 bp, Homo sapien
cgcggtctcttgttgctgtgctaac

SEQ ID NO: 18335 - DNA, 25 bp, Homo sapien
cttggggaagacagttggaagctca

SEQ ID NO: 18336 - DNA, 25 bp, Homo sapien
gctgtgttcctctctagtcacaaga

SEQ ID NO: 18337 - DNA, 25 bp, Homo sapien
agctcctgtcgctctgtcagttgcg

SEQ ID NO: 18338 - DNA, 25 bp, Homo sapien
aggctccaggtttctccgccagagc

SEQ ID NO: 18339 - DNA, 25 bp, Homo sapien
ttggaaccctctttctggctcttgg

SEQ ID NO: 18340 - DNA, 25 bp, Homo sapien
ctgtgctaacgaccgttggaaccct

SEQ ID NO: 18341 - DNA, 25 bp, Homo sapien
gcgaagggcttcttagaacctgctg

SEQ ID NO: 18342 - DNA, 25 bp, Homo sapien
cgactatcacctgaccgtagtaata

SEQ ID NO: 18343 - DNA, 25 bp, Homo sapien
ggttgctgggcacctcgactatcac

SEQ ID NO: 18344 - DNA, 25 bp, Homo sapien
tacgtcgttacgcagcgcggttgct

SEQ ID NO: 18345 - DNA, 25 bp, Homo sapien
cggggcttcgtgaactgtccaatca

SEQ ID NO: 18346 - DNA, 25 bp, Homo sapien
ggcgacatgacctttcgcagctctg

SEQ ID NO: 18347 - DNA, 25 bp, Homo sapien
gtagtaatatctcccgctacgcgcg

SEQ ID NO: 18348 - DNA, 25 bp, Homo sapien
ctgcgacaggatgccagagtccatc

SEQ ID NO: 18349 - DNA, 25 bp, Homo sapien
ccatcgagaggctgggaacaagttc

SEQ ID NO: 18350 - DNA, 25 bp, Homo sapien
tcctgtgcagccagaagcctgtgat

SEQ ID NO: 18351 - DNA, 25 bp, Homo sapien
aggtgtggtggtggtcacgaagcag

SEQ ID NO: 18352 - DNA, 25 bp, Homo sapien
tggtggtggtcacgaagcagagatc

SEQ ID NO: 18353 - DNA, 25 bp, Homo sapien
cgaagcagagatccggccagccgaa

SEQ ID NO: 18354 - DNA, 25 bp, Homo sapien
gaagcagagatccggccagccgaag

SEQ ID NO: 18355 - DNA, 25 bp, Homo sapien
gggtcagcgccatcctgtgcagcca

SEQ ID NO: 18356 - DNA, 25 bp, Homo sapien
atcctgtgcagccagaagcctgtga

SEQ ID NO: 18357 - DNA, 25 bp, Homo sapien
cctgtgcagccagaagcctgtgatg

SEQ ID NO: 18358 - DNA, 25 bp, Homo sapien
acccgccttcgttgcctgagtgaca

SEQ ID NO: 18359 - DNA, 25 bp, Homo sapien
cttctgagcgcggagacacaagcgt

SEQ ID NO: 18360 - DNA, 25 bp, Homo sapien
ggaagtcgcgtctctaagcaacctg

SEQ ID NO: 18361 - DNA, 25 bp, Homo sapien
ttggacattgcactcttggacccgc

SEQ ID NO: 18362 - DNA, 25 bp, Homo sapien
acagctagtagggaagtcgcgtctc

SEQ ID NO: 18363 - DNA, 25 bp, Homo sapien
agcaacctgcattcgtccggggtca

SEQ ID NO: 18364 - DNA, 25 bp, Homo sapien
tgcgtctaagcagaatttgttaacg

SEQ ID NO: 18365 - DNA, 25 bp, Homo sapien
ccctgccacggatatttgcgtctaa

SEQ ID NO: 18366 - DNA, 25 bp, Homo sapien
tttagaccaggaagccgcgcagatc

SEQ ID NO: 18367 - DNA, 25 bp, Homo sapien
tcggccgccttgctttagaccagga

SEQ ID NO: 18368 - DNA, 25 bp, Homo sapien
cctacctagccctgacgatagcgga

SEQ ID NO: 18369 - DNA, 25 bp, Homo sapien
ctgacgatagcggagaatagcctta

SEQ ID NO: 18370 - DNA, 25 bp, Homo sapien
agaatagccttaaccggcctggaag

SEQ ID NO: 18371 - DNA, 25 bp, Homo sapien
cctgactacgagtggaacgattagc

SEQ ID NO: 18372 - DNA, 25 bp, Homo sapien
acgattagcggccatgcggctgttc

SEQ ID NO: 18373 - DNA, 25 bp, Homo sapien
gctgtgccgggcacagacgaagccc

SEQ ID NO: 18374 - DNA, 25 bp, Homo sapien
acctgctgcctagctgtcattcgga

SEQ ID NO: 18375 - DNA, 25 bp, Homo sapien
acccgagatccggaacaatttctgc

SEQ ID NO: 18376 - DNA, 25 bp, Homo sapien
ggctccgtgaaccttagggacaaca

SEQ ID NO: 18377 - DNA, 25 bp, Homo sapien
ttcaacacaattgtccacggagggc

SEQ ID NO: 18378 - DNA, 25 bp, Homo sapien
ggaagcgagatctgcctagctacta

SEQ ID NO: 18379 - DNA, 25 bp, Homo sapien
gcggggctgtataattgtccaatca

SEQ ID NO: 18380 - DNA, 25 bp, Homo sapien
tgcgcaaatgcgtgctacgtcactg

SEQ ID NO: 18381 - DNA, 25 bp, Homo sapien
ccttgacgcgtcaggttgctgtacc

SEQ ID NO: 18382 - DNA, 25 bp, Homo sapien
gtgtcgtagccgagaagactctgtc

SEQ ID NO: 18383 - DNA, 25 bp, Homo sapien
ccaagctcaggggatggcatcagac

SEQ ID NO: 18384 - DNA, 25 bp, Homo sapien
agatcacttcccatacacgcggcag

SEQ ID NO: 18385 - DNA, 25 bp, Homo sapien
tcctggaactctctcttgcggtttg

SEQ ID NO: 18386 - DNA, 25 bp, Homo sapien
cgcaacacgcagtaacgatctcagg

SEQ ID NO: 18387 - DNA, 25 bp, Homo sapien
attcagcccgcgagattctcagaga

SEQ ID NO: 18388 - DNA, 25 bp, Homo sapien
gaggggacctcatgcgacattcagc

SEQ ID NO: 18389 - DNA, 25 bp, Homo sapien
ttgcggtttgcagccagatcacttc

SEQ ID NO: 18390 - DNA, 25 bp, Homo sapien
tcggtctcctggaacactgtcctgg

SEQ ID NO: 18391 - DNA, 25 bp, Homo sapien
cggatcccgcagtaactatctcagg

SEQ ID NO: 18392 - DNA, 25 bp, Homo sapien
gccggccgagaagaccttgccatct

SEQ ID NO: 18393 - DNA, 25 bp, Homo sapien
ctccggggacgatatcagagtgatc

SEQ ID NO: 18394 - DNA, 25 bp, Homo sapien
gggaccttcatacgccactcttctt

SEQ ID NO: 18395 - DNA, 25 bp, Homo sapien
aaagattcccatcccgcagtaatga

SEQ ID NO: 18396 - DNA, 25 bp, Homo sapien
agtgatcacaaagtggcgcccgacc

SEQ ID NO: 18397 - DNA, 25 bp, Homo sapien
agtccattatgcagcaccgcgtgtg

SEQ ID NO: 18398 - DNA, 25 bp, Homo sapien
gactctatcatccaacgctccgagg

SEQ ID NO: 18399 - DNA, 25 bp, Homo sapien
cacggaattgcctccttcgtccggg

SEQ ID NO: 18400 - DNA, 25 bp, Homo sapien
ctgcaacgggctaatccacggaatt

SEQ ID NO: 18401 - DNA, 25 bp, Homo sapien
caacaggcaccgtggctagacccta

SEQ ID NO: 18402 - DNA, 25 bp, Homo sapien
cgtctgtttcgtacgtgccctgggt

SEQ ID NO: 18403 - DNA, 25 bp, Homo sapien
agcaacgtctgcactctcgtgaggg

SEQ ID NO: 18404 - DNA, 25 bp, Homo sapien
agctcaacgggtcggccaccatcaa

SEQ ID NO: 18405 - DNA, 25 bp, Homo sapien
gtttgtaaactggatcgactctatc

SEQ ID NO: 18406 - DNA, 25 bp, Homo sapien
gcgctcaggttacgtccggaatcct

SEQ ID NO: 18407 - DNA, 25 bp, Homo sapien
ggaatcctctcctacggcaaactgg

SEQ ID NO: 18408 - DNA, 25 bp, Homo sapien
tctcctacggcaaactggtgctcca

SEQ ID NO: 18409 - DNA, 25 bp, Homo sapien
tacggcaaactggtgctccaagcgc

SEQ ID NO: 18410 - DNA, 25 bp, Homo sapien
ctcaggttacgtccggaatcctctc

SEQ ID NO: 18411 - DNA, 25 bp, Homo sapien
ctgcgcagccctgagaactgcggga

SEQ ID NO: 18412 - DNA, 25 bp, Homo sapien
gcgcagcagcaccatttcggggccc

SEQ ID NO: 18413 - DNA, 25 bp, Homo sapien
gcaaactggtgctccaagcgcagca

SEQ ID NO: 18414 - DNA, 25 bp, Homo sapien
gcccggcactgtcaacgcagagcgg

SEQ ID NO: 18415 - DNA, 25 bp, Homo sapien
ccgggcaaggcgttgcgagccttca

SEQ ID NO: 18416 - DNA, 25 bp, Homo sapien
gcaaggcgttgcgagccttcactct

SEQ ID NO: 18417 - DNA, 25 bp, Homo sapien
ttcactctcccgacggacgctggcg

SEQ ID NO: 18418 - DNA, 25 bp, Homo sapien
ggtgtcgcccggcactgtcaacgca

SEQ ID NO: 18419 - DNA, 25 bp, Homo sapien
tcggcctggcggtgcaaaccgcgca

SEQ ID NO: 18420 - DNA, 25 bp, Homo sapien
cctcgccgtctctcttgtcttctgg

SEQ ID NO: 18421 - DNA, 25 bp, Homo sapien
actgtcaacgcagagcggcgtgcgc

SEQ ID NO: 18422 - DNA, 25 bp, Homo sapien
agtggctccgatactccgcgtccat

SEQ ID NO: 18423 - DNA, 25 bp, Homo sapien
gatactccgcgtccatcgtccttca

SEQ ID NO: 18424 - DNA, 25 bp, Homo sapien
attagtggctccgatactccgcgtc

SEQ ID NO: 18425 - DNA, 25 bp, Homo sapien
ttctccattagtggctccgatactc

SEQ ID NO: 18426 - DNA, 25 bp, Homo sapien
ccgttctccattagtggctccgata

SEQ ID NO: 18427 - DNA, 25 bp, Homo sapien
gacccgttctccattagtggctccg

SEQ ID NO: 18428 - DNA, 25 bp, Homo sapien
cgccaggagccggtgtccggcggct

SEQ ID NO: 18429 - DNA, 25 bp, Homo sapien
gtccatcgtccttcagcagccttcg

SEQ ID NO: 18430 - DNA, 25 bp, Homo sapien
gcgcgttgctcagaagaacctgcgg

SEQ ID NO: 18431 - DNA, 25 bp, Homo sapien
gcgccagcgcgttgctcagaagaac

SEQ ID NO: 18432 - DNA, 25 bp, Homo sapien
gatctttgaagcctctgagccgcgc

SEQ ID NO: 18433 - DNA, 25 bp, Homo sapien
ggtgaagtgatctttgaagcctctg

SEQ ID NO: 18434 - DNA, 25 bp, Homo sapien
gctgttggcaaaaggtgaagtgatc

SEQ ID NO: 18435 - DNA, 25 bp, Homo sapien
acctgcggaagagcgcaaagggacc

SEQ ID NO: 18436 - DNA, 25 bp, Homo sapien
ctgagcgggcagatgctgatgttta

SEQ ID NO: 18437 - DNA, 25 bp, Homo sapien
ggcagatgctgatgtttagctgttg

SEQ ID NO: 18438 - DNA, 25 bp, Homo sapien
ccggcagccgccagcaacaaaagga

SEQ ID NO: 18439 - DNA, 25 bp, Homo sapien
cgtttcagctcggaggccccactca

SEQ ID NO: 18440 - DNA, 25 bp, Homo sapien
ggcagccgccagcaacaaaaggaaa

SEQ ID NO: 18441 - DNA, 25 bp, Homo sapien
cgaagcccgcgcgtaggcgcccatg

SEQ ID NO: 18442 - DNA, 25 bp, Homo sapien
gtaggcgcccatggctcagcagctt

SEQ ID NO: 18443 - DNA, 25 bp, Homo sapien
gcgcccatggctcagcagcttcctc

SEQ ID NO: 18444 - DNA, 25 bp, Homo sapien
gccagggcgcggtctggaggctcac

SEQ ID NO: 18445 - DNA, 25 bp, Homo sapien
cgcagggcgcgggacatggtccagg

SEQ ID NO: 18446 - DNA, 25 bp, Homo sapien
atgcccagcaggttcatgtagtccg

SEQ ID NO: 18447 - DNA, 25 bp, Homo sapien
cctcctgagatcgacggcccagtaa

SEQ ID NO: 18448 - DNA, 25 bp, Homo sapien
agcgccttcgtcttcattccgggtc

SEQ ID NO: 18449 - DNA, 25 bp, Homo sapien
gcagtgcgagccgtacgatttaatg

SEQ ID NO: 18450 - DNA, 25 bp, Homo sapien
tgccaaaatgatgaacccggaagtg

SEQ ID NO: 18451 - DNA, 25 bp, Homo sapien
tcgcatttccgttcctcatgacaga

SEQ ID NO: 18452 - DNA, 25 bp, Homo sapien
gcctccgtgggtccgacatattgtt

SEQ ID NO: 18453 - DNA, 25 bp, Homo sapien
ggggtcctcacctcagcactttgtt

SEQ ID NO: 18454 - DNA, 25 bp, Homo sapien
gcctccagcagtgcgcggtaattca

SEQ ID NO: 18455 - DNA, 25 bp, Homo sapien
cggtcctcaccatggcattgacttg

SEQ ID NO: 18456 - DNA, 25 bp, Homo sapien
cgcccgaagttggttgcttggaagc

SEQ ID NO: 18457 - DNA, 25 bp, Homo sapien
tcacaccgcggttgaagtcgtagcc

SEQ ID NO: 18458 - DNA, 25 bp, Homo sapien
caacgtcgagctgtgctttagcacg

SEQ ID NO: 18459 - DNA, 25 bp, Homo sapien
agggaaccttccatgcgcctatagc

SEQ ID NO: 18460 - DNA, 25 bp, Homo sapien
atagccggctctcgagtcaaagctg

SEQ ID NO: 18461 - DNA, 25 bp, Homo sapien
cctgtaaaccaggtcgccgccattt

SEQ ID NO: 18462 - DNA, 25 bp, Homo sapien
ttacagggtctcttgcaactgcgtc

SEQ ID NO: 18463 - DNA, 25 bp, Homo sapien
cagcccggattttggcggactgaga

SEQ ID NO: 18464 - DNA, 25 bp, Homo sapien
ccctaggggaagctccattgcgacc

SEQ ID NO: 18465 - DNA, 25 bp, Homo sapien
gcgtcttgtctcctaggcagcacga

SEQ ID NO: 18466 - DNA, 25 bp, Homo sapien
ccggcgctgtctgatgacgtttatg

SEQ ID NO: 18467 - DNA, 25 bp, Homo sapien
tttatgcgcccaccggaagcgacga

SEQ ID NO: 18468 - DNA, 25 bp, Homo sapien
cgggaatcatcgcaccgccctaggg

SEQ ID NO: 18469 - DNA, 25 bp, Homo sapien
gcgtagcctccaggtgacatggtca

SEQ ID NO: 18470 - DNA, 25 bp, Homo sapien
cagcgaagagccctcgtcccagggt

SEQ ID NO: 18471 - DNA, 25 bp, Homo sapien
gcggatcctcatgggacccagcgaa

SEQ ID NO: 18472 - DNA, 25 bp, Homo sapien
cgccagctgcgccatcctcggccgc

SEQ ID NO: 18473 - DNA, 25 bp, Homo sapien
cggacaggcggaggcctccgatcca

SEQ ID NO: 18474 - DNA, 25 bp, Homo sapien
ggccgcatgacgacgggaacgccct

SEQ ID NO: 18475 - DNA, 25 bp, Homo sapien
ctccgtgtgagacccaggtggagcc

SEQ ID NO: 18476 - DNA, 25 bp, Homo sapien
cgcaaggcaagctgcggaggtaggg

SEQ ID NO: 18477 - DNA, 25 bp, Homo sapien
cccgaaggcttccacctccctcgca

SEQ ID NO: 18478 - DNA, 25 bp, Homo sapien
ccggtcacgtgaccaaagagttgcc

SEQ ID NO: 18479 - DNA, 25 bp, Homo sapien
gctgagacaaggtccggtcacgtga

SEQ ID NO: 18480 - DNA, 25 bp, Homo sapien
cacgtgccctggcacttgggaaacc

SEQ ID NO: 18481 - DNA, 25 bp, Homo sapien
ggttcaaccttcacacgtgccctgg

SEQ ID NO: 18482 - DNA, 25 bp, Homo sapien
cgagccaatcggaaggttcaacctt

SEQ ID NO: 18483 - DNA, 25 bp, Homo sapien
gttcaaactggtcccgccgagccaa

SEQ ID NO: 18484 - DNA, 25 bp, Homo sapien
cgggctctgagtgaggcccacttac

SEQ ID NO: 18485 - DNA, 25 bp, Homo sapien
gcccgttctagctgccaggaggatc

SEQ ID NO: 18486 - DNA, 25 bp, Homo sapien
aggcatgcgtaaaggcctccctctc

SEQ ID NO: 18487 - DNA, 25 bp, Homo sapien
ccgataagccctggaactacaaatc

SEQ ID NO: 18488 - DNA, 25 bp, Homo sapien
cggagaatcgcggaagacaccctaa

SEQ ID NO: 18489 - DNA, 25 bp, Homo sapien
gaaagccgccaccaaggcatgcgta

SEQ ID NO: 18490 - DNA, 25 bp, Homo sapien
ttgggattccgaggtagccagttcc

SEQ ID NO: 18491 - DNA, 25 bp, Homo sapien
caccctaaaggagcagttgggattc

SEQ ID NO: 18492 - DNA, 25 bp, Homo sapien
gccagttccgctggactgaaacctg

SEQ ID NO: 18493 - DNA, 25 bp, Homo sapien
gcaggcgcctaactccactcggaga

SEQ ID NO: 18494 - DNA, 25 bp, Homo sapien
ctcgacctttgcagctgcactggtg

SEQ ID NO: 18495 - DNA, 25 bp, Homo sapien
tccaccctcagctgtcggagaaggc

SEQ ID NO: 18496 - DNA, 25 bp, Homo sapien
ccgacgggaaggtgcaggttctcct

SEQ ID NO: 18497 - DNA, 25 bp, Homo sapien
aagcgcctgtacgacgtgctccgcg

SEQ ID NO: 18498 - DNA, 25 bp, Homo sapien
acgacctcctgctgctacaggtcgg

SEQ ID NO: 18499 - DNA, 25 bp, Homo sapien
gcctcgaactctcctgctgcatggg

SEQ ID NO: 18500 - DNA, 25 bp, Homo sapien
gagaaggccacactgggccctgctg

SEQ ID NO: 18501 - DNA, 25 bp, Homo sapien
acccagggtctagcctaaatctctc

SEQ ID NO: 18502 - DNA, 25 bp, Homo sapien
tgccttggaaatgcagggcgcagca

SEQ ID NO: 18503 - DNA, 25 bp, Homo sapien
aacgagcgcgtgagcgtttgagacc

SEQ ID NO: 18504 - DNA, 25 bp, Homo sapien
taccgctgctaccaaggcggcggcg

SEQ ID NO: 18505 - DNA, 25 bp, Homo sapien
atgtcaggagactggctggcctctt

SEQ ID NO: 18506 - DNA, 25 bp, Homo sapien
cgactccttccagtctgacactgaa

SEQ ID NO: 18507 - DNA, 25 bp, Homo sapien
gcttgcgccgcttcgagatcagcct

SEQ ID NO: 18508 - DNA, 25 bp, Homo sapien
tcttgtccacgaagcgccgttcttg

SEQ ID NO: 18509 - DNA, 25 bp, Homo sapien
ctggctgagggacgccgaaaatccc

SEQ ID NO: 18510 - DNA, 25 bp, Homo sapien
tggcgaacaagttcacgccgcccga

SEQ ID NO: 18511 - DNA, 25 bp, Homo sapien
tcattcagaacggaaagtggacttc

SEQ ID NO: 18512 - DNA, 25 bp, Homo sapien
attttgtcgccaggtgccgcgcaaa

SEQ ID NO: 18513 - DNA, 25 bp, Homo sapien
ggaagctgccgtcgttggcgaacaa

SEQ ID NO: 18514 - DNA, 25 bp, Homo sapien
atcttccgcttgaacagctccagga

SEQ ID NO: 18515 - DNA, 25 bp, Homo sapien
cgaagctaagtgtggagcccggacc

SEQ ID NO: 18516 - DNA, 25 bp, Homo sapien
ccacggctccttacgaagctaagtg

SEQ ID NO: 18517 - DNA, 25 bp, Homo sapien
ccgaacaatgcatgccgggaagagc

SEQ ID NO: 18518 - DNA, 25 bp, Homo sapien
gcagcgcagcctgaagtggatcttc

SEQ ID NO: 18519 - DNA, 25 bp, Homo sapien
tagcaacatcatcgagcagcgcagc

SEQ ID NO: 18520 - DNA, 25 bp, Homo sapien
agccgctggagcctacacttagcaa

SEQ ID NO: 18521 - DNA, 25 bp, Homo sapien
agttcgaagatgctcctgatgtgga

SEQ ID NO: 18522 - DNA, 25 bp, Homo sapien
gatcacgtgagccagttccaaaatg

SEQ ID NO: 18523 - DNA, 25 bp, Homo sapien
gtgtgggcaagaccacctgcaggta

SEQ ID NO: 18524 - DNA, 25 bp, Homo sapien
ccaggaggcgtgtaggatataccac

SEQ ID NO: 18525 - DNA, 25 bp, Homo sapien
cttttccaccacgaccggggcatgg

SEQ ID NO: 18526 - DNA, 25 bp, Homo sapien
actcatgcgctacgcagggctctcg

SEQ ID NO: 18527 - DNA, 25 bp, Homo sapien
cctacaacaagtactgggtgccctg

SEQ ID NO: 18528 - DNA, 25 bp, Homo sapien
cgcgaggagcgcaagaagtttgaaa

SEQ ID NO: 18529 - DNA, 25 bp, Homo sapien
ccagggtttatgacccgcgaggagc

SEQ ID NO: 18530 - DNA, 25 bp, Homo sapien
gcaaggggcgagctatccctgaccc

SEQ ID NO: 18531 - DNA, 25 bp, Homo sapien
accatagaccacgtggtggaggctg

SEQ ID NO: 18532 - DNA, 25 bp, Homo sapien
tcagcaccgcggtgttcaagcgctt

SEQ ID NO: 18533 - DNA, 25 bp, Homo sapien
gcgagggccgcatccgcgacaacag

SEQ ID NO: 18534 - DNA, 25 bp, Homo sapien
ccgcaggctggccaaagaagacatg

SEQ ID NO: 18535 - DNA, 25 bp, Homo sapien
cttcagcatcgtgaccatgcccggg

SEQ ID NO: 18536 - DNA, 25 bp, Homo sapien
tgggcctgtcgagcccttcagcatc

SEQ ID NO: 18537 - DNA, 25 bp, Homo sapien
gccagctgctcatgcgcggttgtcc

SEQ ID NO: 18538 - DNA, 25 bp, Homo sapien
tccgcaagaacagctgcgtgtcgga

SEQ ID NO: 18539 - DNA, 25 bp, Homo sapien
gcctgtcctttctactccgcaagaa

SEQ ID NO: 18540 - DNA, 25 bp, Homo sapien
tgggaccctgctctgtcaacaagag

SEQ ID NO: 18541 - DNA, 25 bp, Homo sapien
aagaagacatgcagttccagcggct

SEQ ID NO: 18542 - DNA, 25 bp, Homo sapien
gaagccgcaggagcgtctccctgca

SEQ ID NO: 18543 - DNA, 25 bp, Homo sapien
ggtgctgcgtctccaacccgtggcg

SEQ ID NO: 18544 - DNA, 25 bp, Homo sapien
cgcgcgcggttggcatcctccaggt

SEQ ID NO: 18545 - DNA, 25 bp, Homo sapien
ttgttctccagctgaagccgcagga

SEQ ID NO: 18546 - DNA, 25 bp, Homo sapien
tgaagccgcaggagcgtctccctgc

SEQ ID NO: 18547 - DNA, 25 bp, Homo sapien
gccagggtcgagtcacctcgcaggc

SEQ ID NO: 18548 - DNA, 25 bp, Homo sapien
gctcaccggtgctgcgtctccaacc

SEQ ID NO: 18549 - DNA, 25 bp, Homo sapien
agggtcgagtcacctcgcaggctcg

SEQ ID NO: 18550 - DNA, 25 bp, Homo sapien
gcgtggccggcgttgcgttcctcca

SEQ ID NO: 18551 - DNA, 25 bp, Homo sapien
ggcaactggtcagcgtggcctccag

SEQ ID NO: 18552 - DNA, 25 bp, Homo sapien
gctcggcgtagctcatcctccagtt

SEQ ID NO: 18553 - DNA, 25 bp, Homo sapien
caacggtgagagacttgctgccagg

SEQ ID NO: 18554 - DNA, 25 bp, Homo sapien
gctggccaacggtgagagacttgct

SEQ ID NO: 18555 - DNA, 25 bp, Homo sapien
ggagagcgtggcctacgtacaaata

SEQ ID NO: 18556 - DNA, 25 bp, Homo sapien
tcatcctccagttgtcgcgtgcgct

SEQ ID NO: 18557 - DNA, 25 bp, Homo sapien
tacgtacaaataagggaggggatca

SEQ ID NO: 18558 - DNA, 25 bp, Homo sapien
acgctcatggctcccgatcggattc

SEQ ID NO: 18559 - DNA, 25 bp, Homo sapien
tcggattcaatccaggccacggagc

SEQ ID NO: 18560 - DNA, 25 bp, Homo sapien
gcagagacccgcatagctcagcttt

SEQ ID NO: 18561 - DNA, 25 bp, Homo sapien
gacctacccaggtgagcagagaccc

SEQ ID NO: 18562 - DNA, 25 bp, Homo sapien
agagtccaacggtccagcaagtcga

SEQ ID NO: 18563 - DNA, 25 bp, Homo sapien
aggcaccacgtgaccaggccaattc

SEQ ID NO: 18564 - DNA, 25 bp, Homo sapien
tccagtcagcgaacctcacatggtg

SEQ ID NO: 18565 - DNA, 25 bp, Homo sapien
caggctccgcctcggaacgtaatct

SEQ ID NO: 18566 - DNA, 25 bp, Homo sapien
ctggcttccggactgggctgtcttc

SEQ ID NO: 18567 - DNA, 25 bp, Homo sapien
cgcatcgcacgaacgcagtcactca

SEQ ID NO: 18568 - DNA, 25 bp, Homo sapien
gtgggaacagctgccgttggctccc

SEQ ID NO: 18569 - DNA, 25 bp, Homo sapien
ttccggactgggctgtcttccggcg

SEQ ID NO: 18570 - DNA, 25 bp, Homo sapien
gggcctcggatgctcgtccatatcc

SEQ ID NO: 18571 - DNA, 25 bp, Homo sapien
cagcccactcatgcgcagccgtacg

SEQ ID NO: 18572 - DNA, 25 bp, Homo sapien
gacacccgattacagcccactcatg

SEQ ID NO: 18573 - DNA, 25 bp, Homo sapien
tcttccggcggtcgtgggaacagct

SEQ ID NO: 18574 - DNA, 25 bp, Homo sapien
ggaaccagagcttcccgcgtagcca

SEQ ID NO: 18575 - DNA, 25 bp, Homo sapien
tagccaggcgcgtgtttcctttccc

SEQ ID NO: 18576 - DNA, 25 bp, Homo sapien
ccagctgcctagtctactgacaatg

SEQ ID NO: 18577 - DNA, 25 bp, Homo sapien
ctgacaatgcgcttcccgctcgtga

SEQ ID NO: 18578 - DNA, 25 bp, Homo sapien
cagtggggccgagaaccaagttctg

SEQ ID NO: 18579 - DNA, 25 bp, Homo sapien
agggacctttcccatggagctgaga

SEQ ID NO: 18580 - DNA, 25 bp, Homo sapien
ttcctgcccgatccgaaacttgtgg

SEQ ID NO: 18581 - DNA, 25 bp, Homo sapien
ccaagttctggggacttcgctctcc

SEQ ID NO: 18582 - DNA, 25 bp, Homo sapien
cacggtcccgtaggatccgagtgac

SEQ ID NO: 18583 - DNA, 25 bp, Homo sapien
tgggtccaggctctaggagccgaca

SEQ ID NO: 18584 - DNA, 25 bp, Homo sapien
cacctcttcctgtgccctaatatgg

SEQ ID NO: 18585 - DNA, 25 bp, Homo sapien
ttcctgtgccctaatatgggcggcg

SEQ ID NO: 18586 - DNA, 25 bp, Homo sapien
ggactcccgcctgttgccatggcga

SEQ ID NO: 18587 - DNA, 25 bp, Homo sapien
caggttcctcttccgaggcgcagga

SEQ ID NO: 18588 - DNA, 25 bp, Homo sapien
ccgtaggatccgagtgacggagaca

SEQ ID NO: 18589 - DNA, 25 bp, Homo sapien
cgccgtcgggccaatggaacactcc

SEQ ID NO: 18590 - DNA, 25 bp, Homo sapien
cggccgccagcttcggaatgttcta

SEQ ID NO: 18591 - DNA, 25 bp, Homo sapien
cggagttcaggaagctcggaccgaa

SEQ ID NO: 18592 - DNA, 25 bp, Homo sapien
gcgggcggcattgagatctacatca

SEQ ID NO: 18593 - DNA, 25 bp, Homo sapien
tggcagctggactagccctcgaacc

SEQ ID NO: 18594 - DNA, 25 bp, Homo sapien
ttctgggcctgtaccgcagtctcag

SEQ ID NO: 18595 - DNA, 25 bp, Homo sapien
cggaatgttctagttcctcggcaac

SEQ ID NO: 18596 - DNA, 25 bp, Homo sapien
ttcctcggcaaccacctgcgggatt

SEQ ID NO: 18597 - DNA, 25 bp, Homo sapien
cagacagtccgcagccatggcgttc

SEQ ID NO: 18598 - DNA, 25 bp, Homo sapien
gcaaccgcaagaagcccgggatcta

SEQ ID NO: 18599 - DNA, 25 bp, Homo sapien
gctcgcgcgtttgcggcaaccgcaa

SEQ ID NO: 18600 - DNA, 25 bp, Homo sapien
gtcctgttccggcagggtgactccg

SEQ ID NO: 18601 - DNA, 25 bp, Homo sapien
aaattaacacgggagggatgagcga

SEQ ID NO: 18602 - DNA, 25 bp, Homo sapien
agaccaaattaacacgggagggatg

SEQ ID NO: 18603 - DNA, 25 bp, Homo sapien
gctattgactagtgaagaccaaatt

SEQ ID NO: 18604 - DNA, 25 bp, Homo sapien
cgcggggctattgactagtgaagac

SEQ ID NO: 18605 - DNA, 25 bp, Homo sapien
gagctatgcggcctggatcgacagc

SEQ ID NO: 18606 - DNA, 25 bp, Homo sapien
ggaagaccaagagcgcatcaaagtg

SEQ ID NO: 18607 - DNA, 25 bp, Homo sapien
tgaagacgctcaaggccgagaacgc

SEQ ID NO: 18608 - DNA, 25 bp, Homo sapien
ggcccagctcaaacagaaggtcatg

SEQ ID NO: 18609 - DNA, 25 bp, Homo sapien
tcatgacccacgtcagcaacggctg

SEQ ID NO: 18610 - DNA, 25 bp, Homo sapien
ggggtcaagggacacgccttctgaa

SEQ ID NO: 18611 - DNA, 25 bp, Homo sapien
ggggcgccgcaaaccacactggact

SEQ ID NO: 18612 - DNA, 25 bp, Homo sapien
tttctgctggaaacagactcgattc

SEQ ID NO: 18613 - DNA, 25 bp, Homo sapien
cctctctgcaccgtactgtggaaaa

SEQ ID NO: 18614 - DNA, 25 bp, Homo sapien
ttgaaggcgccatcaaccaccgctg

SEQ ID NO: 18615 - DNA, 25 bp, Homo sapien
ggcgctcacctttgtagtccgacag

SEQ ID NO: 18616 - DNA, 25 bp, Homo sapien
cccgcaaggacaaaggaggccacta

SEQ ID NO: 18617 - DNA, 25 bp, Homo sapien
ggcggccagcactaaagtcaggatc

SEQ ID NO: 18618 - DNA, 25 bp, Homo sapien
gtgcactccgggtgttcatacctgc

SEQ ID NO: 18619 - DNA, 25 bp, Homo sapien
ttcatacctgcgtgggcaaaggcta

SEQ ID NO: 18620 - DNA, 25 bp, Homo sapien
gcaaaggctagacgcacggacgatc

SEQ ID NO: 18621 - DNA, 25 bp, Homo sapien
gcgaagccttttatgcccggcccga

SEQ ID NO: 18622 - DNA, 25 bp, Homo sapien
tgtctctgcgacctgggcaagcagg

SEQ ID NO: 18623 - DNA, 25 bp, Homo sapien
cccttcgactgcgactggaggctct

SEQ ID NO: 18624 - DNA, 25 bp, Homo sapien
cggcaacgggattgtccatcctgca

SEQ ID NO: 18625 - DNA, 25 bp, Homo sapien
ccctgccggcaacgggattgtccat

SEQ ID NO: 18626 - DNA, 25 bp, Homo sapien
cagttacggccctgccggcaacggg

SEQ ID NO: 18627 - DNA, 25 bp, Homo sapien
agctgatccagttacggccctgccg

SEQ ID NO: 18628 - DNA, 25 bp, Homo sapien
cggttttcatggacccggagaagct

SEQ ID NO: 18629 - DNA, 25 bp, Homo sapien
acccggagaagctgatccagttacg

SEQ ID NO: 18630 - DNA, 25 bp, Homo sapien
acaattcccaggagggcgcacggca

SEQ ID NO: 18631 - DNA, 25 bp, Homo sapien
tggagagagacaatacaggccgctg

SEQ ID NO: 18632 - DNA, 25 bp, Homo sapien
agacccgctcctgcagtattagttc

SEQ ID NO: 18633 - DNA, 25 bp, Homo sapien
tacaggccgctgtcgcctgagttcg

SEQ ID NO: 18634 - DNA, 25 bp, Homo sapien
cggccatagcccttcgggactacaa

SEQ ID NO: 18635 - DNA, 25 bp, Homo sapien
cccaagctgagtgttcggccatagc

SEQ ID NO: 18636 - DNA, 25 bp, Homo sapien
ccagagaccgtgaagcagagcttgc

SEQ ID NO: 18637 - DNA, 25 bp, Homo sapien
attagttcttgcagctggtggtggc

SEQ ID NO: 18638 - DNA, 25 bp, Homo sapien
tcgtcctggtctgggacgaggtacc

SEQ ID NO: 18639 - DNA, 25 bp, Homo sapien
atgtgtaaattccttagggattggg

SEQ ID NO: 18640 - DNA, 25 bp, Homo sapien
ttaaggccctagtgggcggagtcca

SEQ ID NO: 18641 - DNA, 25 bp, Homo sapien
ctgcgaaggtctaggaaaaagtgga

SEQ ID NO: 18642 - DNA, 25 bp, Homo sapien
gtcccgtctgcgaaggtctaggaaa

SEQ ID NO: 18643 - DNA, 25 bp, Homo sapien
gagcgacaaaggtccgtcccgtctg

SEQ ID NO: 18644 - DNA, 25 bp, Homo sapien
gcgtggcccagagccgagcgacaaa

SEQ ID NO: 18645 - DNA, 25 bp, Homo sapien
agatgttgaagcagtgacgggctcc

SEQ ID NO: 18646 - DNA, 25 bp, Homo sapien
aatgggcaaagtacgcgagaaaacg

SEQ ID NO: 18647 - DNA, 25 bp, Homo sapien
ttcctgggcaatgggcaaagtacgc

SEQ ID NO: 18648 - DNA, 25 bp, Homo sapien
gagttcctgggcaatgggcaaagta

SEQ ID NO: 18649 - DNA, 25 bp, Homo sapien
tcgcatctggacgttgggagagata

SEQ ID NO: 18650 - DNA, 25 bp, Homo sapien
aggaaggattcgcatctggacgttg

SEQ ID NO: 18651 - DNA, 25 bp, Homo sapien
aagcgactgcgaagggcacgttgga

SEQ ID NO: 18652 - DNA, 25 bp, Homo sapien
gctgtgcctggcgtacccccaatag

SEQ ID NO: 18653 - DNA, 25 bp, Homo sapien
ccaatagccgcaggcggaagcgact

SEQ ID NO: 18654 - DNA, 25 bp, Homo sapien
cagcgagacggcgacacaaatgtgc

SEQ ID NO: 18655 - DNA, 25 bp, Homo sapien
caaaggcgcggacttgaggcgacaa

SEQ ID NO: 18656 - DNA, 25 bp, Homo sapien
gccgacaaacatatacagagacaga

SEQ ID NO: 18657 - DNA, 25 bp, Homo sapien
cgccatcgtgagataggtcgccagg

SEQ ID NO: 18658 - DNA, 25 bp, Homo sapien
cgcgagaccagcaccaaggagagct

SEQ ID NO: 18659 - DNA, 25 bp, Homo sapien
cgaccctgcgcttggatttcagcac

SEQ ID NO: 18660 - DNA, 25 bp, Homo sapien
gacaagctcctggtgaatacccgga

SEQ ID NO: 18661 - DNA, 25 bp, Homo sapien
acagagataacccaggcaaaggcgc

SEQ ID NO: 18662 - DNA, 25 bp, Homo sapien
ggcgcagagcaaagttattgcccta

SEQ ID NO: 18663 - DNA, 25 bp, Homo sapien
gtaaacatgtttgtgcggcaacctc

SEQ ID NO: 18664 - DNA, 25 bp, Homo sapien
ccgccatggacgattcgggcctcat

SEQ ID NO: 18665 - DNA, 25 bp, Homo sapien
cgggagaacttgcactagggtcagc

SEQ ID NO: 18666 - DNA, 25 bp, Homo sapien
ctggggccgaagtcatcgccctggc

SEQ ID NO: 18667 - DNA, 25 bp, Homo sapien
agttattgccctagggctcatgccc

SEQ ID NO: 18668 - DNA, 25 bp, Homo sapien
tcccgaggcataggacgccctgcgt

SEQ ID NO: 18669 - DNA, 25 bp, Homo sapien
ccataggttcgggacgctaaccgcg

SEQ ID NO: 18670 - DNA, 25 bp, Homo sapien
tggcgcctttgtctgctggcgctgc

SEQ ID NO: 18671 - DNA, 25 bp, Homo sapien
cggcagtatgttccgccgcaccaag

SEQ ID NO: 18672 - DNA, 25 bp, Homo sapien
ttctaatttctcgatgccctccttc

SEQ ID NO: 18673 - DNA, 25 bp, Homo sapien
accgcgctttctaatttctcgatgc

SEQ ID NO: 18674 - DNA, 25 bp, Homo sapien
tctggaccgcgctttctaatttctc

SEQ ID NO: 18675 - DNA, 25 bp, Homo sapien
actctctctggaccgcgctttctaa

SEQ ID NO: 18676 - DNA, 25 bp, Homo sapien
gccgccgggtcatgtctgactctct

SEQ ID NO: 18677 - DNA, 25 bp, Homo sapien
gtttgtggcgcctttgtctgctggc

SEQ ID NO: 18678 - DNA, 25 bp, Homo sapien
ctcacttgggtctccacagcagcgc

SEQ ID NO: 18679 - DNA, 25 bp, Homo sapien
ctgcatggacagagctgcaaggccc

SEQ ID NO: 18680 - DNA, 25 bp, Homo sapien
tgtgtgctgcatggacagagctgca

SEQ ID NO: 18681 - DNA, 25 bp, Homo sapien
tcctgtttgcctacgtgtgtgctgc

SEQ ID NO: 18682 - DNA, 25 bp, Homo sapien
gccggccgagctggtttgcagactc

SEQ ID NO: 18683 - DNA, 25 bp, Homo sapien
gaagccaccggtagctccactgaga

SEQ ID NO: 18684 - DNA, 25 bp, Homo sapien
cgcctgtgcgcagctcaggaagcca

SEQ ID NO: 18685 - DNA, 25 bp, Homo sapien
cggtggctcctgtttgcctacgtgt

SEQ ID NO: 18686 - DNA, 25 bp, Homo sapien
ctcctggccaggtgtttccatagca

SEQ ID NO: 18687 - DNA, 25 bp, Homo sapien
tccaatcgccgatctggaacgggga

SEQ ID NO: 18688 - DNA, 25 bp, Homo sapien
cggggtcttagtctctccgagcctt

SEQ ID NO: 18689 - DNA, 25 bp, Homo sapien
cgcgatgcctatcgagggactcttg

SEQ ID NO: 18690 - DNA, 25 bp, Homo sapien
ttccatagcaacaggacggggcagc

SEQ ID NO: 18691 - DNA, 25 bp, Homo sapien
agccaagatgacgtgcgcaagcgca

SEQ ID NO: 18692 - DNA, 25 bp, Homo sapien
gcaagcgcagattgcgcgatgccta

SEQ ID NO: 18693 - DNA, 25 bp, Homo sapien
ctccctttgcggcaggtcgaaagcg

SEQ ID NO: 18694 - DNA, 25 bp, Homo sapien
agccacatggaaacgccgcagacac

SEQ ID NO: 18695 - DNA, 25 bp, Homo sapien
catggaaacgccgcagacacccgga

SEQ ID NO: 18696 - DNA, 25 bp, Homo sapien
cctcgccagcgctcctgcactctgg

SEQ ID NO: 18697 - DNA, 25 bp, Homo sapien
gagccacatggaaacgccgcagaca

SEQ ID NO: 18698 - DNA, 25 bp, Homo sapien
cagagccacatggaaacgccgcaga

SEQ ID NO: 18699 - DNA, 25 bp, Homo sapien
tgcactctggtctctgcagagccac

SEQ ID NO: 18700 - DNA, 25 bp, Homo sapien
gctcctgcactctggtctctgcaga

SEQ ID NO: 18701 - DNA, 25 bp, Homo sapien
gcagacacccggacaaaagccgccc

SEQ ID NO: 18702 - DNA, 25 bp, Homo sapien
atggcgtgctcagcttcatccacca

SEQ ID NO: 18703 - DNA, 25 bp, Homo sapien
gtgacggcctcatcaccacggtcta

SEQ ID NO: 18704 - DNA, 25 bp, Homo sapien
atcacgtctacaaggagaggttccc

SEQ ID NO: 18705 - DNA, 25 bp, Homo sapien
ggactcgacaaaatgggcttctctc

SEQ ID NO: 18706 - DNA, 25 bp, Homo sapien
ttaggacttgtgcttagagagaccc

SEQ ID NO: 18707 - DNA, 25 bp, Homo sapien
ccttcgtaccaagctagtggtctta

SEQ ID NO: 18708 - DNA, 25 bp, Homo sapien
actgcctgaccaagtcccgtgacgg

SEQ ID NO: 18709 - DNA, 25 bp, Homo sapien
ccacggtctacttctatgaattgca

SEQ ID NO: 18710 - DNA, 25 bp, Homo sapien
gtggagcgcgatatcctcaccttcg

SEQ ID NO: 18711 - DNA, 25 bp, Homo sapien
atgttctgctcctttgagactcggc

SEQ ID NO: 18712 - DNA, 25 bp, Homo sapien
ggggagaatgacttcgataccatca

SEQ ID NO: 18713 - DNA, 25 bp, Homo sapien
tcaagctcataagcaacggtgccta

SEQ ID NO: 18714 - DNA, 25 bp, Homo sapien
gcagaacttgatcctccgcaaccag

SEQ ID NO: 18715 - DNA, 25 bp, Homo sapien
caccttcgccgagaacccgtttgtg

SEQ ID NO: 18716 - DNA, 25 bp, Homo sapien
acccgtttgtggtcggcatgttctg

SEQ ID NO: 18717 - DNA, 25 bp, Homo sapien
cgcggcagcgctttgccatgaaaaa

SEQ ID NO: 18718 - DNA, 25 bp, Homo sapien
gccgccgtttctcggcgctgctgga

SEQ ID NO: 18719 - DNA, 25 bp, Homo sapien
accctgcgtgagaagacctggagag

SEQ ID NO: 18720 - DNA, 25 bp, Homo sapien
ctctccggagatgtgagcaggggaa

SEQ ID NO: 18721 - DNA, 25 bp, Homo sapien
ggggcgtgtcttccataaccacgcc

SEQ ID NO: 18722 - DNA, 25 bp, Homo sapien
tccatgcagcaagcgattctccgcg

SEQ ID NO: 18723 - DNA, 25 bp, Homo sapien
cggcctgaccctgcgtgagaagacc

SEQ ID NO: 18724 - DNA, 25 bp, Homo sapien
gattctccgcgtccgaggccagttt

SEQ ID NO: 18725 - DNA, 25 bp, Homo sapien
agcaagcgattctccgcgtccgagg

SEQ ID NO: 18726 - DNA, 25 bp, Homo sapien
aggccaccagtgtcgagcaaggaga

SEQ ID NO: 18727 - DNA, 25 bp, Homo sapien
ggtacccattgtcgtagagcctgcg

SEQ ID NO: 18728 - DNA, 25 bp, Homo sapien
ccggatttccgcaaggacttccatg

SEQ ID NO: 18729 - DNA, 25 bp, Homo sapien
gtgggcagctcgcacactactcaga

SEQ ID NO: 18730 - DNA, 25 bp, Homo sapien
tgtcgccaaagctccatcgccagta

SEQ ID NO: 18731 - DNA, 25 bp, Homo sapien
gcacgctgcacggactgtcgccaaa

SEQ ID NO: 18732 - DNA, 25 bp, Homo sapien
cttgggctgtactcactcgcttcac

SEQ ID NO: 18733 - DNA, 25 bp, Homo sapien
gcctgactccgcctacctaggtatt

SEQ ID NO: 18734 - DNA, 25 bp, Homo sapien
cggagctctcgtccagatacttgta

SEQ ID NO: 18735 - DNA, 25 bp, Homo sapien
ggcaacgtgaaattcctcccaggca

SEQ ID NO: 18736 - DNA, 25 bp, Homo sapien
agcctggccaccgttccttttcgtg

SEQ ID NO: 18737 - DNA, 25 bp, Homo sapien
ctatggggctgagatccaggaatct

SEQ ID NO: 18738 - DNA, 25 bp, Homo sapien
tgcgcactcaccagtctacaggctg

SEQ ID NO: 18739 - DNA, 25 bp, Homo sapien
ggaccctctaagagctggcagcttg

SEQ ID NO: 18740 - DNA, 25 bp, Homo sapien
tttcgtggtagctaatcccagccca

SEQ ID NO: 18741 - DNA, 25 bp, Homo sapien
tggcagcttgtagaccacgaacctg

SEQ ID NO: 18742 - DNA, 25 bp, Homo sapien
tggtgtagctcttgccgcaacccgg

SEQ ID NO: 18743 - DNA, 25 bp, Homo sapien
aagagctggaagtgcccttggtact

SEQ ID NO: 18744 - DNA, 25 bp, Homo sapien
tacatcgcggggtacccggacagta

SEQ ID NO: 18745 - DNA, 25 bp, Homo sapien
gcagggcgcacccaacccgagtgat

SEQ ID NO: 18746 - DNA, 25 bp, Homo sapien
gagtgatcctccgaacccaaaagcc

SEQ ID NO: 18747 - DNA, 25 bp, Homo sapien
ggccgccagcatatgcgcccagagt

SEQ ID NO: 18748 - DNA, 25 bp, Homo sapien
ggctggtcctcagacttcacgtgga

SEQ ID NO: 18749 - DNA, 25 bp, Homo sapien
cggtctcggctatcacacctggatc

SEQ ID NO: 18750 - DNA, 25 bp, Homo sapien
tcagaggcactaaggcagtgagtgc

SEQ ID NO: 18751 - DNA, 25 bp, Homo sapien
gtagggctgatgagggtccgagaag

SEQ ID NO: 18752 - DNA, 25 bp, Homo sapien
tcgcttgcagctcgcactagccggg

SEQ ID NO: 18753 - DNA, 25 bp, Homo sapien
tgatcagtctcgcttgcagctcgca

SEQ ID NO: 18754 - DNA, 25 bp, Homo sapien
tcacctgatcagtctcgcttgcagc

SEQ ID NO: 18755 - DNA, 25 bp, Homo sapien
agtcacctgatcagtctcgcttgca

SEQ ID NO: 18756 - DNA, 25 bp, Homo sapien
cacagtgatcttgcggactggaccg

SEQ ID NO: 18757 - DNA, 25 bp, Homo sapien
agaaaagtcacctgatcagtctcgc

SEQ ID NO: 18758 - DNA, 25 bp, Homo sapien
gttaagcagcagtttcgcggtccgc

SEQ ID NO: 18759 - DNA, 25 bp, Homo sapien
atcagacccgtcagtgcgtcagtca

SEQ ID NO: 18760 - DNA, 25 bp, Homo sapien
ccgggttcagtcagtcaggaaattt

SEQ ID NO: 18761 - DNA, 25 bp, Homo sapien
gggatcgcagccgttccctgcctat

SEQ ID NO: 18762 - DNA, 25 bp, Homo sapien
tccctgtcgctccattccgtatttt

SEQ ID NO: 18763 - DNA, 25 bp, Homo sapien
gtattttcccgccttcaagctcgca

SEQ ID NO: 18764 - DNA, 25 bp, Homo sapien
ccctctttgagaacttgcgcggcca

SEQ ID NO: 18765 - DNA, 25 bp, Homo sapien
ccacgcgccatgtgtggaaatcaga

SEQ ID NO: 18766 - DNA, 25 bp, Homo sapien
cggacaagatgtcgggcactccctt

SEQ ID NO: 18767 - DNA, 25 bp, Homo sapien
cagtgattcggtccgtcaggctctg

SEQ ID NO: 18768 - DNA, 25 bp, Homo sapien
actgtcttggatacggcagagccgg

SEQ ID NO: 18769 - DNA, 25 bp, Homo sapien
tcgtggccttgcatactgtcttgga

SEQ ID NO: 18770 - DNA, 25 bp, Homo sapien
gcgcgctgccaccagtccagagaga

SEQ ID NO: 18771 - DNA, 25 bp, Homo sapien
gtccagagagaaccggctcgtgtca

SEQ ID NO: 18772 - DNA, 25 bp, Homo sapien
cccgcgcgttacgtgatggaactcg

SEQ ID NO: 18773 - DNA, 25 bp, Homo sapien
gctctggccggacatctctgcagct

SEQ ID NO: 18774 - DNA, 25 bp, Homo sapien
atccgccatgactccttccagtgtg

SEQ ID NO: 18775 - DNA, 25 bp, Homo sapien
accggagtgtgtaccgccatcttga

SEQ ID NO: 18776 - DNA, 25 bp, Homo sapien
ccgccatcttgaatgtgtctaactg

SEQ ID NO: 18777 - DNA, 25 bp, Homo sapien
cagggctcaatgtgtcgtcatcttg

SEQ ID NO: 18778 - DNA, 25 bp, Homo sapien
tgtctaactgtagaacagggctcaa

SEQ ID NO: 18779 - DNA, 25 bp, Homo sapien
cccaaactaggcctgagggaatttg

SEQ ID NO: 18780 - DNA, 25 bp, Homo sapien
aatttggcttggacgtagagcgccc

SEQ ID NO: 18781 - DNA, 25 bp, Homo sapien
cccggagtggacacatatacagcta

SEQ ID NO: 18782 - DNA, 25 bp, Homo sapien
cgcggtttctttaaacgcccagatg

SEQ ID NO: 18783 - DNA, 25 bp, Homo sapien
ccgaggatctctgaaggcacccgac

SEQ ID NO: 18784 - DNA, 25 bp, Homo sapien
gatttctcttctgcgtccctgggga

SEQ ID NO: 18785 - DNA, 25 bp, Homo sapien
ggatctgcgttgtcgcccgtaatta

SEQ ID NO: 18786 - DNA, 25 bp, Homo sapien
gccgtctacttcaaggagcagtttc

SEQ ID NO: 18787 - DNA, 25 bp, Homo sapien
gacggccatgggcatagaccaatga

SEQ ID NO: 18788 - DNA, 25 bp, Homo sapien
ttccgaggcgcagcctaacatagtg

SEQ ID NO: 18789 - DNA, 25 bp, Homo sapien
cccacgcgtggtcgaccatcattgg

SEQ ID NO: 18790 - DNA, 25 bp, Homo sapien
ctctccgcgggtgaggcaaggaaac

SEQ ID NO: 18791 - DNA, 25 bp, Homo sapien
cgtcacggacggtcctctggatgca

SEQ ID NO: 18792 - DNA, 25 bp, Homo sapien
cgggtcaccacaaggtccgcctgga

SEQ ID NO: 18793 - DNA, 25 bp, Homo sapien
tgtccaggttcagcgctctccgcgg

SEQ ID NO: 18794 - DNA, 25 bp, Homo sapien
cagagggcgtttattggacctgtcc

SEQ ID NO: 18795 - DNA, 25 bp, Homo sapien
tcagaagctctgctggtcacgcagg

SEQ ID NO: 18796 - DNA, 25 bp, Homo sapien
tctggatgcagatggtccagggatc

SEQ ID NO: 18797 - DNA, 25 bp, Homo sapien
caaaggcaggggcttcctcagaagc

SEQ ID NO: 18798 - DNA, 25 bp, Homo sapien
accgataacgggcatggcgtcactc

SEQ ID NO: 18799 - DNA, 25 bp, Homo sapien
gcccacagcgcggagtttagtctgc

SEQ ID NO: 18800 - DNA, 25 bp, Homo sapien
gtgcctcgctcgagaacgcgctcgt

SEQ ID NO: 18801 - DNA, 25 bp, Homo sapien
gtgcgcatgcccacaaaggccaagg

SEQ ID NO: 18802 - DNA, 25 bp, Homo sapien
atggcgtcactcaggagaccacgtg

SEQ ID NO: 18803 - DNA, 25 bp, Homo sapien
ggctccaatgtcagcgctctcgcgg

SEQ ID NO: 18804 - DNA, 25 bp, Homo sapien
cagaccttcaagatccgcatggagc

SEQ ID NO: 18805 - DNA, 25 bp, Homo sapien
agttgcatgttgtgtgaggatcccg

SEQ ID NO: 18806 - DNA, 25 bp, Homo sapien
atggtcgccaggctcgggtaccatt

SEQ ID NO: 18807 - DNA, 25 bp, Homo sapien
cgggctgtccatgcccggtgcctga

SEQ ID NO: 18808 - DNA, 25 bp, Homo sapien
catcttggctgtgcggggtcctcac

SEQ ID NO: 18809 - DNA, 25 bp, Homo sapien
ccgtaacgcgcgaactgcttagccg

SEQ ID NO: 18810 - DNA, 25 bp, Homo sapien
agcgactcctgcatggtcgccaggc

SEQ ID NO: 18811 - DNA, 25 bp, Homo sapien
ggtaccattcgcgttcttcggcctc

SEQ ID NO: 18812 - DNA, 25 bp, Homo sapien
acacctagtaggctgcgtgcctgtc

SEQ ID NO: 18813 - DNA, 25 bp, Homo sapien
tgcttagccgcgtagcgcggtccca

SEQ ID NO: 18814 - DNA, 25 bp, Homo sapien
cctcacatgggagcggggctaagaa

SEQ ID NO: 18815 - DNA, 25 bp, Homo sapien
gcaaaagcttcgaggatgcctgtcg

SEQ ID NO: 18816 - DNA, 25 bp, Homo sapien
cgaccttggcgcgttgctagagcgc

SEQ ID NO: 18817 - DNA, 25 bp, Homo sapien
tcgggcacaacagcgccgaccttgg

SEQ ID NO: 18818 - DNA, 25 bp, Homo sapien
agccgtggacacagccgacagtgct

SEQ ID NO: 18819 - DNA, 25 bp, Homo sapien
ctttcctcggcgcaaactttctggc

SEQ ID NO: 18820 - DNA, 25 bp, Homo sapien
ggctaagaaaatggcggggctccca

SEQ ID NO: 18821 - DNA, 25 bp, Homo sapien
ccaaagtctttgtttaggcctcaca

SEQ ID NO: 18822 - DNA, 25 bp, Homo sapien
gtccgtgtcaacttgtgtccacata

SEQ ID NO: 18823 - DNA, 25 bp, Homo sapien
tgctcagtcccttcccatgaggttg

SEQ ID NO: 18824 - DNA, 25 bp, Homo sapien
tgtcaacgcacgtgtctccagtgtc

SEQ ID NO: 18825 - DNA, 25 bp, Homo sapien
tgtgcgtcacggcaaagagtgtatc

SEQ ID NO: 18826 - DNA, 25 bp, Homo sapien
gtcccagcgacatgcgtcacatcta

SEQ ID NO: 18827 - DNA, 25 bp, Homo sapien
tgccggatgtagtctctgtgtcacg

SEQ ID NO: 18828 - DNA, 25 bp, Homo sapien
catcgcacgccctgtctcttgtgta

SEQ ID NO: 18829 - DNA, 25 bp, Homo sapien
tggcctccgagcaccatgtgagatg

SEQ ID NO: 18830 - DNA, 25 bp, Homo sapien
tgtgaggcgcagctgtgcccagaac

SEQ ID NO: 18831 - DNA, 25 bp, Homo sapien
ctctgtgaggcgcagctgtgcccag

SEQ ID NO: 18832 - DNA, 25 bp, Homo sapien
agaactccaagttgcgtttgccacc

SEQ ID NO: 18833 - DNA, 25 bp, Homo sapien
ctccaagttgcgtttgccaccacta

SEQ ID NO: 18834 - DNA, 25 bp, Homo sapien
tttgccaccactaccgatgtggctg

SEQ ID NO: 18835 - DNA, 25 bp, Homo sapien
accactaccgatgtggctgcgccag

SEQ ID NO: 18836 - DNA, 25 bp, Homo sapien
taccgatgtggctgcgccagccagg

SEQ ID NO: 18837 - DNA, 25 bp, Homo sapien
cacggagctggggtgtctggcttct

SEQ ID NO: 18838 - DNA, 25 bp, Homo sapien
ttccctgcgcgcatcatggacttca

SEQ ID NO: 18839 - DNA, 25 bp, Homo sapien
atagctctttgatatcccagcccgg

SEQ ID NO: 18840 - DNA, 25 bp, Homo sapien
gtgcctgtacgtaccctacctgaga

SEQ ID NO: 18841 - DNA, 25 bp, Homo sapien
tggacccgctgcaactgactcaaga

SEQ ID NO: 18842 - DNA, 25 bp, Homo sapien
tgtgctttccatgtcgcgggcaaaa

SEQ ID NO: 18843 - DNA, 25 bp, Homo sapien
tgtcacttgcatcgcacactgaggg

SEQ ID NO: 18844 - DNA, 25 bp, Homo sapien
tgtgccgccagagtcttctcaatga

SEQ ID NO: 18845 - DNA, 25 bp, Homo sapien
aatgatccctcccaggcaccgtagg

SEQ ID NO: 18846 - DNA, 25 bp, Homo sapien
cctgtcccgcgactgagcttgcggt

SEQ ID NO: 18847 - DNA, 25 bp, Homo sapien
cgagcttctgcgctgcctctgtcgt

SEQ ID NO: 18848 - DNA, 25 bp, Homo sapien
tgtctcatttaggagcgagcttctg

SEQ ID NO: 18849 - DNA, 25 bp, Homo sapien
tccgccactgaaaaggcgctataga

SEQ ID NO: 18850 - DNA, 25 bp, Homo sapien
gggcacctgagatctccgccactga

SEQ ID NO: 18851 - DNA, 25 bp, Homo sapien
attctctagtagaccctggcgtggg

SEQ ID NO: 18852 - DNA, 25 bp, Homo sapien
tggagctggcgagcctcgcctgtcc

SEQ ID NO: 18853 - DNA, 25 bp, Homo sapien
ctctgtcgtcggagcccgggtttgc

SEQ ID NO: 18854 - DNA, 25 bp, Homo sapien
ggcccttcgacgagcagatccggaa

SEQ ID NO: 18855 - DNA, 25 bp, Homo sapien
ccaaccgaagccagtctttgctctg

SEQ ID NO: 18856 - DNA, 25 bp, Homo sapien
aggcatcgcggcacctccgttgaac

SEQ ID NO: 18857 - DNA, 25 bp, Homo sapien
cgccgccgctacaagttccttaaag

SEQ ID NO: 18858 - DNA, 25 bp, Homo sapien
cttaaagacaagtttcgcgaggcgc

SEQ ID NO: 18859 - DNA, 25 bp, Homo sapien
tcggcacaggctaaaaacgagcgga

SEQ ID NO: 18860 - DNA, 25 bp, Homo sapien
cagaactcctgaggaccctccgttt

SEQ ID NO: 18861 - DNA, 25 bp, Homo sapien
tgaacgggtctaagaacagaactcc

SEQ ID NO: 18862 - DNA, 25 bp, Homo sapien
tttcgacgaacccagcgcaagagta

SEQ ID NO: 18863 - DNA, 25 bp, Homo sapien
gggtagaaaactacctggttcagca

SEQ ID NO: 18864 - DNA, 25 bp, Homo sapien
ttacgaagcgtctagagtataattc

SEQ ID NO: 18865 - DNA, 25 bp, Homo sapien
acgagaattcaaacagaggaggggc

SEQ ID NO: 18866 - DNA, 25 bp, Homo sapien
tacctggttcagcaaacgagaattc

SEQ ID NO: 18867 - DNA, 25 bp, Homo sapien
gagtataattcggtagcgctttgaa

SEQ ID NO: 18868 - DNA, 25 bp, Homo sapien
agcgcaagagtacgccacggcgcct

SEQ ID NO: 18869 - DNA, 25 bp, Homo sapien
gcgctttgaaatccaccctgggatt

SEQ ID NO: 18870 - DNA, 25 bp, Homo sapien
cctggtttgcgctagagccgtttaa

SEQ ID NO: 18871 - DNA, 25 bp, Homo sapien
tgcgctagagccgtttaaaaaagaa

SEQ ID NO: 18872 - DNA, 25 bp, Homo sapien
tccgctccggtctgattcgcaaatc

SEQ ID NO: 18873 - DNA, 25 bp, Homo sapien
actggcacaaaccgggaaacttgcg

SEQ ID NO: 18874 - DNA, 25 bp, Homo sapien
gagttggagacagccctctcctctt

SEQ ID NO: 18875 - DNA, 25 bp, Homo sapien
ccactgcctggtttgcgctagagcc

SEQ ID NO: 18876 - DNA, 25 bp, Homo sapien
gaaagcgcgcttttcggcagagctg

SEQ ID NO: 18877 - DNA, 25 bp, Homo sapien
cggcagagctggttagtttttaatg

SEQ ID NO: 18878 - DNA, 25 bp, Homo sapien
aagatccggcggattgactgcctgc

SEQ ID NO: 18879 - DNA, 25 bp, Homo sapien
cgtctgtgcagacggacactgtgcc

SEQ ID NO: 18880 - DNA, 25 bp, Homo sapien
ctgacaggagttcacggctgcgata

SEQ ID NO: 18881 - DNA, 25 bp, Homo sapien
ggctgcgatagaacatggagatgtc

SEQ ID NO: 18882 - DNA, 25 bp, Homo sapien
acggcaacgttgtctgtgcgcgtgt

SEQ ID NO: 18883 - DNA, 25 bp, Homo sapien
agaataggtgtgtgtagaggctccc

SEQ ID NO: 18884 - DNA, 25 bp, Homo sapien
tgctgaccatcacgggcaagaagcc

SEQ ID NO: 18885 - DNA, 25 bp, Homo sapien
ggtggcttcaaaccacactttcgta

SEQ ID NO: 18886 - DNA, 25 bp, Homo sapien
gtgccttcatgcgtcactctattta

SEQ ID NO: 18887 - DNA, 25 bp, Homo sapien
agcgcccgctctcaggagcgagctg

SEQ ID NO: 18888 - DNA, 25 bp, Homo sapien
ctctatttatgttgttcgcagccca

SEQ ID NO: 18889 - DNA, 25 bp, Homo sapien
ttcgcagcccaacggtagcggccag

SEQ ID NO: 18890 - DNA, 25 bp, Homo sapien
gggtcatttttgctaccgccgccgc

SEQ ID NO: 18891 - DNA, 25 bp, Homo sapien
tatgcctgattccaaatccaccagc

SEQ ID NO: 18892 - DNA, 25 bp, Homo sapien
caccttgtaagtggacgatgaaacc

SEQ ID NO: 18893 - DNA, 25 bp, Homo sapien
gatgaaaccgaaaccacaacgccca

SEQ ID NO: 18894 - DNA, 25 bp, Homo sapien
agaggtggcggaagtctcagcaccc

SEQ ID NO: 18895 - DNA, 25 bp, Homo sapien
agtcctgtgtttggggaccaatgca

SEQ ID NO: 18896 - DNA, 25 bp, Homo sapien
tttggggaccaatgcagggacacac

SEQ ID NO: 18897 - DNA, 25 bp, Homo sapien
aatgcagggacacacgcacctggcg

SEQ ID NO: 18898 - DNA, 25 bp, Homo sapien
caaactgcagacgaaggggctgctt

SEQ ID NO: 18899 - DNA, 25 bp, Homo sapien
gcaggcggctaaccaggccgtcgct

SEQ ID NO: 18900 - DNA, 25 bp, Homo sapien
ggcagcaggcagcattcatccacca

SEQ ID NO: 18901 - DNA, 25 bp, Homo sapien
acacggaggaaggagtcctgtgttt

SEQ ID NO: 18902 - DNA, 25 bp, Homo sapien
cagttcggttggctaaacagggtca

SEQ ID NO: 18903 - DNA, 25 bp, Homo sapien
tccctcgacgacagtcgagggctcg

SEQ ID NO: 18904 - DNA, 25 bp, Homo sapien
gcccacgtgccctttccctcgacga

SEQ ID NO: 18905 - DNA, 25 bp, Homo sapien
aatgatttttcagttcggttggcta

SEQ ID NO: 18906 - DNA, 25 bp, Homo sapien
ctgagagcgaagcagaaggggctcc

SEQ ID NO: 18907 - DNA, 25 bp, Homo sapien
cgcggtcaaagtgcaatgatttttc

SEQ ID NO: 18908 - DNA, 25 bp, Homo sapien
tcggttggctaaacagggtcagagc

SEQ ID NO: 18909 - DNA, 25 bp, Homo sapien
gttggctaaacagggtcagagctga

SEQ ID NO: 18910 - DNA, 25 bp, Homo sapien
ctgctctgccatgttgctttgccga

SEQ ID NO: 18911 - DNA, 25 bp, Homo sapien
ccgtcactgcgcttctgttatacca

SEQ ID NO: 18912 - DNA, 25 bp, Homo sapien
caagtaggcagccagcccgtctgtt

SEQ ID NO: 18913 - DNA, 25 bp, Homo sapien
cccggaaaaaatgaggcaccacttg

SEQ ID NO: 18914 - DNA, 25 bp, Homo sapien
gttttcagtgtcctagcggaatgca

SEQ ID NO: 18915 - DNA, 25 bp, Homo sapien
gcaaggccacttccagagggttgtg

SEQ ID NO: 18916 - DNA, 25 bp, Homo sapien
acttgggtcctatgactgctctgcc

SEQ ID NO: 18917 - DNA, 25 bp, Homo sapien
tctctccggcttctccattgaatgg

SEQ ID NO: 18918 - DNA, 25 bp, Homo sapien
aggatgctggcccagtgcagataag

SEQ ID NO: 18919 - DNA, 25 bp, Homo sapien
ccaggatagccgaggtctccgcgta

SEQ ID NO: 18920 - DNA, 25 bp, Homo sapien
cccagggaaagtgagcggctcccgg

SEQ ID NO: 18921 - DNA, 25 bp, Homo sapien
tggctgaccccggaggaaaccagcg

SEQ ID NO: 18922 - DNA, 25 bp, Homo sapien
tagccgaggtctccgcgtaggtccc

SEQ ID NO: 18923 - DNA, 25 bp, Homo sapien
tgctggcccagtgcagataagggcc

SEQ ID NO: 18924 - DNA, 25 bp, Homo sapien
cgagggtccggcctcaatgctccag

SEQ ID NO: 18925 - DNA, 25 bp, Homo sapien
cctggccgcgcctgataaggagcct

SEQ ID NO: 18926 - DNA, 25 bp, Homo sapien
cacctggtctggagcggatgcacag

SEQ ID NO: 18927 - DNA, 25 bp, Homo sapien
cccgtggccgcttcgggaatcgctg

SEQ ID NO: 18928 - DNA, 25 bp, Homo sapien
atgcacagggcgcctggttccggtc

SEQ ID NO: 18929 - DNA, 25 bp, Homo sapien
gttccggtccagcttccgccactgt

SEQ ID NO: 18930 - DNA, 25 bp, Homo sapien
cctggagagctgggccaaagaaacc

SEQ ID NO: 18931 - DNA, 25 bp, Homo sapien
cactatgcgcaagcccgtggcctgg

SEQ ID NO: 18932 - DNA, 25 bp, Homo sapien
ggccgcttcgggaatcgctggctcc

SEQ ID NO: 18933 - DNA, 25 bp, Homo sapien
ctcagggcaggaagcacctggtctg

SEQ ID NO: 18934 - DNA, 25 bp, Homo sapien
ggtgactgtcgtctcctggacttca

SEQ ID NO: 18935 - DNA, 25 bp, Homo sapien
aaaacctgcggcctcggtaagctga

SEQ ID NO: 18936 - DNA, 25 bp, Homo sapien
ggcccggggatgtcctacatatcta

SEQ ID NO: 18937 - DNA, 25 bp, Homo sapien
cgatccttgcatgagacatccgctg

SEQ ID NO: 18938 - DNA, 25 bp, Homo sapien
ggcttagccacagagacgatccttg

SEQ ID NO: 18939 - DNA, 25 bp, Homo sapien
gccgttctccatcgctgctgtattc

SEQ ID NO: 18940 - DNA, 25 bp, Homo sapien
gctcacgtcaggtcccgattgaatt

SEQ ID NO: 18941 - DNA, 25 bp, Homo sapien
gccctggagactgccactcgaaaaa

SEQ ID NO: 18942 - DNA, 25 bp, Homo sapien
cggcaggatcgtacctggaccgctc

SEQ ID NO: 18943 - DNA, 25 bp, Homo sapien
catagagaggagacggagccggtta

SEQ ID NO: 18944 - DNA, 25 bp, Homo sapien
cgaggatcccccaggggcatagaga

SEQ ID NO: 18945 - DNA, 25 bp, Homo sapien
gcggcctggcccacaatgaatggcc

SEQ ID NO: 18946 - DNA, 25 bp, Homo sapien
ggcccacaatgaatggccgccgcgg

SEQ ID NO: 18947 - DNA, 25 bp, Homo sapien
cctgggtgctttctcggaccgagga

SEQ ID NO: 18948 - DNA, 25 bp, Homo sapien
ggccttgagcgtccagcccgagctt

SEQ ID NO: 18949 - DNA, 25 bp, Homo sapien
ctgagccgacgtactggcgaggatc

SEQ ID NO: 18950 - DNA, 25 bp, Homo sapien
gagacgagaatgtaagtgcagcttc

SEQ ID NO: 18951 - DNA, 25 bp, Homo sapien
cgagactgcggagtgaaagttttaa

SEQ ID NO: 18952 - DNA, 25 bp, Homo sapien
tgtcactcaggaaaacgcgggcgtg

SEQ ID NO: 18953 - DNA, 25 bp, Homo sapien
agcttctggcagttacgagactgcg

SEQ ID NO: 18954 - DNA, 25 bp, Homo sapien
gcaatccagacctctctggagacga

SEQ ID NO: 18955 - DNA, 25 bp, Homo sapien
tgagcagtgacgagaacagcaatcc

SEQ ID NO: 18956 - DNA, 25 bp, Homo sapien
ccctttttcagcagtgtggcggggt

SEQ ID NO: 18957 - DNA, 25 bp, Homo sapien
gcagcggcaactttgcggcaagctc

SEQ ID NO: 18958 - DNA, 25 bp, Homo sapien
gatgaatgccatcgcggccgacatg

SEQ ID NO: 18959 - DNA, 25 bp, Homo sapien
gtggagcatggcttcgagaccgcca

SEQ ID NO: 18960 - DNA, 25 bp, Homo sapien
acgggcaagatcgagccggacatga

SEQ ID NO: 18961 - DNA, 25 bp, Homo sapien
cttcatcagtgaaacgggcaagatc

SEQ ID NO: 18962 - DNA, 25 bp, Homo sapien
tgaggatgacgcctacaccaccttc

SEQ ID NO: 18963 - DNA, 25 bp, Homo sapien
atgcccaaggtcaaggtgctcaagg

SEQ ID NO: 18964 - DNA, 25 bp, Homo sapien
tcggctgaagccctgcagtaacccg

SEQ ID NO: 18965 - DNA, 25 bp, Homo sapien
tcgtgcgcaagagctggatgcccaa

SEQ ID NO: 18966 - DNA, 25 bp, Homo sapien
gcgcccgcgaaaaccgtggagagaa

SEQ ID NO: 18967 - DNA, 25 bp, Homo sapien
gggagctctacctctcggccaaggt

SEQ ID NO: 18968 - DNA, 25 bp, Homo sapien
cgtttccggagccaatggacacgca

SEQ ID NO: 18969 - DNA, 25 bp, Homo sapien
ggtcccgagcaagaaagcccgtctg

SEQ ID NO: 18970 - DNA, 25 bp, Homo sapien
agcgcatcatgaccctgtcggtgtg

SEQ ID NO: 18971 - DNA, 25 bp, Homo sapien
ggagcgtcatccgaagtcgccgatc

SEQ ID NO: 18972 - DNA, 25 bp, Homo sapien
cggcggacagcatgctcaacgtgct

SEQ ID NO: 18973 - DNA, 25 bp, Homo sapien
ggaagatgtatcactcccgcatgca

SEQ ID NO: 18974 - DNA, 25 bp, Homo sapien
ttgaagcttttcatggactccctga

SEQ ID NO: 18975 - DNA, 25 bp, Homo sapien
gcgcaggccattccgcagctcattg

SEQ ID NO: 18976 - DNA, 25 bp, Homo sapien
cagctcattggtcgtccagtccagc

SEQ ID NO: 18977 - DNA, 25 bp, Homo sapien
cttcgagagacatgtcagtcccttc

SEQ ID NO: 18978 - DNA, 25 bp, Homo sapien
cctctcctcagccatcttggttgtg

SEQ ID NO: 18979 - DNA, 25 bp, Homo sapien
ccaggcacgggcaatgtaaataatg

SEQ ID NO: 18980 - DNA, 25 bp, Homo sapien
ctggcacctgggagatcgtcccatc

SEQ ID NO: 18981 - DNA, 25 bp, Homo sapien
ctcggattgttcctgcgcaacttca

SEQ ID NO: 18982 - DNA, 25 bp, Homo sapien
atctgctctgtctctgcattgctgg

SEQ ID NO: 18983 - DNA, 25 bp, Homo sapien
gctgggtttccagctcccaacctaa

SEQ ID NO: 18984 - DNA, 25 bp, Homo sapien
ctcctgtgtatgcagggtcgttctg

SEQ ID NO: 18985 - DNA, 25 bp, Homo sapien
cgatcacgggccctgtcctaatatg

SEQ ID NO: 18986 - DNA, 25 bp, Homo sapien
cctaatatgggcaaccggaagcggc

SEQ ID NO: 18987 - DNA, 25 bp, Homo sapien
acgtcactccgtccaaatttagttg

SEQ ID NO: 18988 - DNA, 25 bp, Homo sapien
cccgcaccaggaatgaatggagcca

SEQ ID NO: 18989 - DNA, 25 bp, Homo sapien
ggagccattcgaacaattctgcatc

SEQ ID NO: 18990 - DNA, 25 bp, Homo sapien
cctcagaacgtctgctggtggaatc

SEQ ID NO: 18991 - DNA, 25 bp, Homo sapien
tcctctcctgtgtggattgtgaagg

SEQ ID NO: 18992 - DNA, 25 bp, Homo sapien
taaaaggcgccacctactccgagtc

SEQ ID NO: 18993 - DNA, 25 bp, Homo sapien
acaccgcaggcggtagctcaatgca

SEQ ID NO: 18994 - DNA, 25 bp, Homo sapien
tagctcaatgcacccgcgtcggagt

SEQ ID NO: 18995 - DNA, 25 bp, Homo sapien
cttgccgcgcatcctgtcgcaggaa

SEQ ID NO: 18996 - DNA, 25 bp, Homo sapien
cctgtcgggaagacaaaggagtcgc

SEQ ID NO: 18997 - DNA, 25 bp, Homo sapien
tgaaggagagcttctcaccgttctc

SEQ ID NO: 18998 - DNA, 25 bp, Homo sapien
attgactcccgcatttggcttttcc

SEQ ID NO: 18999 - DNA, 25 bp, Homo sapien
gaggtgggtaagtcgtcactatgca

SEQ ID NO: 19000 - DNA, 25 bp, Homo sapien
tggggatttgatcttgccaaggaaa

SEQ ID NO: 19001 - DNA, 25 bp, Homo sapien
tcgtcactatgcagggcggagccat

SEQ ID NO: 19002 - DNA, 25 bp, Homo sapien
gcggagccatcctgtgtctatcacg

SEQ ID NO: 19003 - DNA, 25 bp, Homo sapien
cctgtgtctatcacgcccaagggcg

SEQ ID NO: 19004 - DNA, 25 bp, Homo sapien
cccaagggcggtgcatgcaaattga

SEQ ID NO: 19005 - DNA, 25 bp, Homo sapien
gaagtcgtggcttctgcaccgccct

SEQ ID NO: 19006 - DNA, 25 bp, Homo sapien
cagatctcggtcagccggtcgccgg

SEQ ID NO: 19007 - DNA, 25 bp, Homo sapien
accgtgcagggcgacagcttgcaga

SEQ ID NO: 19008 - DNA, 25 bp, Homo sapien
aagagcttggtgtggtagtcgcaca

SEQ ID NO: 19009 - DNA, 25 bp, Homo sapien
ctcttgtcaggcgtgttgagaaagt

SEQ ID NO: 19010 - DNA, 25 bp, Homo sapien
ggacccaccgacgtcggtgatcttg

SEQ ID NO: 19011 - DNA, 25 bp, Homo sapien
tcgcacacgcgggtcaccgtgcagg

SEQ ID NO: 19012 - DNA, 25 bp, Homo sapien
atcttggtgcagatctcggtcagcc

SEQ ID NO: 19013 - DNA, 25 bp, Homo sapien
cgtcggtgatcttggtgcagatctc

SEQ ID NO: 19014 - DNA, 25 bp, Homo sapien
gagccgccggccttacggatcacag

SEQ ID NO: 19015 - DNA, 25 bp, Homo sapien
ccgggcttagcaccaatcatcgtca

SEQ ID NO: 19016 - DNA, 25 bp, Homo sapien
cggccttacggatcacaggggaata

SEQ ID NO: 19017 - DNA, 25 bp, Homo sapien
ccctcggacacgtgcgggccagatg

SEQ ID NO: 19018 - DNA, 25 bp, Homo sapien
catcggcctcgtcgtagtcggagcc

SEQ ID NO: 19019 - DNA, 25 bp, Homo sapien
tgtagggttcgtgcaggcccttcct

SEQ ID NO: 19020 - DNA, 25 bp, Homo sapien
catcgtcactctcgctgtagggttc

SEQ ID NO: 19021 - DNA, 25 bp, Homo sapien
atcacaggggaataggacacgtgtg

SEQ ID NO: 19022 - DNA, 25 bp, Homo sapien
gatccggggacctttgcctagagtg

SEQ ID NO: 19023 - DNA, 25 bp, Homo sapien
tccacaaccgaggagcaagcagctg

SEQ ID NO: 19024 - DNA, 25 bp, Homo sapien
tgccggtgcgccatgtgctctcggc

SEQ ID NO: 19025 - DNA, 25 bp, Homo sapien
acctttgcctagagtggctgttgga

SEQ ID NO: 19026 - DNA, 25 bp, Homo sapien
ccgttcctgggcatagcggtccttg

SEQ ID NO: 19027 - DNA, 25 bp, Homo sapien
gtgctgtcgatgcttccgatccttg

SEQ ID NO: 19028 - DNA, 25 bp, Homo sapien
tggtcccgctccttcgacggcaggt

SEQ ID NO: 19029 - DNA, 25 bp, Homo sapien
agcctggggtcacttgcagccgcac

SEQ ID NO: 19030 - DNA, 25 bp, Homo sapien
cagaaatgcatctgtcacgggactc

SEQ ID NO: 19031 - DNA, 25 bp, Homo sapien
acgtgtacgatgcacaaacaccagg

SEQ ID NO: 19032 - DNA, 25 bp, Homo sapien
tacgctccgggccagaaatgcatct

SEQ ID NO: 19033 - DNA, 25 bp, Homo sapien
ggttccgagggcatgttacgctccg

SEQ ID NO: 19034 - DNA, 25 bp, Homo sapien
gtcgccagcacagtcaggcctggtg

SEQ ID NO: 19035 - DNA, 25 bp, Homo sapien
agttgcggaatctatcatacgtgta

SEQ ID NO: 19036 - DNA, 25 bp, Homo sapien
aagcggaagagcatcttttcttacc

SEQ ID NO: 19037 - DNA, 25 bp, Homo sapien
ctcgagccaattgggagaagcggaa

SEQ ID NO: 19038 - DNA, 25 bp, Homo sapien
ccacgaactgccacatgcggtactg

SEQ ID NO: 19039 - DNA, 25 bp, Homo sapien
tgtacaccgggcaccctctgtctaa

SEQ ID NO: 19040 - DNA, 25 bp, Homo sapien
tggcgaaatcaatgcaggccctctg

SEQ ID NO: 19041 - DNA, 25 bp, Homo sapien
ggcttggcgctgatggcgaaatcaa

SEQ ID NO: 19042 - DNA, 25 bp, Homo sapien
tgccacatgcggtactggaagctct

SEQ ID NO: 19043 - DNA, 25 bp, Homo sapien
tcgaaaggcggagacaccacgaact

SEQ ID NO: 19044 - DNA, 25 bp, Homo sapien
catggccatgatcgtgtactcgaaa

SEQ ID NO: 19045 - DNA, 25 bp, Homo sapien
ttgttctgcggcatgtgtcgggtca

SEQ ID NO: 19046 - DNA, 25 bp, Homo sapien
gtgctgtttcccatcttggctgggc

SEQ ID NO: 19047 - DNA, 25 bp, Homo sapien
ccggggtcggtgctgtttcccatct

SEQ ID NO: 19048 - DNA, 25 bp, Homo sapien
ggttggtgacgataaggctattctc

SEQ ID NO: 19049 - DNA, 25 bp, Homo sapien
tggtgacgataaggctattctcggg

SEQ ID NO: 19050 - DNA, 25 bp, Homo sapien
gataaggctattctcgggggtcttg

SEQ ID NO: 19051 - DNA, 25 bp, Homo sapien
ggccatggcagggatggccagcatg

SEQ ID NO: 19052 - DNA, 25 bp, Homo sapien
tgtttcccatcttggctgggctctg

SEQ ID NO: 19053 - DNA, 25 bp, Homo sapien
gtcggtgctgtttcccatcttggct

SEQ ID NO: 19054 - DNA, 25 bp, Homo sapien
cgagcttctgaatcgcctgggcaac

SEQ ID NO: 19055 - DNA, 25 bp, Homo sapien
cggacatcagttcctgcggctcttg

SEQ ID NO: 19056 - DNA, 25 bp, Homo sapien
ctctcactcggtgccggacatcagt

SEQ ID NO: 19057 - DNA, 25 bp, Homo sapien
cgggtctgcacactctcactcggtg

SEQ ID NO: 19058 - DNA, 25 bp, Homo sapien
cattgggtctctcgttggtcaggag

SEQ ID NO: 19059 - DNA, 25 bp, Homo sapien
ttgacgccttagcaaccgagcgagc

SEQ ID NO: 19060 - DNA, 25 bp, Homo sapien
gtgaggtcgaatcccagccttgacg

SEQ ID NO: 19061 - DNA, 25 bp, Homo sapien
ggcaacctggaagccgcccatctaa

SEQ ID NO: 19062 - DNA, 25 bp, Homo sapien
gcgggcctgtttcctgaggaagtcc

SEQ ID NO: 19063 - DNA, 25 bp, Homo sapien
gtccatttcgttatacagggcctcc

SEQ ID NO: 19064 - DNA, 25 bp, Homo sapien
gctcgtccgggtccatttcgttata

SEQ ID NO: 19065 - DNA, 25 bp, Homo sapien
ccagaacccgggttgctccaggctg

SEQ ID NO: 19066 - DNA, 25 bp, Homo sapien
gctttcgcatctcactggtccgctg

SEQ ID NO: 19067 - DNA, 25 bp, Homo sapien
ccggctggccagcaagttctgcttt

SEQ ID NO: 19068 - DNA, 25 bp, Homo sapien
ttggtgttgttgttgcggttctcct

SEQ ID NO: 19069 - DNA, 25 bp, Homo sapien
tgtaggcagccttccagcgctcgtc

SEQ ID NO: 19070 - DNA, 25 bp, Homo sapien
atctcgtctccgaagcgggccattc

SEQ ID NO: 19071 - DNA, 25 bp, Homo sapien
tggagctacgactgcggagacgctc

SEQ ID NO: 19072 - DNA, 25 bp, Homo sapien
accggttaaccgtgaggcagttctg

SEQ ID NO: 19073 - DNA, 25 bp, Homo sapien
tagagtgccatggtccgcgctctct

SEQ ID NO: 19074 - DNA, 25 bp, Homo sapien
tgactgcttgtacatcctttgcgcc

SEQ ID NO: 19075 - DNA, 25 bp, Homo sapien
tggcgtattttctcaccacgttgtc

SEQ ID NO: 19076 - DNA, 25 bp, Homo sapien
cgggccattctgcaaagagcaaagg

SEQ ID NO: 19077 - DNA, 25 bp, Homo sapien
ctctgcgccattgactgcttgtaca

SEQ ID NO: 19078 - DNA, 25 bp, Homo sapien
taggtgtggtaattaatgtagtccc

SEQ ID NO: 19079 - DNA, 25 bp, Homo sapien
tgaggttttttacctgggaggcaga

SEQ ID NO: 19080 - DNA, 25 bp, Homo sapien
tgaaaccctgtctcgaaatgaggtt

SEQ ID NO: 19081 - DNA, 25 bp, Homo sapien
atgaaaccctgtctcgaaatgaggt

SEQ ID NO: 19082 - DNA, 25 bp, Homo sapien
aggaggactgcgtgagtccagaagt

SEQ ID NO: 19083 - DNA, 25 bp, Homo sapien
aggtgtggtaattaatgtagtccca

SEQ ID NO: 19084 - DNA, 25 bp, Homo sapien
ctaggtgtggtaattaatgtagtcc

SEQ ID NO: 19085 - DNA, 25 bp, Homo sapien
tgtggtaattaatgtagtcccagct

SEQ ID NO: 19086 - DNA, 25 bp, Homo sapien
gacccgatttagatgcccggagccg

SEQ ID NO: 19087 - DNA, 25 bp, Homo sapien
actccggcgtcgcagaacgcttggc

SEQ ID NO: 19088 - DNA, 25 bp, Homo sapien
aacgcttggcgtatcgtccttcagc

SEQ ID NO: 19089 - DNA, 25 bp, Homo sapien
tggcgtatcgtccttcagccaatca

SEQ ID NO: 19090 - DNA, 25 bp, Homo sapien
cagccaatcagcgtggagctgctgc

SEQ ID NO: 19091 - DNA, 25 bp, Homo sapien
ggcattcctggattggcccactccg

SEQ ID NO: 19092 - DNA, 25 bp, Homo sapien
agctgaggacccgatttagatgccc

SEQ ID NO: 19093 - DNA, 25 bp, Homo sapien
acgcggagctgaggacccgatttag

SEQ ID NO: 19094 - DNA, 25 bp, Homo sapien
agagcgcctggaaggacgacttcgc

SEQ ID NO: 19095 - DNA, 25 bp, Homo sapien
ctgagccacatccaggaggcccaga

SEQ ID NO: 19096 - DNA, 25 bp, Homo sapien
ggacgccatgttccggctggagcat

SEQ ID NO: 19097 - DNA, 25 bp, Homo sapien
atgagcaggtgctgaccacaggtga

SEQ ID NO: 19098 - DNA, 25 bp, Homo sapien
cgccaactgcgactacgtgatcgtg

SEQ ID NO: 19099 - DNA, 25 bp, Homo sapien
aggccgaccgcagcacactcaagaa

SEQ ID NO: 19100 - DNA, 25 bp, Homo sapien
ttcgccctcaacagcatgctgcgga

SEQ ID NO: 19101 - DNA, 25 bp, Homo sapien
gcccagccgagctctgatcgttgca

SEQ ID NO: 19102 - DNA, 25 bp, Homo sapien
tcacatccctgacgtcctcccgagc

SEQ ID NO: 19103 - DNA, 25 bp, Homo sapien
tctgcactcacatccctgacgtcct

SEQ ID NO: 19104 - DNA, 25 bp, Homo sapien
tcctcccgtgccctcacgtggtcct

SEQ ID NO: 19105 - DNA, 25 bp, Homo sapien
acatccctgacgtcctcccgagccc

SEQ ID NO: 19106 - DNA, 25 bp, Homo sapien
cacatccctgacgtcctcccgagcc

SEQ ID NO: 19107 - DNA, 25 bp, Homo sapien
ctcccgagccctcacgtggtcctcc

SEQ ID NO: 19108 - DNA, 25 bp, Homo sapien
catccctgacgtcctcccgagccct

SEQ ID NO: 19109 - DNA, 25 bp, Homo sapien
cctctgcactcacatccctgacgtc

SEQ ID NO: 19110 - DNA, 25 bp, Homo sapien
tgcaagatgctgtccagcagcacca

SEQ ID NO: 19111 - DNA, 25 bp, Homo sapien
acggggtcctgaccgaggccatgat

SEQ ID NO: 19112 - DNA, 25 bp, Homo sapien
cgtatgcctccgaggacggggtcct

SEQ ID NO: 19113 - DNA, 25 bp, Homo sapien
gggagaccacacctcacggagcctg

SEQ ID NO: 19114 - DNA, 25 bp, Homo sapien
atcctgagtccatggggagaccaca

SEQ ID NO: 19115 - DNA, 25 bp, Homo sapien
cagcaccagcagatgatgcgctggc

SEQ ID NO: 19116 - DNA, 25 bp, Homo sapien
ggacacccgcgtgcaagatgctgtc

SEQ ID NO: 19117 - DNA, 25 bp, Homo sapien
ggacgagcaaccctcatcctgagtc

SEQ ID NO: 19118 - DNA, 25 bp, Homo sapien
tgcatctccgcgcttcgttggacgc

SEQ ID NO: 19119 - DNA, 25 bp, Homo sapien
gcctggcttgtcttgtcagtcactg

SEQ ID NO: 19120 - DNA, 25 bp, Homo sapien
cccggaatgagtttccgcgcagttc

SEQ ID NO: 19121 - DNA, 25 bp, Homo sapien
acatttcccagggtgaacagcggcg

SEQ ID NO: 19122 - DNA, 25 bp, Homo sapien
cgccctagactagcggagctgcatc

SEQ ID NO: 19123 - DNA, 25 bp, Homo sapien
tcctactaaggagttgggccgcagc

SEQ ID NO: 19124 - DNA, 25 bp, Homo sapien
ctcgagtcacgtcgtcctactaagg

SEQ ID NO: 19125 - DNA, 25 bp, Homo sapien
ggctaggcgcaacacggactacatt

SEQ ID NO: 19126 - DNA, 25 bp, Homo sapien
gcccagctgtatggttaggccacca

SEQ ID NO: 19127 - DNA, 25 bp, Homo sapien
cggccgtgatgacgtcctcattggt

SEQ ID NO: 19128 - DNA, 25 bp, Homo sapien
accacgattggtgaaggggttcctg

SEQ ID NO: 19129 - DNA, 25 bp, Homo sapien
tcgcgcgcagtctaggaaagagacg

SEQ ID NO: 19130 - DNA, 25 bp, Homo sapien
cgacttgggacgcaacgacacctgc

SEQ ID NO: 19131 - DNA, 25 bp, Homo sapien
acacctgcgcgtgtgcgtattgcct

SEQ ID NO: 19132 - DNA, 25 bp, Homo sapien
ccgctggtcctcctagagtttggtg

SEQ ID NO: 19133 - DNA, 25 bp, Homo sapien
ttggtccgcccaaccacgattggtg

SEQ ID NO: 19134 - DNA, 25 bp, Homo sapien
ggccaggggaactacaatgcccaca

SEQ ID NO: 19135 - DNA, 25 bp, Homo sapien
agtcgatgtttagcagccctgccga

SEQ ID NO: 19136 - DNA, 25 bp, Homo sapien
ctgtgcctcatggagtcgatgttta

SEQ ID NO: 19137 - DNA, 25 bp, Homo sapien
ctgaaggggatactcaccggctgaa

SEQ ID NO: 19138 - DNA, 25 bp, Homo sapien
tagtcccacgtgtagcggagaaaca

SEQ ID NO: 19139 - DNA, 25 bp, Homo sapien
gtgctgacttaggattggcaaaatc

SEQ ID NO: 19140 - DNA, 25 bp, Homo sapien
tgggactcaggctgaacattggttc

SEQ ID NO: 19141 - DNA, 25 bp, Homo sapien
tgcttactcctcttccggacctgga

SEQ ID NO: 19142 - DNA, 25 bp, Homo sapien
ccggccagatgtcgaagttcctaga

SEQ ID NO: 19143 - DNA, 25 bp, Homo sapien
aagccggctgctccggttcctcttt

SEQ ID NO: 19144 - DNA, 25 bp, Homo sapien
cgccgagacgcgtgactacaactac

SEQ ID NO: 19145 - DNA, 25 bp, Homo sapien
tccagcgtcgccttgctctagacgg

SEQ ID NO: 19146 - DNA, 25 bp, Homo sapien
tagcactgctctactccggggtctt

SEQ ID NO: 19147 - DNA, 25 bp, Homo sapien
gagggcctctgactccgacaaagga

SEQ ID NO: 19148 - DNA, 25 bp, Homo sapien
cccacagcttgttgggtaaacagcg

SEQ ID NO: 19149 - DNA, 25 bp, Homo sapien
atttcggaggacagcaggtgttagc

SEQ ID NO: 19150 - DNA, 25 bp, Homo sapien
ttggacgagcctgacccatttcctc

SEQ ID NO: 19151 - DNA, 25 bp, Homo sapien
tccgcgggtgccacgtgttcagcct

SEQ ID NO: 19152 - DNA, 25 bp, Homo sapien
acacccacccggtctgtgcggcctg

SEQ ID NO: 19153 - DNA, 25 bp, Homo sapien
agccctgcccaagtcggagcggcgt

SEQ ID NO: 19154 - DNA, 25 bp, Homo sapien
ctcgccggtccgacctctaagccca

SEQ ID NO: 19155 - DNA, 25 bp, Homo sapien
ccgctaagggactccacggtctgca

SEQ ID NO: 19156 - DNA, 25 bp, Homo sapien
taagcccaccctttggacgagcctg

SEQ ID NO: 19157 - DNA, 25 bp, Homo sapien
gagatcccaacccaggagccggtga

SEQ ID NO: 19158 - DNA, 25 bp, Homo sapien
gggtgatttcccacctctgcgggtc

SEQ ID NO: 19159 - DNA, 25 bp, Homo sapien
tgagtctgaactcccagccggcacg

SEQ ID NO: 19160 - DNA, 25 bp, Homo sapien
atccgagtcggccaaaagccgggca

SEQ ID NO: 19161 - DNA, 25 bp, Homo sapien
agcgccaaggactggcagttccgga

SEQ ID NO: 19162 - DNA, 25 bp, Homo sapien
ttccggaacgggcaatcccagccga

SEQ ID NO: 19163 - DNA, 25 bp, Homo sapien
tcggtgggtcatgctccggcactcc

SEQ ID NO: 19164 - DNA, 25 bp, Homo sapien
ctggtggaggagcacgttccgctcc

SEQ ID NO: 19165 - DNA, 25 bp, Homo sapien
agcgacgcgaagtgaagaggattct

SEQ ID NO: 19166 - DNA, 25 bp, Homo sapien
cgcgtccgctttaatcggggagaga

SEQ ID NO: 19167 - DNA, 25 bp, Homo sapien
atcagccgccacgtgtgggcctaag

SEQ ID NO: 19168 - DNA, 25 bp, Homo sapien
cctgctcgagatctgcagtggctgc

SEQ ID NO: 19169 - DNA, 25 bp, Homo sapien
cccgccctaggtgtgccggtaatga

SEQ ID NO: 19170 - DNA, 25 bp, Homo sapien
ggcacggattcttcccagggtagca

SEQ ID NO: 19171 - DNA, 25 bp, Homo sapien
gaaccactggctcctcggacggaca

SEQ ID NO: 19172 - DNA, 25 bp, Homo sapien
ttcagctccttggtgacagcggtga

SEQ ID NO: 19173 - DNA, 25 bp, Homo sapien
ttacccacagatgcccgcatacatg

SEQ ID NO: 19174 - DNA, 25 bp, Homo sapien
tcggacaccggcttcccgttgcagg

SEQ ID NO: 19175 - DNA, 25 bp, Homo sapien
cagcgcacctgcatagctgctggtg

SEQ ID NO: 19176 - DNA, 25 bp, Homo sapien
tcaaaggactcggacaccggactcg

SEQ ID NO: 19177 - DNA, 25 bp, Homo sapien
cttcccgttgcaggtctggatcttc

SEQ ID NO: 19178 - DNA, 25 bp, Homo sapien
tgcaggtctggatcttcttcacaac

SEQ ID NO: 19179 - DNA, 25 bp, Homo sapien
ggagctggcgcccatgccagagcca

SEQ ID NO: 19180 - DNA, 25 bp, Homo sapien
tggcgcccatgccagagccaaagct

SEQ ID NO: 19181 - DNA, 25 bp, Homo sapien
gctcagcgcacctgcatagctgctg

SEQ ID NO: 19182 - DNA, 25 bp, Homo sapien
ggatgtacgggacattctagaactc

SEQ ID NO: 19183 - DNA, 25 bp, Homo sapien
ctcgcctccgcttaggtctggattg

SEQ ID NO: 19184 - DNA, 25 bp, Homo sapien
aacatccaagcggtggggcacaggc

SEQ ID NO: 19185 - DNA, 25 bp, Homo sapien
tgaaggggccgttaggaacatccaa

SEQ ID NO: 19186 - DNA, 25 bp, Homo sapien
tgagcaccgccggaagtttctgccg

SEQ ID NO: 19187 - DNA, 25 bp, Homo sapien
tgtcggccgcgttccgaatgagcac

SEQ ID NO: 19188 - DNA, 25 bp, Homo sapien
gccagtagctttcaccctcggttgc

SEQ ID NO: 19189 - DNA, 25 bp, Homo sapien
tgccagtcggcttcgtttcctacaa

SEQ ID NO: 19190 - DNA, 25 bp, Homo sapien
ccaaacgctcgctctcccgccgaca

SEQ ID NO: 19191 - DNA, 25 bp, Homo sapien
tcggcctcagcaagcgctcagggca

SEQ ID NO: 19192 - DNA, 25 bp, Homo sapien
tcagcaagcgctcagggcagttggc

SEQ ID NO: 19193 - DNA, 25 bp, Homo sapien
ccctttgaccaatgggctgcagtca

SEQ ID NO: 19194 - DNA, 25 bp, Homo sapien
tcccgccgacatgcgcgctaaggta

SEQ ID NO: 19195 - DNA, 25 bp, Homo sapien
tgcgcgctaaggtatgtcaagatgg

SEQ ID NO: 19196 - DNA, 25 bp, Homo sapien
gcgctaaggtatgtcaagatggtga

SEQ ID NO: 19197 - DNA, 25 bp, Homo sapien
ggcagccagcaccacgagtccacaa

SEQ ID NO: 19198 - DNA, 25 bp, Homo sapien
gttaagcacaccctgcattctcggg

SEQ ID NO: 19199 - DNA, 25 bp, Homo sapien
ttcttccagggcacaacaaacttgg

SEQ ID NO: 19200 - DNA, 25 bp, Homo sapien
tcgcctttgtgctttgtaagagaaa

SEQ ID NO: 19201 - DNA, 25 bp, Homo sapien
acttttcagtgagcacgccggtcgc

SEQ ID NO: 19202 - DNA, 25 bp, Homo sapien
tcttagacctgccttaaactgagta

SEQ ID NO: 19203 - DNA, 25 bp, Homo sapien
gggctacttgactactctacttgta

SEQ ID NO: 19204 - DNA, 25 bp, Homo sapien
tcccagcggttctactgagcaaggc

SEQ ID NO: 19205 - DNA, 25 bp, Homo sapien
ggaaagctctcgcttcccgttaagc

SEQ ID NO: 19206 - DNA, 25 bp, Homo sapien
gaggttcccgcgagactcttctctg

SEQ ID NO: 19207 - DNA, 25 bp, Homo sapien
cacggatcgagaaccttggggctcc

SEQ ID NO: 19208 - DNA, 25 bp, Homo sapien
ttggggctccctggaaacttgccac

SEQ ID NO: 19209 - DNA, 25 bp, Homo sapien
acgctgccttgggttcgcctacgtc

SEQ ID NO: 19210 - DNA, 25 bp, Homo sapien
tctgcgtcctggactcaccgcaggg

SEQ ID NO: 19211 - DNA, 25 bp, Homo sapien
gcgtgtcccttacgcgcttctatcg

SEQ ID NO: 19212 - DNA, 25 bp, Homo sapien
tcccaaagcctgttcggcagtcgcg

SEQ ID NO: 19213 - DNA, 25 bp, Homo sapien
gcgtggctcccgtagccagatgctt

SEQ ID NO: 19214 - DNA, 25 bp, Homo sapien
tgtgagtcctctcccgccaatgggt

SEQ ID NO: 19215 - DNA, 25 bp, Homo sapien
ctggcccattaccttgttgagatga

SEQ ID NO: 19216 - DNA, 25 bp, Homo sapien
gagggttcctggtgacatcgtatcc

SEQ ID NO: 19217 - DNA, 25 bp, Homo sapien
tatccgcgcttcttcaggggcacag

SEQ ID NO: 19218 - DNA, 25 bp, Homo sapien
gcaggtgctcccaaagggttaaatg

SEQ ID NO: 19219 - DNA, 25 bp, Homo sapien
ggtcccacaacctttgttctcagtg

SEQ ID NO: 19220 - DNA, 25 bp, Homo sapien
gagttcctcaaagagcggtcccaca

SEQ ID NO: 19221 - DNA, 25 bp, Homo sapien
ttttccggcagccacgggatcgcaa

SEQ ID NO: 19222 - DNA, 25 bp, Homo sapien
ccggaatgcctaatcaccatggtga

SEQ ID NO: 19223 - DNA, 25 bp, Homo sapien
attgtcatgcagaagtgatccgggc

SEQ ID NO: 19224 - DNA, 25 bp, Homo sapien
agggtggctggtaattgatcttctg

SEQ ID NO: 19225 - DNA, 25 bp, Homo sapien
cggcttgcaagtggtttcagaaatg

SEQ ID NO: 19226 - DNA, 25 bp, Homo sapien
tcctctacgccgtctgagcagaaga

SEQ ID NO: 19227 - DNA, 25 bp, Homo sapien
gctgcctcctcttacggccggaatg

SEQ ID NO: 19228 - DNA, 25 bp, Homo sapien
ctgaggcttctcctttcggcttgaa

SEQ ID NO: 19229 - DNA, 25 bp, Homo sapien
aatgtttccgaagtccagggctccg

SEQ ID NO: 19230 - DNA, 25 bp, Homo sapien
caaccgggtgtctgacagccggaca

SEQ ID NO: 19231 - DNA, 25 bp, Homo sapien
ggtgcgtgataaattcccaaggagc

SEQ ID NO: 19232 - DNA, 25 bp, Homo sapien
gccgccctcgtgatttatctggatt

SEQ ID NO: 19233 - DNA, 25 bp, Homo sapien
ccggcaaaggcgttcaagggcagcc

SEQ ID NO: 19234 - DNA, 25 bp, Homo sapien
cgacgggtcgatggttttatctgtc

SEQ ID NO: 19235 - DNA, 25 bp, Homo sapien
cggatcgataaagccgaaacgctgg

SEQ ID NO: 19236 - DNA, 25 bp, Homo sapien
cagcaagtgaaattcccgtcggatc

SEQ ID NO: 19237 - DNA, 25 bp, Homo sapien
acagcgggatctgcacagcaagtga

SEQ ID NO: 19238 - DNA, 25 bp, Homo sapien
cccacaggcgatagggaattcggac

SEQ ID NO: 19239 - DNA, 25 bp, Homo sapien
agatcacgtgattagggccaacatg

SEQ ID NO: 19240 - DNA, 25 bp, Homo sapien
aaacggcagcttcctggtctctgtc

SEQ ID NO: 19241 - DNA, 25 bp, Homo sapien
tgccggttgctacccgagtacaaac

SEQ ID NO: 19242 - DNA, 25 bp, Homo sapien
ctaaagattgggtgggtaggcttca

SEQ ID NO: 19243 - DNA, 25 bp, Homo sapien
ggaaggacttcgcagccgctaaaga

SEQ ID NO: 19244 - DNA, 25 bp, Homo sapien
ttctgcgagtacgagccaaccggca

SEQ ID NO: 19245 - DNA, 25 bp, Homo sapien
caacgcgatgcctctgccctaaggg

SEQ ID NO: 19246 - DNA, 25 bp, Homo sapien
gcgctgtcaaagatggtgcccacca

SEQ ID NO: 19247 - DNA, 25 bp, Homo sapien
ccctaccaggttgctgtcaccagga

SEQ ID NO: 19248 - DNA, 25 bp, Homo sapien
cgcagttgcgcatgaagtcgacaca

SEQ ID NO: 19249 - DNA, 25 bp, Homo sapien
gcgtgcctccaccatgcgttctatg

SEQ ID NO: 19250 - DNA, 25 bp, Homo sapien
ctccagcacgtagcggtacagcatg

SEQ ID NO: 19251 - DNA, 25 bp, Homo sapien
ggactacttcgtcagccctcgagta

SEQ ID NO: 19252 - DNA, 25 bp, Homo sapien
atgcgttctatgtctctggccagga

SEQ ID NO: 19253 - DNA, 25 bp, Homo sapien
tcctgtagcctgtcatagaagtggg

SEQ ID NO: 19254 - DNA, 25 bp, Homo sapien
tgtgccctttgacttgcatcgtcta

SEQ ID NO: 19255 - DNA, 25 bp, Homo sapien
attactgacccgcagccattggcta

SEQ ID NO: 19256 - DNA, 25 bp, Homo sapien
aggacctgccagaccctatgagggg

SEQ ID NO: 19257 - DNA, 25 bp, Homo sapien
tgagcctctctaagtctaggacctg

SEQ ID NO: 19258 - DNA, 25 bp, Homo sapien
acagagtcctatcctacgcggcgga

SEQ ID NO: 19259 - DNA, 25 bp, Homo sapien
ttggctaattcgcttgatctggatc

SEQ ID NO: 19260 - DNA, 25 bp, Homo sapien
gcgctcgcaacccacaggttcatga

SEQ ID NO: 19261 - DNA, 25 bp, Homo sapien
tctcgatggtgtagtccagctctgc

SEQ ID NO: 19262 - DNA, 25 bp, Homo sapien
ccgcagccatcgagttgatcaaaga

SEQ ID NO: 19263 - DNA, 25 bp, Homo sapien
taccgtcggtcaaggagatctccaa

SEQ ID NO: 19264 - DNA, 25 bp, Homo sapien
agctcttcctggtaagtgcgccctt

SEQ ID NO: 19265 - DNA, 25 bp, Homo sapien
ctgcaggccaagatcctcagtggta

SEQ ID NO: 19266 - DNA, 25 bp, Homo sapien
cctcagtggtaaggacctgctcaaa

SEQ ID NO: 19267 - DNA, 25 bp, Homo sapien
ccagcctgccgatgtttttgcagca

SEQ ID NO: 19268 - DNA, 25 bp, Homo sapien
tcctggcgcgcaacgacatgagcat

SEQ ID NO: 19269 - DNA, 25 bp, Homo sapien
cgcagtgcttcgtgcagatgttccc

SEQ ID NO: 19270 - DNA, 25 bp, Homo sapien
aagttcccagaaggcacagcgctcg

SEQ ID NO: 19271 - DNA, 25 bp, Homo sapien
gcttgcgcgcgggatttaaactgcg

SEQ ID NO: 19272 - DNA, 25 bp, Homo sapien
gcgcgtttctcttccttgctgactc

SEQ ID NO: 19273 - DNA, 25 bp, Homo sapien
cttgctgactctccgaatggccatg

SEQ ID NO: 19274 - DNA, 25 bp, Homo sapien
atggccatggactcgtcgcttcagg

SEQ ID NO: 19275 - DNA, 25 bp, Homo sapien
gcctgtttcccggtctcgctatcaa

SEQ ID NO: 19276 - DNA, 25 bp, Homo sapien
gctatcaagatccaacgcagtaatg

SEQ ID NO: 19277 - DNA, 25 bp, Homo sapien
cggtgagacgactgaaattactgcc

SEQ ID NO: 19278 - DNA, 25 bp, Homo sapien
cctggccgcacgtgtatgatgacaa

SEQ ID NO: 19279 - DNA, 25 bp, Homo sapien
cggcagctgacacgtaagtctcgtc

SEQ ID NO: 19280 - DNA, 25 bp, Homo sapien
cggcgctcagaaacaacgtaaagta

SEQ ID NO: 19281 - DNA, 25 bp, Homo sapien
ttcacagcctactgaggagtccaga

SEQ ID NO: 19282 - DNA, 25 bp, Homo sapien
catgcaggcatctctcgggacaact

SEQ ID NO: 19283 - DNA, 25 bp, Homo sapien
accgagtcacagtggctcaagcttc

SEQ ID NO: 19284 - DNA, 25 bp, Homo sapien
gctcgggtctttccgtgtgacagtt

SEQ ID NO: 19285 - DNA, 25 bp, Homo sapien
ggtaatgctgcatactcccgagtgc

SEQ ID NO: 19286 - DNA, 25 bp, Homo sapien
aggctctgctcagggtcgtcgctca

SEQ ID NO: 19287 - DNA, 25 bp, Homo sapien
cccaggaatgagggccgcagagact

SEQ ID NO: 19288 - DNA, 25 bp, Homo sapien
agccactcaccgcaggttgaaggtg

SEQ ID NO: 19289 - DNA, 25 bp, Homo sapien
gctctcggggaaggaccgaggcatc

SEQ ID NO: 19290 - DNA, 25 bp, Homo sapien
gccgattcctcctcgatgcgggctg

SEQ ID NO: 19291 - DNA, 25 bp, Homo sapien
ctcgcacgcggccgaagttccggag

SEQ ID NO: 19292 - DNA, 25 bp, Homo sapien
agtgcaagccactcaccgcaggttg

SEQ ID NO: 19293 - DNA, 25 bp, Homo sapien
gctcagggtcgtcgctcatgctgcg

SEQ ID NO: 19294 - DNA, 25 bp, Homo sapien
ttccgcgttcctgtcgcagtccaga

SEQ ID NO: 19295 - DNA, 25 bp, Homo sapien
cgccgtgcacgctagccgagatgac

SEQ ID NO: 19296 - DNA, 25 bp, Homo sapien
cagcacggacgccaggttcgcgtag

SEQ ID NO: 19297 - DNA, 25 bp, Homo sapien
ttaagcacgcgggtgctgaccgagc

SEQ ID NO: 19298 - DNA, 25 bp, Homo sapien
aagcgcttaagcacgcgggtgctga

SEQ ID NO: 19299 - DNA, 25 bp, Homo sapien
acctgcatccggctgtgggccggac

SEQ ID NO: 19300 - DNA, 25 bp, Homo sapien
tctcccaggcgccacctgcatccgg

SEQ ID NO: 19301 - DNA, 25 bp, Homo sapien
tgtcgcagtccagacccttccctgg

SEQ ID NO: 19302 - DNA, 25 bp, Homo sapien
gcagcgaaggccgtagtctcgctca

SEQ ID NO: 19303 - DNA, 25 bp, Homo sapien
acttcgccagggcagtcctcggggt

SEQ ID NO: 19304 - DNA, 25 bp, Homo sapien
gcgaaggccgtagtctcgctcagga

SEQ ID NO: 19305 - DNA, 25 bp, Homo sapien
accgcaggacttcgccagggcagtc

SEQ ID NO: 19306 - DNA, 25 bp, Homo sapien
cggaggcaccgcaggacttcgccag

SEQ ID NO: 19307 - DNA, 25 bp, Homo sapien
cacacctgtctgagcggcgcagcga

SEQ ID NO: 19308 - DNA, 25 bp, Homo sapien
agcttgctcgcactcggctgtgcgg

SEQ ID NO: 19309 - DNA, 25 bp, Homo sapien
aggccctctgggctgctccaccctg

SEQ ID NO: 19310 - DNA, 25 bp, Homo sapien
ggacttcagcacacatcccgaagga

SEQ ID NO: 19311 - DNA, 25 bp, Homo sapien
cctggttgcacctgcatggtgacta

SEQ ID NO: 19312 - DNA, 25 bp, Homo sapien
ttcattgataaaacgctgggctccc

SEQ ID NO: 19313 - DNA, 25 bp, Homo sapien
cagcgcagcgtagcaaatccaggca

SEQ ID NO: 19314 - DNA, 25 bp, Homo sapien
acctacctcaaaggccgcttgttgg

SEQ ID NO: 19315 - DNA, 25 bp, Homo sapien
tgctacgaggccactgacacagaga

SEQ ID NO: 19316 - DNA, 25 bp, Homo sapien
ctgacacagagactggcagcgccta

SEQ ID NO: 19317 - DNA, 25 bp, Homo sapien
tgtcaaagtcatcccgcagagccgc

SEQ ID NO: 19318 - DNA, 25 bp, Homo sapien
agagcgcacggctgaccacgtgaac

SEQ ID NO: 19319 - DNA, 25 bp, Homo sapien
ggtcgggcctcatcaatgctgggca

SEQ ID NO: 19320 - DNA, 25 bp, Homo sapien
ggcaaccctgagaagctgacccttg

SEQ ID NO: 19321 - DNA, 25 bp, Homo sapien
agtagcacgcgtcgtgcagccctgc

SEQ ID NO: 19322 - DNA, 25 bp, Homo sapien
aggcgaacgtgcacctgctcgcaga

SEQ ID NO: 19323 - DNA, 25 bp, Homo sapien
ataccagcttgtagcgtggcgggct

SEQ ID NO: 19324 - DNA, 25 bp, Homo sapien
cggagtctttggcattctcctcctc

SEQ ID NO: 19325 - DNA, 25 bp, Homo sapien
gcaccacactgcataccagcttgta

SEQ ID NO: 19326 - DNA, 25 bp, Homo sapien
gggactgcgcactaactggccttgc

SEQ ID NO: 19327 - DNA, 25 bp, Homo sapien
taactggccttgctctgcaggtgga

SEQ ID NO: 19328 - DNA, 25 bp, Homo sapien
agcatcaccgctttctggacctgtc

SEQ ID NO: 19329 - DNA, 25 bp, Homo sapien
gtccttcaaatgatccaacgccggg

SEQ ID NO: 19330 - DNA, 25 bp, Homo sapien
acagctcccgaagtgctcggcgttc

SEQ ID NO: 19331 - DNA, 25 bp, Homo sapien
gaagaaccgttgtctgccacgcgca

SEQ ID NO: 19332 - DNA, 25 bp, Homo sapien
gcagaaccggcaggaaccactcatc

SEQ ID NO: 19333 - DNA, 25 bp, Homo sapien
tggaaatgccatgccctgcggagag

SEQ ID NO: 19334 - DNA, 25 bp, Homo sapien
gcaaattaccctagccgcgcggccc

SEQ ID NO: 19335 - DNA, 25 bp, Homo sapien
gggcgctcccataggctagcccggt

SEQ ID NO: 19336 - DNA, 25 bp, Homo sapien
gttatctgggcgctcccataggcta

SEQ ID NO: 19337 - DNA, 25 bp, Homo sapien
cggcgccgggattcacccgctccgt

SEQ ID NO: 19338 - DNA, 25 bp, Homo sapien
aattgctggcccgagacgcacagca

SEQ ID NO: 19339 - DNA, 25 bp, Homo sapien
gcccgagacgcacagcagggctcga

SEQ ID NO: 19340 - DNA, 25 bp, Homo sapien
tgaggggcccgcaaattaccctagc

SEQ ID NO: 19341 - DNA, 25 bp, Homo sapien
cataggctagcccggtctcccggta

SEQ ID NO: 19342 - DNA, 25 bp, Homo sapien
cgagaaactcgatggaacgcgcaga

SEQ ID NO: 19343 - DNA, 25 bp, Homo sapien
atgacggaggggaagcacactcagc

SEQ ID NO: 19344 - DNA, 25 bp, Homo sapien
agaagaccgccgagcgatggatgac

SEQ ID NO: 19345 - DNA, 25 bp, Homo sapien
gcagagcagacccatggagaagaga

SEQ ID NO: 19346 - DNA, 25 bp, Homo sapien
cgcgcgatggccgagaaactcgatg

SEQ ID NO: 19347 - DNA, 25 bp, Homo sapien
gtcacagctataactcagctcccgg

SEQ ID NO: 19348 - DNA, 25 bp, Homo sapien
cagccagcttgtgtgcggcctggca

SEQ ID NO: 19349 - DNA, 25 bp, Homo sapien
agcagggagtcgagctgacaacttc

SEQ ID NO: 19350 - DNA, 25 bp, Homo sapien
tacaggggagaaaaggcaaacagcc

SEQ ID NO: 19351 - DNA, 25 bp, Homo sapien
cgccgaacgcaatgccaactcaata

SEQ ID NO: 19352 - DNA, 25 bp, Homo sapien
agagcccgtggccattgcacagctc

SEQ ID NO: 19353 - DNA, 25 bp, Homo sapien
gccgataatccacgccaaagagctg

SEQ ID NO: 19354 - DNA, 25 bp, Homo sapien
cagggaagagcgcacctttgtcagc

SEQ ID NO: 19355 - DNA, 25 bp, Homo sapien
ccttgtaaagcttgtagagcacctc

SEQ ID NO: 19356 - DNA, 25 bp, Homo sapien
tagagcacctctcgcggcacgaaag

SEQ ID NO: 19357 - DNA, 25 bp, Homo sapien
tgcctctgccaagaagcgcacgcgg

SEQ ID NO: 19358 - DNA, 25 bp, Homo sapien
cattccgcgggaaggaccagtagac

SEQ ID NO: 19359 - DNA, 25 bp, Homo sapien
gtccgccattgctggggactgactg

SEQ ID NO: 19360 - DNA, 25 bp, Homo sapien
ccgcttagccggagagaccggtgac

SEQ ID NO: 19361 - DNA, 25 bp, Homo sapien
gcgctccaggcgcaaacagcctaga

SEQ ID NO: 19362 - DNA, 25 bp, Homo sapien
tgggccacgaacactgccgcttagc

SEQ ID NO: 19363 - DNA, 25 bp, Homo sapien
ccagtaaggaatccggctgcaggtg

SEQ ID NO: 19364 - DNA, 25 bp, Homo sapien
ttggcggcgcagtccagtaaggaat

SEQ ID NO: 19365 - DNA, 25 bp, Homo sapien
ccagtagacgatgcggcgctgcacg

SEQ ID NO: 19366 - DNA, 25 bp, Homo sapien
ctttgatctcgactggcgcgcctac

SEQ ID NO: 19367 - DNA, 25 bp, Homo sapien
tggcgtcatcccatccgctttgatc

SEQ ID NO: 19368 - DNA, 25 bp, Homo sapien
aacgtggcttcacgagttcggctcc

SEQ ID NO: 19369 - DNA, 25 bp, Homo sapien
aggccgcctccacaggaagggaaag

SEQ ID NO: 19370 - DNA, 25 bp, Homo sapien
cttccggaaccgcttagagctaagg

SEQ ID NO: 19371 - DNA, 25 bp, Homo sapien
tccgaggacccatcttgcgaaagtt

SEQ ID NO: 19372 - DNA, 25 bp, Homo sapien
ctctgctgacctggcggctgtagaa

SEQ ID NO: 19373 - DNA, 25 bp, Homo sapien
ctgaggctcacggtttcggagtaag

SEQ ID NO: 19374 - DNA, 25 bp, Homo sapien
ctttctcctgcttggcgcgagcaca

SEQ ID NO: 19375 - DNA, 25 bp, Homo sapien
cggctcactgagacccggtggtcca

SEQ ID NO: 19376 - DNA, 25 bp, Homo sapien
ctccggacgatcagcccaggactga

SEQ ID NO: 19377 - DNA, 25 bp, Homo sapien
ggacaagtctaggtcgccgtccaga

SEQ ID NO: 19378 - DNA, 25 bp, Homo sapien
cgacgcggtctttttggtgaacgag

SEQ ID NO: 19379 - DNA, 25 bp, Homo sapien
aaacctgtgcttcgacgtggcggac

SEQ ID NO: 19380 - DNA, 25 bp, Homo sapien
cacaggcaccgcgtggttctcacaa

SEQ ID NO: 19381 - DNA, 25 bp, Homo sapien
gtgccgccacttacgccgtggtcag

SEQ ID NO: 19382 - DNA, 25 bp, Homo sapien
gtgcctcgccaactccggaagattt

SEQ ID NO: 19383 - DNA, 25 bp, Homo sapien
gctgcccaaaataacactgctggtt

SEQ ID NO: 19384 - DNA, 25 bp, Homo sapien
tctgccagtcagaaggccacaccgg

SEQ ID NO: 19385 - DNA, 25 bp, Homo sapien
ttgtgcccaggaaaccaaacctcgc

SEQ ID NO: 19386 - DNA, 25 bp, Homo sapien
ttttcatcgaaaccctaagccatgg

SEQ ID NO: 19387 - DNA, 25 bp, Homo sapien
tgtgcctgatagtttgccacgaatc

SEQ ID NO: 19388 - DNA, 25 bp, Homo sapien
tttcccagaggtagagctgaggtcc

SEQ ID NO: 19389 - DNA, 25 bp, Homo sapien
aacctcgcagctattgttttcatcg

SEQ ID NO: 19390 - DNA, 25 bp, Homo sapien
ggcagcacaggccaataggcaatta

SEQ ID NO: 19391 - DNA, 25 bp, Homo sapien
gagaaagattacctcccgcgagctc

SEQ ID NO: 19392 - DNA, 25 bp, Homo sapien
agctcccgcagcttccgacggtgag

SEQ ID NO: 19393 - DNA, 25 bp, Homo sapien
tgaacggaagttcgacccatcggcg

SEQ ID NO: 19394 - DNA, 25 bp, Homo sapien
cacagacgactcaggcgggagacga

SEQ ID NO: 19395 - DNA, 25 bp, Homo sapien
cgacagtgacgatggcgcagtttca

SEQ ID NO: 19396 - DNA, 25 bp, Homo sapien
ggcccacgctgatgaagacagcaga

SEQ ID NO: 19397 - DNA, 25 bp, Homo sapien
gcaagtccagcgtacccacagacga

SEQ ID NO: 19398 - DNA, 25 bp, Homo sapien
cgtcctcttttcacgttacctgagg

SEQ ID NO: 19399 - DNA, 25 bp, Homo sapien
gggccgcgaaagactgaaacgccta

SEQ ID NO: 19400 - DNA, 25 bp, Homo sapien
ccaacagggcagctggtagctctgc

SEQ ID NO: 19401 - DNA, 25 bp, Homo sapien
ggacgatccgaccagcgaagccaac

SEQ ID NO: 19402 - DNA, 25 bp, Homo sapien
aacgaggagactactgccatggccc

SEQ ID NO: 19403 - DNA, 25 bp, Homo sapien
agaagccggcgactcagctaggcta

SEQ ID NO: 19404 - DNA, 25 bp, Homo sapien
gcggcaaagagggagcatagtaacc

SEQ ID NO: 19405 - DNA, 25 bp, Homo sapien
tagtaaccctcacagctcgttggtg

SEQ ID NO: 19406 - DNA, 25 bp, Homo sapien
taggcaatatggtcccgctactgga

SEQ ID NO: 19407 - DNA, 25 bp, Homo sapien
cgtaacggcccaattgtccttgaga

SEQ ID NO: 19408 - DNA, 25 bp, Homo sapien
cccagcaagctcagcgtgtaacgtg

SEQ ID NO: 19409 - DNA, 25 bp, Homo sapien
tcctgatttcgtgtggctgtctcca

SEQ ID NO: 19410 - DNA, 25 bp, Homo sapien
ccaccgtgtagcttgccgggaaact

SEQ ID NO: 19411 - DNA, 25 bp, Homo sapien
gaggcggtggaactacctttctcta

SEQ ID NO: 19412 - DNA, 25 bp, Homo sapien
ctcttgcgaacacaaccggcgatgg

SEQ ID NO: 19413 - DNA, 25 bp, Homo sapien
tctccaaggaggaaacgaactacgc

SEQ ID NO: 19414 - DNA, 25 bp, Homo sapien
gcgctgcctttatagccagtaggga

SEQ ID NO: 19415 - DNA, 25 bp, Homo sapien
ccacgcttgccttggggttcaacca

SEQ ID NO: 19416 - DNA, 25 bp, Homo sapien
gcagcgctcaagcagtctcggactc

SEQ ID NO: 19417 - DNA, 25 bp, Homo sapien
ccagtcccaacacaagtcgcagaaa

SEQ ID NO: 19418 - DNA, 25 bp, Homo sapien
gcagaaactaaccaccgacaccagg

SEQ ID NO: 19419 - DNA, 25 bp, Homo sapien
acaagacgcgcaagagctctccggg

SEQ ID NO: 19420 - DNA, 25 bp, Homo sapien
aatgactcggcgctttccctcgttg

SEQ ID NO: 19421 - DNA, 25 bp, Homo sapien
cgacaccaggcaagaacaagacgcg

SEQ ID NO: 19422 - DNA, 25 bp, Homo sapien
cgcggtgcaatgtgggccagcaaaa

SEQ ID NO: 19423 - DNA, 25 bp, Homo sapien
ctgcggagtgagtgaccaagttccg

SEQ ID NO: 19424 - DNA, 25 bp, Homo sapien
agtgaccaagttccggccagttcga

SEQ ID NO: 19425 - DNA, 25 bp, Homo sapien
gccagttcgacctcgaggatccaga

SEQ ID NO: 19426 - DNA, 25 bp, Homo sapien
atccagaggtggagacggtactacc

SEQ ID NO: 19427 - DNA, 25 bp, Homo sapien
agacggtactacctcccagctctgt

SEQ ID NO: 19428 - DNA, 25 bp, Homo sapien
tccaaacccgcgctgcggagtgagt

SEQ ID NO: 19429 - DNA, 25 bp, Homo sapien
gaaggcggtccaccctgcgcgtgat

SEQ ID NO: 19430 - DNA, 25 bp, Homo sapien
aaactccattgtttggggccgctgc

SEQ ID NO: 19431 - DNA, 25 bp, Homo sapien
aggctctattccgttcgctggttcg

SEQ ID NO: 19432 - DNA, 25 bp, Homo sapien
gagctggtttctgccgacaagtaag

SEQ ID NO: 19433 - DNA, 25 bp, Homo sapien
gggagtacttgccttcccaagagca

SEQ ID NO: 19434 - DNA, 25 bp, Homo sapien
cccagcgtgtgcctctggtagaacc

SEQ ID NO: 19435 - DNA, 25 bp, Homo sapien
agctttggactatctccgtggggcc

SEQ ID NO: 19436 - DNA, 25 bp, Homo sapien
gagtgagtctctggcgtcccaaatt

SEQ ID NO: 19437 - DNA, 25 bp, Homo sapien
acctcgctcacgtcttgtgctggga

SEQ ID NO: 19438 - DNA, 25 bp, Homo sapien
aaggccgtctttccagaactgctca

SEQ ID NO: 19439 - DNA, 25 bp, Homo sapien
ggttggccttttgcactggagaata

SEQ ID NO: 19440 - DNA, 25 bp, Homo sapien
taaagttctgcctctcgccgggagc

SEQ ID NO: 19441 - DNA, 25 bp, Homo sapien
ccggcctcagcttgtagttctcgaa

SEQ ID NO: 19442 - DNA, 25 bp, Homo sapien
agttctcgaatctcctgctccaggc

SEQ ID NO: 19443 - DNA, 25 bp, Homo sapien
accgcctcggacatgggactctgag

SEQ ID NO: 19444 - DNA, 25 bp, Homo sapien
cctctgttatccagggccgcatttc

SEQ ID NO: 19445 - DNA, 25 bp, Homo sapien
atttcctgtagggatagccgcagcc

SEQ ID NO: 19446 - DNA, 25 bp, Homo sapien
ccttacttctcgtgtgcgcgtcgtt

SEQ ID NO: 19447 - DNA, 25 bp, Homo sapien
ctgaggcacggacaagcctagttta

SEQ ID NO: 19448 - DNA, 25 bp, Homo sapien
gcccacctgaagaagcgcatgcgca

SEQ ID NO: 19449 - DNA, 25 bp, Homo sapien
agctcttcccaaaatggctgcccgg

SEQ ID NO: 19450 - DNA, 25 bp, Homo sapien
aggcggctagtccacaaccataaca

SEQ ID NO: 19451 - DNA, 25 bp, Homo sapien
accacctgtgtgagagcttctttca

SEQ ID NO: 19452 - DNA, 25 bp, Homo sapien
ggacctatacccaaccacctgtgtg

SEQ ID NO: 19453 - DNA, 25 bp, Homo sapien
agttccctacgctgccaacgttcgg

SEQ ID NO: 19454 - DNA, 25 bp, Homo sapien
tgggaagggacttcggacgcttcgc

SEQ ID NO: 19455 - DNA, 25 bp, Homo sapien
ccctgcgcgcgcagtcgcgaccagc

SEQ ID NO: 19456 - DNA, 25 bp, Homo sapien
aggttcttccgctcgcgggagactg

SEQ ID NO: 19457 - DNA, 25 bp, Homo sapien
ggccctgggttttcactgcgcgtgc

SEQ ID NO: 19458 - DNA, 25 bp, Homo sapien
agttccccgagaactggaggcgaag

SEQ ID NO: 19459 - DNA, 25 bp, Homo sapien
gtgactgggccgtacagttccccga

SEQ ID NO: 19460 - DNA, 25 bp, Homo sapien
gcgtgcgcgaggttcttccgctcgc

SEQ ID NO: 19461 - DNA, 25 bp, Homo sapien
acagacgcgcccgaacgcaggccct

SEQ ID NO: 19462 - DNA, 25 bp, Homo sapien
ttggtcacgttgtagccgaggttct

SEQ ID NO: 19463 - DNA, 25 bp, Homo sapien
gtctgcagctcgtgcccaaccaggt

SEQ ID NO: 19464 - DNA, 25 bp, Homo sapien
gacagcgggcctctccaatggccgg

SEQ ID NO: 19465 - DNA, 25 bp, Homo sapien
ctgtgtgggattttagacgtcccgg

SEQ ID NO: 19466 - DNA, 25 bp, Homo sapien
cgcgcgactgtgtgggattttagac

SEQ ID NO: 19467 - DNA, 25 bp, Homo sapien
cccaaccaggttgggcatcttggtc

SEQ ID NO: 19468 - DNA, 25 bp, Homo sapien
ccgaggttctggcacatggagatgc

SEQ ID NO: 19469 - DNA, 25 bp, Homo sapien
ttgggcatcttggtcacgttgtagc

SEQ ID NO: 19470 - DNA, 25 bp, Homo sapien
cgaggcgtcagcgatgctgtctctt

SEQ ID NO: 19471 - DNA, 25 bp, Homo sapien
gggagggtgaacctgaatggaagcc

SEQ ID NO: 19472 - DNA, 25 bp, Homo sapien
cagcgatgctgtctcttccgtgagg

SEQ ID NO: 19473 - DNA, 25 bp, Homo sapien
cgggtcctttgcgaccgttcgctgg

SEQ ID NO: 19474 - DNA, 25 bp, Homo sapien
cgcttctggtcctccgactgcgcgc

SEQ ID NO: 19475 - DNA, 25 bp, Homo sapien
tttgcgaccgttcgctggcgcgtgc

SEQ ID NO: 19476 - DNA, 25 bp, Homo sapien
ccggccgaaggctggctgtaggcag

SEQ ID NO: 19477 - DNA, 25 bp, Homo sapien
cgtcagcgatgctgtctcttccgtg

SEQ ID NO: 19478 - DNA, 25 bp, Homo sapien
gcgattggtcagagcccagttacta

SEQ ID NO: 19479 - DNA, 25 bp, Homo sapien
agcctgcgtcttttgtctgccttgc

SEQ ID NO: 19480 - DNA, 25 bp, Homo sapien
gcccggactccagccactagagttt

SEQ ID NO: 19481 - DNA, 25 bp, Homo sapien
tcaatcagaatggtacgatccgggc

SEQ ID NO: 19482 - DNA, 25 bp, Homo sapien
aagtccagtcagctcggcttgtctg

SEQ ID NO: 19483 - DNA, 25 bp, Homo sapien
cgcaaacggcggttactgacaggct

SEQ ID NO: 19484 - DNA, 25 bp, Homo sapien
ccgcctcgatgtaccgggattctgt

SEQ ID NO: 19485 - DNA, 25 bp, Homo sapien
ctgtcaagtgcctgagaacatgttc

SEQ ID NO: 19486 - DNA, 25 bp, Homo sapien
tgggcacttgctctgccgtggtgcc

SEQ ID NO: 19487 - DNA, 25 bp, Homo sapien
tgagaccgtgtcacgtgaggacatg

SEQ ID NO: 19488 - DNA, 25 bp, Homo sapien
tgaatgttgcaggtggtgttgccac

SEQ ID NO: 19489 - DNA, 25 bp, Homo sapien
tcacgtgaggacatgacggagctgc

SEQ ID NO: 19490 - DNA, 25 bp, Homo sapien
tgcccggcactgagtgggcacttgc

SEQ ID NO: 19491 - DNA, 25 bp, Homo sapien
catgacggagctgcttaatgcgccg

SEQ ID NO: 19492 - DNA, 25 bp, Homo sapien
cctggtcagtgtgacggtgaatgtt

SEQ ID NO: 19493 - DNA, 25 bp, Homo sapien
ccaccatgttggtgagaccgtgtca

SEQ ID NO: 19494 - DNA, 25 bp, Homo sapien
gcgcccggcgcggttaattatagcc

SEQ ID NO: 19495 - DNA, 25 bp, Homo sapien
cccgcgaataaatccggagcggatt

SEQ ID NO: 19496 - DNA, 25 bp, Homo sapien
atccggagcggatttgcatcacagc

SEQ ID NO: 19497 - DNA, 25 bp, Homo sapien
ggtgcgcctcgctttacggaaagaa

SEQ ID NO: 19498 - DNA, 25 bp, Homo sapien
gcggatttgcatcacagcagccgcg

SEQ ID NO: 19499 - DNA, 25 bp, Homo sapien
gtcagggccaggaaaggcacttcca

SEQ ID NO: 19500 - DNA, 25 bp, Homo sapien
ccctggcgaccttgggtcagggcca

SEQ ID NO: 19501 - DNA, 25 bp, Homo sapien
aggaccctagctgcgggactctagc

SEQ ID NO: 19502 - DNA, 25 bp, Homo sapien
gtgctctttcaggtccaactccaga

SEQ ID NO: 19503 - DNA, 25 bp, Homo sapien
cccagacgcctgacctgcgggatgt

SEQ ID NO: 19504 - DNA, 25 bp, Homo sapien
ccaccggttttgctccgctttagca

SEQ ID NO: 19505 - DNA, 25 bp, Homo sapien
tttctgagtgttacggcgccctcct

SEQ ID NO: 19506 - DNA, 25 bp, Homo sapien
atacatccacagacggtgctgcgcg

SEQ ID NO: 19507 - DNA, 25 bp, Homo sapien
ccacgcaatccagggccagaggttg

SEQ ID NO: 19508 - DNA, 25 bp, Homo sapien
gctgaggtctccgagtgctctttca

SEQ ID NO: 19509 - DNA, 25 bp, Homo sapien
tgtgcgcagcactcgaatacatcca

SEQ ID NO: 19510 - DNA, 25 bp, Homo sapien
gtaagtccagctactagcggggcta

SEQ ID NO: 19511 - DNA, 25 bp, Homo sapien
agtccagctactagcggggctaagg

SEQ ID NO: 19512 - DNA, 25 bp, Homo sapien
gtccagctactagcggggctaaggc

SEQ ID NO: 19513 - DNA, 25 bp, Homo sapien
tgaaagtcagacaattagggagcct

SEQ ID NO: 19514 - DNA, 25 bp, Homo sapien
gaaagtcagacaattagggagcctg

SEQ ID NO: 19515 - DNA, 25 bp, Homo sapien
agtcagacaattagggagcctgtct

SEQ ID NO: 19516 - DNA, 25 bp, Homo sapien
cagacaattagggagcctgtctggc

SEQ ID NO: 19517 - DNA, 25 bp, Homo sapien
taagtccagctactagcggggctaa

SEQ ID NO: 19518 - DNA, 25 bp, Homo sapien
cgcttagtcagtttggcacccgaga

SEQ ID NO: 19519 - DNA, 25 bp, Homo sapien
gtcattcgagcctccctcgcttgtt

SEQ ID NO: 19520 - DNA, 25 bp, Homo sapien
atcggcttggcctccggaatctcga

SEQ ID NO: 19521 - DNA, 25 bp, Homo sapien
ggttcgacatccgagactctcctgc

SEQ ID NO: 19522 - DNA, 25 bp, Homo sapien
ggtcagcctgcccatttaggtctcc

SEQ ID NO: 19523 - DNA, 25 bp, Homo sapien
tctccgatcctacgagctggctttc

SEQ ID NO: 19524 - DNA, 25 bp, Homo sapien
aggtctccgtctttactctgtccag

SEQ ID NO: 19525 - DNA, 25 bp, Homo sapien
tcgcttgtttaagccgctccgggcc

SEQ ID NO: 19526 - DNA, 25 bp, Homo sapien
gaacgcctagcgtctttcccaagca

SEQ ID NO: 19527 - DNA, 25 bp, Homo sapien
cctgggagagcgtcagatgtatttc

SEQ ID NO: 19528 - DNA, 25 bp, Homo sapien
cggtcccgcggagacatcgatataa

SEQ ID NO: 19529 - DNA, 25 bp, Homo sapien
gcactccacggaacgtccttaggca

SEQ ID NO: 19530 - DNA, 25 bp, Homo sapien
tccgcactctatgtcccgagcgtta

SEQ ID NO: 19531 - DNA, 25 bp, Homo sapien
cccgagcgttagtgtcttccacttg

SEQ ID NO: 19532 - DNA, 25 bp, Homo sapien
acttgttacgtctgcagtctcctga

SEQ ID NO: 19533 - DNA, 25 bp, Homo sapien
cgccgatatggctgcgctgacactg

SEQ ID NO: 19534 - DNA, 25 bp, Homo sapien
agggtactcgcagcggcactttcag

SEQ ID NO: 19535 - DNA, 25 bp, Homo sapien
ctccaggtgactgccggagcgtagt

SEQ ID NO: 19536 - DNA, 25 bp, Homo sapien
ctgaagggatcatggtgcagtacga

SEQ ID NO: 19537 - DNA, 25 bp, Homo sapien
gcggcttcaactgtcgcggtaggca

SEQ ID NO: 19538 - DNA, 25 bp, Homo sapien
gggccgcctctgatagcctctaggc

SEQ ID NO: 19539 - DNA, 25 bp, Homo sapien
gtgcccaaccggtgctaaactcaag

SEQ ID NO: 19540 - DNA, 25 bp, Homo sapien
taaactcaagcttgggaggtcgccc

SEQ ID NO: 19541 - DNA, 25 bp, Homo sapien
gaggtcgcccacgagaaacagtcgc

SEQ ID NO: 19542 - DNA, 25 bp, Homo sapien
agaccgagattcagcgagacgcgcg

SEQ ID NO: 19543 - DNA, 25 bp, Homo sapien
cgcccgcattcagttcgaaggacca

SEQ ID NO: 19544 - DNA, 25 bp, Homo sapien
gttcgaaggaccagccagtaggccc

SEQ ID NO: 19545 - DNA, 25 bp, Homo sapien
gcgcatatgcaagccatgaattatc

SEQ ID NO: 19546 - DNA, 25 bp, Homo sapien
tgaaaggagtcaattaccggctcta

SEQ ID NO: 19547 - DNA, 25 bp, Homo sapien
cggctctaaaaacgagtgtctgcgc

SEQ ID NO: 19548 - DNA, 25 bp, Homo sapien
cgcctatttacggagcgatctaccc

SEQ ID NO: 19549 - DNA, 25 bp, Homo sapien
gccaaggcggctcagttcctcttct

SEQ ID NO: 19550 - DNA, 25 bp, Homo sapien
cgccgacggtctcgcgctctgattt

SEQ ID NO: 19551 - DNA, 25 bp, Homo sapien
gcgctctgatttcctcaccgtatga

SEQ ID NO: 19552 - DNA, 25 bp, Homo sapien
cctcaccgtatgaaatgaaattcca

SEQ ID NO: 19553 - DNA, 25 bp, Homo sapien
ccgtatgaaatgaaattccacaggg

SEQ ID NO: 19554 - DNA, 25 bp, Homo sapien
ccacagggggattcgaaaggaaatg

SEQ ID NO: 19555 - DNA, 25 bp, Homo sapien
tcgaaaggaaatgagaccgggactc

SEQ ID NO: 19556 - DNA, 25 bp, Homo sapien
agaccgggactctccgtgcttctcg

SEQ ID NO: 19557 - DNA, 25 bp, Homo sapien
gccgcccttcctgtctcggggacac

SEQ ID NO: 19558 - DNA, 25 bp, Homo sapien
acgtactcacagacacgcaatttga

SEQ ID NO: 19559 - DNA, 25 bp, Homo sapien
tccctaagtgacagcgagagaatcg

SEQ ID NO: 19560 - DNA, 25 bp, Homo sapien
cccaatccggcaaatagagtcaatc

SEQ ID NO: 19561 - DNA, 25 bp, Homo sapien
ggccgctaacccgattatgcagatc

SEQ ID NO: 19562 - DNA, 25 bp, Homo sapien
ctaagcggctctcggatttgggaaa

SEQ ID NO: 19563 - DNA, 25 bp, Homo sapien
ggacttctcccagccgggtgaatgg

SEQ ID NO: 19564 - DNA, 25 bp, Homo sapien
ttatgaagggaacaatctggcggcc

SEQ ID NO: 19565 - DNA, 25 bp, Homo sapien
aaatcgcgctgagcctccctaagtg

SEQ ID NO: 19566 - DNA, 25 bp, Homo sapien
cggcaaatgacactctcggaatctt

SEQ ID NO: 19567 - DNA, 25 bp, Homo sapien
atcaacggcggcaaatgacactctc

SEQ ID NO: 19568 - DNA, 25 bp, Homo sapien
ctattatcaacaccatcaacggcgg

SEQ ID NO: 19569 - DNA, 25 bp, Homo sapien
tagagaatccgcctctgtgccgccg

SEQ ID NO: 19570 - DNA, 25 bp, Homo sapien
ctgcgctgaggggaagccttaatag

SEQ ID NO: 19571 - DNA, 25 bp, Homo sapien
ctctggtctgcttctcgcttgctgc

SEQ ID NO: 19572 - DNA, 25 bp, Homo sapien
atcttgactccaatctgatgcctgg

SEQ ID NO: 19573 - DNA, 25 bp, Homo sapien
tgcttctcgcttgctgctgcgctga

SEQ ID NO: 19574 - DNA, 25 bp, Homo sapien
ctttgttagtcttgtcagcgcggcc

SEQ ID NO: 19575 - DNA, 25 bp, Homo sapien
ggacctagcctcctctgaacgcaga

SEQ ID NO: 19576 - DNA, 25 bp, Homo sapien
cgcgcgccatggatcaagatgatga

SEQ ID NO: 19577 - DNA, 25 bp, Homo sapien
atgatgaatcgctgcggacggcgca

SEQ ID NO: 19578 - DNA, 25 bp, Homo sapien
ggccgcgctaataacctgtccagga

SEQ ID NO: 19579 - DNA, 25 bp, Homo sapien
tccggaattaggtctaagccgccca

SEQ ID NO: 19580 - DNA, 25 bp, Homo sapien
ggtgttcccgctcttcgaggacatc

SEQ ID NO: 19581 - DNA, 25 bp, Homo sapien
tccaggagatggctcgtggcaaatt

SEQ ID NO: 19582 - DNA, 25 bp, Homo sapien
agtgtaagtcggtgtgcctgggacc

SEQ ID NO: 19583 - DNA, 25 bp, Homo sapien
ccaagaatgccacgcttgtcgccgg

SEQ ID NO: 19584 - DNA, 25 bp, Homo sapien
agaatgccacgcttgtcgccggccg

SEQ ID NO: 19585 - DNA, 25 bp, Homo sapien
tcagtcgaccccaggacgcgctgga

SEQ ID NO: 19586 - DNA, 25 bp, Homo sapien
acgcgctggagggtgttgtgctcag

SEQ ID NO: 19587 - DNA, 25 bp, Homo sapien
ttgtgctcagtgtaagtcggtgtgc

SEQ ID NO: 19588 - DNA, 25 bp, Homo sapien
tgctcagtgtaagtcggtgtgcctg

SEQ ID NO: 19589 - DNA, 25 bp, Homo sapien
ctcagccaagaatgccacgcttgtc

SEQ ID NO: 19590 - DNA, 25 bp, Homo sapien
cgccagtgcggtgtctctgctgcag

SEQ ID NO: 19591 - DNA, 25 bp, Homo sapien
agcacatcggggtccttgcaagacc

SEQ ID NO: 19592 - DNA, 25 bp, Homo sapien
ctcggctggggaagccgtccctagt

SEQ ID NO: 19593 - DNA, 25 bp, Homo sapien
tccctagtgagggagacgtcccgca

SEQ ID NO: 19594 - DNA, 25 bp, Homo sapien
tgagggagacgtcccgcatcacggt

SEQ ID NO: 19595 - DNA, 25 bp, Homo sapien
gttttcctgtctggcgctgtacctt

SEQ ID NO: 19596 - DNA, 25 bp, Homo sapien
ccttaggggtctgcatcagtgagac

SEQ ID NO: 19597 - DNA, 25 bp, Homo sapien
ggtctgcatcagtgagacccttccc

SEQ ID NO: 19598 - DNA, 25 bp, Homo sapien
cgtcacggttttgcctcatttggaa

SEQ ID NO: 19599 - DNA, 25 bp, Homo sapien
tcagctgccaccaagtgcgcctttt

SEQ ID NO: 19600 - DNA, 25 bp, Homo sapien
gcggagacaaatccttctcagtttg

SEQ ID NO: 19601 - DNA, 25 bp, Homo sapien
agaacgcttcggatccgtcacggtt

SEQ ID NO: 19602 - DNA, 25 bp, Homo sapien
ctggattgcgattctgcacgaattt

SEQ ID NO: 19603 - DNA, 25 bp, Homo sapien
agtgcgccttttctctctggattgc

SEQ ID NO: 19604 - DNA, 25 bp, Homo sapien
cccactgggcggatcagaaagtttg

SEQ ID NO: 19605 - DNA, 25 bp, Homo sapien
cggccttggtctaggaaccttcagg

SEQ ID NO: 19606 - DNA, 25 bp, Homo sapien
gcacgccaggcacgcatcaagctcc

SEQ ID NO: 19607 - DNA, 25 bp, Homo sapien
aggcgaaggcgcctgccagcgtcac

SEQ ID NO: 19608 - DNA, 25 bp, Homo sapien
ccacgacgagcagcgcgttgtgctc

SEQ ID NO: 19609 - DNA, 25 bp, Homo sapien
acacacgcagcaggccgcgaagaag

SEQ ID NO: 19610 - DNA, 25 bp, Homo sapien
ggctacacacgcagcaggccgcgaa

SEQ ID NO: 19611 - DNA, 25 bp, Homo sapien
tgtcctgtgccgtgggctcgctgct

SEQ ID NO: 19612 - DNA, 25 bp, Homo sapien
gagctggactccttccgagcgcagc

SEQ ID NO: 19613 - DNA, 25 bp, Homo sapien
tgggttgagctggactccttccgag

SEQ ID NO: 19614 - DNA, 25 bp, Homo sapien
tcgtccgcactttccgagagccagg

SEQ ID NO: 19615 - DNA, 25 bp, Homo sapien
agagcgcaggaccaccaagagaggc

SEQ ID NO: 19616 - DNA, 25 bp, Homo sapien
cgccgtccgctgacttctaggggct

SEQ ID NO: 19617 - DNA, 25 bp, Homo sapien
ccgagccgcttggagatcctagatc

SEQ ID NO: 19618 - DNA, 25 bp, Homo sapien
gcttcacggtttgcaagcacccttg

SEQ ID NO: 19619 - DNA, 25 bp, Homo sapien
cgttctcctctaggcttcacggttt

SEQ ID NO: 19620 - DNA, 25 bp, Homo sapien
agcacccttgcaaataactcctagc

SEQ ID NO: 19621 - DNA, 25 bp, Homo sapien
gcgagcggggttcttaccatacacc

SEQ ID NO: 19622 - DNA, 25 bp, Homo sapien
cgggccacagagtaagcgccatctc

SEQ ID NO: 19623 - DNA, 25 bp, Homo sapien
tccggcgctttcttttccgaatgga

SEQ ID NO: 19624 - DNA, 25 bp, Homo sapien
tgcagatcgctcctccgagaacgcg

SEQ ID NO: 19625 - DNA, 25 bp, Homo sapien
gcaggtctcgcttttaccttcgctg

SEQ ID NO: 19626 - DNA, 25 bp, Homo sapien
ctcggaggaatacctcgcaggtctc

SEQ ID NO: 19627 - DNA, 25 bp, Homo sapien
cctccgcagctgaatcgcgtcgtga

SEQ ID NO: 19628 - DNA, 25 bp, Homo sapien
ctcgggacagtcctgaaaagcgtcc

SEQ ID NO: 19629 - DNA, 25 bp, Homo sapien
caggcacagaggtcgcagacagctc

SEQ ID NO: 19630 - DNA, 25 bp, Homo sapien
gcaatgccatatagcgcggcgcaga

SEQ ID NO: 19631 - DNA, 25 bp, Homo sapien
aggccttcgatccagtccatgagca

SEQ ID NO: 19632 - DNA, 25 bp, Homo sapien
cgctccgccatagtgccgtagatga

SEQ ID NO: 19633 - DNA, 25 bp, Homo sapien
gaagtccaccacgtgcacggcgatc

SEQ ID NO: 19634 - DNA, 25 bp, Homo sapien
tggtagcctcaccacactgcgcagg

SEQ ID NO: 19635 - DNA, 25 bp, Homo sapien
ccgacttgagagaggcctgtgcctt

SEQ ID NO: 19636 - DNA, 25 bp, Homo sapien
tgtgccttcttgtacagctcaaagc

SEQ ID NO: 19637 - DNA, 25 bp, Homo sapien
tcttcgtcgttgatgaggccttcga

SEQ ID NO: 19638 - DNA, 25 bp, Homo sapien
actcacgggtcctcttctggccgtg

SEQ ID NO: 19639 - DNA, 25 bp, Homo sapien
tggggtcacattcccagccacagga

SEQ ID NO: 19640 - DNA, 25 bp, Homo sapien
gttctctctcctgtcagcctgtccg

SEQ ID NO: 19641 - DNA, 25 bp, Homo sapien
gccgaagaaatgaaagtggaagcca

SEQ ID NO: 19642 - DNA, 25 bp, Homo sapien
tgccacgccaggacggccgaagaaa

SEQ ID NO: 19643 - DNA, 25 bp, Homo sapien
tccggactgtgccacgccaggacgg

SEQ ID NO: 19644 - DNA, 25 bp, Homo sapien
cgcaactttcgaagctctgagcctc

SEQ ID NO: 19645 - DNA, 25 bp, Homo sapien
tgcaacctcaaaccagctcccaggg

SEQ ID NO: 19646 - DNA, 25 bp, Homo sapien
tggaggcgtccaacggctccgtcct

SEQ ID NO: 19647 - DNA, 25 bp, Homo sapien
acccgtgttgtcatcaaggcccagg

SEQ ID NO: 19648 - DNA, 25 bp, Homo sapien
ggcctgtggtcacccgtgttgtcat

SEQ ID NO: 19649 - DNA, 25 bp, Homo sapien
ctacgccgaggcctagtgggctcca

SEQ ID NO: 19650 - DNA, 25 bp, Homo sapien
acttcaacgtccagctacgccgagg

SEQ ID NO: 19651 - DNA, 25 bp, Homo sapien
tacgtgttctctgagcactgccgcg

SEQ ID NO: 19652 - DNA, 25 bp, Homo sapien
cctggggtgacttccactacaagac

SEQ ID NO: 19653 - DNA, 25 bp, Homo sapien
cgtcctcatcaatgggcagcggtga

SEQ ID NO: 19654 - DNA, 25 bp, Homo sapien
acctgcgcagcagctggatcttgtc

SEQ ID NO: 19655 - DNA, 25 bp, Homo sapien
tgtagtagtccgtccttcagcatcg

SEQ ID NO: 19656 - DNA, 25 bp, Homo sapien
tccagggaggctgcccaaattcaac

SEQ ID NO: 19657 - DNA, 25 bp, Homo sapien
ctgcgcgccaagtccgttctctaaa

SEQ ID NO: 19658 - DNA, 25 bp, Homo sapien
gttctctaaagccagcggatctcca

SEQ ID NO: 19659 - DNA, 25 bp, Homo sapien
cttgtcgcggtagcggtcgtagaaa

SEQ ID NO: 19660 - DNA, 25 bp, Homo sapien
aagccagcggatctccatgtcctcg

SEQ ID NO: 19661 - DNA, 25 bp, Homo sapien
caggcactcgatgtagtagtccgtc

SEQ ID NO: 19662 - DNA, 25 bp, Homo sapien
tgggtcccacctgccgattagggtg

SEQ ID NO: 19663 - DNA, 25 bp, Homo sapien
actcccattggtcgcccgctggggt

SEQ ID NO: 19664 - DNA, 25 bp, Homo sapien
cgcctgccagtaagccgcactccca

SEQ ID NO: 19665 - DNA, 25 bp, Homo sapien
ccgacacgttgttgttggcgttggt

SEQ ID NO: 19666 - DNA, 25 bp, Homo sapien
tgctcccgacacgttgttgttggcg

SEQ ID NO: 19667 - DNA, 25 bp, Homo sapien
cacgggcaactctcggccactcaca

SEQ ID NO: 19668 - DNA, 25 bp, Homo sapien
ctcggccgaccgaaagcgctcccgc

SEQ ID NO: 19669 - DNA, 25 bp, Homo sapien
cccggagtttgaggtctccggcacg

SEQ ID NO: 19670 - DNA, 25 bp, Homo sapien
ctgctgcaggccattaagctgtacc

SEQ ID NO: 19671 - DNA, 25 bp, Homo sapien
cagaagcttcgcgagggcccagaga

SEQ ID NO: 19672 - DNA, 25 bp, Homo sapien
cttttacctggcgttcgtgttctgc

SEQ ID NO: 19673 - DNA, 25 bp, Homo sapien
ttcttcccgcgagtcagaagcttcg

SEQ ID NO: 19674 - DNA, 25 bp, Homo sapien
taaccggctagaaatcccgcacgcg

SEQ ID NO: 19675 - DNA, 25 bp, Homo sapien
cgcaaaagcagttgggccgaacgaa

SEQ ID NO: 19676 - DNA, 25 bp, Homo sapien
tgcgcgctttggtaaccggctagaa

SEQ ID NO: 19677 - DNA, 25 bp, Homo sapien
gctgcgcagagccatggaattctcc

SEQ ID NO: 19678 - DNA, 25 bp, Homo sapien
cgggcagctccgctgtaaccgaggc

SEQ ID NO: 19679 - DNA, 25 bp, Homo sapien
gcagacaaagttagcgccacgtggg

SEQ ID NO: 19680 - DNA, 25 bp, Homo sapien
ccgagacgtgagaagaggcagacaa

SEQ ID NO: 19681 - DNA, 25 bp, Homo sapien
cgccgccgatgtgtagaaggaaacc

SEQ ID NO: 19682 - DNA, 25 bp, Homo sapien
acagacaagcggatgcccgctctga

SEQ ID NO: 19683 - DNA, 25 bp, Homo sapien
cgctcggtcatcctgtgggcagaca

SEQ ID NO: 19684 - DNA, 25 bp, Homo sapien
ttggcgacgccgttcagcaggacca

SEQ ID NO: 19685 - DNA, 25 bp, Homo sapien
gcggccctttaagtctctcgcggcg

SEQ ID NO: 19686 - DNA, 25 bp, Homo sapien
tgccttggccggcccacttgggaac

SEQ ID NO: 19687 - DNA, 25 bp, Homo sapien
cctccacctcgtgttgtgggagctg

SEQ ID NO: 19688 - DNA, 25 bp, Homo sapien
gcctccacctcgtgttgtgggagct

SEQ ID NO: 19689 - DNA, 25 bp, Homo sapien
ggcctccacctcgtgttgtgggagc

SEQ ID NO: 19690 - DNA, 25 bp, Homo sapien
cggcctccacctcgtgttgtgggag

SEQ ID NO: 19691 - DNA, 25 bp, Homo sapien
ccggcctccacctcgtgttgtggga

SEQ ID NO: 19692 - DNA, 25 bp, Homo sapien
gggtgtcggcctcgctgcctgtctt

SEQ ID NO: 19693 - DNA, 25 bp, Homo sapien
ctccacctcgtgttgtgggagctgc

SEQ ID NO: 19694 - DNA, 25 bp, Homo sapien
ctcagctggccgtgtcctggcaggt

SEQ ID NO: 19695 - DNA, 25 bp, Homo sapien
ctggcccagtttgactacgggagga

SEQ ID NO: 19696 - DNA, 25 bp, Homo sapien
ctgaagctggcccagtttgactacg

SEQ ID NO: 19697 - DNA, 25 bp, Homo sapien
ccagtttgactacgggaggaagtgc

SEQ ID NO: 19698 - DNA, 25 bp, Homo sapien
aagtgctcggaggtcgctcggctga

SEQ ID NO: 19699 - DNA, 25 bp, Homo sapien
agatgctcagttgcgccaggcctgt

SEQ ID NO: 19700 - DNA, 25 bp, Homo sapien
gctgcctgtcttccggcctccacct

SEQ ID NO: 19701 - DNA, 25 bp, Homo sapien
cagctgctgtggagatgctcagttg

SEQ ID NO: 19702 - DNA, 25 bp, Homo sapien
tggctcccgaatacatcataatttg

SEQ ID NO: 19703 - DNA, 25 bp, Homo sapien
caaacacagtcgcaggggccacaca

SEQ ID NO: 19704 - DNA, 25 bp, Homo sapien
agatccctgctgagaacaccaacgg

SEQ ID NO: 19705 - DNA, 25 bp, Homo sapien
aagggcctcgaagggtccacatcta

SEQ ID NO: 19706 - DNA, 25 bp, Homo sapien
cctgtcgccaagaagaccacactta

SEQ ID NO: 19707 - DNA, 25 bp, Homo sapien
cagcctcgcgcatttctgtatattg

SEQ ID NO: 19708 - DNA, 25 bp, Homo sapien
cgaagacctcttttgcggacgtggg

SEQ ID NO: 19709 - DNA, 25 bp, Homo sapien
aggccagaatgctcacgtttttccg

SEQ ID NO: 19710 - DNA, 25 bp, Homo sapien
tggtcagaaacctcgccagtcaggg

SEQ ID NO: 19711 - DNA, 25 bp, Homo sapien
gcgcaatggaaagcccagctaggta

SEQ ID NO: 19712 - DNA, 25 bp, Homo sapien
gtaggctttccgcaagcgcaatgga

SEQ ID NO: 19713 - DNA, 25 bp, Homo sapien
gccggaagtgctctataagatgatc

SEQ ID NO: 19714 - DNA, 25 bp, Homo sapien
ggcaaacacaagctcgcgaaactga

SEQ ID NO: 19715 - DNA, 25 bp, Homo sapien
accggcgctccaggatcaaggatcc

SEQ ID NO: 19716 - DNA, 25 bp, Homo sapien
cgccacgcctgctgactggtcagaa

SEQ ID NO: 19717 - DNA, 25 bp, Homo sapien
ccgttacgtattggtgtgccgacca

SEQ ID NO: 19718 - DNA, 25 bp, Homo sapien
gccaccgcttgaggtcgctttgttc

SEQ ID NO: 19719 - DNA, 25 bp, Homo sapien
cgcactgtcaccgaacgtgtcttta

SEQ ID NO: 19720 - DNA, 25 bp, Homo sapien
ctgaaggagagacctatttttcttc

SEQ ID NO: 19721 - DNA, 25 bp, Homo sapien
tgtgcgcccacagttgtctgaagga

SEQ ID NO: 19722 - DNA, 25 bp, Homo sapien
ctttactctagaaaggaggcccgtg

SEQ ID NO: 19723 - DNA, 25 bp, Homo sapien
ggggaccagattcgtctctagagtg

SEQ ID NO: 19724 - DNA, 25 bp, Homo sapien
ttcttacattttggggaccagattc

SEQ ID NO: 19725 - DNA, 25 bp, Homo sapien
ccgcaagctttagggcggagccagc

SEQ ID NO: 19726 - DNA, 25 bp, Homo sapien
tggagcgctacctgtgagcctgcgc

SEQ ID NO: 19727 - DNA, 25 bp, Homo sapien
aggcctacctgaggcagccgggctt

SEQ ID NO: 19728 - DNA, 25 bp, Homo sapien
cgtcgacagcctggtgaacctgcag

SEQ ID NO: 19729 - DNA, 25 bp, Homo sapien
ctgttcagcgtcgacagcctggtga

SEQ ID NO: 19730 - DNA, 25 bp, Homo sapien
ccgcgcgtctgttcagcgtcgacag

SEQ ID NO: 19731 - DNA, 25 bp, Homo sapien
taccgcttcatcaccgaacgctttg

SEQ ID NO: 19732 - DNA, 25 bp, Homo sapien
gacagcccgcgcaagtggcagaaca

SEQ ID NO: 19733 - DNA, 25 bp, Homo sapien
gaacgctttgccttctaccgcgaca

SEQ ID NO: 19734 - DNA, 25 bp, Homo sapien
ttcggtctctcctgaggtcgcaacc

SEQ ID NO: 19735 - DNA, 25 bp, Homo sapien
gcgggtttcaagtggcgctgttttc

SEQ ID NO: 19736 - DNA, 25 bp, Homo sapien
ttcaagtggcgctgttttcggtctc

SEQ ID NO: 19737 - DNA, 25 bp, Homo sapien
cgctgttttcggtctctcctgaggt

SEQ ID NO: 19738 - DNA, 25 bp, Homo sapien
gttttcggtctctcctgaggtcgca

SEQ ID NO: 19739 - DNA, 25 bp, Homo sapien
tggcgctgttttcggtctctcctga

SEQ ID NO: 19740 - DNA, 25 bp, Homo sapien
aagtggcgctgttttcggtctctcc

SEQ ID NO: 19741 - DNA, 25 bp, Homo sapien
ctgttttcggtctctcctgaggtcg

SEQ ID NO: 19742 - DNA, 25 bp, Homo sapien
acgcgtggtggttatctccgcgcca

SEQ ID NO: 19743 - DNA, 25 bp, Homo sapien
aattcactctcgaactttgcccggc

SEQ ID NO: 19744 - DNA, 25 bp, Homo sapien
aactttgcccggcagacgcgtggtg

SEQ ID NO: 19745 - DNA, 25 bp, Homo sapien
ccttggtctcaacaaccgcgcagta

SEQ ID NO: 19746 - DNA, 25 bp, Homo sapien
ccgcgcagtacttgggtgcttaagc

SEQ ID NO: 19747 - DNA, 25 bp, Homo sapien
gtacttgggtgcttaagcgagtccc

SEQ ID NO: 19748 - DNA, 25 bp, Homo sapien
cctaccacatagtccagggttgggg

SEQ ID NO: 19749 - DNA, 25 bp, Homo sapien
tagcggaaagagaagatgtaaattc

SEQ ID NO: 19750 - DNA, 25 bp, Homo sapien
gccttcgaccagacagtgtccctgg

SEQ ID NO: 19751 - DNA, 25 bp, Homo sapien
cgaccagacagtgtccctggccgtg

SEQ ID NO: 19752 - DNA, 25 bp, Homo sapien
agacagtgtccctggccgtgggctt

SEQ ID NO: 19753 - DNA, 25 bp, Homo sapien
ctggccgtgggcttcattctgggca

SEQ ID NO: 19754 - DNA, 25 bp, Homo sapien
ccgtgggcttcattctgggcagcgc

SEQ ID NO: 19755 - DNA, 25 bp, Homo sapien
ggtcctcagggacccgtgccagtga

SEQ ID NO: 19756 - DNA, 25 bp, Homo sapien
cgacatcgcgaacatcctgggcccg

SEQ ID NO: 19757 - DNA, 25 bp, Homo sapien
gcggcgccttcgaccagacagtgtc

SEQ ID NO: 19758 - DNA, 25 bp, Homo sapien
gagcgctcaacatccgaggactttg

SEQ ID NO: 19759 - DNA, 25 bp, Homo sapien
ccagcggatgccctcttgagggagc

SEQ ID NO: 19760 - DNA, 25 bp, Homo sapien
cgcacctgccatagcgcttgcgccc

SEQ ID NO: 19761 - DNA, 25 bp, Homo sapien
atgccctcttgagggagcgcgcacg

SEQ ID NO: 19762 - DNA, 25 bp, Homo sapien
tccctcgcgtacagcctcggctctg

SEQ ID NO: 19763 - DNA, 25 bp, Homo sapien
aacatccgaggactttggcccagag

SEQ ID NO: 19764 - DNA, 25 bp, Homo sapien
cccttgagctgcgatacgccgagcg

SEQ ID NO: 19765 - DNA, 25 bp, Homo sapien
tgcgatacgccgagcgctcaacatc

SEQ ID NO: 19766 - DNA, 25 bp, Homo sapien
cccagagccgagaacagctcattta

SEQ ID NO: 19767 - DNA, 25 bp, Homo sapien
cccggacgccactgatagcaacgta

SEQ ID NO: 19768 - DNA, 25 bp, Homo sapien
tcccaattgttctgggctgcacgag

SEQ ID NO: 19769 - DNA, 25 bp, Homo sapien
cccggcacgaccagagacgctgtaa

SEQ ID NO: 19770 - DNA, 25 bp, Homo sapien
ctgtaaccaagacccgcagagcctg

SEQ ID NO: 19771 - DNA, 25 bp, Homo sapien
ttcccgctctttggcggctgcagca

SEQ ID NO: 19772 - DNA, 25 bp, Homo sapien
tgcaagacgccgaacaggctgagcc

SEQ ID NO: 19773 - DNA, 25 bp, Homo sapien
ccgcataatcgctggagggcttttc

SEQ ID NO: 19774 - DNA, 25 bp, Homo sapien
ccgaggcagacttagccgaggacga

SEQ ID NO: 19775 - DNA, 25 bp, Homo sapien
acggctacggctacgggctggctct

SEQ ID NO: 19776 - DNA, 25 bp, Homo sapien
cggagtcggccgacatgttcgacaa

SEQ ID NO: 19777 - DNA, 25 bp, Homo sapien
cccaagaagcggctgacgttgagcg

SEQ ID NO: 19778 - DNA, 25 bp, Homo sapien
ccgaggccgacgcagacatagacgt

SEQ ID NO: 19779 - DNA, 25 bp, Homo sapien
gcgagatcatgtcctccgagagctc

SEQ ID NO: 19780 - DNA, 25 bp, Homo sapien
ctgctgctgcgagatcatgtcctcc

SEQ ID NO: 19781 - DNA, 25 bp, Homo sapien
acgttgagcgagatctgcgagttca

SEQ ID NO: 19782 - DNA, 25 bp, Homo sapien
aggcgccgacgctgtttaaacgaag

SEQ ID NO: 19783 - DNA, 25 bp, Homo sapien
cgtgcctcgtaaggtttcgtgctta

SEQ ID NO: 19784 - DNA, 25 bp, Homo sapien
gcagctcgcctagagtctttacgga

SEQ ID NO: 19785 - DNA, 25 bp, Homo sapien
ccgatacgcgcgtcaaaatgttgtg

SEQ ID NO: 19786 - DNA, 25 bp, Homo sapien
ccagctctagtttcgggaacggatt

SEQ ID NO: 19787 - DNA, 25 bp, Homo sapien
tccgcaccgtcaccttctgggttgt

SEQ ID NO: 19788 - DNA, 25 bp, Homo sapien
tgtccgcgactttgcatttctcctg

SEQ ID NO: 19789 - DNA, 25 bp, Homo sapien
gcgctgtcttttcgctccacgcgga

SEQ ID NO: 19790 - DNA, 25 bp, Homo sapien
gattcaccctggctggcagagacta

SEQ ID NO: 19791 - DNA, 25 bp, Homo sapien
tcttgctcctatgcgggacgaccca

SEQ ID NO: 19792 - DNA, 25 bp, Homo sapien
ctcccagttcgagtgagcgaagcca

SEQ ID NO: 19793 - DNA, 25 bp, Homo sapien
gggctccggaccgagattcctgaaa

SEQ ID NO: 19794 - DNA, 25 bp, Homo sapien
gtaccgggagcttaccctccgctga

SEQ ID NO: 19795 - DNA, 25 bp, Homo sapien
tgcgctgaccctccgttagaggctg

SEQ ID NO: 19796 - DNA, 25 bp, Homo sapien
aggctgactctccaaactaggacga

SEQ ID NO: 19797 - DNA, 25 bp, Homo sapien
actgagttggcgagactcccagttc

SEQ ID NO: 19798 - DNA, 25 bp, Homo sapien
ggaaagccagctcctctaccgtgtc

SEQ ID NO: 19799 - DNA, 25 bp, Homo sapien
ccggttccggcgctcttatctggcg

SEQ ID NO: 19800 - DNA, 25 bp, Homo sapien
cgggaaagccagctcctctaccgtg

SEQ ID NO: 19801 - DNA, 25 bp, Homo sapien
tctggcgggaaagccagctcctcta

SEQ ID NO: 19802 - DNA, 25 bp, Homo sapien
cttatctggcgggaaagccagctcc

SEQ ID NO: 19803 - DNA, 25 bp, Homo sapien
gcgctcttatctggcgggaaagcca

SEQ ID NO: 19804 - DNA, 25 bp, Homo sapien
tccggcgctcttatctggcgggaaa

SEQ ID NO: 19805 - DNA, 25 bp, Homo sapien
tggcgggaaagccagctcctctacc

SEQ ID NO: 19806 - DNA, 25 bp, Homo sapien
gccattgtggtagagtttctgcttc

SEQ ID NO: 19807 - DNA, 25 bp, Homo sapien
ttcacgtgtaccatgttcccggcgg

SEQ ID NO: 19808 - DNA, 25 bp, Homo sapien
gaggtcgatctcctgcttggtcaca

SEQ ID NO: 19809 - DNA, 25 bp, Homo sapien
tggtcacactgtccgtcacaaagta

SEQ ID NO: 19810 - DNA, 25 bp, Homo sapien
tcacaaagtagttctcggaggcgtc

SEQ ID NO: 19811 - DNA, 25 bp, Homo sapien
ccgtcgtacgggatcacgtagtgga

SEQ ID NO: 19812 - DNA, 25 bp, Homo sapien
cagactcaacgaggcccaggtcaca

SEQ ID NO: 19813 - DNA, 25 bp, Homo sapien
acgaggtcccttttacatctgtaca

SEQ ID NO: 19814 - DNA, 25 bp, Homo sapien
ctgctattgctccaggtgtcgcgta

SEQ ID NO: 19815 - DNA, 25 bp, Homo sapien
cggtagcctgcaggcgtaattggca

SEQ ID NO: 19816 - DNA, 25 bp, Homo sapien
cgtaattggcatgcacgccgttgta

SEQ ID NO: 19817 - DNA, 25 bp, Homo sapien
cgccgttgtagctgagaccgcttaa

SEQ ID NO: 19818 - DNA, 25 bp, Homo sapien
ttcattacctcacgcggagcctgtg

SEQ ID NO: 19819 - DNA, 25 bp, Homo sapien
ccctaatgggagtcagctgtgtttt

SEQ ID NO: 19820 - DNA, 25 bp, Homo sapien
tgaaataatgtgatgcacgccgcga

SEQ ID NO: 19821 - DNA, 25 bp, Homo sapien
acgggtttctctgcggattctttga

SEQ ID NO: 19822 - DNA, 25 bp, Homo sapien
tcttgcgcggaaggcgttatcagcc

SEQ ID NO: 19823 - DNA, 25 bp, Homo sapien
acggggcgcgggacctctctctgtc

SEQ ID NO: 19824 - DNA, 25 bp, Homo sapien
agtttgccgccctggctggaccgcg

SEQ ID NO: 19825 - DNA, 25 bp, Homo sapien
tgtttccagtttgccgccctggctg

SEQ ID NO: 19826 - DNA, 25 bp, Homo sapien
caaaacctccgcagctgtttccagt

SEQ ID NO: 19827 - DNA, 25 bp, Homo sapien
cgcttattagatgaggcggcgcctg

SEQ ID NO: 19828 - DNA, 25 bp, Homo sapien
ggtctcccagcggtcttgcgcggaa

SEQ ID NO: 19829 - DNA, 25 bp, Homo sapien
cggaggattttcacagcacagcttc

SEQ ID NO: 19830 - DNA, 25 bp, Homo sapien
cgctcgcgagccagcactagtgtag

SEQ ID NO: 19831 - DNA, 25 bp, Homo sapien
gcatcttcaaacacacagcggcgga

SEQ ID NO: 19832 - DNA, 25 bp, Homo sapien
attacatgtgtgcaaacagccgcgg

SEQ ID NO: 19833 - DNA, 25 bp, Homo sapien
tccgactgttttggcctccggagca

SEQ ID NO: 19834 - DNA, 25 bp, Homo sapien
ctgcggaagattggaagcgactctc

SEQ ID NO: 19835 - DNA, 25 bp, Homo sapien
gtctctgtccggatgagccacatga

SEQ ID NO: 19836 - DNA, 25 bp, Homo sapien
tgagccttagtctgcgcgcccaaaa

SEQ ID NO: 19837 - DNA, 25 bp, Homo sapien
agaccattcatacctcgctggaggg

SEQ ID NO: 19838 - DNA, 25 bp, Homo sapien
cggggcgcagagcaaacttaacctt

SEQ ID NO: 19839 - DNA, 25 bp, Homo sapien
cggcctccgcttaacctgggcgcgc

SEQ ID NO: 19840 - DNA, 25 bp, Homo sapien
gctaatggcctcgtctaaatgcgga

SEQ ID NO: 19841 - DNA, 25 bp, Homo sapien
atcgatcgcggctaatggcctcgtc

SEQ ID NO: 19842 - DNA, 25 bp, Homo sapien
accttcatttgggagcgcccagcgg

SEQ ID NO: 19843 - DNA, 25 bp, Homo sapien
gcgcagagcaaacttaaccttcatt

SEQ ID NO: 19844 - DNA, 25 bp, Homo sapien
cgtctaaatgcggagccgctgcctc

SEQ ID NO: 19845 - DNA, 25 bp, Homo sapien
cttaaccttcatttgggagcgccca

SEQ ID NO: 19846 - DNA, 25 bp, Homo sapien
gcaacttgtacaggtgctccttgtg

SEQ ID NO: 19847 - DNA, 25 bp, Homo sapien
gattttaatctcacgcttggccgca

SEQ ID NO: 19848 - DNA, 25 bp, Homo sapien
aagccgctgcctcgagactggaaac

SEQ ID NO: 19849 - DNA, 25 bp, Homo sapien
tcacctgcgatatcccagagctgca

SEQ ID NO: 19850 - DNA, 25 bp, Homo sapien
cttgagcgcgaagtccacgccgatt

SEQ ID NO: 19851 - DNA, 25 bp, Homo sapien
cccggtagtgcgaagagaagttctg

SEQ ID NO: 19852 - DNA, 25 bp, Homo sapien
ggtcgccaatcaccagcaacttgta

SEQ ID NO: 19853 - DNA, 25 bp, Homo sapien
aagttctggtgcacgtagcgcttga

SEQ ID NO: 19854 - DNA, 25 bp, Homo sapien
ctgtgtcgctgcctgatcgagtgac

SEQ ID NO: 19855 - DNA, 25 bp, Homo sapien
cgagtgacgggcgaggacatacaca

SEQ ID NO: 19856 - DNA, 25 bp, Homo sapien
ggcgaggacatacacactgcggccc

SEQ ID NO: 19857 - DNA, 25 bp, Homo sapien
cgcccaaccgctgctcttttaggaa

SEQ ID NO: 19858 - DNA, 25 bp, Homo sapien
ccgctgctcttttaggaaacgtgca

SEQ ID NO: 19859 - DNA, 25 bp, Homo sapien
gaaacgtgcacttgcgctcgcggag

SEQ ID NO: 19860 - DNA, 25 bp, Homo sapien
gctcgggccaaacgcgtcatgcaca

SEQ ID NO: 19861 - DNA, 25 bp, Homo sapien
aacgcgtcatgcacagagcgctcgc

SEQ ID NO: 19862 - DNA, 25 bp, Homo sapien
ggcgtcatccaggagggcatcatca

SEQ ID NO: 19863 - DNA, 25 bp, Homo sapien
aagcgcacgtccctctctgtgagcg

SEQ ID NO: 19864 - DNA, 25 bp, Homo sapien
tctgtgagcgagtttaccatgagca

SEQ ID NO: 19865 - DNA, 25 bp, Homo sapien
gggcagcacgtcctgcaggttttcc

SEQ ID NO: 19866 - DNA, 25 bp, Homo sapien
ccgcgatggcattgaataggtagtc

SEQ ID NO: 19867 - DNA, 25 bp, Homo sapien
atcaacttcacgtagtccaggtggc

SEQ ID NO: 19868 - DNA, 25 bp, Homo sapien
ttcaagcgccagtaaagctcgtggg

SEQ ID NO: 19869 - DNA, 25 bp, Homo sapien
taccatgagcatcacccagacgggc

SEQ ID NO: 19870 - DNA, 25 bp, Homo sapien
acgggactagaatacccaggcaggc

SEQ ID NO: 19871 - DNA, 25 bp, Homo sapien
ccaaaccatggtcccacgggactag

SEQ ID NO: 19872 - DNA, 25 bp, Homo sapien
cctctggggcgtggctgactgtccc

SEQ ID NO: 19873 - DNA, 25 bp, Homo sapien
cccagttgggcacggagtttcctct

SEQ ID NO: 19874 - DNA, 25 bp, Homo sapien
gtttcctctggagcacggggctcca

SEQ ID NO: 19875 - DNA, 25 bp, Homo sapien
ctgactgtccctgtcggacctgggg

SEQ ID NO: 19876 - DNA, 25 bp, Homo sapien
tgcggaagcaggacccaaaccatgg

SEQ ID NO: 19877 - DNA, 25 bp, Homo sapien
tccgtctgttggaagagggagaccc

SEQ ID NO: 19878 - DNA, 25 bp, Homo sapien
ctctgaagtgatttgggaacgatct

SEQ ID NO: 19879 - DNA, 25 bp, Homo sapien
agctgatctccagcgccagggcgca

SEQ ID NO: 19880 - DNA, 25 bp, Homo sapien
gcgctaccggtactcactgagctga

SEQ ID NO: 19881 - DNA, 25 bp, Homo sapien
ggtcgacgctccctagggatgattc

SEQ ID NO: 19882 - DNA, 25 bp, Homo sapien
tctgaaagcgcgcaagttggaagtc

SEQ ID NO: 19883 - DNA, 25 bp, Homo sapien
tgggagagcgcttctgagaacaaga

SEQ ID NO: 19884 - DNA, 25 bp, Homo sapien
aagtcgggttgaagccagcatagcg

SEQ ID NO: 19885 - DNA, 25 bp, Homo sapien
actctctctcactggaaagttagga

SEQ ID NO: 19886 - DNA, 25 bp, Homo sapien
agtcagacccgagcaatcacagccg

SEQ ID NO: 19887 - DNA, 25 bp, Homo sapien
gtttggaagcgcactgccacttgca

SEQ ID NO: 19888 - DNA, 25 bp, Homo sapien
accgttctgccaatcggctgctttc

SEQ ID NO: 19889 - DNA, 25 bp, Homo sapien
cccactgttattgttcctgaaagca

SEQ ID NO: 19890 - DNA, 25 bp, Homo sapien
tgtcctccaggaaccgcacaaaggc

SEQ ID NO: 19891 - DNA, 25 bp, Homo sapien
agcgcgtagcagacgttgtcctcca

SEQ ID NO: 19892 - DNA, 25 bp, Homo sapien
ggttgtcaaaatccagccgcgagcg

SEQ ID NO: 19893 - DNA, 25 bp, Homo sapien
cggcgtacaccttctggttgtcaaa

SEQ ID NO: 19894 - DNA, 25 bp, Homo sapien
acacctgcccaggtagaacggcgcc

SEQ ID NO: 19895 - DNA, 25 bp, Homo sapien
gaccccagagtgattgcgctgcttc

SEQ ID NO: 19896 - DNA, 25 bp, Homo sapien
tccttactctcagctatctgtctct

SEQ ID NO: 19897 - DNA, 25 bp, Homo sapien
tggtacctccttactctcagctatc

SEQ ID NO: 19898 - DNA, 25 bp, Homo sapien
agggagcgcccatggtacctcctta

SEQ ID NO: 19899 - DNA, 25 bp, Homo sapien
taaggtcctctcacgagggagcgcc

SEQ ID NO: 19900 - DNA, 25 bp, Homo sapien
tcaaaggcggctctaaggtcctctc

SEQ ID NO: 19901 - DNA, 25 bp, Homo sapien
gctggccttccgcaccgtcgtgaag

SEQ ID NO: 19902 - DNA, 25 bp, Homo sapien
cgttctccacgtcaacgtctacgta

SEQ ID NO: 19903 - DNA, 25 bp, Homo sapien
ggagcattgatttccatacacgttc

SEQ ID NO: 19904 - DNA, 25 bp, Homo sapien
acgctgcctgccaacagactttgga

SEQ ID NO: 19905 - DNA, 25 bp, Homo sapien
acggatgtctagtttggacgctgcc

SEQ ID NO: 19906 - DNA, 25 bp, Homo sapien
cgtcacgtgcatggacggatgtcta

SEQ ID NO: 19907 - DNA, 25 bp, Homo sapien
tgttcgcttggctttgcaaaacgca

SEQ ID NO: 19908 - DNA, 25 bp, Homo sapien
tgtcacgcgagtgcatgttcgcttg

SEQ ID NO: 19909 - DNA, 25 bp, Homo sapien
ggacatggcgtgatactgtggacat

SEQ ID NO: 19910 - DNA, 25 bp, Homo sapien
ctacctcaggaagacgcggcacgac

SEQ ID NO: 19911 - DNA, 25 bp, Homo sapien
atggcgctttcctgacggcgaccgg

SEQ ID NO: 19912 - DNA, 25 bp, Homo sapien
gatccaccgcatcctggcaactgag

SEQ ID NO: 19913 - DNA, 25 bp, Homo sapien
cgccatttttgttgtccctcagtct

SEQ ID NO: 19914 - DNA, 25 bp, Homo sapien
atcctggcaactgagcaggctccgc

SEQ ID NO: 19915 - DNA, 25 bp, Homo sapien
caggtctgtagggatggcgctttcc

SEQ ID NO: 19916 - DNA, 25 bp, Homo sapien
agtgggctgacaggagctacctcag

SEQ ID NO: 19917 - DNA, 25 bp, Homo sapien
tgttgtccctcagtctccgagctca

SEQ ID NO: 19918 - DNA, 25 bp, Homo sapien
ttgaacgtcctggtggcgccaaaaa

SEQ ID NO: 19919 - DNA, 25 bp, Homo sapien
tcctcgaggtggctttgttgaacgt

SEQ ID NO: 19920 - DNA, 25 bp, Homo sapien
tcctctctgcgcctttccgtagttg

SEQ ID NO: 19921 - DNA, 25 bp, Homo sapien
ctgaaacttgggttgacgcgcgccc

SEQ ID NO: 19922 - DNA, 25 bp, Homo sapien
gaagatgcgcctcaagaaccaggta

SEQ ID NO: 19923 - DNA, 25 bp, Homo sapien
agggcccttgcaagaggatcctgcc

SEQ ID NO: 19924 - DNA, 25 bp, Homo sapien
aaccaggtagaagcgcctcggcgca

SEQ ID NO: 19925 - DNA, 25 bp, Homo sapien
gagtcgtcctccgtctctacgcgaa

SEQ ID NO: 19926 - DNA, 25 bp, Homo sapien
agtcacagaacgtgtcggctgcccg

SEQ ID NO: 19927 - DNA, 25 bp, Homo sapien
gaaggcggtaccctcaccacagtca

SEQ ID NO: 19928 - DNA, 25 bp, Homo sapien
ggtcacacagcaccgcagtggcaca

SEQ ID NO: 19929 - DNA, 25 bp, Homo sapien
ccacctgggttctagagctccttga

SEQ ID NO: 19930 - DNA, 25 bp, Homo sapien
tggggccacaccacattagcacgga

SEQ ID NO: 19931 - DNA, 25 bp, Homo sapien
gcgcgtgacctccaagggtccttct

SEQ ID NO: 19932 - DNA, 25 bp, Homo sapien
ccctactggcggaaggaagagtcgc

SEQ ID NO: 19933 - DNA, 25 bp, Homo sapien
gccgcgtccacactgtccttgggag

SEQ ID NO: 19934 - DNA, 25 bp, Homo sapien
ggctcaagggcagaaaggacgaccc

SEQ ID NO: 19935 - DNA, 25 bp, Homo sapien
gtgcgcgtctctgaaacggggactt

SEQ ID NO: 19936 - DNA, 25 bp, Homo sapien
cttgaaatagctacgccggcccgga

SEQ ID NO: 19937 - DNA, 25 bp, Homo sapien
cgaggcgcgcgccttgaaatagcta

SEQ ID NO: 19938 - DNA, 25 bp, Homo sapien
cccagcaggtcaagataggtgcagt

SEQ ID NO: 19939 - DNA, 25 bp, Homo sapien
cggcttacccataaccgagcagttg

SEQ ID NO: 19940 - DNA, 25 bp, Homo sapien
agtcaagatgctctggccacccaca

SEQ ID NO: 19941 - DNA, 25 bp, Homo sapien
agcagttgacatcgcgctgggaacc

SEQ ID NO: 19942 - DNA, 25 bp, Homo sapien
tcccagaagcggagactcaatcgcc

SEQ ID NO: 19943 - DNA, 25 bp, Homo sapien
aaagaggtaacgctgccgccactgc

SEQ ID NO: 19944 - DNA, 25 bp, Homo sapien
agtacagatactggctccctggggc

SEQ ID NO: 19945 - DNA, 25 bp, Homo sapien
ctgccctctctttccagggtgggaa

SEQ ID NO: 19946 - DNA, 25 bp, Homo sapien
ttcaggaataaacgtggacagtagc

SEQ ID NO: 19947 - DNA, 25 bp, Homo sapien
cagtagcggtcaggaaggagattcc

SEQ ID NO: 19948 - DNA, 25 bp, Homo sapien
ctccagcttgctttgggaagcattc

SEQ ID NO: 19949 - DNA, 25 bp, Homo sapien
ctcagaccgagtcggctccagcttg

SEQ ID NO: 19950 - DNA, 25 bp, Homo sapien
gaaccgccctacgaggagaggctgg

SEQ ID NO: 19951 - DNA, 25 bp, Homo sapien
atgaggcggccggaaccgccctacg

SEQ ID NO: 19952 - DNA, 25 bp, Homo sapien
caccggggctttagagggcgcagcg

SEQ ID NO: 19953 - DNA, 25 bp, Homo sapien
gcaccggggctttagagggcgcagc

SEQ ID NO: 19954 - DNA, 25 bp, Homo sapien
aaccgccctacgaggagaggctggg

SEQ ID NO: 19955 - DNA, 25 bp, Homo sapien
cggaaccgccctacgaggagaggct

SEQ ID NO: 19956 - DNA, 25 bp, Homo sapien
tgaggcggccggaaccgccctacga

SEQ ID NO: 19957 - DNA, 25 bp, Homo sapien
aggctgggaggctccgaaaacctgg

SEQ ID NO: 19958 - DNA, 25 bp, Homo sapien
cagaagtttaccttgggatgtcgcc

SEQ ID NO: 19959 - DNA, 25 bp, Homo sapien
cccagaagtttaccttgggatgtcg

SEQ ID NO: 19960 - DNA, 25 bp, Homo sapien
agaagtttaccttgggatgtcgccg

SEQ ID NO: 19961 - DNA, 25 bp, Homo sapien
aggggaggagtcattcttttcctgg

SEQ ID NO: 19962 - DNA, 25 bp, Homo sapien
cgaggggaggagtcattcttttcct

SEQ ID NO: 19963 - DNA, 25 bp, Homo sapien
gatgtcgccggacccagccgagggg

SEQ ID NO: 19964 - DNA, 25 bp, Homo sapien
ttaccttgggatgtcgccggaccca

SEQ ID NO: 19965 - DNA, 25 bp, Homo sapien
accttgggatgtcgccggacccagc

SEQ ID NO: 19966 - DNA, 25 bp, Homo sapien
cggttctggctcagtcacacgtcgc

SEQ ID NO: 19967 - DNA, 25 bp, Homo sapien
agtcacacgtcgctctgttcctgct

SEQ ID NO: 19968 - DNA, 25 bp, Homo sapien
aagcacaaagtgctgctctgcagca

SEQ ID NO: 19969 - DNA, 25 bp, Homo sapien
tcagtcagggcgtttggcgagtccc

SEQ ID NO: 19970 - DNA, 25 bp, Homo sapien
ccctatttctcgaggagcgggacgg

SEQ ID NO: 19971 - DNA, 25 bp, Homo sapien
cgggattcggcattgttttcttaga

SEQ ID NO: 19972 - DNA, 25 bp, Homo sapien
ttctagctcatatctatgcaaagga

SEQ ID NO: 19973 - DNA, 25 bp, Homo sapien
tgttcctgcttcagtgcgcaccttg

SEQ ID NO: 19974 - DNA, 25 bp, Homo sapien
tgccacttgctggagtctgtgaatg

SEQ ID NO: 19975 - DNA, 25 bp, Homo sapien
ggccgcgtcttgtcagtctatcagc

SEQ ID NO: 19976 - DNA, 25 bp, Homo sapien
tcccgcagaagccaagggtgtagcc

SEQ ID NO: 19977 - DNA, 25 bp, Homo sapien
caggtatccttctcgcttgaggcca

SEQ ID NO: 19978 - DNA, 25 bp, Homo sapien
actcgctcccagaaaatgccacttg

SEQ ID NO: 19979 - DNA, 25 bp, Homo sapien
tgcgtctctgcgttgctctttcgaa

SEQ ID NO: 19980 - DNA, 25 bp, Homo sapien
tccgacacggacaaggtctatgata

SEQ ID NO: 19981 - DNA, 25 bp, Homo sapien
aggttccgaggccaagtatgtctag

SEQ ID NO: 19982 - DNA, 25 bp, Homo sapien
tgtcaagatatccagcggcgtccgc

SEQ ID NO: 19983 - DNA, 25 bp, Homo sapien
ccgttgaccataggcccgtacaggc

SEQ ID NO: 19984 - DNA, 25 bp, Homo sapien
ctgggaacacgcgtgtcaagatatc

SEQ ID NO: 19985 - DNA, 25 bp, Homo sapien
ttcagcacctgctcgatggcctgca

SEQ ID NO: 19986 - DNA, 25 bp, Homo sapien
ctttgtcagcctctgaaccggattc

SEQ ID NO: 19987 - DNA, 25 bp, Homo sapien
cggtcacgcatgagatcgctaaagg

SEQ ID NO: 19988 - DNA, 25 bp, Homo sapien
actgcttctccggagcgccgttgac

SEQ ID NO: 19989 - DNA, 25 bp, Homo sapien
tcgctaaaggcgtagtccatgggtg

SEQ ID NO: 19990 - DNA, 25 bp, Homo sapien
agagcgacagttttggcccagaagt

SEQ ID NO: 19991 - DNA, 25 bp, Homo sapien
gggatctttctcgaagaccacctca

SEQ ID NO: 19992 - DNA, 25 bp, Homo sapien
acctgtggtgcagttttttagcttc

SEQ ID NO: 19993 - DNA, 25 bp, Homo sapien
ctctgggacccgtaaaaatgtgagc

SEQ ID NO: 19994 - DNA, 25 bp, Homo sapien
agacctgatatacacgctaggggta

SEQ ID NO: 19995 - DNA, 25 bp, Homo sapien
gccatggctgctcttagacctgata

SEQ ID NO: 19996 - DNA, 25 bp, Homo sapien
cggaacctccttgtgagccctagca

SEQ ID NO: 19997 - DNA, 25 bp, Homo sapien
tgagcgccaaaagttccacggtgag

SEQ ID NO: 19998 - DNA, 25 bp, Homo sapien
acgccatctgtttgccggctgcgac

SEQ ID NO: 19999 - DNA, 25 bp, Homo sapien
cctcggagcaagcagacgccatctg

SEQ ID NO: 20000 - DNA, 25 bp, Homo sapien
ggctgatactctccgcccgggaatg

SEQ ID NO: 20001 - DNA, 25 bp, Homo sapien
gctgcgacgcgtcccgtttaattac

SEQ ID NO: 20002 - DNA, 25 bp, Homo sapien
tcccggcagcctaatagagatgata

SEQ ID NO: 20003 - DNA, 25 bp, Homo sapien
ccggattccgttagtttggctgata

SEQ ID NO: 20004 - DNA, 25 bp, Homo sapien
gaaggaatctccacgggttgcccta

SEQ ID NO: 20005 - DNA, 25 bp, Homo sapien
acccgggaggcattgacttttgcgc

SEQ ID NO: 20006 - DNA, 25 bp, Homo sapien
ggatcaagccctcgcgtcttccggg

SEQ ID NO: 20007 - DNA, 25 bp, Homo sapien
ctggtgctcagcttctatccggacc

SEQ ID NO: 20008 - DNA, 25 bp, Homo sapien
gtctgcccagtgtcgccaggcttct

SEQ ID NO: 20009 - DNA, 25 bp, Homo sapien
ggcagaacaaccaactgaaggtgga

SEQ ID NO: 20010 - DNA, 25 bp, Homo sapien
gctgcagccctcctttggatcaagc

SEQ ID NO: 20011 - DNA, 25 bp, Homo sapien
cctttggatcaagccctcgcgtctt

SEQ ID NO: 20012 - DNA, 25 bp, Homo sapien
aaaggccgggcagaacaaccaactg

SEQ ID NO: 20013 - DNA, 25 bp, Homo sapien
gctgcgaatcggctcctggcccaat

SEQ ID NO: 20014 - DNA, 25 bp, Homo sapien
gttgtggactcaccggccacagttg

SEQ ID NO: 20015 - DNA, 25 bp, Homo sapien
ttgtggaatcggtccagcagcgcgt

SEQ ID NO: 20016 - DNA, 25 bp, Homo sapien
gcagcgcgttcatgtccatcaagca

SEQ ID NO: 20017 - DNA, 25 bp, Homo sapien
atcaagcacgcgatggcctggaaga

SEQ ID NO: 20018 - DNA, 25 bp, Homo sapien
gcctggaagagctcatgaccggtca

SEQ ID NO: 20019 - DNA, 25 bp, Homo sapien
acacatgtgcgctcacgcgtgtcga

SEQ ID NO: 20020 - DNA, 25 bp, Homo sapien
gctcatgaccggtcagcgccaagga

SEQ ID NO: 20021 - DNA, 25 bp, Homo sapien
cggccacagttgcagtggcagacgc

SEQ ID NO: 20022 - DNA, 25 bp, Homo sapien
catcgaggtcgcaaagcgccgcttt

SEQ ID NO: 20023 - DNA, 25 bp, Homo sapien
ctgtcaagcgctgagcgcgcgacta

SEQ ID NO: 20024 - DNA, 25 bp, Homo sapien
gcacattttgcctgtcatcgaggtc

SEQ ID NO: 20025 - DNA, 25 bp, Homo sapien
gccaggatcatctcccggtccatgt

SEQ ID NO: 20026 - DNA, 25 bp, Homo sapien
gcgctcatgcactcggtaaccttca

SEQ ID NO: 20027 - DNA, 25 bp, Homo sapien
cagcccggacaggaagattggtctg

SEQ ID NO: 20028 - DNA, 25 bp, Homo sapien
ccggataccttcagcggcgttaagc

SEQ ID NO: 20029 - DNA, 25 bp, Homo sapien
gcgccacggctgtcgcacattttgc

SEQ ID NO: 20030 - DNA, 25 bp, Homo sapien
cgggctccgtagacgctttccgcat

SEQ ID NO: 20031 - DNA, 25 bp, Homo sapien
gaagaaaccggcaccctctctgaga

SEQ ID NO: 20032 - DNA, 25 bp, Homo sapien
cacgcaagtgcctgtaggggtgaaa

SEQ ID NO: 20033 - DNA, 25 bp, Homo sapien
gccctgtccgcagcaaaggggcaca

SEQ ID NO: 20034 - DNA, 25 bp, Homo sapien
cagaacttggcctacgtttcccagg

SEQ ID NO: 20035 - DNA, 25 bp, Homo sapien
cagctcaatgagtgcctacagcaga

SEQ ID NO: 20036 - DNA, 25 bp, Homo sapien
gaaagcctgaacgagctcggtcgta

SEQ ID NO: 20037 - DNA, 25 bp, Homo sapien
gagcctccttaaaactctgccgtta

SEQ ID NO: 20038 - DNA, 25 bp, Homo sapien
atttcggcaaaggtcgtcatggtcg

SEQ ID NO: 20039 - DNA, 25 bp, Homo sapien
catatttgggagacgacgggataca

SEQ ID NO: 20040 - DNA, 25 bp, Homo sapien
cacggctctccgtgctcttggggaa

SEQ ID NO: 20041 - DNA, 25 bp, Homo sapien
tcgtgggcaactggatctctttggg

SEQ ID NO: 20042 - DNA, 25 bp, Homo sapien
gggtgaccacactgctgatctgctc

SEQ ID NO: 20043 - DNA, 25 bp, Homo sapien
tcggccacatcatacagcgccttgg

SEQ ID NO: 20044 - DNA, 25 bp, Homo sapien
cgaggagctctgagtgtaatctctt

SEQ ID NO: 20045 - DNA, 25 bp, Homo sapien
ggcgtgctttccagggacattcaca

SEQ ID NO: 20046 - DNA, 25 bp, Homo sapien
ccatcccactggacggttctggcga

SEQ ID NO: 20047 - DNA, 25 bp, Homo sapien
aggctgagcaaacggcgcccgacct

SEQ ID NO: 20048 - DNA, 25 bp, Homo sapien
cccagcttgcgctgtacggagcgcg

SEQ ID NO: 20049 - DNA, 25 bp, Homo sapien
ggcacccggaggcaactaaggccgc

SEQ ID NO: 20050 - DNA, 25 bp, Homo sapien
cccggactttggagtgtcttctgcg

SEQ ID NO: 20051 - DNA, 25 bp, Homo sapien
cgttaggatttggatcccagtggcc

SEQ ID NO: 20052 - DNA, 25 bp, Homo sapien
ccggtgagtgcctagctcttcgcgg

SEQ ID NO: 20053 - DNA, 25 bp, Homo sapien
ggagtgtcttctgcgttaggatttg

SEQ ID NO: 20054 - DNA, 25 bp, Homo sapien
ttcacgagtctcagtccgaccgggc

SEQ ID NO: 20055 - DNA, 25 bp, Homo sapien
ccggaagatggggaactgcctcaaa

SEQ ID NO: 20056 - DNA, 25 bp, Homo sapien
agcaaaaattgacgcagcaccgaga

SEQ ID NO: 20057 - DNA, 25 bp, Homo sapien
agcaccgagaacagctgctagtgga

SEQ ID NO: 20058 - DNA, 25 bp, Homo sapien
accagagcacgcacggcgcgatgac

SEQ ID NO: 20059 - DNA, 25 bp, Homo sapien
gtttcggagccaggtacggagccaa

SEQ ID NO: 20060 - DNA, 25 bp, Homo sapien
tgacctggattaggcccagcagctc

SEQ ID NO: 20061 - DNA, 25 bp, Homo sapien
cggagccaagcagtcagagagaagc

SEQ ID NO: 20062 - DNA, 25 bp, Homo sapien
cccgctccgacaggtgagagcccgg

SEQ ID NO: 20063 - DNA, 25 bp, Homo sapien
cccacccgcaccgtagggccatggc

SEQ ID NO: 20064 - DNA, 25 bp, Homo sapien
acctatttggcgctagaagttcttc

SEQ ID NO: 20065 - DNA, 25 bp, Homo sapien
ggtccactttactgtcacttctcct

SEQ ID NO: 20066 - DNA, 25 bp, Homo sapien
ctagaagttcttctccgggacctga

SEQ ID NO: 20067 - DNA, 25 bp, Homo sapien
gttcttctccgggacctgaggtcca

SEQ ID NO: 20068 - DNA, 25 bp, Homo sapien
ggacctgaggtccactttactgtca

SEQ ID NO: 20069 - DNA, 25 bp, Homo sapien
ccagccggacgccaatcgcggccca

SEQ ID NO: 20070 - DNA, 25 bp, Homo sapien
gacttcgcagatagcccgcgtcttg

SEQ ID NO: 20071 - DNA, 25 bp, Homo sapien
tgcccggtacctgcggtcgcttttc

SEQ ID NO: 20072 - DNA, 25 bp, Homo sapien
gctcaggtgggaccgcgtctaccct

SEQ ID NO: 20073 - DNA, 25 bp, Homo sapien
gatagcccgcgtcttgcgacactga

SEQ ID NO: 20074 - DNA, 25 bp, Homo sapien
cttctcaccgagctgacttcgcaga

SEQ ID NO: 20075 - DNA, 25 bp, Homo sapien
cgccgctgcccaaacctgaccgcca

SEQ ID NO: 20076 - DNA, 25 bp, Homo sapien
cgcgtcttgcgacactgagcggcgc

SEQ ID NO: 20077 - DNA, 25 bp, Homo sapien
accgagctgacttcgcagatagccc

SEQ ID NO: 20078 - DNA, 25 bp, Homo sapien
ggagtctcggccaccggaccagagc

SEQ ID NO: 20079 - DNA, 25 bp, Homo sapien
tgtttccatcatgcaagggagggga

SEQ ID NO: 20080 - DNA, 25 bp, Homo sapien
cgccgcagccatggtgtttccatca

SEQ ID NO: 20081 - DNA, 25 bp, Homo sapien
tgtggcgttacctgtgtcagagaga

SEQ ID NO: 20082 - DNA, 25 bp, Homo sapien
caagccaagaagtcggcgaagctga

SEQ ID NO: 20083 - DNA, 25 bp, Homo sapien
gcctgcttggcccacaagccaagaa

SEQ ID NO: 20084 - DNA, 25 bp, Homo sapien
gagcgcggccgggtcacagtccact

SEQ ID NO: 20085 - DNA, 25 bp, Homo sapien
ccggcgcggacataaaattaaagcg

SEQ ID NO: 20086 - DNA, 25 bp, Homo sapien
tggccacttgcggagtgagtagacc

SEQ ID NO: 20087 - DNA, 25 bp, Homo sapien
cttggcgaatggctttcttgctggc

SEQ ID NO: 20088 - DNA, 25 bp, Homo sapien
gacgggctgaacctcagtcaggacc

SEQ ID NO: 20089 - DNA, 25 bp, Homo sapien
caatcgccaggggtctctttgccag

SEQ ID NO: 20090 - DNA, 25 bp, Homo sapien
gtgacccatggccaatcgccagggg

SEQ ID NO: 20091 - DNA, 25 bp, Homo sapien
acctcctacagcaggtgacccatgg

SEQ ID NO: 20092 - DNA, 25 bp, Homo sapien
gagcgcgaatgtcgtgctcaccctg

SEQ ID NO: 20093 - DNA, 25 bp, Homo sapien
ttctccagccgctacccagtgggaa

SEQ ID NO: 20094 - DNA, 25 bp, Homo sapien
ccaccaagctggagcgatggacatc

SEQ ID NO: 20095 - DNA, 25 bp, Homo sapien
gcaagaaagtagtcacgctcacgta

SEQ ID NO: 20096 - DNA, 25 bp, Homo sapien
ggcaccaacgtgacccggactgatt

SEQ ID NO: 20097 - DNA, 25 bp, Homo sapien
tctcggaacagccagcgaacatttc

SEQ ID NO: 20098 - DNA, 25 bp, Homo sapien
cccggcgcgtttatgacgtacgagt

SEQ ID NO: 20099 - DNA, 25 bp, Homo sapien
gtgctccgcgtgtcaaagaaaaata

SEQ ID NO: 20100 - DNA, 25 bp, Homo sapien
agtattttcctacacccgccggatg

SEQ ID NO: 20101 - DNA, 25 bp, Homo sapien
ccgccgatgacgctactgatttcag

SEQ ID NO: 20102 - DNA, 25 bp, Homo sapien
ggggatcggtccctgatcctccgcg

SEQ ID NO: 20103 - DNA, 25 bp, Homo sapien
cccttaccgcggactccgagtgcgg

SEQ ID NO: 20104 - DNA, 25 bp, Homo sapien
tggtctggtccggtcaggtcctcac

SEQ ID NO: 20105 - DNA, 25 bp, Homo sapien
ctggtccggtcaggtcctcacagtg

SEQ ID NO: 20106 - DNA, 25 bp, Homo sapien
tcctcacagtggcgcctgagggctg

SEQ ID NO: 20107 - DNA, 25 bp, Homo sapien
ggatcggtccctgatcctccgcggg

SEQ ID NO: 20108 - DNA, 25 bp, Homo sapien
cccgctccagcactgctccgctccg

SEQ ID NO: 20109 - DNA, 25 bp, Homo sapien
ctgagggctgaggctcccgctccag

SEQ ID NO: 20110 - DNA, 25 bp, Homo sapien
ttgacaggtcttagttgacgcgctg

SEQ ID NO: 20111 - DNA, 25 bp, Homo sapien
acgcgctgttcagcgctttgagttc

SEQ ID NO: 20112 - DNA, 25 bp, Homo sapien
gttgacgcgctgttcagcgctttga

SEQ ID NO: 20113 - DNA, 25 bp, Homo sapien
caggtcttagttgacgcgctgttca

SEQ ID NO: 20114 - DNA, 25 bp, Homo sapien
cgtgattatatttgggccccgtgtg

SEQ ID NO: 20115 - DNA, 25 bp, Homo sapien
atatttgacaggtcttagttgacgc

SEQ ID NO: 20116 - DNA, 25 bp, Homo sapien
ggtcttagttgacgcgctgttcagc

SEQ ID NO: 20117 - DNA, 25 bp, Homo sapien
cccgtgtgattatatttgacaggtc

SEQ ID NO: 20118 - DNA, 25 bp, Homo sapien
gacgccagtcctccggtcctggagg

SEQ ID NO: 20119 - DNA, 25 bp, Homo sapien
acgaccggtgaccatgtctcaggcc

SEQ ID NO: 20120 - DNA, 25 bp, Homo sapien
ctcggggtcctgaggccaaactctc

SEQ ID NO: 20121 - DNA, 25 bp, Homo sapien
acgccggccattcagaggcccagtg

SEQ ID NO: 20122 - DNA, 25 bp, Homo sapien
ccgcacaggcttcccttagggcggg

SEQ ID NO: 20123 - DNA, 25 bp, Homo sapien
ccctggaatcctcaacggagggatg

SEQ ID NO: 20124 - DNA, 25 bp, Homo sapien
tgtccggtgaccctggacgccagtc

SEQ ID NO: 20125 - DNA, 25 bp, Homo sapien
ccacaggtcagggacgggatgaccc

SEQ ID NO: 20126 - DNA, 25 bp, Homo sapien
cccaggctgcaccagtctgctccgc

SEQ ID NO: 20127 - DNA, 25 bp, Homo sapien
tgtgcccgccggaccgagaaggagc

SEQ ID NO: 20128 - DNA, 25 bp, Homo sapien
agcggttacagttgtgcggcctgcc

SEQ ID NO: 20129 - DNA, 25 bp, Homo sapien
accgagggtcaaagactgagtggaa

SEQ ID NO: 20130 - DNA, 25 bp, Homo sapien
gtcaaagactgagtggaagcccgaa

SEQ ID NO: 20131 - DNA, 25 bp, Homo sapien
agactgagtggaagcccgaaggccc

SEQ ID NO: 20132 - DNA, 25 bp, Homo sapien
gtctgctacccagagccgggttttc

SEQ ID NO: 20133 - DNA, 25 bp, Homo sapien
ctgcaccagtctgctccgccgcgcc

SEQ ID NO: 20134 - DNA, 25 bp, Homo sapien
ccgcaagtgctctgtggtaccagga

SEQ ID NO: 20135 - DNA, 25 bp, Homo sapien
gtggccgccaactcacactgacgtt

SEQ ID NO: 20136 - DNA, 25 bp, Homo sapien
gagtccgcagtatgcagttccctga

SEQ ID NO: 20137 - DNA, 25 bp, Homo sapien
tcggcctgggcacttccatttacta

SEQ ID NO: 20138 - DNA, 25 bp, Homo sapien
aggcaccggacccatgctttgcaga

SEQ ID NO: 20139 - DNA, 25 bp, Homo sapien
tgcgcttccatcaatccggccagta

SEQ ID NO: 20140 - DNA, 25 bp, Homo sapien
cgtgccaggcagtagagctcgtaac

SEQ ID NO: 20141 - DNA, 25 bp, Homo sapien
tcctctcagggagcgaccattggca

SEQ ID NO: 20142 - DNA, 25 bp, Homo sapien
gggagaaccgttgctcctcgcgtcc

SEQ ID NO: 20143 - DNA, 25 bp, Homo sapien
cgagagctgttctcgagcgcgagtt

SEQ ID NO: 20144 - DNA, 25 bp, Homo sapien
cgggaaaatgtaggccaagatagta

SEQ ID NO: 20145 - DNA, 25 bp, Homo sapien
tcacgtagaagggtacgagagctgt

SEQ ID NO: 20146 - DNA, 25 bp, Homo sapien
ttcgtggattctgggtgtccaggtc

SEQ ID NO: 20147 - DNA, 25 bp, Homo sapien
tgagcttaaaggtgcagatcacgta

SEQ ID NO: 20148 - DNA, 25 bp, Homo sapien
agcgcgagttgcttttcgtggattc

SEQ ID NO: 20149 - DNA, 25 bp, Homo sapien
gcagacggtccacacagttcgccga

SEQ ID NO: 20150 - DNA, 25 bp, Homo sapien
agttcagatgttcgctcccgggata

SEQ ID NO: 20151 - DNA, 25 bp, Homo sapien
ggtgttggaggaccctccctgcttc

SEQ ID NO: 20152 - DNA, 25 bp, Homo sapien
gccatctttctcttgccgcgtgctg

SEQ ID NO: 20153 - DNA, 25 bp, Homo sapien
ggctgaggcagccatctttctcttg

SEQ ID NO: 20154 - DNA, 25 bp, Homo sapien
tcggctgtatcacgtggatctgctc

SEQ ID NO: 20155 - DNA, 25 bp, Homo sapien
actaagagggatgcgcaaagcaggc

SEQ ID NO: 20156 - DNA, 25 bp, Homo sapien
cctgccgccactagcactaagaggg

SEQ ID NO: 20157 - DNA, 25 bp, Homo sapien
gtctttctctgtctcggctgaggca

SEQ ID NO: 20158 - DNA, 25 bp, Homo sapien
ggtccgagtgacaagaacgttcacg

SEQ ID NO: 20159 - DNA, 25 bp, Homo sapien
aacgttcacgtatcttcgggagaga

SEQ ID NO: 20160 - DNA, 25 bp, Homo sapien
ttcgggagagaacgaaaaggtgctc

SEQ ID NO: 20161 - DNA, 25 bp, Homo sapien
tgcggctaccgcagctcctacagga

SEQ ID NO: 20162 - DNA, 25 bp, Homo sapien
ccctccggaggaggctttcggctca

SEQ ID NO: 20163 - DNA, 25 bp, Homo sapien
gcacggccgcctttcgggtttgcat

SEQ ID NO: 20164 - DNA, 25 bp, Homo sapien
ggcagatgacgcctgtttgcaaaca

SEQ ID NO: 20165 - DNA, 25 bp, Homo sapien
gccctgcacgtacatcccggaggga

SEQ ID NO: 20166 - DNA, 25 bp, Homo sapien
gctccaatgaggtcgctgcgcccag

SEQ ID NO: 20167 - DNA, 25 bp, Homo sapien
gacaggaactctgggcggttccgcc

SEQ ID NO: 20168 - DNA, 25 bp, Homo sapien
taggtagcgcaggacaggaactctg

SEQ ID NO: 20169 - DNA, 25 bp, Homo sapien
acctcgcggtgaatccgagccaaac

SEQ ID NO: 20170 - DNA, 25 bp, Homo sapien
gacgcggcatacctcgcggtgaatc

SEQ ID NO: 20171 - DNA, 25 bp, Homo sapien
caggtgaaagcgaggccagacactc

SEQ ID NO: 20172 - DNA, 25 bp, Homo sapien
gagtgactccggctcaggtgaaagc

SEQ ID NO: 20173 - DNA, 25 bp, Homo sapien
accggccggctccaatgaggtcgct

SEQ ID NO: 20174 - DNA, 25 bp, Homo sapien
gcggttcacgtaaagccagcgaggc

SEQ ID NO: 20175 - DNA, 25 bp, Homo sapien
ttcacgtaaagccagcgaggccctg

SEQ ID NO: 20176 - DNA, 25 bp, Homo sapien
tcacgtaaagccagcgaggccctgc

SEQ ID NO: 20177 - DNA, 25 bp, Homo sapien
cgtggttatggagctggcggctgca

SEQ ID NO: 20178 - DNA, 25 bp, Homo sapien
cggttcacgtaaagccagcgaggcc

SEQ ID NO: 20179 - DNA, 25 bp, Homo sapien
atcaggtgcctggagcaggcctaga

SEQ ID NO: 20180 - DNA, 25 bp, Homo sapien
ttatcaggtgcctggagcaggccta

SEQ ID NO: 20181 - DNA, 25 bp, Homo sapien
cgctgcgcggttggcccttctcccg

SEQ ID NO: 20182 - DNA, 25 bp, Homo sapien
aagatagacacgtacctgaacgccg

SEQ ID NO: 20183 - DNA, 25 bp, Homo sapien
ccgccttggacctcctgggaggcga

SEQ ID NO: 20184 - DNA, 25 bp, Homo sapien
cctgaagaccatccggaacggcgtt

SEQ ID NO: 20185 - DNA, 25 bp, Homo sapien
aagaccatccggaacggcgttcata

SEQ ID NO: 20186 - DNA, 25 bp, Homo sapien
cggaacggcgttcataagatagaca

SEQ ID NO: 20187 - DNA, 25 bp, Homo sapien
cgttcataagatagacacgtacctg

SEQ ID NO: 20188 - DNA, 25 bp, Homo sapien
accctgaagaccatccggaacggcg

SEQ ID NO: 20189 - DNA, 25 bp, Homo sapien
cggcgttcataagatagacacgtac

SEQ ID NO: 20190 - DNA, 25 bp, Homo sapien
gcagggctccttctacaactacggg

SEQ ID NO: 20191 - DNA, 25 bp, Homo sapien
agcggaagccctttacactacggtg

SEQ ID NO: 20192 - DNA, 25 bp, Homo sapien
catgcagccgccatcattgattcga

SEQ ID NO: 20193 - DNA, 25 bp, Homo sapien
tccgtacacctaagaggggcgcatg

SEQ ID NO: 20194 - DNA, 25 bp, Homo sapien
cactacggtgtttccggcttcaaga

SEQ ID NO: 20195 - DNA, 25 bp, Homo sapien
ggaccaaagcgtgtgtctcactaga

SEQ ID NO: 20196 - DNA, 25 bp, Homo sapien
gggatgcggcacctctaacctgcac

SEQ ID NO: 20197 - DNA, 25 bp, Homo sapien
ggggcgcatgacgtacatccgctaa

SEQ ID NO: 20198 - DNA, 25 bp, Homo sapien
tccaggaaagaaagaagtgtcaggc

SEQ ID NO: 20199 - DNA, 25 bp, Homo sapien
gttagccgcgctgattcgcccgctt

SEQ ID NO: 20200 - DNA, 25 bp, Homo sapien
agagacactcgttagctcgcgagga

SEQ ID NO: 20201 - DNA, 25 bp, Homo sapien
aggtaggaggatcgcgcactcacac

SEQ ID NO: 20202 - DNA, 25 bp, Homo sapien
cacaggcaccgtttacaccggggcg

SEQ ID NO: 20203 - DNA, 25 bp, Homo sapien
cagagcctgtaatggggtcctggcc

SEQ ID NO: 20204 - DNA, 25 bp, Homo sapien
cagtctggttcctagtctctgccga

SEQ ID NO: 20205 - DNA, 25 bp, Homo sapien
ccgggacacgactagctcaggactc

SEQ ID NO: 20206 - DNA, 25 bp, Homo sapien
acctccggaacaagccatggtggcg

SEQ ID NO: 20207 - DNA, 25 bp, Homo sapien
ctacgacttcaaggcggtcaacatc

SEQ ID NO: 20208 - DNA, 25 bp, Homo sapien
tgtcgctggagaagtaccgcggatc

SEQ ID NO: 20209 - DNA, 25 bp, Homo sapien
ttcgctaccggcacctttgggcagc

SEQ ID NO: 20210 - DNA, 25 bp, Homo sapien
ccagcctttgccattcacgggtgaa

SEQ ID NO: 20211 - DNA, 25 bp, Homo sapien
taaccgtagcatcgtgcggcctttc

SEQ ID NO: 20212 - DNA, 25 bp, Homo sapien
tgcctcaggacagacggtgaaactg

SEQ ID NO: 20213 - DNA, 25 bp, Homo sapien
aacatccggggcaaactggtgtcgc

SEQ ID NO: 20214 - DNA, 25 bp, Homo sapien
tgcggcttccgcgaccacaagtact

SEQ ID NO: 20215 - DNA, 25 bp, Homo sapien
ccggctggtgccttgtctgtctgcc

SEQ ID NO: 20216 - DNA, 25 bp, Homo sapien
ggtctcttcgtctctgccgttctca

SEQ ID NO: 20217 - DNA, 25 bp, Homo sapien
gatgagcggcgcctgcacgagctac

SEQ ID NO: 20218 - DNA, 25 bp, Homo sapien
cacgagctacgtgagcgcagagcag

SEQ ID NO: 20219 - DNA, 25 bp, Homo sapien
cgtcgtgctgtcgttgcgcacccag

SEQ ID NO: 20220 - DNA, 25 bp, Homo sapien
gaccacaagtactgctgcgacgacc

SEQ ID NO: 20221 - DNA, 25 bp, Homo sapien
ggccgctgtcttctgctgcggcttc

SEQ ID NO: 20222 - DNA, 25 bp, Homo sapien
gtggagagatctaaaatcaaggcat

SEQ ID NO: 20223 - DNA, 25 bp, Homo sapien
catgacataggggtggctttcccag

SEQ ID NO: 20224 - DNA, 25 bp, Homo sapien
ccttgtaagagaaaagctcaactca

SEQ ID NO: 20225 - DNA, 25 bp, Homo sapien
tgcccaccgggttacctgccctcaa

SEQ ID NO: 20226 - DNA, 25 bp, Homo sapien
tgccctcaagcctccgcccagagaa

SEQ ID NO: 20227 - DNA, 25 bp, Homo sapien
tacccagtgcttctgccctggcgtg

SEQ ID NO: 20228 - DNA, 25 bp, Homo sapien
ccttcagatcgcagccgtcaccaca

SEQ ID NO: 20229 - DNA, 25 bp, Homo sapien
agagcatgacataggggtggctttc

SEQ ID NO: 20230 - DNA, 25 bp, Homo sapien
agctgagcagaccttgccccaagca

SEQ ID NO: 20231 - DNA, 25 bp, Homo sapien
tctgtcacaacctctgcccagcgcg

SEQ ID NO: 20232 - DNA, 25 bp, Homo sapien
tcggtcactcccctctgtcacaacc

SEQ ID NO: 20233 - DNA, 25 bp, Homo sapien
ccggcctcaggtctcggccactccc

SEQ ID NO: 20234 - DNA, 25 bp, Homo sapien
cgacacaggcgagctgagcagacct

SEQ ID NO: 20235 - DNA, 25 bp, Homo sapien
cccgacacaggcgagctgagcagac

SEQ ID NO: 20236 - DNA, 25 bp, Homo sapien
caggtctcggccactcccctctgtc

SEQ ID NO: 20237 - DNA, 25 bp, Homo sapien
ccgacacaggcgagctgagcagacc

SEQ ID NO: 20238 - DNA, 25 bp, Homo sapien
tggaagtccaccatgccggccatgg

SEQ ID NO: 20239 - DNA, 25 bp, Homo sapien
agcctctcagaggtcgcagaccaga

SEQ ID NO: 20240 - DNA, 25 bp, Homo sapien
ccttctcgtggtagcagtggtagtt

SEQ ID NO: 20241 - DNA, 25 bp, Homo sapien
ctggctcggtcttcccgggacacat

SEQ ID NO: 20242 - DNA, 25 bp, Homo sapien
gtagttgcactccacctccatgttc

SEQ ID NO: 20243 - DNA, 25 bp, Homo sapien
tccatgttctccaaaaaggacttga

SEQ ID NO: 20244 - DNA, 25 bp, Homo sapien
aggacttgacctgctcctcatcctg

SEQ ID NO: 20245 - DNA, 25 bp, Homo sapien
cgccggcccaaagacggtcacgtga

SEQ ID NO: 20246 - DNA, 25 bp, Homo sapien
acgctcctagcttgagggaaagagg

SEQ ID NO: 20247 - DNA, 25 bp, Homo sapien
cctcgtctgagtctgcgcattgaga

SEQ ID NO: 20248 - DNA, 25 bp, Homo sapien
tctgagtctgcgcattgagagcgga

SEQ ID NO: 20249 - DNA, 25 bp, Homo sapien
gcggctgctactgctacgctcctag

SEQ ID NO: 20250 - DNA, 25 bp, Homo sapien
ctacgctcctagcttgagggaaaga

SEQ ID NO: 20251 - DNA, 25 bp, Homo sapien
acggaggctgcatgcccgaggacca

SEQ ID NO: 20252 - DNA, 25 bp, Homo sapien
ggagcaaggcctgccctagccgcag

SEQ ID NO: 20253 - DNA, 25 bp, Homo sapien
actgctacgctcctagcttgaggga

SEQ ID NO: 20254 - DNA, 25 bp, Homo sapien
gttcatttcttgcacccgggccaca

SEQ ID NO: 20255 - DNA, 25 bp, Homo sapien
tcgacgccggctctctttttgacgc

SEQ ID NO: 20256 - DNA, 25 bp, Homo sapien
tgagattctttcagttccgcgcgtc

SEQ ID NO: 20257 - DNA, 25 bp, Homo sapien
gggcgagcctcctcaggattcctcg

SEQ ID NO: 20258 - DNA, 25 bp, Homo sapien
ctgctgtgagcttagacgtaggtgc

SEQ ID NO: 20259 - DNA, 25 bp, Homo sapien
gcctcgccgggcatttcaaaagctc

SEQ ID NO: 20260 - DNA, 25 bp, Homo sapien
gacggtgtttttgcagtcatgaacc

SEQ ID NO: 20261 - DNA, 25 bp, Homo sapien
tggccgttaccacctgaggcctttg

SEQ ID NO: 20262 - DNA, 25 bp, Homo sapien
ttgctccacctatgggccaagcgtc

SEQ ID NO: 20263 - DNA, 25 bp, Homo sapien
cagcgaacttttccctggagccaga

SEQ ID NO: 20264 - DNA, 25 bp, Homo sapien
tggagccagaaggacgcaaaggttc

SEQ ID NO: 20265 - DNA, 25 bp, Homo sapien
cgcacttaaacgctcctggcctggg

SEQ ID NO: 20266 - DNA, 25 bp, Homo sapien
gggatcgaatccttcaacgcactga

SEQ ID NO: 20267 - DNA, 25 bp, Homo sapien
ccggaactgcacatttaccttggtc

SEQ ID NO: 20268 - DNA, 25 bp, Homo sapien
tttctgccagtgacccgcgaacttt

SEQ ID NO: 20269 - DNA, 25 bp, Homo sapien
acacgcgatcagaggcgttttctgc

SEQ ID NO: 20270 - DNA, 25 bp, Homo sapien
gaatctctggggtcatagcgtctcg

SEQ ID NO: 20271 - DNA, 25 bp, Homo sapien
tggcttgtactctgcggaatctctg

SEQ ID NO: 20272 - DNA, 25 bp, Homo sapien
tctggtcagagttcatgaagcagcc

SEQ ID NO: 20273 - DNA, 25 bp, Homo sapien
ctttagattctgagcggagtcccga

SEQ ID NO: 20274 - DNA, 25 bp, Homo sapien
gccctcacagagacagctccagatg

SEQ ID NO: 20275 - DNA, 25 bp, Homo sapien
tctgtccctccagtgactgcttggg

SEQ ID NO: 20276 - DNA, 25 bp, Homo sapien
ctgggtttctctgtccctccggtct

SEQ ID NO: 20277 - DNA, 25 bp, Homo sapien
gctccttaatgccaaactgcctttc

SEQ ID NO: 20278 - DNA, 25 bp, Homo sapien
tctatctgtctacgcggctgcttcc

SEQ ID NO: 20279 - DNA, 25 bp, Homo sapien
cactagttgagctaaaggtctcagc

SEQ ID NO: 20280 - DNA, 25 bp, Homo sapien
cctgtcatgagagcctgggcccgaa

SEQ ID NO: 20281 - DNA, 25 bp, Homo sapien
ccgctgcgcacatctggaaagaatc

SEQ ID NO: 20282 - DNA, 25 bp, Homo sapien
gagagcgcccagcttgacttgaatg

SEQ ID NO: 20283 - DNA, 25 bp, Homo sapien
cacaacaaaacttgcgtcgcggaga

SEQ ID NO: 20284 - DNA, 25 bp, Homo sapien
gcgccttcctgcgaatgaggcagaa

SEQ ID NO: 20285 - DNA, 25 bp, Homo sapien
gtctggagtccgtctatctgtctac

SEQ ID NO: 20286 - DNA, 25 bp, Homo sapien
gtccatgtgctgaaggtcaagcgca

SEQ ID NO: 20287 - DNA, 25 bp, Homo sapien
tcagctgcgtgagctgtacctcacc

SEQ ID NO: 20288 - DNA, 25 bp, Homo sapien
ctgcacaaccagatcacaggcattg

SEQ ID NO: 20289 - DNA, 25 bp, Homo sapien
ggtgcacctgtacaacaacgcgctg

SEQ ID NO: 20290 - DNA, 25 bp, Homo sapien
gcctcaagcggttgcacacggtgca

SEQ ID NO: 20291 - DNA, 25 bp, Homo sapien
ctgcacttggagaagaacgccatcc

SEQ ID NO: 20292 - DNA, 25 bp, Homo sapien
caatgagctggctgccttggcacga

SEQ ID NO: 20293 - DNA, 25 bp, Homo sapien
tgggctgcctcgaaatgtccatgtg

SEQ ID NO: 20294 - DNA, 25 bp, Homo sapien
ggcgtccttcataccgttacttcca

SEQ ID NO: 20295 - DNA, 25 bp, Homo sapien
tcagcacatggcgtccttcataccg

SEQ ID NO: 20296 - DNA, 25 bp, Homo sapien
acagagcgagactgccaaggtgccc

SEQ ID NO: 20297 - DNA, 25 bp, Homo sapien
gctcaggaaccaggcaggcagacac

SEQ ID NO: 20298 - DNA, 25 bp, Homo sapien
cacaatgccgaaggggaaatacctg

SEQ ID NO: 20299 - DNA, 25 bp, Homo sapien
cccgcaatgaggaacacaatgccga

SEQ ID NO: 20300 - DNA, 25 bp, Homo sapien
gggtcgtccatctccaggatcttac

SEQ ID NO: 20301 - DNA, 25 bp, Homo sapien
ggatcttacccgcaatgaggaacac

SEQ ID NO: 20302 - DNA, 25 bp, Homo sapien
ctcaggagtcctgacgcagtgtctt

SEQ ID NO: 20303 - DNA, 25 bp, Homo sapien
accaggacagcctgcccaggtgagc

SEQ ID NO: 20304 - DNA, 25 bp, Homo sapien
tcgtgcccaccatgcactaccagga

SEQ ID NO: 20305 - DNA, 25 bp, Homo sapien
cggccagtacctgcagcgcagcatc

SEQ ID NO: 20306 - DNA, 25 bp, Homo sapien
cttgtgtttagactccagaactccc

SEQ ID NO: 20307 - DNA, 25 bp, Homo sapien
gcggccttgtgtttagactccagaa

SEQ ID NO: 20308 - DNA, 25 bp, Homo sapien
cggagaagtgcctcaggagtcctga

SEQ ID NO: 20309 - DNA, 25 bp, Homo sapien
ctgacgcagtgtcttgggcgctaac

SEQ ID NO: 20310 - DNA, 25 bp, Homo sapien
aggaggaccgcactgaattcaaaga

SEQ ID NO: 20311 - DNA, 25 bp, Homo sapien
acactcgcagcgtcgcctctgacga

SEQ ID NO: 20312 - DNA, 25 bp, Homo sapien
gcactgaattcaaagagttccagga

SEQ ID NO: 20313 - DNA, 25 bp, Homo sapien
ccgcactgaattcaaagagttccag

SEQ ID NO: 20314 - DNA, 25 bp, Homo sapien
ggaccgcactgaattcaaagagttc

SEQ ID NO: 20315 - DNA, 25 bp, Homo sapien
aggctttcccggacggtgccgcgat

SEQ ID NO: 20316 - DNA, 25 bp, Homo sapien
cgaggaggaccgcactgaattcaaa

SEQ ID NO: 20317 - DNA, 25 bp, Homo sapien
tgtggggtgagctttaagaaggcgc

SEQ ID NO: 20318 - DNA, 25 bp, Homo sapien
tgccgttgctttccggcgcgtcgta

SEQ ID NO: 20319 - DNA, 25 bp, Homo sapien
ggctttgagttgcagcgcgattttc

SEQ ID NO: 20320 - DNA, 25 bp, Homo sapien
cagagcgactgcgtcagccgtgcct

SEQ ID NO: 20321 - DNA, 25 bp, Homo sapien
gtgccacagggagacactccttctg

SEQ ID NO: 20322 - DNA, 25 bp, Homo sapien
ctggcgcgagctgttgcctcccaga

SEQ ID NO: 20323 - DNA, 25 bp, Homo sapien
taaaaggcgggtgccgtctgcgcac

SEQ ID NO: 20324 - DNA, 25 bp, Homo sapien
gtgatgttctccagcgtggctttga

SEQ ID NO: 20325 - DNA, 25 bp, Homo sapien
cgtctgcgcaccctcagtagggcgg

SEQ ID NO: 20326 - DNA, 25 bp, Homo sapien
ccactaaggggtccccacgaagctg

SEQ ID NO: 20327 - DNA, 25 bp, Homo sapien
gagcacgaggcggatccggaccact

SEQ ID NO: 20328 - DNA, 25 bp, Homo sapien
cacgaggcggatccggaccactaag

SEQ ID NO: 20329 - DNA, 25 bp, Homo sapien
taaggggtccccacgaagctgagca

SEQ ID NO: 20330 - DNA, 25 bp, Homo sapien
ccacgaagctgagcatgaggcggat

SEQ ID NO: 20331 - DNA, 25 bp, Homo sapien
cccacgaagctgagcatgaggcgga

SEQ ID NO: 20332 - DNA, 25 bp, Homo sapien
acgaagctgagcatgaggcggatcc

SEQ ID NO: 20333 - DNA, 25 bp, Homo sapien
cacgaagctgagcatgaggcggatc

SEQ ID NO: 20334 - DNA, 25 bp, Homo sapien
tctgcgcccgacactgacgtttgcg

SEQ ID NO: 20335 - DNA, 25 bp, Homo sapien
ggacctaggtcatctcggcagtaaa

SEQ ID NO: 20336 - DNA, 25 bp, Homo sapien
tgtgtgagtcgtacaccgctcttta

SEQ ID NO: 20337 - DNA, 25 bp, Homo sapien
tgacttcgcttaaagacctcgggcc

SEQ ID NO: 20338 - DNA, 25 bp, Homo sapien
tcgcccggaagtggcaacaagactg

SEQ ID NO: 20339 - DNA, 25 bp, Homo sapien
gacaaccgagcctgaacttccaaga

SEQ ID NO: 20340 - DNA, 25 bp, Homo sapien
ctccaggaactcgtggccgaacttg

SEQ ID NO: 20341 - DNA, 25 bp, Homo sapien
caggctgcttttaccgtccggtcga

SEQ ID NO: 20342 - DNA, 25 bp, Homo sapien
gatttgtctttgcagtcgcggtcgc

SEQ ID NO: 20343 - DNA, 25 bp, Homo sapien
tggtccggctacaggggctccgacc

SEQ ID NO: 20344 - DNA, 25 bp, Homo sapien
gcacgagcggttgccgcactggaac

SEQ ID NO: 20345 - DNA, 25 bp, Homo sapien
tcaaactggcggtcgcagacccagc

SEQ ID NO: 20346 - DNA, 25 bp, Homo sapien
gagcggtcctcgcagtcaaactggc

SEQ ID NO: 20347 - DNA, 25 bp, Homo sapien
atagcggatccgcaatccctgggcg

SEQ ID NO: 20348 - DNA, 25 bp, Homo sapien
cggcctcgtccgatttgtctttgca

SEQ ID NO: 20349 - DNA, 25 bp, Homo sapien
atccggatcggatagcggatccgca

SEQ ID NO: 20350 - DNA, 25 bp, Homo sapien
cggagctgcgtggaactttgaaaca

SEQ ID NO: 20351 - DNA, 25 bp, Homo sapien
tttcgggaagctagacctttgcagg

SEQ ID NO: 20352 - DNA, 25 bp, Homo sapien
tcgtcgcatctccacacagagggga

SEQ ID NO: 20353 - DNA, 25 bp, Homo sapien
tccggcactggaattggtccttttc

SEQ ID NO: 20354 - DNA, 25 bp, Homo sapien
tctgctcagatacagcccataggga

SEQ ID NO: 20355 - DNA, 25 bp, Homo sapien
gggcttcaggcacactccatccaaa

SEQ ID NO: 20356 - DNA, 25 bp, Homo sapien
cgagaccaggcacctacttaaagtg

SEQ ID NO: 20357 - DNA, 25 bp, Homo sapien
tgtggtctaagcagtcatcgtcctc

SEQ ID NO: 20358 - DNA, 25 bp, Homo sapien
gcgatgcccttctccttgttcagca

SEQ ID NO: 20359 - DNA, 25 bp, Homo sapien
tgttcagcacagacaccacggagtc

SEQ ID NO: 20360 - DNA, 25 bp, Homo sapien
tgggcacggcatacctgtagaggtc

SEQ ID NO: 20361 - DNA, 25 bp, Homo sapien
agaggtcctctaccgtgcgctcgaa

SEQ ID NO: 20362 - DNA, 25 bp, Homo sapien
gtgcgctcgaagcaggcgaacttca

SEQ ID NO: 20363 - DNA, 25 bp, Homo sapien
catcatggtgtaggggatctgcctc

SEQ ID NO: 20364 - DNA, 25 bp, Homo sapien
ccagcgagacatcggggaagaactc

SEQ ID NO: 20365 - DNA, 25 bp, Homo sapien
cgaaaaggtacaggccggctctcca

SEQ ID NO: 20366 - DNA, 25 bp, Homo sapien
ggcccactgttcaccgactttggta

SEQ ID NO: 20367 - DNA, 25 bp, Homo sapien
acagaattttcctgccggcacgtta

SEQ ID NO: 20368 - DNA, 25 bp, Homo sapien
tgctacctgatctccgagcgccaga

SEQ ID NO: 20369 - DNA, 25 bp, Homo sapien
tagctgtagtttgtgccattccggc

SEQ ID NO: 20370 - DNA, 25 bp, Homo sapien
cgtccagtcgacttagcagtgcttc

SEQ ID NO: 20371 - DNA, 25 bp, Homo sapien
gaggctcctcctccagaataacaga

SEQ ID NO: 20372 - DNA, 25 bp, Homo sapien
tcccgccatttccttgggctggagg

SEQ ID NO: 20373 - DNA, 25 bp, Homo sapien
caaatgccgctggaagcagtgcctc

SEQ ID NO: 20374 - DNA, 25 bp, Homo sapien
cccacattcctatgcgcagcggagg

SEQ ID NO: 20375 - DNA, 25 bp, Homo sapien
cgcgcaaaccggcacagtgggcaat

SEQ ID NO: 20376 - DNA, 25 bp, Homo sapien
gattgcgcgtctttaacataggtta

SEQ ID NO: 20377 - DNA, 25 bp, Homo sapien
ctagcccaatcagaggtcaaaccca

SEQ ID NO: 20378 - DNA, 25 bp, Homo sapien
gaaaccagcctcctttgcacgaatg

SEQ ID NO: 20379 - DNA, 25 bp, Homo sapien
ggagtcccaagctgggcgctgaatc

SEQ ID NO: 20380 - DNA, 25 bp, Homo sapien
ggcggcaacgaggattcccagagca

SEQ ID NO: 20381 - DNA, 25 bp, Homo sapien
actgccgctggtcagacgctcagca

SEQ ID NO: 20382 - DNA, 25 bp, Homo sapien
cgccaccgcagttcaaaggcaggaa

SEQ ID NO: 20383 - DNA, 25 bp, Homo sapien
gaccctgctgggtctgcctcaaacg

SEQ ID NO: 20384 - DNA, 25 bp, Homo sapien
cgcaaacgcggctgtaactccagga

SEQ ID NO: 20385 - DNA, 25 bp, Homo sapien
gcctcaaacgctgcctgagcgaagc

SEQ ID NO: 20386 - DNA, 25 bp, Homo sapien
ctgcgaggcttcgtctggacaagct

SEQ ID NO: 20387 - DNA, 25 bp, Homo sapien
tggacaagctcaacaggccaggact

SEQ ID NO: 20388 - DNA, 25 bp, Homo sapien
tctggcgaccaaacggtcccttcga

SEQ ID NO: 20389 - DNA, 25 bp, Homo sapien
ctagtctagggcgtacaggagaccg

SEQ ID NO: 20390 - DNA, 25 bp, Homo sapien
cccagttgccggaagccggagatcc

SEQ ID NO: 20391 - DNA, 25 bp, Homo sapien
gtacaggtcccgcaaactcggcagc

SEQ ID NO: 20392 - DNA, 25 bp, Homo sapien
ggcctcagttgctccgcgccggttt

SEQ ID NO: 20393 - DNA, 25 bp, Homo sapien
agctcccagagaaacctgcgtgctg

SEQ ID NO: 20394 - DNA, 25 bp, Homo sapien
agcagctcccagagaaacctgcgtg

SEQ ID NO: 20395 - DNA, 25 bp, Homo sapien
ctgagcctcgagttcttaaagagac

SEQ ID NO: 20396 - DNA, 25 bp, Homo sapien
aggctgagcctcgagttcttaaaga

SEQ ID NO: 20397 - DNA, 25 bp, Homo sapien
gccggtttcggtccagcccagttgc

SEQ ID NO: 20398 - DNA, 25 bp, Homo sapien
tcacctgggactcccgttagctctg

SEQ ID NO: 20399 - DNA, 25 bp, Homo sapien
actcccgttagctctgggcgccgga

SEQ ID NO: 20400 - DNA, 25 bp, Homo sapien
gcgggccaagatgcgaaaccactcc

SEQ ID NO: 20401 - DNA, 25 bp, Homo sapien
gggcccacctctgcgagttccaaac

SEQ ID NO: 20402 - DNA, 25 bp, Homo sapien
tgcgaaaccactcctgtgcgccttt

SEQ ID NO: 20403 - DNA, 25 bp, Homo sapien
gctcccattacttcgcgggccaaga

SEQ ID NO: 20404 - DNA, 25 bp, Homo sapien
accgctgagtttccgggcgcgcgct

SEQ ID NO: 20405 - DNA, 25 bp, Homo sapien
gtcgcgcgcgctccaactctgaaat

SEQ ID NO: 20406 - DNA, 25 bp, Homo sapien
agacgccgtatcacccaagaccgag

SEQ ID NO: 20407 - DNA, 25 bp, Homo sapien
tgacttcttcccttcgcggggcagg

SEQ ID NO: 20408 - DNA, 25 bp, Homo sapien
gggaattcaaccatcgcaagcgtta

SEQ ID NO: 20409 - DNA, 25 bp, Homo sapien
cacctctgggactacgaacttcttc

SEQ ID NO: 20410 - DNA, 25 bp, Homo sapien
ggtcaactgacaggcccggtggcaa

SEQ ID NO: 20411 - DNA, 25 bp, Homo sapien
agaccgagtcaaatgcttcagccga

SEQ ID NO: 20412 - DNA, 25 bp, Homo sapien
cgcccgcatttcttcgcagtgcatt

SEQ ID NO: 20413 - DNA, 25 bp, Homo sapien
ttggtctcggaaaactacagccgcc

SEQ ID NO: 20414 - DNA, 25 bp, Homo sapien
tttgtcttgacgctgtgaacactcg

SEQ ID NO: 20415 - DNA, 25 bp, Homo sapien
actcgaccaagtgctgcgtcttatc

SEQ ID NO: 20416 - DNA, 25 bp, Homo sapien
tgcacccatcactaaccaggaaacg

SEQ ID NO: 20417 - DNA, 25 bp, Homo sapien
acttgtaacagtcacttcccgcggc

SEQ ID NO: 20418 - DNA, 25 bp, Homo sapien
cgtcttatctttgggccgcatcttg

SEQ ID NO: 20419 - DNA, 25 bp, Homo sapien
gcttccactgcagtttacggcgatg

SEQ ID NO: 20420 - DNA, 25 bp, Homo sapien
tacggcgatgacttctgccaacgca

SEQ ID NO: 20421 - DNA, 25 bp, Homo sapien
tgctttcgggctctcacttgtaaca

SEQ ID NO: 20422 - DNA, 25 bp, Homo sapien
atggcgctgtgtccaacgctagccc

SEQ ID NO: 20423 - DNA, 25 bp, Homo sapien
tggtgccacggagccctccttgtgg

SEQ ID NO: 20424 - DNA, 25 bp, Homo sapien
ttgtggtcccacaagatggcgctgt

SEQ ID NO: 20425 - DNA, 25 bp, Homo sapien
caagatggcgctgtgtccaacgcta

SEQ ID NO: 20426 - DNA, 25 bp, Homo sapien
ctttctccaggcatagtcgtactca

SEQ ID NO: 20427 - DNA, 25 bp, Homo sapien
ggcatagtcgtactcacacgcactc

SEQ ID NO: 20428 - DNA, 25 bp, Homo sapien
tccaggcatagtcgtactcacacgc

SEQ ID NO: 20429 - DNA, 25 bp, Homo sapien
gtcccacaagatggcgctgtgtcca

SEQ ID NO: 20430 - DNA, 25 bp, Homo sapien
gaccaggcctgctatatctttcacc

SEQ ID NO: 20431 - DNA, 25 bp, Homo sapien
tcagatcggtatggcattggcgtcc

SEQ ID NO: 20432 - DNA, 25 bp, Homo sapien
caaggacccaaggttctaccgctcg

SEQ ID NO: 20433 - DNA, 25 bp, Homo sapien
ccctggatagggtgtacgagatccc

SEQ ID NO: 20434 - DNA, 25 bp, Homo sapien
ctggagcccatcacctttgcgggga

SEQ ID NO: 20435 - DNA, 25 bp, Homo sapien
cacctttgcggggaagatgcacttc

SEQ ID NO: 20436 - DNA, 25 bp, Homo sapien
gtggaggtcttgaggctatcagatc

SEQ ID NO: 20437 - DNA, 25 bp, Homo sapien
gagcatccgctgtacaaagaccagg

SEQ ID NO: 20438 - DNA, 25 bp, Homo sapien
gtgcgtttacctgactgtggggtcc

SEQ ID NO: 20439 - DNA, 25 bp, Homo sapien
ccggaggaccctgtgaggccagaca

SEQ ID NO: 20440 - DNA, 25 bp, Homo sapien
ccagacagtagaggcaggttataga

SEQ ID NO: 20441 - DNA, 25 bp, Homo sapien
ggcaggttatagatcacagcacatg

SEQ ID NO: 20442 - DNA, 25 bp, Homo sapien
tcacagcacatggagaagcgcagaa

SEQ ID NO: 20443 - DNA, 25 bp, Homo sapien
tggtcgccggctcaacggtgtaaaa

SEQ ID NO: 20444 - DNA, 25 bp, Homo sapien
ctcaacggtgtaaaacggcgagcgg

SEQ ID NO: 20445 - DNA, 25 bp, Homo sapien
cgccacggtgcgtttacctgactgt

SEQ ID NO: 20446 - DNA, 25 bp, Homo sapien
tggcaaaatggaactgtgcctgccc

SEQ ID NO: 20447 - DNA, 25 bp, Homo sapien
tttccagttgtctgatgggcgccgt

SEQ ID NO: 20448 - DNA, 25 bp, Homo sapien
cgcaggcactggcactttccagttg

SEQ ID NO: 20449 - DNA, 25 bp, Homo sapien
atgggcgccgtctgccaaacaagcc

SEQ ID NO: 20450 - DNA, 25 bp, Homo sapien
agcaaacttttcacgcacctggcaa

SEQ ID NO: 20451 - DNA, 25 bp, Homo sapien
ggccacggcgcagcaaacttttcac

SEQ ID NO: 20452 - DNA, 25 bp, Homo sapien
gtgctacagaacagcgcgggccctt

SEQ ID NO: 20453 - DNA, 25 bp, Homo sapien
gacagatggccacgcaggcactggc

SEQ ID NO: 20454 - DNA, 25 bp, Homo sapien
agccgtctaaaagccggcgagcaga

SEQ ID NO: 20455 - DNA, 25 bp, Homo sapien
agcagagaccggcagtgcgcacacg

SEQ ID NO: 20456 - DNA, 25 bp, Homo sapien
ctcaccagcgcggagatcgtggaga

SEQ ID NO: 20457 - DNA, 25 bp, Homo sapien
ctaaaagccggcgagcagagaccgg

SEQ ID NO: 20458 - DNA, 25 bp, Homo sapien
acacaagcgggctccgagtgggatc

SEQ ID NO: 20459 - DNA, 25 bp, Homo sapien
cctccagagagaggagaacattttc

SEQ ID NO: 20460 - DNA, 25 bp, Homo sapien
agaacattttctactggaagccgtc

SEQ ID NO: 20461 - DNA, 25 bp, Homo sapien
tttctactggaagccgtctaaaagc

SEQ ID NO: 20462 - DNA, 25 bp, Homo sapien
tccgccggctcccaacaatgggctc

SEQ ID NO: 20463 - DNA, 25 bp, Homo sapien
tacttggagctcaaccgaacgtggc

SEQ ID NO: 20464 - DNA, 25 bp, Homo sapien
cgccgctggtctacttggagctcaa

SEQ ID NO: 20465 - DNA, 25 bp, Homo sapien
tagggcttacttttcccgagcctgc

SEQ ID NO: 20466 - DNA, 25 bp, Homo sapien
agctcaaccgaacgtggctacccgg

SEQ ID NO: 20467 - DNA, 25 bp, Homo sapien
ccacttgcaaaatagggcttacttt

SEQ ID NO: 20468 - DNA, 25 bp, Homo sapien
cgcggccgccacttgcaaaataggg

SEQ ID NO: 20469 - DNA, 25 bp, Homo sapien
aacgtcccgcgatggatggccgcct

SEQ ID NO: 20470 - DNA, 25 bp, Homo sapien
gtggagccgcgcgaaaatggccctt

SEQ ID NO: 20471 - DNA, 25 bp, Homo sapien
cgaaaatggcccttggcgtgctttg

SEQ ID NO: 20472 - DNA, 25 bp, Homo sapien
ttaagaggagggagagtgatttctc

SEQ ID NO: 20473 - DNA, 25 bp, Homo sapien
tctcccaaatttccaaggtttgcca

SEQ ID NO: 20474 - DNA, 25 bp, Homo sapien
tttgccagtcttggcaagttagccc

SEQ ID NO: 20475 - DNA, 25 bp, Homo sapien
ttctgcacgggaaagggtgccactc

SEQ ID NO: 20476 - DNA, 25 bp, Homo sapien
ctccacgctgagagctgggcggctc

SEQ ID NO: 20477 - DNA, 25 bp, Homo sapien
gcgcggctgctcctttactagatca

SEQ ID NO: 20478 - DNA, 25 bp, Homo sapien
tcccaacatatatgcaataaaatac

SEQ ID NO: 20479 - DNA, 25 bp, Homo sapien
aatatttgaacagccggcctctggg

SEQ ID NO: 20480 - DNA, 25 bp, Homo sapien
ggaaaatatttgaacagccggcctc

SEQ ID NO: 20481 - DNA, 25 bp, Homo sapien
cttgggaaaatatttgaacagccgg

SEQ ID NO: 20482 - DNA, 25 bp, Homo sapien
tatgcaataaaatacaatacatgtg

SEQ ID NO: 20483 - DNA, 25 bp, Homo sapien
ggagaaacatatttatcccaacata

SEQ ID NO: 20484 - DNA, 25 bp, Homo sapien
ccaagagtggagaaacatatttatc

SEQ ID NO: 20485 - DNA, 25 bp, Homo sapien
atacaatacatgtgattaatgaatg

SEQ ID NO: 20486 - DNA, 25 bp, Homo sapien
cttggggccagatgggctgcgcagc

SEQ ID NO: 20487 - DNA, 25 bp, Homo sapien
tgctccctccgagatccgggcccgc

SEQ ID NO: 20488 - DNA, 25 bp, Homo sapien
tcccagcatagtgactccggctgct

SEQ ID NO: 20489 - DNA, 25 bp, Homo sapien
agggttgagtggcttttgccccaca

SEQ ID NO: 20490 - DNA, 25 bp, Homo sapien
atggctaggagaggcgcccgacgcc

SEQ ID NO: 20491 - DNA, 25 bp, Homo sapien
ccggccatggctaggagaggcgccc

SEQ ID NO: 20492 - DNA, 25 bp, Homo sapien
tgagtggcttttgccccacatcctg

SEQ ID NO: 20493 - DNA, 25 bp, Homo sapien
agcatagtgactccggctgctccct

SEQ ID NO: 20494 - DNA, 25 bp, Homo sapien
tcagacatcctagtccgcgcaggca

SEQ ID NO: 20495 - DNA, 25 bp, Homo sapien
ggtcggatcgcgtaaccatagtatc

SEQ ID NO: 20496 - DNA, 25 bp, Homo sapien
atagtatccaaaccgtgtccgcgcg

SEQ ID NO: 20497 - DNA, 25 bp, Homo sapien
cgctacccttcagatcatggctgtg

SEQ ID NO: 20498 - DNA, 25 bp, Homo sapien
atcatgacttcatcggactccgggg

SEQ ID NO: 20499 - DNA, 25 bp, Homo sapien
ccaccttcgctgtttgggtcggatc

SEQ ID NO: 20500 - DNA, 25 bp, Homo sapien
cggccgctattgttgtccaccttcg

SEQ ID NO: 20501 - DNA, 25 bp, Homo sapien
gcggcccttacttcgagatgttttc

SEQ ID NO: 20502 - DNA, 25 bp, Homo sapien
cgtaatgagctgtttccaccagggg

SEQ ID NO: 20503 - DNA, 25 bp, Homo sapien
ctccatcccgtaatgagctgtttcc

SEQ ID NO: 20504 - DNA, 25 bp, Homo sapien
gttctagcacattttctccatcccg

SEQ ID NO: 20505 - DNA, 25 bp, Homo sapien
tgcaaagcgtggctccgcagggcaa

SEQ ID NO: 20506 - DNA, 25 bp, Homo sapien
cgcttgatttattaagctaatgttc

SEQ ID NO: 20507 - DNA, 25 bp, Homo sapien
tgtctgcagagcgactgcggcttcc

SEQ ID NO: 20508 - DNA, 25 bp, Homo sapien
gctccgggagcgcttgatttattaa

SEQ ID NO: 20509 - DNA, 25 bp, Homo sapien
aggcaggcgttctggacctgcaccc

SEQ ID NO: 20510 - DNA, 25 bp, Homo sapien
tggggcccatagtcctcacttctgc

SEQ ID NO: 20511 - DNA, 25 bp, Homo sapien
agagtcgtcgcgcttcactagaccc

SEQ ID NO: 20512 - DNA, 25 bp, Homo sapien
ctcttgggacgattttgtgcgttcc

SEQ ID NO: 20513 - DNA, 25 bp, Homo sapien
ccgcgcttgccggagatagcattga

SEQ ID NO: 20514 - DNA, 25 bp, Homo sapien
cgtgcggaacaacaggacgtcataa

SEQ ID NO: 20515 - DNA, 25 bp, Homo sapien
cggttctggttgctcgagcacacca

SEQ ID NO: 20516 - DNA, 25 bp, Homo sapien
tacctgaggatgttgtgcgcctcca

SEQ ID NO: 20517 - DNA, 25 bp, Homo sapien
ggaggcccacagacattcccgcatt

SEQ ID NO: 20518 - DNA, 25 bp, Homo sapien
attggtctctcactagggttggggc

SEQ ID NO: 20519 - DNA, 25 bp, Homo sapien
ctggtatttacgctgggattggtct

SEQ ID NO: 20520 - DNA, 25 bp, Homo sapien
cgctgctgactcatttgcggacggg

SEQ ID NO: 20521 - DNA, 25 bp, Homo sapien
gctccgcatcgcagaaggcggctca

SEQ ID NO: 20522 - DNA, 25 bp, Homo sapien
gagccgtccaggaactctacagcgc

SEQ ID NO: 20523 - DNA, 25 bp, Homo sapien
gcctcccatcctttgggtaagagcc

SEQ ID NO: 20524 - DNA, 25 bp, Homo sapien
cctcgcacggtcttgcttgcaggct

SEQ ID NO: 20525 - DNA, 25 bp, Homo sapien
ggggcatgaagcaccctggtattta

SEQ ID NO: 20526 - DNA, 25 bp, Homo sapien
gcagggcatcagctatggaacaacc

SEQ ID NO: 20527 - DNA, 25 bp, Homo sapien
gttgagtattgaaaatcggcctcga

SEQ ID NO: 20528 - DNA, 25 bp, Homo sapien
ccgatcgctggtttctagttgagta

SEQ ID NO: 20529 - DNA, 25 bp, Homo sapien
ggatcccacctcagacgacgtcatg

SEQ ID NO: 20530 - DNA, 25 bp, Homo sapien
ccaaaagcattcgaaggccgggcga

SEQ ID NO: 20531 - DNA, 25 bp, Homo sapien
cgacgtcatggactcgttcctggaa

SEQ ID NO: 20532 - DNA, 25 bp, Homo sapien
cagccttaccgtggcggctttcatg

SEQ ID NO: 20533 - DNA, 25 bp, Homo sapien
tggggcacctccttcaatcccagat

SEQ ID NO: 20534 - DNA, 25 bp, Homo sapien
agtgctgccctcattttacaacgga

SEQ ID NO: 20535 - DNA, 25 bp, Homo sapien
gccaaagagcgagtacccggctttc

SEQ ID NO: 20536 - DNA, 25 bp, Homo sapien
ttttccggaagtgtagccaaagagc

SEQ ID NO: 20537 - DNA, 25 bp, Homo sapien
tttcgccaattgcaaagccgcgctc

SEQ ID NO: 20538 - DNA, 25 bp, Homo sapien
gcccgtccctcaggtctgggagtca

SEQ ID NO: 20539 - DNA, 25 bp, Homo sapien
accgcgtgctcgcttcatttcgctg

SEQ ID NO: 20540 - DNA, 25 bp, Homo sapien
cccaactcaaggacgggatgcaagt

SEQ ID NO: 20541 - DNA, 25 bp, Homo sapien
gaccaggagtatcgaaaagtttatg

SEQ ID NO: 20542 - DNA, 25 bp, Homo sapien
ggtctcgaagagcagccgcaccagc

SEQ ID NO: 20543 - DNA, 25 bp, Homo sapien
cctcgcgctccatggtctcgaagag

SEQ ID NO: 20544 - DNA, 25 bp, Homo sapien
atccggacctggtcccatcagctgg

SEQ ID NO: 20545 - DNA, 25 bp, Homo sapien
tcagcctaaggcagggagtccatcc

SEQ ID NO: 20546 - DNA, 25 bp, Homo sapien
aagaatcgaactggctccgctccca

SEQ ID NO: 20547 - DNA, 25 bp, Homo sapien
caaaccgcgcgggtgtcgcaacatc

SEQ ID NO: 20548 - DNA, 25 bp, Homo sapien
gtccagctccactgcgcgcttgaag

SEQ ID NO: 20549 - DNA, 25 bp, Homo sapien
gcgtccacgcccatatagtagtaga

SEQ ID NO: 20550 - DNA, 25 bp, Homo sapien
gtagcctagcgccttgtcgtagagc

SEQ ID NO: 20551 - DNA, 25 bp, Homo sapien
acgtcgaagccatgcgcgtagccct

SEQ ID NO: 20552 - DNA, 25 bp, Homo sapien
gcgcggctcgaagttcaactgcatc

SEQ ID NO: 20553 - DNA, 25 bp, Homo sapien
ctgcatctccaggtgaaagtggccc

SEQ ID NO: 20554 - DNA, 25 bp, Homo sapien
gcgtctagatcgtcggccacagcct

SEQ ID NO: 20555 - DNA, 25 bp, Homo sapien
tcacccttgtccctgaggctgtgga

SEQ ID NO: 20556 - DNA, 25 bp, Homo sapien
taggtgtttccgctttcgctgctca

SEQ ID NO: 20557 - DNA, 25 bp, Homo sapien
ctcctccaggtagaatgcgaaagcg

SEQ ID NO: 20558 - DNA, 25 bp, Homo sapien
gggcccgtttgcgtcctgggctcac

SEQ ID NO: 20559 - DNA, 25 bp, Homo sapien
tcacgcccacggtccaaagcagctg

SEQ ID NO: 20560 - DNA, 25 bp, Homo sapien
cgcatcacaaggcccgggttgccgt

SEQ ID NO: 20561 - DNA, 25 bp, Homo sapien
gcaggcctgccatgagggaaagcca

SEQ ID NO: 20562 - DNA, 25 bp, Homo sapien
tgccatgagggaaagccaggatgcc

SEQ ID NO: 20563 - DNA, 25 bp, Homo sapien
cggagctcatggctggaaccgcgtc

SEQ ID NO: 20564 - DNA, 25 bp, Homo sapien
cacggccaccaagtggttcaccggg

SEQ ID NO: 20565 - DNA, 25 bp, Homo sapien
tcatggctggaaccgcgtcggctcc

SEQ ID NO: 20566 - DNA, 25 bp, Homo sapien
ggagcgctgctgagcttgaacacca

SEQ ID NO: 20567 - DNA, 25 bp, Homo sapien
aggcgcgcacgtagtagtagatatc

SEQ ID NO: 20568 - DNA, 25 bp, Homo sapien
gaggcacacgaacacccagcgctgg

SEQ ID NO: 20569 - DNA, 25 bp, Homo sapien
aggaacccgcagctttcattggctg

SEQ ID NO: 20570 - DNA, 25 bp, Homo sapien
cttaagcggttttgcagtggctttc

SEQ ID NO: 20571 - DNA, 25 bp, Homo sapien
ctgagtcagtcaccctttggccgga

SEQ ID NO: 20572 - DNA, 25 bp, Homo sapien
ggaaacctggcggtaacctctgcag

SEQ ID NO: 20573 - DNA, 25 bp, Homo sapien
tgcttctggatgtcccgcacgcgct

SEQ ID NO: 20574 - DNA, 25 bp, Homo sapien
cgccaaggcgttccggtcagcagca

SEQ ID NO: 20575 - DNA, 25 bp, Homo sapien
gccgctggtagggtcgctcagccct

SEQ ID NO: 20576 - DNA, 25 bp, Homo sapien
ccaggagccagacctcggttttgcg

SEQ ID NO: 20577 - DNA, 25 bp, Homo sapien
cagcccaatcgtgctggcgctttaa

SEQ ID NO: 20578 - DNA, 25 bp, Homo sapien
caaggttccgatccgcgccaaggcg

SEQ ID NO: 20579 - DNA, 25 bp, Homo sapien
cgacagcgctggacacctggagctg

SEQ ID NO: 20580 - DNA, 25 bp, Homo sapien
cccaatcgtgctggcgctttaagga

SEQ ID NO: 20581 - DNA, 25 bp, Homo sapien
agccagacctcggttttgcgggctg

SEQ ID NO: 20582 - DNA, 25 bp, Homo sapien
gagggagaccttggccagcccctgc

SEQ ID NO: 20583 - DNA, 25 bp, Homo sapien
caccggctaggtaacacggcactcg

SEQ ID NO: 20584 - DNA, 25 bp, Homo sapien
ggcaccggctaggtaacacggcact

SEQ ID NO: 20585 - DNA, 25 bp, Homo sapien
ggctgaggtccctctgggcctccgt

SEQ ID NO: 20586 - DNA, 25 bp, Homo sapien
gctgcggagaccgttcccgccaccc

SEQ ID NO: 20587 - DNA, 25 bp, Homo sapien
aagcgccttgctcagcgccgggcgg

SEQ ID NO: 20588 - DNA, 25 bp, Homo sapien
cgcctgtgaaatgcgggcgatgact

SEQ ID NO: 20589 - DNA, 25 bp, Homo sapien
tgccactccgcaggctcggtttcct

SEQ ID NO: 20590 - DNA, 25 bp, Homo sapien
cagataggatcgtccgatggggctc

SEQ ID NO: 20591 - DNA, 25 bp, Homo sapien
gctgcgctattcagtgggaaggttc

SEQ ID NO: 20592 - DNA, 25 bp, Homo sapien
agggctcttcgcttggcacgatctt

SEQ ID NO: 20593 - DNA, 25 bp, Homo sapien
actacgaggagctggtgctagcctt

SEQ ID NO: 20594 - DNA, 25 bp, Homo sapien
tctaggtctcctcgccaggacagca

SEQ ID NO: 20595 - DNA, 25 bp, Homo sapien
ccctagaaggtttccgcagcgacgt

SEQ ID NO: 20596 - DNA, 25 bp, Homo sapien
cgaaacctgatcctccagtccgggg

SEQ ID NO: 20597 - DNA, 25 bp, Homo sapien
ccgccgttcagttcagggtctgagc

SEQ ID NO: 20598 - DNA, 25 bp, Homo sapien
cagtgccacggcctcgttaatgtcg

SEQ ID NO: 20599 - DNA, 25 bp, Homo sapien
cagcgtggtcatgtgctgctcctcc

SEQ ID NO: 20600 - DNA, 25 bp, Homo sapien
tcctcctccgattccatggcttggg

SEQ ID NO: 20601 - DNA, 25 bp, Homo sapien
accgcagtcctgaaggaaatccacc

SEQ ID NO: 20602 - DNA, 25 bp, Homo sapien
ttaatgtcgttcttggccaggcgca

SEQ ID NO: 20603 - DNA, 25 bp, Homo sapien
gaggaaggcttctccatcgtcgcca

SEQ ID NO: 20604 - DNA, 25 bp, Homo sapien
ctgaacgtcgcggaaatcccttggc

SEQ ID NO: 20605 - DNA, 25 bp, Homo sapien
cggcctgaaatgcaccgcagtcctg

SEQ ID NO: 20606 - DNA, 25 bp, Homo sapien
cctcgtcgggctcggtggactggcc

SEQ ID NO: 20607 - DNA, 25 bp, Homo sapien
aaaccgaccaagtgggctgcggcgg

SEQ ID NO: 20608 - DNA, 25 bp, Homo sapien
aggaggaaaccgaccaagtgggctg

SEQ ID NO: 20609 - DNA, 25 bp, Homo sapien
gcaagcttcccatctctgctttctc

SEQ ID NO: 20610 - DNA, 25 bp, Homo sapien
cgccgcggaggaacggccgaggcgc

SEQ ID NO: 20611 - DNA, 25 bp, Homo sapien
gagcgcgcaagcttcccatctctgc

SEQ ID NO: 20612 - DNA, 25 bp, Homo sapien
gcaccaggccaaaactaggaggaaa

SEQ ID NO: 20613 - DNA, 25 bp, Homo sapien
gggcaccaggccaaaactaggagga

SEQ ID NO: 20614 - DNA, 25 bp, Homo sapien
tctccgggacgatcgctttgtcgta

SEQ ID NO: 20615 - DNA, 25 bp, Homo sapien
tcctccgcagctggttccttaatga

SEQ ID NO: 20616 - DNA, 25 bp, Homo sapien
tgcctgcctccaactgcagaaggtg

SEQ ID NO: 20617 - DNA, 25 bp, Homo sapien
cgacttttactgagctggtttaaca

SEQ ID NO: 20618 - DNA, 25 bp, Homo sapien
catttcactcggatggagggcgacc

SEQ ID NO: 20619 - DNA, 25 bp, Homo sapien
gccagatcccgagcagaaacttttg

SEQ ID NO: 20620 - DNA, 25 bp, Homo sapien
actctcggggcgatccatttcactc

SEQ ID NO: 20621 - DNA, 25 bp, Homo sapien
gcttccaacgtggagacgactttta

SEQ ID NO: 20622 - DNA, 25 bp, Homo sapien
gggtgaagatcggacactacgtgct

SEQ ID NO: 20623 - DNA, 25 bp, Homo sapien
cgctgcttcgggttccgccgcagga

SEQ ID NO: 20624 - DNA, 25 bp, Homo sapien
acactacgtgctgggcgacacgctg

SEQ ID NO: 20625 - DNA, 25 bp, Homo sapien
aagtgaagagttgagtacgcgctcc

SEQ ID NO: 20626 - DNA, 25 bp, Homo sapien
ttgagtacgcgctccggaccgctgt

SEQ ID NO: 20627 - DNA, 25 bp, Homo sapien
ccgcaggagcctctcactcccggga

SEQ ID NO: 20628 - DNA, 25 bp, Homo sapien
gcgcgccgaagatggctgagaagca

SEQ ID NO: 20629 - DNA, 25 bp, Homo sapien
atcggacactacgtgctgggcgaca

SEQ ID NO: 20630 - DNA, 25 bp, Homo sapien
gcaggctcgaggtccgatatagcca

SEQ ID NO: 20631 - DNA, 25 bp, Homo sapien
tgaggaaaagggtctggccaccagc

SEQ ID NO: 20632 - DNA, 25 bp, Homo sapien
cgaatctcagcgctacggaggagta

SEQ ID NO: 20633 - DNA, 25 bp, Homo sapien
ttcgagaggtcgaagccgaatctca

SEQ ID NO: 20634 - DNA, 25 bp, Homo sapien
atccagttctcacggtgcccgcgaa

SEQ ID NO: 20635 - DNA, 25 bp, Homo sapien
tccacagaggatccgaagaaaggcc

SEQ ID NO: 20636 - DNA, 25 bp, Homo sapien
cgagcggcagagaacagagtccaca

SEQ ID NO: 20637 - DNA, 25 bp, Homo sapien
tgcatccaagtcagagcgtcgagtc

SEQ ID NO: 20638 - DNA, 25 bp, Homo sapien
ccagtgacctaactgggccggcagg

SEQ ID NO: 20639 - DNA, 25 bp, Homo sapien
ccgccgatcggttcccggctgaggt

SEQ ID NO: 20640 - DNA, 25 bp, Homo sapien
ccgggctccaacctctttgctcagc

SEQ ID NO: 20641 - DNA, 25 bp, Homo sapien
gaggcccgccggtctttctgatttc

SEQ ID NO: 20642 - DNA, 25 bp, Homo sapien
ccggtctttctgatttccgcgggcg

SEQ ID NO: 20643 - DNA, 25 bp, Homo sapien
accgtcctaccctcggcatggctgc

SEQ ID NO: 20644 - DNA, 25 bp, Homo sapien
aggtttgggcgccacagtcaccggc

SEQ ID NO: 20645 - DNA, 25 bp, Homo sapien
agtgcgcggaagacaccgtcctacc

SEQ ID NO: 20646 - DNA, 25 bp, Homo sapien
catccctgctagttctccgtggcct

SEQ ID NO: 20647 - DNA, 25 bp, Homo sapien
agcgtccgctccatccctgctagtt

SEQ ID NO: 20648 - DNA, 25 bp, Homo sapien
cgcctgcttgcaggggcagctccca

SEQ ID NO: 20649 - DNA, 25 bp, Homo sapien
ccctgtcggcaggtatgtggctctc

SEQ ID NO: 20650 - DNA, 25 bp, Homo sapien
ggcgtgttcctcaactccatctaca

SEQ ID NO: 20651 - DNA, 25 bp, Homo sapien
gcggcgtgttcctcaactccatcta

SEQ ID NO: 20652 - DNA, 25 bp, Homo sapien
caggccatccgggtccaagcggacg

SEQ ID NO: 20653 - DNA, 25 bp, Homo sapien
gtatgtggctctcccaggacggccg

SEQ ID NO: 20654 - DNA, 25 bp, Homo sapien
cgtcgacgcggatgaagttgtttcc

SEQ ID NO: 20655 - DNA, 25 bp, Homo sapien
gccagccagagtccagtcgtcgacg

SEQ ID NO: 20656 - DNA, 25 bp, Homo sapien
gggttaaatggctgcgcgtcaactc

SEQ ID NO: 20657 - DNA, 25 bp, Homo sapien
tcagggagcaagagccgcttgtctc

SEQ ID NO: 20658 - DNA, 25 bp, Homo sapien
acccacagtaggcagtgcgggcaca

SEQ ID NO: 20659 - DNA, 25 bp, Homo sapien
gggcgggcgcaacatattctcctac

SEQ ID NO: 20660 - DNA, 25 bp, Homo sapien
gcgggcacagtgttgcagaccacca

SEQ ID NO: 20661 - DNA, 25 bp, Homo sapien
ggaaatgctcaagaccacaggactg

SEQ ID NO: 20662 - DNA, 25 bp, Homo sapien
ggtgacaccgcagacccgacctatg

SEQ ID NO: 20663 - DNA, 25 bp, Homo sapien
ctagcgcctccgtgtggcttaaggc

SEQ ID NO: 20664 - DNA, 25 bp, Homo sapien
actgtggcgctctagcgcctccgtg

SEQ ID NO: 20665 - DNA, 25 bp, Homo sapien
gcagtcaatacagccgcccagagtc

SEQ ID NO: 20666 - DNA, 25 bp, Homo sapien
cgtgaggactgactcaagcagaagc

SEQ ID NO: 20667 - DNA, 25 bp, Homo sapien
aaagcgtcaccgtgaggactgactc

SEQ ID NO: 20668 - DNA, 25 bp, Homo sapien
aatacagccgcccagagtcgttctc

SEQ ID NO: 20669 - DNA, 25 bp, Homo sapien
aagcagaagcgaaagcggtgacacc

SEQ ID NO: 20670 - DNA, 25 bp, Homo sapien
gcgccttgagcagcagacacttgga

SEQ ID NO: 20671 - DNA, 25 bp, Homo sapien
gggagaaccgatactcacctgtagg

SEQ ID NO: 20672 - DNA, 25 bp, Homo sapien
gccgcccgcgataggatcagaacag

SEQ ID NO: 20673 - DNA, 25 bp, Homo sapien
ccactggtatttgggtgacacatcc

SEQ ID NO: 20674 - DNA, 25 bp, Homo sapien
gccttctgagacgtgttctgccgca

SEQ ID NO: 20675 - DNA, 25 bp, Homo sapien
ggtcgtagaggccatcgttgtccac

SEQ ID NO: 20676 - DNA, 25 bp, Homo sapien
ggcggcatcgccgatatccacgtca

SEQ ID NO: 20677 - DNA, 25 bp, Homo sapien
acacggtcatcttgttggtgggaca

SEQ ID NO: 20678 - DNA, 25 bp, Homo sapien
cggctttgaaaagtcgcggtcactc

SEQ ID NO: 20679 - DNA, 25 bp, Homo sapien
gctcgcccaagttcaacaaccggtg

SEQ ID NO: 20680 - DNA, 25 bp, Homo sapien
tttaccgccgtggagaagcctaaga

SEQ ID NO: 20681 - DNA, 25 bp, Homo sapien
gcactcttacttgtcgactcgcgcg

SEQ ID NO: 20682 - DNA, 25 bp, Homo sapien
cttgcaaaagttggctccgggactc

SEQ ID NO: 20683 - DNA, 25 bp, Homo sapien
ctttgcagtcatagaacagtccgtc

SEQ ID NO: 20684 - DNA, 25 bp, Homo sapien
ctcccagccgggaaagttctttgct

SEQ ID NO: 20685 - DNA, 25 bp, Homo sapien
gggcatcgtcatagaaggtcgtttc

SEQ ID NO: 20686 - DNA, 25 bp, Homo sapien
tttggcgatccagcgggcaagcgaa

SEQ ID NO: 20687 - DNA, 25 bp, Homo sapien
aacgcagctgggcagtcgcgccgct

SEQ ID NO: 20688 - DNA, 25 bp, Homo sapien
ggcttctggctgctaaatcaggaga

SEQ ID NO: 20689 - DNA, 25 bp, Homo sapien
agctggaagaggctttggcgatcca

SEQ ID NO: 20690 - DNA, 25 bp, Homo sapien
cggcgaatgagttgacgggtggagc

SEQ ID NO: 20691 - DNA, 25 bp, Homo sapien
tggctgctaaatcaggagagtgagc

SEQ ID NO: 20692 - DNA, 25 bp, Homo sapien
tggggcttctggctgctaaatcagg

SEQ ID NO: 20693 - DNA, 25 bp, Homo sapien
tcgccagcgcgctttctcttcctgg

SEQ ID NO: 20694 - DNA, 25 bp, Homo sapien
tgatgcactcacaacacggccgggc

SEQ ID NO: 20695 - DNA, 25 bp, Homo sapien
cgcgctacagctggaagaaaggtga

SEQ ID NO: 20696 - DNA, 25 bp, Homo sapien
cgatcaaccacacggactgcctggt

SEQ ID NO: 20697 - DNA, 25 bp, Homo sapien
tcgacgacagcgagtactgggtcct

SEQ ID NO: 20698 - DNA, 25 bp, Homo sapien
agaaaggtgaccgtccaggctggcc

SEQ ID NO: 20699 - DNA, 25 bp, Homo sapien
gccactggagtctagcaggcaagga

SEQ ID NO: 20700 - DNA, 25 bp, Homo sapien
cgcctgggcccagaacattcttatc

SEQ ID NO: 20701 - DNA, 25 bp, Homo sapien
gcggcatccacttcgacgacagcga

SEQ ID NO: 20702 - DNA, 25 bp, Homo sapien
tgccctctgtgtaaataaagccaca

SEQ ID NO: 20703 - DNA, 25 bp, Homo sapien
ccgccagcgattcgtccttacaagg

SEQ ID NO: 20704 - DNA, 25 bp, Homo sapien
ccagcgattcgtccttacaaggcta

SEQ ID NO: 20705 - DNA, 25 bp, Homo sapien
ttcgtccttacaaggctagcctcca

SEQ ID NO: 20706 - DNA, 25 bp, Homo sapien
acgggctgccctctgtgtaaataaa

SEQ ID NO: 20707 - DNA, 25 bp, Homo sapien
aaagccacagacttccgcccacagg

SEQ ID NO: 20708 - DNA, 25 bp, Homo sapien
gaactggtgctacggccgctacgca

SEQ ID NO: 20709 - DNA, 25 bp, Homo sapien
tacaaggctagcctccacgggctgc

SEQ ID NO: 20710 - DNA, 25 bp, Homo sapien
ctgccggccgttgtaaactggcgct

SEQ ID NO: 20711 - DNA, 25 bp, Homo sapien
gcgccggtttgcgaagagctttcct

SEQ ID NO: 20712 - DNA, 25 bp, Homo sapien
gctttcctcggacagctactgctga

SEQ ID NO: 20713 - DNA, 25 bp, Homo sapien
tctgagtaatcgcaggcaatcagcg

SEQ ID NO: 20714 - DNA, 25 bp, Homo sapien
ttttgtcgctcagccagccaagtgg

SEQ ID NO: 20715 - DNA, 25 bp, Homo sapien
aatcagcgcggctggggttaaaagc

SEQ ID NO: 20716 - DNA, 25 bp, Homo sapien
gcgcgcggcacttcctgcttttgct

SEQ ID NO: 20717 - DNA, 25 bp, Homo sapien
agctactgctgatttttgtcgctca

SEQ ID NO: 20718 - DNA, 25 bp, Homo sapien
aagcagcaggctttatgcggctgtc

SEQ ID NO: 20719 - DNA, 25 bp, Homo sapien
tctctttggcgttcgcgttccctcg

SEQ ID NO: 20720 - DNA, 25 bp, Homo sapien
tttccgaagagtccggccctgcgca

SEQ ID NO: 20721 - DNA, 25 bp, Homo sapien
aagagtccggccctgcgcaaaggcg

SEQ ID NO: 20722 - DNA, 25 bp, Homo sapien
ggaagccttcccgacagtctgtaga

SEQ ID NO: 20723 - DNA, 25 bp, Homo sapien
gtctgtagatgaaatgaacgcgccc

SEQ ID NO: 20724 - DNA, 25 bp, Homo sapien
ccgggccagtgaaagcagcaggctt

SEQ ID NO: 20725 - DNA, 25 bp, Homo sapien
ggcccgtgatttcagtttccgaaga

SEQ ID NO: 20726 - DNA, 25 bp, Homo sapien
agaggcagaggccacaatcaagaca

SEQ ID NO: 20727 - DNA, 25 bp, Homo sapien
cagttgagaagggaacttgccacgg

SEQ ID NO: 20728 - DNA, 25 bp, Homo sapien
ggcagttgagaagggaacttgccac

SEQ ID NO: 20729 - DNA, 25 bp, Homo sapien
agcagagagggtttcacgcgggcca

SEQ ID NO: 20730 - DNA, 25 bp, Homo sapien
cgacagtcagtcgaggcagcagaga

SEQ ID NO: 20731 - DNA, 25 bp, Homo sapien
caagacacggaaacgacagtcagtc

SEQ ID NO: 20732 - DNA, 25 bp, Homo sapien
ggccacaatcaagacacggaaacga

SEQ ID NO: 20733 - DNA, 25 bp, Homo sapien
gcagaggccacaatcaagacacgga

SEQ ID NO: 20734 - DNA, 25 bp, Homo sapien
gcggtgtcttgcaggccaggacgca

SEQ ID NO: 20735 - DNA, 25 bp, Homo sapien
tggctactatggaagcggctatggt

SEQ ID NO: 20736 - DNA, 25 bp, Homo sapien
tctggcaccttgactctggatccgg

SEQ ID NO: 20737 - DNA, 25 bp, Homo sapien
cgacgccacggtggctactatggaa

SEQ ID NO: 20738 - DNA, 25 bp, Homo sapien
tctggatccgggcatcagggctctg

SEQ ID NO: 20739 - DNA, 25 bp, Homo sapien
cttgactctggatccgggcatcagg

SEQ ID NO: 20740 - DNA, 25 bp, Homo sapien
ggttcttctggcaccttgactctgg

SEQ ID NO: 20741 - DNA, 25 bp, Homo sapien
caccttgactctggatccgggcatc

SEQ ID NO: 20742 - DNA, 25 bp, Homo sapien
ctcttagcgcgcacgcccagaaaga

SEQ ID NO: 20743 - DNA, 25 bp, Homo sapien
tggacaagtactgtaagtgaccctc

SEQ ID NO: 20744 - DNA, 25 bp, Homo sapien
cgcggctacgtgcagaatccgtcta

SEQ ID NO: 20745 - DNA, 25 bp, Homo sapien
cacgcccggttcaaagggccaatca

SEQ ID NO: 20746 - DNA, 25 bp, Homo sapien
agcagacgcagcgtagccgatcttg

SEQ ID NO: 20747 - DNA, 25 bp, Homo sapien
cctgggtaagctccgcaaggtgagt

SEQ ID NO: 20748 - DNA, 25 bp, Homo sapien
cagaaagaggcttctccaacccggc

SEQ ID NO: 20749 - DNA, 25 bp, Homo sapien
gcagaatccgtctagctaaaatgta

SEQ ID NO: 20750 - DNA, 25 bp, Homo sapien
ccctgtgcgacagcctcatgatctg

SEQ ID NO: 20751 - DNA, 25 bp, Homo sapien
tagcaggtcgtggacgccggctcct

SEQ ID NO: 20752 - DNA, 25 bp, Homo sapien
cccttgaccgagagaatgccacctg

SEQ ID NO: 20753 - DNA, 25 bp, Homo sapien
agcctcatgatctgggtgagtgcga

SEQ ID NO: 20754 - DNA, 25 bp, Homo sapien
agctggggctacctgcacagggtcc

SEQ ID NO: 20755 - DNA, 25 bp, Homo sapien
tcacctcgtgcccttgaccgagaga

SEQ ID NO: 20756 - DNA, 25 bp, Homo sapien
agagaatgccacctgcgggtcgacg

SEQ ID NO: 20757 - DNA, 25 bp, Homo sapien
tcgggcctggtaccgagctttcctg

SEQ ID NO: 20758 - DNA, 25 bp, Homo sapien
ctgcgaagatgccaggcgctggatt

SEQ ID NO: 20759 - DNA, 25 bp, Homo sapien
tccgaggatggaccactgcccagag

SEQ ID NO: 20760 - DNA, 25 bp, Homo sapien
tctttgggcgccgtcttttgagaaa

SEQ ID NO: 20761 - DNA, 25 bp, Homo sapien
cttttgagaaagtcagcagcgagca

SEQ ID NO: 20762 - DNA, 25 bp, Homo sapien
acagtgcccagtaggagagtccgag

SEQ ID NO: 20763 - DNA, 25 bp, Homo sapien
agggcagccgccagagagcccatcg

SEQ ID NO: 20764 - DNA, 25 bp, Homo sapien
tgctcttctgcggtccaagcaggcg

SEQ ID NO: 20765 - DNA, 25 bp, Homo sapien
agcagaaaggcgacagtgcccagta

SEQ ID NO: 20766 - DNA, 25 bp, Homo sapien
gggcttaccgctagggcagcgtccc

SEQ ID NO: 20767 - DNA, 25 bp, Homo sapien
tcggccctgattgcccggagagaac

SEQ ID NO: 20768 - DNA, 25 bp, Homo sapien
aatcacagggcccgcatcgcgggcg

SEQ ID NO: 20769 - DNA, 25 bp, Homo sapien
gacactctcagacccggggacggga

SEQ ID NO: 20770 - DNA, 25 bp, Homo sapien
aagctgacactctcagacccgggga

SEQ ID NO: 20771 - DNA, 25 bp, Homo sapien
cgtgcttctccccaggaagctgaca

SEQ ID NO: 20772 - DNA, 25 bp, Homo sapien
ctgttccgccctggtcgctaaggac

SEQ ID NO: 20773 - DNA, 25 bp, Homo sapien
cagaggtgcgcggtccgtgcttctc

SEQ ID NO: 20774 - DNA, 25 bp, Homo sapien
ggtccttgcccgaagcgcattaaaa

SEQ ID NO: 20775 - DNA, 25 bp, Homo sapien
taaaacggcgccctctggtgtcagc

SEQ ID NO: 20776 - DNA, 25 bp, Homo sapien
cgccaccctgttcgcaaactgaaag

SEQ ID NO: 20777 - DNA, 25 bp, Homo sapien
cccgagtttagaaagtgtcttgccg

SEQ ID NO: 20778 - DNA, 25 bp, Homo sapien
agaaagtgtcttgccgctctgcgga

SEQ ID NO: 20779 - DNA, 25 bp, Homo sapien
gctgcgatcagaaagtccggctccc

SEQ ID NO: 20780 - DNA, 25 bp, Homo sapien
agcgagtcccgagatccgagcccgg

SEQ ID NO: 20781 - DNA, 25 bp, Homo sapien
gggtagagttctactcgccaccctg

SEQ ID NO: 20782 - DNA, 25 bp, Homo sapien
tacgcggcgcgatctccaagcgctg

SEQ ID NO: 20783 - DNA, 25 bp, Homo sapien
gcgcttcctccgaggtcgggctacg

SEQ ID NO: 20784 - DNA, 25 bp, Homo sapien
gcagctttaaaaacttctgaaaggc

SEQ ID NO: 20785 - DNA, 25 bp, Homo sapien
ctggttcaaagcctcaaaggataga

SEQ ID NO: 20786 - DNA, 25 bp, Homo sapien
ctcaaaggatagaacttgggccgga

SEQ ID NO: 20787 - DNA, 25 bp, Homo sapien
cgcagagctgaactcccagatttta

SEQ ID NO: 20788 - DNA, 25 bp, Homo sapien
aacccgagatttcgccgcagagctg

SEQ ID NO: 20789 - DNA, 25 bp, Homo sapien
ccgtagacgccgagcagacgcggtc

SEQ ID NO: 20790 - DNA, 25 bp, Homo sapien
ggggtctcgcggaaatactcatgct

SEQ ID NO: 20791 - DNA, 25 bp, Homo sapien
aatactcatgcttgaggccgtcctc

SEQ ID NO: 20792 - DNA, 25 bp, Homo sapien
acgagtcggctaccgtgagaaccct

SEQ ID NO: 20793 - DNA, 25 bp, Homo sapien
gtcgtcgtcaccctgggacgagtcg

SEQ ID NO: 20794 - DNA, 25 bp, Homo sapien
ccttcaggtcgtcgtcaccctggga

SEQ ID NO: 20795 - DNA, 25 bp, Homo sapien
cgaggagttccgagtctcatcgcag

SEQ ID NO: 20796 - DNA, 25 bp, Homo sapien
agccgcagtagccacgcctgtggtc

SEQ ID NO: 20797 - DNA, 25 bp, Homo sapien
gttccgagtctcatcgcagctccag

SEQ ID NO: 20798 - DNA, 25 bp, Homo sapien
cagtccctctcagggcctgcagtgg

SEQ ID NO: 20799 - DNA, 25 bp, Homo sapien
agctctgaaactgggaaagtccgcg

SEQ ID NO: 20800 - DNA, 25 bp, Homo sapien
tggcgatggagagcagaattgaatt

SEQ ID NO: 20801 - DNA, 25 bp, Homo sapien
gcgggtttcagctgccaccacgaaa

SEQ ID NO: 20802 - DNA, 25 bp, Homo sapien
ttcagttgtgttgggcatctgatcc

SEQ ID NO: 20803 - DNA, 25 bp, Homo sapien
aggcgacaaaggtttctcacaggtc

SEQ ID NO: 20804 - DNA, 25 bp, Homo sapien
attaatgtggagaacgaggccgtcc

SEQ ID NO: 20805 - DNA, 25 bp, Homo sapien
aagtaaggatcggttctgccgcgtc

SEQ ID NO: 20806 - DNA, 25 bp, Homo sapien
gggcttttcttcagaacggtgtcca

SEQ ID NO: 20807 - DNA, 25 bp, Homo sapien
acctcgtgcgtggttactatgcaaa

SEQ ID NO: 20808 - DNA, 25 bp, Homo sapien
caaccgcaggcaaaggtactttatc

SEQ ID NO: 20809 - DNA, 25 bp, Homo sapien
gtccagaccggagcttgcgccgaat

SEQ ID NO: 20810 - DNA, 25 bp, Homo sapien
tgcgccaacagaacgattccgagag

SEQ ID NO: 20811 - DNA, 25 bp, Homo sapien
caggggaacttgtactgcgccaaca

SEQ ID NO: 20812 - DNA, 25 bp, Homo sapien
ttatcctcacgttgcccagtaccgg

SEQ ID NO: 20813 - DNA, 25 bp, Homo sapien
tgcgccgaatgtaggggctcctatt

SEQ ID NO: 20814 - DNA, 25 bp, Homo sapien
acggactgcggaacagcagtgtttt

SEQ ID NO: 20815 - DNA, 25 bp, Homo sapien
ttgcagtccatgacacgcagaaatc

SEQ ID NO: 20816 - DNA, 25 bp, Homo sapien
aaatctggctcagcgtttctgctgc

SEQ ID NO: 20817 - DNA, 25 bp, Homo sapien
tgtttattgtttgtcagccttcggg

SEQ ID NO: 20818 - DNA, 25 bp, Homo sapien
cgccctcttattaatgcgttaatta

SEQ ID NO: 20819 - DNA, 25 bp, Homo sapien
tccgactcaactcagagcatggggc

SEQ ID NO: 20820 - DNA, 25 bp, Homo sapien
agcccacgttgtgcagggcgccgaa

SEQ ID NO: 20821 - DNA, 25 bp, Homo sapien
ttggctctcccggagtgaaagtttc

SEQ ID NO: 20822 - DNA, 25 bp, Homo sapien
cagagccctgatgcccggatccaga

SEQ ID NO: 20823 - DNA, 25 bp, Homo sapien
accatagccgcttccatagtagcca

SEQ ID NO: 20824 - DNA, 25 bp, Homo sapien
ccctgatgcccggatccagagtcaa

SEQ ID NO: 20825 - DNA, 25 bp, Homo sapien
ttccatagtagccaccgtggcgtcg

SEQ ID NO: 20826 - DNA, 25 bp, Homo sapien
atgcccggatccagagtcaaggtgc

SEQ ID NO: 20827 - DNA, 25 bp, Homo sapien
ccggatccagagtcaaggtgccaga

SEQ ID NO: 20828 - DNA, 25 bp, Homo sapien
ccagagtcaaggtgccagaagaacc

SEQ ID NO: 20829 - DNA, 25 bp, Homo sapien
tgcgtcctggcctgcaagacaccgc

SEQ ID NO: 20830 - DNA, 25 bp, Homo sapien
cgaggctggcttgcagcccgctgct

SEQ ID NO: 20831 - DNA, 25 bp, Homo sapien
gcaactgctcttcatcaacaacgcg

SEQ ID NO: 20832 - DNA, 25 bp, Homo sapien
cccaggaccgaggagctgcagcaac

SEQ ID NO: 20833 - DNA, 25 bp, Homo sapien
cttgcagcccgctgcttggggcctt

SEQ ID NO: 20834 - DNA, 25 bp, Homo sapien
cgcaacgacgatgcgctgcggcagc

SEQ ID NO: 20835 - DNA, 25 bp, Homo sapien
tgtcgccgagctgcatgctggtcct

SEQ ID NO: 20836 - DNA, 25 bp, Homo sapien
ggagctgcagcaactgctcttcatc

SEQ ID NO: 20837 - DNA, 25 bp, Homo sapien
tgcttggggccttgcgtcagctccc

SEQ ID NO: 20838 - DNA, 25 bp, Homo sapien
ctcgcataggatagaggccagttcc

SEQ ID NO: 20839 - DNA, 25 bp, Homo sapien
cccagggtcctgtagtgactgagac

SEQ ID NO: 20840 - DNA, 25 bp, Homo sapien
tgagacgaaccacaggacaccaacg

SEQ ID NO: 20841 - DNA, 25 bp, Homo sapien
acaccaacgagtctggccgtcacgg

SEQ ID NO: 20842 - DNA, 25 bp, Homo sapien
cgccatcttggagaccgacactttc

SEQ ID NO: 20843 - DNA, 25 bp, Homo sapien
tagaggccagttccgtctcttcgcg

SEQ ID NO: 20844 - DNA, 25 bp, Homo sapien
gtctcttcgcgtgttcttctgcccg

SEQ ID NO: 20845 - DNA, 25 bp, Homo sapien
gttcttaaagggacctcgcatagga

SEQ ID NO: 20846 - DNA, 25 bp, Homo sapien
cccggtaggaattcacctgcacgta

SEQ ID NO: 20847 - DNA, 25 bp, Homo sapien
ggcggagtctttccctccatcggtg

SEQ ID NO: 20848 - DNA, 25 bp, Homo sapien
ctattttgcgcccagatcggtgccc

SEQ ID NO: 20849 - DNA, 25 bp, Homo sapien
ggtggcacggatcctattttgcgcc

SEQ ID NO: 20850 - DNA, 25 bp, Homo sapien
ggcctcgaatctcggcccactggta

SEQ ID NO: 20851 - DNA, 25 bp, Homo sapien
ccaggtaaagcgtgaggtcccggct

SEQ ID NO: 20852 - DNA, 25 bp, Homo sapien
ctgcacgtaaacagccagggcaacc

SEQ ID NO: 20853 - DNA, 25 bp, Homo sapien
tcctccagcgcaccaggtaaagcgt

SEQ ID NO: 20854 - DNA, 25 bp, Homo sapien
cgctcctcagtcgtccaggcggatt

SEQ ID NO: 20855 - DNA, 25 bp, Homo sapien
ctggcccaggtacgtgaggcccgag

SEQ ID NO: 20856 - DNA, 25 bp, Homo sapien
ccaggagcgtgaggtccagggtgcc

SEQ ID NO: 20857 - DNA, 25 bp, Homo sapien
cgccccaagtaaggctggtccagga

SEQ ID NO: 20858 - DNA, 25 bp, Homo sapien
ccaggtaaggctggcccgggtgcat

SEQ ID NO: 20859 - DNA, 25 bp, Homo sapien
attcctttttcgccaggtaaggctg

SEQ ID NO: 20860 - DNA, 25 bp, Homo sapien
gtccaggcggattcctttttcgcca

SEQ ID NO: 20861 - DNA, 25 bp, Homo sapien
caggcggattcctttttcgccaggt

SEQ ID NO: 20862 - DNA, 25 bp, Homo sapien
tcgattccaggtagcagtgggagcc

SEQ ID NO: 20863 - DNA, 25 bp, Homo sapien
agagtcccttaccttggcgagctgc

SEQ ID NO: 20864 - DNA, 25 bp, Homo sapien
caccacctgagtcgcaaggacagca

SEQ ID NO: 20865 - DNA, 25 bp, Homo sapien
cgcagccactgctttaaagggagcc

SEQ ID NO: 20866 - DNA, 25 bp, Homo sapien
gagcccgcggcaaagaacgcccagt

SEQ ID NO: 20867 - DNA, 25 bp, Homo sapien
ttttgcgacaggagagagactaaga

SEQ ID NO: 20868 - DNA, 25 bp, Homo sapien
gcactacggggagacttttgcgaca

SEQ ID NO: 20869 - DNA, 25 bp, Homo sapien
ccgcagcgcctagctcggaaaagct

SEQ ID NO: 20870 - DNA, 25 bp, Homo sapien
ggctcctgcctttcgtgtctctgca

SEQ ID NO: 20871 - DNA, 25 bp, Homo sapien
cggacttcgctttgggccatgacca

SEQ ID NO: 20872 - DNA, 25 bp, Homo sapien
gctcccgcccatctaattggctttg

SEQ ID NO: 20873 - DNA, 25 bp, Homo sapien
gcaatttcaaaggacgccacgttca

SEQ ID NO: 20874 - DNA, 25 bp, Homo sapien
ctcgcgcgcacgaatggttaaaaaa

SEQ ID NO: 20875 - DNA, 25 bp, Homo sapien
ggctctgtgcctgcgttgtttgaaa

SEQ ID NO: 20876 - DNA, 25 bp, Homo sapien
cccacactcattcgggttggacttg

SEQ ID NO: 20877 - DNA, 25 bp, Homo sapien
ttgctattagatgggcttgctgctc

SEQ ID NO: 20878 - DNA, 25 bp, Homo sapien
ataaacctccgcagaagtccaggcc

SEQ ID NO: 20879 - DNA, 25 bp, Homo sapien
taatgttccttagaggcgcgcaacg

SEQ ID NO: 20880 - DNA, 25 bp, Homo sapien
aggaacgagccctgccgtaatgttc

SEQ ID NO: 20881 - DNA, 25 bp, Homo sapien
cacaaagaatttgggaagcggccga

SEQ ID NO: 20882 - DNA, 25 bp, Homo sapien
acctgctgatcttctgggcgaaggc

SEQ ID NO: 20883 - DNA, 25 bp, Homo sapien
cgccgcgcgtttctccttttgttgg

SEQ ID NO: 20884 - DNA, 25 bp, Homo sapien
cccacgccggatatttacctgctga

SEQ ID NO: 20885 - DNA, 25 bp, Homo sapien
cctggcgaggcaagaaaataagata

SEQ ID NO: 20886 - DNA, 25 bp, Homo sapien
ctgctcccgcatcttgcgctcccgc

SEQ ID NO: 20887 - DNA, 25 bp, Homo sapien
gcgtcccgccgagcacagctgccca

SEQ ID NO: 20888 - DNA, 25 bp, Homo sapien
ccagggggcagcagacacgcgtccc

SEQ ID NO: 20889 - DNA, 25 bp, Homo sapien
agcaagtgcccagcaccagggggca

SEQ ID NO: 20890 - DNA, 25 bp, Homo sapien
cgaaaagcaagcaccggaaccaagc

SEQ ID NO: 20891 - DNA, 25 bp, Homo sapien
ccgcctgtgacagcaagtgcccagc

SEQ ID NO: 20892 - DNA, 25 bp, Homo sapien
ggaaccaagcgcccgcctgtgacag

SEQ ID NO: 20893 - DNA, 25 bp, Homo sapien
gaaaagcaagcaccggaaccaagcg

SEQ ID NO: 20894 - DNA, 25 bp, Homo sapien
cacctaagctggtcgagcaaactca

SEQ ID NO: 20895 - DNA, 25 bp, Homo sapien
tcatgatgcagagcttcggcgctta

SEQ ID NO: 20896 - DNA, 25 bp, Homo sapien
cggccgtcgttcagcatcgagaaca

SEQ ID NO: 20897 - DNA, 25 bp, Homo sapien
tagcgtgccactctccggacagttt

SEQ ID NO: 20898 - DNA, 25 bp, Homo sapien
ggacagtttctgcagcccgcagcct

SEQ ID NO: 20899 - DNA, 25 bp, Homo sapien
ctcaagccaaatggccggcgcaata

SEQ ID NO: 20900 - DNA, 25 bp, Homo sapien
ccgccggggatagctttccatacag

SEQ ID NO: 20901 - DNA, 25 bp, Homo sapien
ggcggcctcgagcaacaaatgcacc

SEQ ID NO: 20902 - DNA, 25 bp, Homo sapien
tgtccagaggcatccgaaagccagg

SEQ ID NO: 20903 - DNA, 25 bp, Homo sapien
gctgctcagaggcttttgttgctcc

SEQ ID NO: 20904 - DNA, 25 bp, Homo sapien
ctcccaataaatcgatcggcggtga

SEQ ID NO: 20905 - DNA, 25 bp, Homo sapien
gccaacttgcctggacgtaacaaga

SEQ ID NO: 20906 - DNA, 25 bp, Homo sapien
cgcgaatggaatggcgctaaaaata

SEQ ID NO: 20907 - DNA, 25 bp, Homo sapien
agaattcgatgtccgagcgacctcc

SEQ ID NO: 20908 - DNA, 25 bp, Homo sapien
gcccaagctgcgatgtggagaattc

SEQ ID NO: 20909 - DNA, 25 bp, Homo sapien
ggaggacaagccgaacccttcagga

SEQ ID NO: 20910 - DNA, 25 bp, Homo sapien
gcggctcccaactaggcggcctaaa

SEQ ID NO: 20911 - DNA, 25 bp, Homo sapien
caatctgtgtgtctcaatgcctgta

SEQ ID NO: 20912 - DNA, 25 bp, Homo sapien
ggcgtctcaggatagtgtcaccacc

SEQ ID NO: 20913 - DNA, 25 bp, Homo sapien
ccgtgtgcaacctcgggatcattta

SEQ ID NO: 20914 - DNA, 25 bp, Homo sapien
cccaagcagagcaaaggaggttcct

SEQ ID NO: 20915 - DNA, 25 bp, Homo sapien
tttggagactacttcgagaccggtg

SEQ ID NO: 20916 - DNA, 25 bp, Homo sapien
cggcggaatcgaaattaggctcatt

SEQ ID NO: 20917 - DNA, 25 bp, Homo sapien
tgattcaccgcgtcaagagcactga

SEQ ID NO: 20918 - DNA, 25 bp, Homo sapien
acccaggtgtgaaaggcacccgccg

SEQ ID NO: 20919 - DNA, 25 bp, Homo sapien
ggactccgcgtttgccatgctcctt

SEQ ID NO: 20920 - DNA, 25 bp, Homo sapien
aaccacagtgctgtcgtgtcgggga

SEQ ID NO: 20921 - DNA, 25 bp, Homo sapien
cggctactcagttgcccgctcatgg

SEQ ID NO: 20922 - DNA, 25 bp, Homo sapien
ggaggctcgcgacggaaaataaatc

SEQ ID NO: 20923 - DNA, 25 bp, Homo sapien
taccacggtttaattaagccacagc

SEQ ID NO: 20924 - DNA, 25 bp, Homo sapien
taagccacagccctagcacgaggac

SEQ ID NO: 20925 - DNA, 25 bp, Homo sapien
ttccttcttgcctcgtgatgtggga

SEQ ID NO: 20926 - DNA, 25 bp, Homo sapien
taagagcatgggatcccggaggttc

SEQ ID NO: 20927 - DNA, 25 bp, Homo sapien
gacctctcgggttccatcggctctt

SEQ ID NO: 20928 - DNA, 25 bp, Homo sapien
gcccttcctgcagggtcgcttgtgg

SEQ ID NO: 20929 - DNA, 25 bp, Homo sapien
ggcacccttgtccttgcggttctga

SEQ ID NO: 20930 - DNA, 25 bp, Homo sapien
atacacgcccgggatagctgcactc

SEQ ID NO: 20931 - DNA, 25 bp, Homo sapien
tccactgcggtggaaggacctttca

SEQ ID NO: 20932 - DNA, 25 bp, Homo sapien
cgggcttggcatttgtcgagatgca

SEQ ID NO: 20933 - DNA, 25 bp, Homo sapien
tcgagatgcaccgtcagggcaaagg

SEQ ID NO: 20934 - DNA, 25 bp, Homo sapien
aggtgttccagagcagcgccaacta

SEQ ID NO: 20935 - DNA, 25 bp, Homo sapien
cctctgctattctcggctaggactg

SEQ ID NO: 20936 - DNA, 25 bp, Homo sapien
tgcagccttggaagatacgattacg

SEQ ID NO: 20937 - DNA, 25 bp, Homo sapien
gcgtctgacatttgccctaaccttg

SEQ ID NO: 20938 - DNA, 25 bp, Homo sapien
cgcggagaacttcatccagagtatc

SEQ ID NO: 20939 - DNA, 25 bp, Homo sapien
tcgtgacagttaagacccaggcgta

SEQ ID NO: 20940 - DNA, 25 bp, Homo sapien
cgccaccatggtgaagatcgtgaca

SEQ ID NO: 20941 - DNA, 25 bp, Homo sapien
ccggttctacatgaaggaggccatc

SEQ ID NO: 20942 - DNA, 25 bp, Homo sapien
cagccggtgttcaggcaagtctatc

SEQ ID NO: 20943 - DNA, 25 bp, Homo sapien
gcgctgttctcggagtccgacccag

SEQ ID NO: 20944 - DNA, 25 bp, Homo sapien
ccagggactcgttcctcggtgcgca

SEQ ID NO: 20945 - DNA, 25 bp, Homo sapien
ctgctgcccaaggtaagaggcgccc

SEQ ID NO: 20946 - DNA, 25 bp, Homo sapien
ccgcctcagcgagaggaggaatgca

SEQ ID NO: 20947 - DNA, 25 bp, Homo sapien
gcaggttagagggacaaagagcttt

SEQ ID NO: 20948 - DNA, 25 bp, Homo sapien
gcgacccggacagcctgggactgac

SEQ ID NO: 20949 - DNA, 25 bp, Homo sapien
gcgcagcagcgattgtcagcgctga

SEQ ID NO: 20950 - DNA, 25 bp, Homo sapien
gggtctccgtctccagccacgggaa

SEQ ID NO: 20951 - DNA, 25 bp, Homo sapien
ccgcctctcttgctggttccataaa

SEQ ID NO: 20952 - DNA, 25 bp, Homo sapien
ctggttccataaatcaccgcagccg

SEQ ID NO: 20953 - DNA, 25 bp, Homo sapien
tctttctttcagttgtgtgggtttg

SEQ ID NO: 20954 - DNA, 25 bp, Homo sapien
gaagccgacttctccatcctggacg

SEQ ID NO: 20955 - DNA, 25 bp, Homo sapien
ctgctcgctgcgctgggactcgcag

SEQ ID NO: 20956 - DNA, 25 bp, Homo sapien
cggagcagagcctgcaacagaggaa

SEQ ID NO: 20957 - DNA, 25 bp, Homo sapien
ccatcctggacgaggcgcaagtgct

SEQ ID NO: 20958 - DNA, 25 bp, Homo sapien
gccttggcctgcattttattttcaa

SEQ ID NO: 20959 - DNA, 25 bp, Homo sapien
gcctgccttggcctgcattttattt

SEQ ID NO: 20960 - DNA, 25 bp, Homo sapien
ccttcaactcctcttgccctgcaaa

SEQ ID NO: 20961 - DNA, 25 bp, Homo sapien
gaggcagctctttgttccccggcct

SEQ ID NO: 20962 - DNA, 25 bp, Homo sapien
ggcccgcgaggcagctctttgttcc

SEQ ID NO: 20963 - DNA, 25 bp, Homo sapien
tgggcacaccctatgccgccgttcc

SEQ ID NO: 20964 - DNA, 25 bp, Homo sapien
ggcctgcattttattttcaaccaag

SEQ ID NO: 20965 - DNA, 25 bp, Homo sapien
tccacatcccttccacttctacctg

SEQ ID NO: 20966 - DNA, 25 bp, Homo sapien
cccaggacagcaactgccaggtact

SEQ ID NO: 20967 - DNA, 25 bp, Homo sapien
gaagccaccgcgaaggggccgcatc

SEQ ID NO: 20968 - DNA, 25 bp, Homo sapien
agagaacgaccctgggcgttcgcga

SEQ ID NO: 20969 - DNA, 25 bp, Homo sapien
actgccaggtactgggacggtgata

SEQ ID NO: 20970 - DNA, 25 bp, Homo sapien
ttcccgcgaggtggttctcgggctc

SEQ ID NO: 20971 - DNA, 25 bp, Homo sapien
tgggaagaccgagttcgcgcccgca

SEQ ID NO: 20972 - DNA, 25 bp, Homo sapien
ggagctgagcaaccgcaggaaaatc

SEQ ID NO: 20973 - DNA, 25 bp, Homo sapien
caggaaaatcctggtgaaaaacctg

SEQ ID NO: 20974 - DNA, 25 bp, Homo sapien
ctcggggtggtataaacaggatgtc

SEQ ID NO: 20975 - DNA, 25 bp, Homo sapien
attgccaggattcgcccgtagattg

SEQ ID NO: 20976 - DNA, 25 bp, Homo sapien
aactcatctaggacgcgaggtcatc

SEQ ID NO: 20977 - DNA, 25 bp, Homo sapien
gttcaccgcgtcctctagattctag

SEQ ID NO: 20978 - DNA, 25 bp, Homo sapien
gtttatgaaaacttgccgtgcgcgc

SEQ ID NO: 20979 - DNA, 25 bp, Homo sapien
gtcaagttcgcggtacaaggagcta

SEQ ID NO: 20980 - DNA, 25 bp, Homo sapien
cgaggtcatctatcgcggggagtaa

SEQ ID NO: 20981 - DNA, 25 bp, Homo sapien
cggtgacactcaccacttccgtgtg

SEQ ID NO: 20982 - DNA, 25 bp, Homo sapien
attcttaccgtggaacagccgcgtg

SEQ ID NO: 20983 - DNA, 25 bp, Homo sapien
gctccaggtttcagcgcaggcttcc

SEQ ID NO: 20984 - DNA, 25 bp, Homo sapien
ttaagaaaagcattggcaccgcagc

SEQ ID NO: 20985 - DNA, 25 bp, Homo sapien
aagcgatgctttcttggcccgggct

SEQ ID NO: 20986 - DNA, 25 bp, Homo sapien
cacgatcgatgtggccagtctgcgc

SEQ ID NO: 20987 - DNA, 25 bp, Homo sapien
ctcttaccgaaagcgcgagcccgga

SEQ ID NO: 20988 - DNA, 25 bp, Homo sapien
gtcaccatccgaaagtgcgagcctg

SEQ ID NO: 20989 - DNA, 25 bp, Homo sapien
cggcgtgagacaacctagctttttt

SEQ ID NO: 20990 - DNA, 25 bp, Homo sapien
acctctggcccagaactcaagacga

SEQ ID NO: 20991 - DNA, 25 bp, Homo sapien
ggcgctcgccagaagtatcctcact

SEQ ID NO: 20992 - DNA, 25 bp, Homo sapien
tcgccagaagtatcctcacttcctg

SEQ ID NO: 20993 - DNA, 25 bp, Homo sapien
tgtgttgacgcctaatgatgatata

SEQ ID NO: 20994 - DNA, 25 bp, Homo sapien
gccgagcagagcgacgccgactttt

SEQ ID NO: 20995 - DNA, 25 bp, Homo sapien
ccagaactcaagacgacaggggctc

SEQ ID NO: 20996 - DNA, 25 bp, Homo sapien
aactcaagacgacaggggctcgctc

SEQ ID NO: 20997 - DNA, 25 bp, Homo sapien
cacttcctgtgttgacgcctaatga

SEQ ID NO: 20998 - DNA, 25 bp, Homo sapien
tcccgccggatccttcatgtaaaca

SEQ ID NO: 20999 - DNA, 25 bp, Homo sapien
agctaaaaatgccactgacggaccc

SEQ ID NO: 21000 - DNA, 25 bp, Homo sapien
caaaaccgcggaaatgcccatgggc

SEQ ID NO: 21001 - DNA, 25 bp, Homo sapien
agcgagtgcgcaacatttacacaca

SEQ ID NO: 21002 - DNA, 25 bp, Homo sapien
ggacggcaagggacccacgccagca

SEQ ID NO: 21003 - DNA, 25 bp, Homo sapien
ggctctatttacagtcgccgccgga

SEQ ID NO: 21004 - DNA, 25 bp, Homo sapien
tgtaaacaacatccaggctctattt

SEQ ID NO: 21005 - DNA, 25 bp, Homo sapien
cgtggcagggtgcaagctaaaaatg

SEQ ID NO: 21006 - DNA, 25 bp, Homo sapien
agaggccggctgttcaaatattttc

SEQ ID NO: 21007 - DNA, 25 bp, Homo sapien
gataaatatgtttctccactcttgg

SEQ ID NO: 21008 - DNA, 25 bp, Homo sapien
cccagaggccggctgttcaaatatt

SEQ ID NO: 21009 - DNA, 25 bp, Homo sapien
tatgttgggataaatatgtttctcc

SEQ ID NO: 21010 - DNA, 25 bp, Homo sapien
ggccggctgttcaaatattttccca

SEQ ID NO: 21011 - DNA, 25 bp, Homo sapien
tgtattttattgcatatatgttggg

SEQ ID NO: 21012 - DNA, 25 bp, Homo sapien
ccggctgttcaaatattttcccaag

SEQ ID NO: 21013 - DNA, 25 bp, Homo sapien
ttacattcattaatcacatgtattg

SEQ ID NO: 21014 - DNA, 25 bp, Homo sapien
ttgccatgagcagggacataataga

SEQ ID NO: 21015 - DNA, 25 bp, Homo sapien
accctctgattgtggcggtcgcccg

SEQ ID NO: 21016 - DNA, 25 bp, Homo sapien
gctgtaccgttgtgggctacgttca

SEQ ID NO: 21017 - DNA, 25 bp, Homo sapien
agaagtcccactattgccatgagca

SEQ ID NO: 21018 - DNA, 25 bp, Homo sapien
cataatagagtttaaaggccgccgt

SEQ ID NO: 21019 - DNA, 25 bp, Homo sapien
cagtttgcttcgacgccgttgttta

SEQ ID NO: 21020 - DNA, 25 bp, Homo sapien
gacgccgttgtttatgacaaccgcg

SEQ ID NO: 21021 - DNA, 25 bp, Homo sapien
ggctacgttcagagaagtcccacta

SEQ ID NO: 21022 - DNA, 25 bp, Homo sapien
caggctcgtacgtgccggggcgcat

SEQ ID NO: 21023 - DNA, 25 bp, Homo sapien
tcagtccgcctgctactcggtcccg

SEQ ID NO: 21024 - DNA, 25 bp, Homo sapien
agcgtggcgctcagtccgcctgcta

SEQ ID NO: 21025 - DNA, 25 bp, Homo sapien
acggcgcgcttcagcagctttgcgt

SEQ ID NO: 21026 - DNA, 25 bp, Homo sapien
tggctttgagtcacccccgcttgtg

SEQ ID NO: 21027 - DNA, 25 bp, Homo sapien
agaccacacgttgcccacgtgcgag

SEQ ID NO: 21028 - DNA, 25 bp, Homo sapien
ggacgagacgcagaccacacgttgc

SEQ ID NO: 21029 - DNA, 25 bp, Homo sapien
ggctcccggatcacggcgcccttcc

SEQ ID NO: 21030 - DNA, 25 bp, Homo sapien
aatggcttccaaactcctgcgcgcg

SEQ ID NO: 21031 - DNA, 25 bp, Homo sapien
gcaccgtgtgccagaggatcgccca

SEQ ID NO: 21032 - DNA, 25 bp, Homo sapien
gtgccagaggatcgcccagaacttt

SEQ ID NO: 21033 - DNA, 25 bp, Homo sapien
cagaggatcgcccagaactttggtc

SEQ ID NO: 21034 - DNA, 25 bp, Homo sapien
aactttggtctccagcatctctcca

SEQ ID NO: 21035 - DNA, 25 bp, Homo sapien
gcgggagaacatcaaggccagcacc

SEQ ID NO: 21036 - DNA, 25 bp, Homo sapien
tcctcgcgaaggcaatggcttccaa

SEQ ID NO: 21037 - DNA, 25 bp, Homo sapien
agcggccacttcttgcgggagaaca

SEQ ID NO: 21038 - DNA, 25 bp, Homo sapien
gctcgttgctttggctctggacaca

SEQ ID NO: 21039 - DNA, 25 bp, Homo sapien
cctggatgcctaggcgacgcccgaa

SEQ ID NO: 21040 - DNA, 25 bp, Homo sapien
gcgcaccgatgggcgccactgagaa

SEQ ID NO: 21041 - DNA, 25 bp, Homo sapien
ccagaagagccggaagctgttttcc

SEQ ID NO: 21042 - DNA, 25 bp, Homo sapien
ggaagctgttttccttgcggcggcc

SEQ ID NO: 21043 - DNA, 25 bp, Homo sapien
tcgggacctgttaccctgaggcagg

SEQ ID NO: 21044 - DNA, 25 bp, Homo sapien
cctgttaccctgaggcaggggcgca

SEQ ID NO: 21045 - DNA, 25 bp, Homo sapien
gctgatgtcggcacagtctcctttc

SEQ ID NO: 21046 - DNA, 25 bp, Homo sapien
agctaagttctttgggtgagacgtg

SEQ ID NO: 21047 - DNA, 25 bp, Homo sapien
gtgagacgtgcaacaacgcaggccc

SEQ ID NO: 21048 - DNA, 25 bp, Homo sapien
ctgcttccggaacgctaattttagg

SEQ ID NO: 21049 - DNA, 25 bp, Homo sapien
tcttttcacccgctttccgtgcgag

SEQ ID NO: 21050 - DNA, 25 bp, Homo sapien
tgcgcagcagtctgcgcttcgagtg

SEQ ID NO: 21051 - DNA, 25 bp, Homo sapien
cttcgagtgcgctgtgttttaagga

SEQ ID NO: 21052 - DNA, 25 bp, Homo sapien
acgcagcccgttgggcaggtttcgc

SEQ ID NO: 21053 - DNA, 25 bp, Homo sapien
gagcccttccttcctattgcgctgg

SEQ ID NO: 21054 - DNA, 25 bp, Homo sapien
ccatggacagctcaggtagcgctgc

SEQ ID NO: 21055 - DNA, 25 bp, Homo sapien
gacgcggcgacacctataggattgc

SEQ ID NO: 21056 - DNA, 25 bp, Homo sapien
cctataggattgcttccgggcactc

SEQ ID NO: 21057 - DNA, 25 bp, Homo sapien
ctctttgcgtcatgtcgggcactta

SEQ ID NO: 21058 - DNA, 25 bp, Homo sapien
tctcccttttcgcttcccaggttga

SEQ ID NO: 21059 - DNA, 25 bp, Homo sapien
taccggaaaaagaccagcaacgatg

SEQ ID NO: 21060 - DNA, 25 bp, Homo sapien
tctttgcagctggtggacagtaacg

SEQ ID NO: 21061 - DNA, 25 bp, Homo sapien
aacgatggttatgaatctttgcagc

SEQ ID NO: 21062 - DNA, 25 bp, Homo sapien
acatggcgggcgttaaaggtacatc

SEQ ID NO: 21063 - DNA, 25 bp, Homo sapien
cgtttgcgagctaaggtcggagttc

SEQ ID NO: 21064 - DNA, 25 bp, Homo sapien
tctgaactatcaggcgcggcctctg

SEQ ID NO: 21065 - DNA, 25 bp, Homo sapien
ggaggcgatcgaccgctcccttcgt

SEQ ID NO: 21066 - DNA, 25 bp, Homo sapien
ctccgttccggtcaagcctggggct

SEQ ID NO: 21067 - DNA, 25 bp, Homo sapien
tagcgaggccgggtctgaactatca

SEQ ID NO: 21068 - DNA, 25 bp, Homo sapien
ctaggggaggagctctgcattgtct

SEQ ID NO: 21069 - DNA, 25 bp, Homo sapien
ttctagactggcaggagcggagttc

SEQ ID NO: 21070 - DNA, 25 bp, Homo sapien
ggtactgccagggaactcgcggcac

SEQ ID NO: 21071 - DNA, 25 bp, Homo sapien
ggaagatctggacacacggctgaca

SEQ ID NO: 21072 - DNA, 25 bp, Homo sapien
ccggggcagcttagcgggaccacca

SEQ ID NO: 21073 - DNA, 25 bp, Homo sapien
taactcgagaatggggctttgggac

SEQ ID NO: 21074 - DNA, 25 bp, Homo sapien
tcccgctctgggtaactcgagaatg

SEQ ID NO: 21075 - DNA, 25 bp, Homo sapien
caccgcgtgcttgctgagttcgcct

SEQ ID NO: 21076 - DNA, 25 bp, Homo sapien
gagcgaacctgctcgggaccaccga

SEQ ID NO: 21077 - DNA, 25 bp, Homo sapien
cgccatctctgccttcggtcgagtt

SEQ ID NO: 21078 - DNA, 25 bp, Homo sapien
agaccaagtggcaccggcgagctgt

SEQ ID NO: 21079 - DNA, 25 bp, Homo sapien
cgtccgtgcgatacggtcacattgt

SEQ ID NO: 21080 - DNA, 25 bp, Homo sapien
cgcagcgcggcagaccaagtggcac

SEQ ID NO: 21081 - DNA, 25 bp, Homo sapien
accggcgagctgtctctcttccggg

SEQ ID NO: 21082 - DNA, 25 bp, Homo sapien
tttaaagggccagaggacgagagaa

SEQ ID NO: 21083 - DNA, 25 bp, Homo sapien
gcctgtgtctccctggcgcgggttc

SEQ ID NO: 21084 - DNA, 25 bp, Homo sapien
tcactcgcagcgcatggtctacccg

SEQ ID NO: 21085 - DNA, 25 bp, Homo sapien
gcgatacggtcacattgttattccc

SEQ ID NO: 21086 - DNA, 25 bp, Homo sapien
tttcctacagagactgcagttggca

SEQ ID NO: 21087 - DNA, 25 bp, Homo sapien
ccagtcggttgcgagaaaagctccc

SEQ ID NO: 21088 - DNA, 25 bp, Homo sapien
cgcgtcgcggagaaacgtgtcattt

SEQ ID NO: 21089 - DNA, 25 bp, Homo sapien
aagcgaggccgctcccgtgtgcgct

SEQ ID NO: 21090 - DNA, 25 bp, Homo sapien
actcgaactcggtcgtcgaagggcg

SEQ ID NO: 21091 - DNA, 25 bp, Homo sapien
gtcccgtctgtagcccggacggcga

SEQ ID NO: 21092 - DNA, 25 bp, Homo sapien
gcacagctgtctttggtcgggctca

SEQ ID NO: 21093 - DNA, 25 bp, Homo sapien
cgtgtcatttaggagaaagtttgtt

SEQ ID NO: 21094 - DNA, 25 bp, Homo sapien
tgggctccaaagtcaagagctcacg

SEQ ID NO: 21095 - DNA, 25 bp, Homo sapien
gcgtccgcccattcctcactgctgt

SEQ ID NO: 21096 - DNA, 25 bp, Homo sapien
aattcggttctgagcgtcgccggac

SEQ ID NO: 21097 - DNA, 25 bp, Homo sapien
tccgggaggatctgtccgcggaaat

SEQ ID NO: 21098 - DNA, 25 bp, Homo sapien
cctcaaagccgcggggtccaaagag

SEQ ID NO: 21099 - DNA, 25 bp, Homo sapien
gcaaacacaaagagccgcgcggcca

SEQ ID NO: 21100 - DNA, 25 bp, Homo sapien
tctgtccgcggaaattcggttctga

SEQ ID NO: 21101 - DNA, 25 bp, Homo sapien
caagagctcacgttccgggaggatc

SEQ ID NO: 21102 - DNA, 25 bp, Homo sapien
tggggattcctcacgggagcccgcc

SEQ ID NO: 21103 - DNA, 25 bp, Homo sapien
ccggctcttggggattcctcacggg

SEQ ID NO: 21104 - DNA, 25 bp, Homo sapien
cggctcttggggattcctcacggga

SEQ ID NO: 21105 - DNA, 25 bp, Homo sapien
gctcttggggattcctcacgggagc

SEQ ID NO: 21106 - DNA, 25 bp, Homo sapien
cttggggattcctcacgggagcccg

SEQ ID NO: 21107 - DNA, 25 bp, Homo sapien
gattcctcacgggagcccgccgcct

SEQ ID NO: 21108 - DNA, 25 bp, Homo sapien
tgcctggccacaagctgctccgccg

SEQ ID NO: 21109 - DNA, 25 bp, Homo sapien
tcttggggattcctcacgggagccc

SEQ ID NO: 21110 - DNA, 25 bp, Homo sapien
gaagccacagccacgaacgatttta

SEQ ID NO: 21111 - DNA, 25 bp, Homo sapien
agtctgactcgatgaccgtggtctc

SEQ ID NO: 21112 - DNA, 25 bp, Homo sapien
ggttttcaccgaggacgacatgctg

SEQ ID NO: 21113 - DNA, 25 bp, Homo sapien
agctcttccagtgctggggttttca

SEQ ID NO: 21114 - DNA, 25 bp, Homo sapien
tttcggcttctcttcggagccagga

SEQ ID NO: 21115 - DNA, 25 bp, Homo sapien
acttcggtgaccaaacagagagccc

SEQ ID NO: 21116 - DNA, 25 bp, Homo sapien
gccgccgtcgctcttggcaaaaaca

SEQ ID NO: 21117 - DNA, 25 bp, Homo sapien
tggtgacggtcagtacgttctcatc

SEQ ID NO: 21118 - DNA, 25 bp, Homo sapien
gctctgtttgaggtcaccctggaga

SEQ ID NO: 21119 - DNA, 25 bp, Homo sapien
tttgaggtcaccctggagaccggcc

SEQ ID NO: 21120 - DNA, 25 bp, Homo sapien
tcaccctggagaccggcctcagagt

SEQ ID NO: 21121 - DNA, 25 bp, Homo sapien
cctcagagtccagggagagtgcgcg

SEQ ID NO: 21122 - DNA, 25 bp, Homo sapien
ccgccggctgaatgaagcctgggac

SEQ ID NO: 21123 - DNA, 25 bp, Homo sapien
ccgagggctctgtttgaggtcaccc

SEQ ID NO: 21124 - DNA, 25 bp, Homo sapien
tgcaggtagggtcgcctctctctgc

SEQ ID NO: 21125 - DNA, 25 bp, Homo sapien
ctccctgctgcaggtagggtcgcct

SEQ ID NO: 21126 - DNA, 25 bp, Homo sapien
tccggaatgtttgccgggcgtcatg

SEQ ID NO: 21127 - DNA, 25 bp, Homo sapien
aatccgctgcggagtgagttcgcct

SEQ ID NO: 21128 - DNA, 25 bp, Homo sapien
agcgccgcctttttgccttcgcggt

SEQ ID NO: 21129 - DNA, 25 bp, Homo sapien
attccagtttgggatgaggggctcc

SEQ ID NO: 21130 - DNA, 25 bp, Homo sapien
agcggctgtaagtgcagcctccaca

SEQ ID NO: 21131 - DNA, 25 bp, Homo sapien
ctccggacgacgactggaagaagga

SEQ ID NO: 21132 - DNA, 25 bp, Homo sapien
gttcgcttcggtccctgatcccagt

SEQ ID NO: 21133 - DNA, 25 bp, Homo sapien
tggagccctggctcaacaagcggcc

SEQ ID NO: 21134 - DNA, 25 bp, Homo sapien
ttgctgagtctcacatccgggttct

SEQ ID NO: 21135 - DNA, 25 bp, Homo sapien
tctcacatccgggttctggccgtga

SEQ ID NO: 21136 - DNA, 25 bp, Homo sapien
gttgtccggaacaggccattctctg

SEQ ID NO: 21137 - DNA, 25 bp, Homo sapien
ggagcttcgcctggaacttagttgg

SEQ ID NO: 21138 - DNA, 25 bp, Homo sapien
ttttcccttcctaaccgagatgctg

SEQ ID NO: 21139 - DNA, 25 bp, Homo sapien
taaccgagatgctgttgcgcccttc

SEQ ID NO: 21140 - DNA, 25 bp, Homo sapien
atcagctggagccagcgaagcgccc

SEQ ID NO: 21141 - DNA, 25 bp, Homo sapien
gtgacccggcagtacggcaaatatg

SEQ ID NO: 21142 - DNA, 25 bp, Homo sapien
gcctcggccctacctgtaattggtg

SEQ ID NO: 21143 - DNA, 25 bp, Homo sapien
gccaggggaactacatcgagacacc

SEQ ID NO: 21144 - DNA, 25 bp, Homo sapien
ccctggagactttgctcgggcattg

SEQ ID NO: 21145 - DNA, 25 bp, Homo sapien
gtctatgaacttccgccatggctgc

SEQ ID NO: 21146 - DNA, 25 bp, Homo sapien
cccgagcatgctgacgtctatgaac

SEQ ID NO: 21147 - DNA, 25 bp, Homo sapien
gggcttctcctttaacccgagcatg

SEQ ID NO: 21148 - DNA, 25 bp, Homo sapien
ctcatctcggagtgtggaggatttc

SEQ ID NO: 21149 - DNA, 25 bp, Homo sapien
accacgatcaggaaggagctcacgc

SEQ ID NO: 21150 - DNA, 25 bp, Homo sapien
tcccaccctcatgcaaattttgatt

SEQ ID NO: 21151 - DNA, 25 bp, Homo sapien
cgccgcggtcccacacttgcctgac

SEQ ID NO: 21152 - DNA, 25 bp, Homo sapien
cccgctggagaacgtcccaccgact

SEQ ID NO: 21153 - DNA, 25 bp, Homo sapien
tcttccaacccttccgcaccctgaa

SEQ ID NO: 21154 - DNA, 25 bp, Homo sapien
tgaaacaaacctcatctcctttcct

SEQ ID NO: 21155 - DNA, 25 bp, Homo sapien
agtcccttagcaacgcgtcctcggt

SEQ ID NO: 21156 - DNA, 25 bp, Homo sapien
ttagcaacgcgtcctcggtccgtag

SEQ ID NO: 21157 - DNA, 25 bp, Homo sapien
gcaacgcgtcctcggtccgtagaaa

SEQ ID NO: 21158 - DNA, 25 bp, Homo sapien
aactgagaagcgagtcctctccgcc

SEQ ID NO: 21159 - DNA, 25 bp, Homo sapien
gattccgtgtctcgcgtctcccgag

SEQ ID NO: 21160 - DNA, 25 bp, Homo sapien
ctgcgtgcccgggattccgtgtctc

SEQ ID NO: 21161 - DNA, 25 bp, Homo sapien
aggatcccggaccagcggggtgtct

SEQ ID NO: 21162 - DNA, 25 bp, Homo sapien
acacgtggtgagtgaccagtgactc

SEQ ID NO: 21163 - DNA, 25 bp, Homo sapien
gcccgatcctcactcgccgccagct

SEQ ID NO: 21164 - DNA, 25 bp, Homo sapien
cgcttccagagctgaactgagaagc

SEQ ID NO: 21165 - DNA, 25 bp, Homo sapien
cgcccgctggcaggcgacacgtggt

SEQ ID NO: 21166 - DNA, 25 bp, Homo sapien
aaccgtgacggcgtaactgactcgc

SEQ ID NO: 21167 - DNA, 25 bp, Homo sapien
actgactcgcgaaagtgctctttgg

SEQ ID NO: 21168 - DNA, 25 bp, Homo sapien
ttgaacttggggctaccacgctcct

SEQ ID NO: 21169 - DNA, 25 bp, Homo sapien
caccttcgcaggaccggacttttgt

SEQ ID NO: 21170 - DNA, 25 bp, Homo sapien
ggtatgtaggccagagtcatttctc

SEQ ID NO: 21171 - DNA, 25 bp, Homo sapien
gtcatttctcctgaggcgactctcc

SEQ ID NO: 21172 - DNA, 25 bp, Homo sapien
gactctccgcgtcgggactacaatt

SEQ ID NO: 21173 - DNA, 25 bp, Homo sapien
tctggccacccttaaactctctagg

SEQ ID NO: 21174 - DNA, 25 bp, Homo sapien
cccgataacgtggtgttgtgcctgc

SEQ ID NO: 21175 - DNA, 25 bp, Homo sapien
ctgtcgcttttctgcctgtctcgga

SEQ ID NO: 21176 - DNA, 25 bp, Homo sapien
ggccaagctgctcaacgtgtaagtg

SEQ ID NO: 21177 - DNA, 25 bp, Homo sapien
cctgagtcagcgcacgatcactgtc

SEQ ID NO: 21178 - DNA, 25 bp, Homo sapien
ccctggaggaagtgctcagcaaagc

SEQ ID NO: 21179 - DNA, 25 bp, Homo sapien
ccttgcccgcgtgtaggatggataa

SEQ ID NO: 21180 - DNA, 25 bp, Homo sapien
gcactctcgggacttctcacgggac

SEQ ID NO: 21181 - DNA, 25 bp, Homo sapien
gggcgacctgcagtttgcaatatga

SEQ ID NO: 21182 - DNA, 25 bp, Homo sapien
cggggtgcgtcatatgggctctccc

SEQ ID NO: 21183 - DNA, 25 bp, Homo sapien
tgcgacccgctatttccctgctaga

SEQ ID NO: 21184 - DNA, 25 bp, Homo sapien
cagcgcccagcggattccaaggctg

SEQ ID NO: 21185 - DNA, 25 bp, Homo sapien
agcggattccaaggctgcgctcccg

SEQ ID NO: 21186 - DNA, 25 bp, Homo sapien
gcgcgccgtttctgcctctgggtct

SEQ ID NO: 21187 - DNA, 25 bp, Homo sapien
cgccgggactcggtctctaagggct

SEQ ID NO: 21188 - DNA, 25 bp, Homo sapien
ctcggtctctaagggctcctggaga

SEQ ID NO: 21189 - DNA, 25 bp, Homo sapien
acaagccacggctgggaacactggg

SEQ ID NO: 21190 - DNA, 25 bp, Homo sapien
ccacttgtgcagcagcgtacttttc

SEQ ID NO: 21191 - DNA, 25 bp, Homo sapien
tgccgactaccacgacgcggtaatc

SEQ ID NO: 21192 - DNA, 25 bp, Homo sapien
cagcagcttctgttccttggagcca

SEQ ID NO: 21193 - DNA, 25 bp, Homo sapien
catgacggaagttgccgctcgccca

SEQ ID NO: 21194 - DNA, 25 bp, Homo sapien
ctggcgttacccatcgttgggattc

SEQ ID NO: 21195 - DNA, 25 bp, Homo sapien
ccagcaactggcagtaggtattttc

SEQ ID NO: 21196 - DNA, 25 bp, Homo sapien
attttcaatggtcggcaggtactca

SEQ ID NO: 21197 - DNA, 25 bp, Homo sapien
ccactcttgctgtcggtgatgtgca

SEQ ID NO: 21198 - DNA, 25 bp, Homo sapien
ttttatattccgacttgcgcacagg

SEQ ID NO: 21199 - DNA, 25 bp, Homo sapien
gacaaatgcgctgctcggagagact

SEQ ID NO: 21200 - DNA, 25 bp, Homo sapien
gagctcactcctccgcggttttata

SEQ ID NO: 21201 - DNA, 25 bp, Homo sapien
ggcacgaaccaagcagcctagaaga

SEQ ID NO: 21202 - DNA, 25 bp, Homo sapien
gggtaacaggcatagattccgcttg

SEQ ID NO: 21203 - DNA, 25 bp, Homo sapien
tccgcttgcgcaatacgtggtaaga

SEQ ID NO: 21204 - DNA, 25 bp, Homo sapien
acgtggtaagaaaccagctgtgagg

SEQ ID NO: 21205 - DNA, 25 bp, Homo sapien
ctcggagagactgccgcggcaacca

SEQ ID NO: 21206 - DNA, 25 bp, Homo sapien
tgcattgaaagctgcgcaccaccgc

SEQ ID NO: 21207 - DNA, 25 bp, Homo sapien
catcgggtccgccagcggctaggaa

SEQ ID NO: 21208 - DNA, 25 bp, Homo sapien
gctaggaagcccgattgtgtcgttc

SEQ ID NO: 21209 - DNA, 25 bp, Homo sapien
ccttttccaaatgcgcctgcgtctg

SEQ ID NO: 21210 - DNA, 25 bp, Homo sapien
acatctccgagctccgtctggcttc

SEQ ID NO: 21211 - DNA, 25 bp, Homo sapien
gtctggcttctttctcccttgcctg

SEQ ID NO: 21212 - DNA, 25 bp, Homo sapien
ttctttctcccttgcctgtgagcgc

SEQ ID NO: 21213 - DNA, 25 bp, Homo sapien
cctggcggcggatgcattgaaagct

SEQ ID NO: 21214 - DNA, 25 bp, Homo sapien
catttaaggtgatgaaaccctcgtc

SEQ ID NO: 21215 - DNA, 25 bp, Homo sapien
acccactataaatctgtacacacta

SEQ ID NO: 21216 - DNA, 25 bp, Homo sapien
acacactataaatctgtacactata

SEQ ID NO: 21217 - DNA, 25 bp, Homo sapien
acactataaatctatagttcacacg

SEQ ID NO: 21218 - DNA, 25 bp, Homo sapien
tggttcaaaaccatttaaggtgatg

SEQ ID NO: 21219 - DNA, 25 bp, Homo sapien
agcgcagcatggctcccttttcggt

SEQ ID NO: 21220 - DNA, 25 bp, Homo sapien
ccctccagagaagtcttaatgagga

SEQ ID NO: 21221 - DNA, 25 bp, Homo sapien
gggaatacagcttcattggttcaaa

SEQ ID NO: 21222 - DNA, 25 bp, Homo sapien
agtcgattacgttgccctcccggag

SEQ ID NO: 21223 - DNA, 25 bp, Homo sapien
ggggcgagcaatcaactttgtaacc

SEQ ID NO: 21224 - DNA, 25 bp, Homo sapien
cccgactcttctgttgttcctaata

SEQ ID NO: 21225 - DNA, 25 bp, Homo sapien
gggacattcacagtcaccggctctc

SEQ ID NO: 21226 - DNA, 25 bp, Homo sapien
cgccaaaagaggacggggacattca

SEQ ID NO: 21227 - DNA, 25 bp, Homo sapien
cacccggaagcctgtttgactcaga

SEQ ID NO: 21228 - DNA, 25 bp, Homo sapien
gcgcccgctgcaaagttggcattga

SEQ ID NO: 21229 - DNA, 25 bp, Homo sapien
gcgatccgtcgccatgcttaagatt

SEQ ID NO: 21230 - DNA, 25 bp, Homo sapien
ctgcgaacggtcgaggtaaaactgc

SEQ ID NO: 21231 - DNA, 25 bp, Homo sapien
aagggttgcatacccgctacttctc

SEQ ID NO: 21232 - DNA, 25 bp, Homo sapien
ggtgagcggccaaatcggaatattc

SEQ ID NO: 21233 - DNA, 25 bp, Homo sapien
gggactcatccctccgaccgaggta

SEQ ID NO: 21234 - DNA, 25 bp, Homo sapien
cggtcccgtctatccgagctgtctt

SEQ ID NO: 21235 - DNA, 25 bp, Homo sapien
gaggcacaccctgactctccatagg

SEQ ID NO: 21236 - DNA, 25 bp, Homo sapien
ccgccgccgatttgaatagcataga

SEQ ID NO: 21237 - DNA, 25 bp, Homo sapien
cttcctttcggacctgaggcccaga

SEQ ID NO: 21238 - DNA, 25 bp, Homo sapien
caggactgggatttttcttctcata

SEQ ID NO: 21239 - DNA, 25 bp, Homo sapien
taacgtggcaccttcctggattccc

SEQ ID NO: 21240 - DNA, 25 bp, Homo sapien
actggcatcatggtctaacgtggca

SEQ ID NO: 21241 - DNA, 25 bp, Homo sapien
cgtccacctgaagggcactggcatc

SEQ ID NO: 21242 - DNA, 25 bp, Homo sapien
cgtcccgttctcgaaaagcagccta

SEQ ID NO: 21243 - DNA, 25 bp, Homo sapien
cggtgagacacagccaagagccatg

SEQ ID NO: 21244 - DNA, 25 bp, Homo sapien
gctagcgtttcaatcctgtgcagga

SEQ ID NO: 21245 - DNA, 25 bp, Homo sapien
ctccgcccaggatttattgtctgtg

SEQ ID NO: 21246 - DNA, 25 bp, Homo sapien
tgaagccagtcaaggcggccctcga

SEQ ID NO: 21247 - DNA, 25 bp, Homo sapien
cacctgctagtgaagccagtcaagg

SEQ ID NO: 21248 - DNA, 25 bp, Homo sapien
gctcgcacctgctagtgaagccagt

SEQ ID NO: 21249 - DNA, 25 bp, Homo sapien
gggtactacttcaaccacatcacta

SEQ ID NO: 21250 - DNA, 25 bp, Homo sapien
ctcaggccgagggtactacttcaac

SEQ ID NO: 21251 - DNA, 25 bp, Homo sapien
cgacctggcggcaggaaatcacccg

SEQ ID NO: 21252 - DNA, 25 bp, Homo sapien
gctgggaaaagcgcatgagccgccc

SEQ ID NO: 21253 - DNA, 25 bp, Homo sapien
ggccctcgacctggcggcaggaaat

SEQ ID NO: 21254 - DNA, 25 bp, Homo sapien
ctcctttcgtgagcgcgcgctctgg

SEQ ID NO: 21255 - DNA, 25 bp, Homo sapien
gcttcaggcgcgacatgttcaaagt

SEQ ID NO: 21256 - DNA, 25 bp, Homo sapien
tcaaagtcctaggtccagaagctgc

SEQ ID NO: 21257 - DNA, 25 bp, Homo sapien
ggcgcagtccagatgtcgtcagcac

SEQ ID NO: 21258 - DNA, 25 bp, Homo sapien
cagatgtcgtcagcaccagcgcctg

SEQ ID NO: 21259 - DNA, 25 bp, Homo sapien
agagaagccttttccgttgccggtg

SEQ ID NO: 21260 - DNA, 25 bp, Homo sapien
cgctatccgcttcaggcgcgacatg

SEQ ID NO: 21261 - DNA, 25 bp, Homo sapien
gggccttcactctctgcggcgcagt

SEQ ID NO: 21262 - DNA, 25 bp, Homo sapien
gagcgtctctctccgcagtggcaga

SEQ ID NO: 21263 - DNA, 25 bp, Homo sapien
ttcgcgaattttccggtcgcgcagg

SEQ ID NO: 21264 - DNA, 25 bp, Homo sapien
atccgttgcgtttcaggaaccttcg

SEQ ID NO: 21265 - DNA, 25 bp, Homo sapien
cggcttccggaaacgatccgttgcg

SEQ ID NO: 21266 - DNA, 25 bp, Homo sapien
cgcgttcctcttaccgtcggaattg

SEQ ID NO: 21267 - DNA, 25 bp, Homo sapien
ttccaggcgacttaaaaggagtgcg

SEQ ID NO: 21268 - DNA, 25 bp, Homo sapien
cgtgttcgttctaaattccaggcga

SEQ ID NO: 21269 - DNA, 25 bp, Homo sapien
tcgctagcaccggtctgacgactga

SEQ ID NO: 21270 - DNA, 25 bp, Homo sapien
ggcggcaccgaggtaatccaggtga

SEQ ID NO: 21271 - DNA, 25 bp, Homo sapien
caggtgactaatgtctccccgagcg

SEQ ID NO: 21272 - DNA, 25 bp, Homo sapien
caagatcgacgaactgcgcctcttc

SEQ ID NO: 21273 - DNA, 25 bp, Homo sapien
ctcttcccgccggagtgagtatcgt

SEQ ID NO: 21274 - DNA, 25 bp, Homo sapien
ccggagtgagtatcgtccaccatca

SEQ ID NO: 21275 - DNA, 25 bp, Homo sapien
gtgagtatcgtccaccatcactgtt

SEQ ID NO: 21276 - DNA, 25 bp, Homo sapien
gtatcgtccaccatcactgttcctg

SEQ ID NO: 21277 - DNA, 25 bp, Homo sapien
accatcactgttcctgctaacgccg

SEQ ID NO: 21278 - DNA, 25 bp, Homo sapien
ttcccagaatcactaggcgccggcg

SEQ ID NO: 21279 - DNA, 25 bp, Homo sapien
ccacagcctccgttggatatgttcg

SEQ ID NO: 21280 - DNA, 25 bp, Homo sapien
gccgtcgctgccttacaccgaaaaa

SEQ ID NO: 21281 - DNA, 25 bp, Homo sapien
gtgcccacgacaccaggatctcagt

SEQ ID NO: 21282 - DNA, 25 bp, Homo sapien
gaagctagaactcaggtgcccacga

SEQ ID NO: 21283 - DNA, 25 bp, Homo sapien
ggacaaacgcatctcccggggaaga

SEQ ID NO: 21284 - DNA, 25 bp, Homo sapien
gcccttgccaatcctgcttctggta

SEQ ID NO: 21285 - DNA, 25 bp, Homo sapien
cctcccgcagaggaatgcagaatga

SEQ ID NO: 21286 - DNA, 25 bp, Homo sapien
gtcggctctacctgcgtgctttagc

SEQ ID NO: 21287 - DNA, 25 bp, Homo sapien
ccaacaatcgctgtgtgccgcttta

SEQ ID NO: 21288 - DNA, 25 bp, Homo sapien
tcgtgagactgcagacccgctaata

SEQ ID NO: 21289 - DNA, 25 bp, Homo sapien
tcgcggtgacgtttcaggcaacgcc

SEQ ID NO: 21290 - DNA, 25 bp, Homo sapien
gggactccagcttcactccgctttg

SEQ ID NO: 21291 - DNA, 25 bp, Homo sapien
cccgcagggactaacaccacttgga

SEQ ID NO: 21292 - DNA, 25 bp, Homo sapien
ggacacccggcttcgactggttata

SEQ ID NO: 21293 - DNA, 25 bp, Homo sapien
ctcaggacgggtactcaggaatttc

SEQ ID NO: 21294 - DNA, 25 bp, Homo sapien
atggccagtgcgttgcccacgaaac

SEQ ID NO: 21295 - DNA, 25 bp, Homo sapien
ctccttcatgttggcttcgaggtga

SEQ ID NO: 21296 - DNA, 25 bp, Homo sapien
cacgcgtcttcatgtggctcgcata

SEQ ID NO: 21297 - DNA, 25 bp, Homo sapien
cgaggagagcccgaaaacagtcatg

SEQ ID NO: 21298 - DNA, 25 bp, Homo sapien
cgatgtgctcccaacgctgcttgga

SEQ ID NO: 21299 - DNA, 25 bp, Homo sapien
cccagttatgcgaagagctagtccc

SEQ ID NO: 21300 - DNA, 25 bp, Homo sapien
ggaaggacttcttgcgcttgctctc

SEQ ID NO: 21301 - DNA, 25 bp, Homo sapien
ctgcttggacaggtacacgacgatg

SEQ ID NO: 21302 - DNA, 25 bp, Homo sapien
gacggacctcggaaagcttccacta

SEQ ID NO: 21303 - DNA, 25 bp, Homo sapien
cggaaattcttggtcgacatcttga

SEQ ID NO: 21304 - DNA, 25 bp, Homo sapien
cgtcccaattcaggacccttcttga

SEQ ID NO: 21305 - DNA, 25 bp, Homo sapien
tttttgtcagggcaaatccagtccc

SEQ ID NO: 21306 - DNA, 25 bp, Homo sapien
cccgtcactgactcggaaattcttg

SEQ ID NO: 21307 - DNA, 25 bp, Homo sapien
ccgcagctatgtcttcacaggagga

SEQ ID NO: 21308 - DNA, 25 bp, Homo sapien
ctcaacccgtcttaaggcacagaaa

SEQ ID NO: 21309 - DNA, 25 bp, Homo sapien
gactttcggcaactcggggctgtcc

SEQ ID NO: 21310 - DNA, 25 bp, Homo sapien
cgccggcgactgtgagttgtttttt

SEQ ID NO: 21311 - DNA, 25 bp, Homo sapien
gccaagcggccgtttccttagcaac

SEQ ID NO: 21312 - DNA, 25 bp, Homo sapien
ctgtcgtaagcgctagagggattct

SEQ ID NO: 21313 - DNA, 25 bp, Homo sapien
ctcgaggcaccgtaagtttgaagtc

SEQ ID NO: 21314 - DNA, 25 bp, Homo sapien
tttcttctaatcttgcctgggtggc

SEQ ID NO: 21315 - DNA, 25 bp, Homo sapien
gcgctgcttttttgcggggacacga

SEQ ID NO: 21316 - DNA, 25 bp, Homo sapien
gcccaggcggtccagttatgtaaga

SEQ ID NO: 21317 - DNA, 25 bp, Homo sapien
ccggtgcgttttacctctcgaggca

SEQ ID NO: 21318 - DNA, 25 bp, Homo sapien
ccctccggaagtatcgctgcgagaa

SEQ ID NO: 21319 - DNA, 25 bp, Homo sapien
cacccagcgaaaattgcggaggttt

SEQ ID NO: 21320 - DNA, 25 bp, Homo sapien
agccacccagcgaaaattgcggagg

SEQ ID NO: 21321 - DNA, 25 bp, Homo sapien
ccggaagtatcgctgcgagaagcca

SEQ ID NO: 21322 - DNA, 25 bp, Homo sapien
ggaccctccggaagtatcgctgcga

SEQ ID NO: 21323 - DNA, 25 bp, Homo sapien
ctgctagggaccctccggaagtatc

SEQ ID NO: 21324 - DNA, 25 bp, Homo sapien
tatggcagctgctagggaccctccg

SEQ ID NO: 21325 - DNA, 25 bp, Homo sapien
agtatcgctgcgagaagccacccag

SEQ ID NO: 21326 - DNA, 25 bp, Homo sapien
agccctgcgcccaaatgcgtcagtg

SEQ ID NO: 21327 - DNA, 25 bp, Homo sapien
tgagaaagtgttcgcccatcacgcg

SEQ ID NO: 21328 - DNA, 25 bp, Homo sapien
caatatttatgaccagcaggcgatg

SEQ ID NO: 21329 - DNA, 25 bp, Homo sapien
aagggcctcaactcccaatggtggc

SEQ ID NO: 21330 - DNA, 25 bp, Homo sapien
tctcgaggtcgctttcgaaggcagg

SEQ ID NO: 21331 - DNA, 25 bp, Homo sapien
gaacagagcttgtttccggggcacc

SEQ ID NO: 21332 - DNA, 25 bp, Homo sapien
acccacaccgactttggattagtga

SEQ ID NO: 21333 - DNA, 25 bp, Homo sapien
tgactccagggcgtttctctcgagg

SEQ ID NO: 21334 - DNA, 25 bp, Homo sapien
agcttactggcgctctgcgaaccgg

SEQ ID NO: 21335 - DNA, 25 bp, Homo sapien
ttcgcgccatagcttttagccggga

SEQ ID NO: 21336 - DNA, 25 bp, Homo sapien
caggctgccctgcttaatttcggcg

SEQ ID NO: 21337 - DNA, 25 bp, Homo sapien
ctctctcttagactggaaacgcttc

SEQ ID NO: 21338 - DNA, 25 bp, Homo sapien
tgcgaaccggctggaaagaaacacc

SEQ ID NO: 21339 - DNA, 25 bp, Homo sapien
ctcttggtcgcagaacttggctttc

SEQ ID NO: 21340 - DNA, 25 bp, Homo sapien
ggctttccgctattggtcctccaga

SEQ ID NO: 21341 - DNA, 25 bp, Homo sapien
ggcgtggttcctaattttctctctc

SEQ ID NO: 21342 - DNA, 25 bp, Homo sapien
tcgctgagctaaagtgcatctggcc

SEQ ID NO: 21343 - DNA, 25 bp, Homo sapien
aaccggaatgctttgcgagagtgca

SEQ ID NO: 21344 - DNA, 25 bp, Homo sapien
gactgtccctgctatcttgacaagg

SEQ ID NO: 21345 - DNA, 25 bp, Homo sapien
cttcgactggggacgacatccttta

SEQ ID NO: 21346 - DNA, 25 bp, Homo sapien
cgatggatgatgcacttaggggacc

SEQ ID NO: 21347 - DNA, 25 bp, Homo sapien
ttacacggagagttggccaagtttg

SEQ ID NO: 21348 - DNA, 25 bp, Homo sapien
tgtaaagttccaacctccgcgcagc

SEQ ID NO: 21349 - DNA, 25 bp, Homo sapien
tggcgagcccggatatttttagctg

SEQ ID NO: 21350 - DNA, 25 bp, Homo sapien
caggggcagtttcgggaatccgagt

SEQ ID NO: 21351 - DNA, 25 bp, Homo sapien
cagggctctgtttctgcgcctgcag

SEQ ID NO: 21352 - DNA, 25 bp, Homo sapien
ctcgggtccgcaagagcagggctct

SEQ ID NO: 21353 - DNA, 25 bp, Homo sapien
acaggtctgacccaggcgagtccct

SEQ ID NO: 21354 - DNA, 25 bp, Homo sapien
gatctccacaggtctgacccaggcg

SEQ ID NO: 21355 - DNA, 25 bp, Homo sapien
gaccacgttttctctcaggctccag

SEQ ID NO: 21356 - DNA, 25 bp, Homo sapien
ggatgcgcctcctttgaccacgttt

SEQ ID NO: 21357 - DNA, 25 bp, Homo sapien
ggagtcctggatgcgcctcctttga

SEQ ID NO: 21358 - DNA, 25 bp, Homo sapien
acgagtcacgcggtttgtctgagta

SEQ ID NO: 21359 - DNA, 25 bp, Homo sapien
gagacctggctcgtttcgttcggct

SEQ ID NO: 21360 - DNA, 25 bp, Homo sapien
acaccaggcgaaagcggagctgttc

SEQ ID NO: 21361 - DNA, 25 bp, Homo sapien
tgacaagctctcacctcactcggga

SEQ ID NO: 21362 - DNA, 25 bp, Homo sapien
accgcagggcacaaaacgagtcacg

SEQ ID NO: 21363 - DNA, 25 bp, Homo sapien
ggacacttgcctgccctgaggcaca

SEQ ID NO: 21364 - DNA, 25 bp, Homo sapien
agctgttctgtttaaacgccctttg

SEQ ID NO: 21365 - DNA, 25 bp, Homo sapien
tttgaaatcatctgcagcctgtctg

SEQ ID NO: 21366 - DNA, 25 bp, Homo sapien
ggaacttctgatctgtttctccata

SEQ ID NO: 21367 - DNA, 25 bp, Homo sapien
gggacgaggactcgtgctcctcctc

SEQ ID NO: 21368 - DNA, 25 bp, Homo sapien
aggggtctagaaccgcctgcgcctc

SEQ ID NO: 21369 - DNA, 25 bp, Homo sapien
ggcgagaatcgtgacctcaagaagc

SEQ ID NO: 21370 - DNA, 25 bp, Homo sapien
ctactccgcagtgtcaggggctcat

SEQ ID NO: 21371 - DNA, 25 bp, Homo sapien
cgggcagcacgctcggaacttctga

SEQ ID NO: 21372 - DNA, 25 bp, Homo sapien
cccgcactctgagggccttcattag

SEQ ID NO: 21373 - DNA, 25 bp, Homo sapien
ccgcaagacttctggggtccgaata

SEQ ID NO: 21374 - DNA, 25 bp, Homo sapien
gcgcatggtgtcgagcccacttcca

SEQ ID NO: 21375 - DNA, 25 bp, Homo sapien
cggaccacgccgcaatgcctcgtca

SEQ ID NO: 21376 - DNA, 25 bp, Homo sapien
ttcctcaccgcgcatggtgtcgagc

SEQ ID NO: 21377 - DNA, 25 bp, Homo sapien
ctaggcaagacgcagcccaggaggc

SEQ ID NO: 21378 - DNA, 25 bp, Homo sapien
ttccacctctctgcagtgctgcaga

SEQ ID NO: 21379 - DNA, 25 bp, Homo sapien
gtgctgcagacaacctctagggctc

SEQ ID NO: 21380 - DNA, 25 bp, Homo sapien
cccagcgagagctagggagccgaca

SEQ ID NO: 21381 - DNA, 25 bp, Homo sapien
agggagccgacaagctgcgacctct

SEQ ID NO: 21382 - DNA, 25 bp, Homo sapien
tcctcgaggatagcgagcccgaatt

SEQ ID NO: 21383 - DNA, 25 bp, Homo sapien
cgagctctttgttgctgtgatggca

SEQ ID NO: 21384 - DNA, 25 bp, Homo sapien
cctctactggaaagacaacggtggc

SEQ ID NO: 21385 - DNA, 25 bp, Homo sapien
acgcgctgggcccaagaaagacacc

SEQ ID NO: 21386 - DNA, 25 bp, Homo sapien
cttcacaggccaaccagaactctgg

SEQ ID NO: 21387 - DNA, 25 bp, Homo sapien
gaggacggcactgtcccttgcgacc

SEQ ID NO: 21388 - DNA, 25 bp, Homo sapien
agcccgaattccacgcgggcgatga

SEQ ID NO: 21389 - DNA, 25 bp, Homo sapien
ttggccgcgcctggatgtaaacagg

SEQ ID NO: 21390 - DNA, 25 bp, Homo sapien
ccaggactatcagagattgcccgga

SEQ ID NO: 21391 - DNA, 25 bp, Homo sapien
acacgatctgggtttgaccgttctc

SEQ ID NO: 21392 - DNA, 25 bp, Homo sapien
tccgggtaaaggtgaaggctgacca

SEQ ID NO: 21393 - DNA, 25 bp, Homo sapien
tgtcaaggccgtgacccgtgtatta

SEQ ID NO: 21394 - DNA, 25 bp, Homo sapien
ccgtgtattattgtccgagtggccg

SEQ ID NO: 21395 - DNA, 25 bp, Homo sapien
gccctgggccaaaaataggtgcggc

SEQ ID NO: 21396 - DNA, 25 bp, Homo sapien
cgtagcctagcgtttcattttccgt

SEQ ID NO: 21397 - DNA, 25 bp, Homo sapien
ttttccgtatcctcccgtcaggcga

SEQ ID NO: 21398 - DNA, 25 bp, Homo sapien
cctgtcctggcacgtcaggagctgc

SEQ ID NO: 21399 - DNA, 25 bp, Homo sapien
cgcagcttctgtagttgggctactg

SEQ ID NO: 21400 - DNA, 25 bp, Homo sapien
gggtcgctcagaaacctcatacttc

SEQ ID NO: 21401 - DNA, 25 bp, Homo sapien
acctcatacttctcgggtcagggaa

SEQ ID NO: 21402 - DNA, 25 bp, Homo sapien
tgctgaggcctgagatctcatcaac

SEQ ID NO: 21403 - DNA, 25 bp, Homo sapien
gagatctcatcaacctcgccttctg

SEQ ID NO: 21404 - DNA, 25 bp, Homo sapien
cccgctacaatttcggactccagga

SEQ ID NO: 21405 - DNA, 25 bp, Homo sapien
tggtctctgcatccacctgtcctgg

SEQ ID NO: 21406 - DNA, 25 bp, Homo sapien
tctgtggcggcgcagcttacaccgc

SEQ ID NO: 21407 - DNA, 25 bp, Homo sapien
cgtcgagccgcgaaaggttcacaga

SEQ ID NO: 21408 - DNA, 25 bp, Homo sapien
cccttgctgctcagaggcacggagt

SEQ ID NO: 21409 - DNA, 25 bp, Homo sapien
gcagagcgcactctgcgcacgtcga

SEQ ID NO: 21410 - DNA, 25 bp, Homo sapien
agaggtcctgccgtggtaccagcct

SEQ ID NO: 21411 - DNA, 25 bp, Homo sapien
cctgcatcctgaaggtaacgacttg

SEQ ID NO: 21412 - DNA, 25 bp, Homo sapien
cccttatttggatctgcgggaatgt

SEQ ID NO: 21413 - DNA, 25 bp, Homo sapien
ccgagaagaaaaggccgtactctgc

SEQ ID NO: 21414 - DNA, 25 bp, Homo sapien
cgcgaggtcgcctgttacaaaggga

SEQ ID NO: 21415 - DNA, 25 bp, Homo sapien
caccagcttgttgctagtgtacagc

SEQ ID NO: 21416 - DNA, 25 bp, Homo sapien
ggtgcccaaaatgaagaccctgatg

SEQ ID NO: 21417 - DNA, 25 bp, Homo sapien
tctggcagtgtgtttagcgctcacc

SEQ ID NO: 21418 - DNA, 25 bp, Homo sapien
ttgtggcaactccaccgggcaaaga

SEQ ID NO: 21419 - DNA, 25 bp, Homo sapien
ctagagtgaccaccgcacagttgtc

SEQ ID NO: 21420 - DNA, 25 bp, Homo sapien
ggagcatcccttgcgatacgctagg

SEQ ID NO: 21421 - DNA, 25 bp, Homo sapien
gcgagcctgaggattctgcacaaaa

SEQ ID NO: 21422 - DNA, 25 bp, Homo sapien
ccagacgctgagcactgagagtagc

SEQ ID NO: 21423 - DNA, 25 bp, Homo sapien
cagcggccctggaatcttgggcatc

SEQ ID NO: 21424 - DNA, 25 bp, Homo sapien
gcaatttcacgagcctgtccctgga

SEQ ID NO: 21425 - DNA, 25 bp, Homo sapien
agtagcatctacttcggcgccctgg

SEQ ID NO: 21426 - DNA, 25 bp, Homo sapien
gccctggtgcaagcggataacatcc

SEQ ID NO: 21427 - DNA, 25 bp, Homo sapien
tgcctggactcggtgatactgaata

SEQ ID NO: 21428 - DNA, 25 bp, Homo sapien
ctgaataacaatgagctgccgctgc

SEQ ID NO: 21429 - DNA, 25 bp, Homo sapien
gtcttcctggagctcaaccgcaatt

SEQ ID NO: 21430 - DNA, 25 bp, Homo sapien
ttgccaagacagtcgcagcccggct

SEQ ID NO: 21431 - DNA, 25 bp, Homo sapien
aactctgcggttttgtggagctcga

SEQ ID NO: 21432 - DNA, 25 bp, Homo sapien
cctctggtccggctttagaactctg

SEQ ID NO: 21433 - DNA, 25 bp, Homo sapien
ctgcgggtttttgcgacaccatccg

SEQ ID NO: 21434 - DNA, 25 bp, Homo sapien
tgccgtaaagtagcgctgcgggttt

SEQ ID NO: 21435 - DNA, 25 bp, Homo sapien
gacggccatgtttaccggcttcaga

SEQ ID NO: 21436 - DNA, 25 bp, Homo sapien
gccgaaggacaagagcaacacagtt

SEQ ID NO: 21437 - DNA, 25 bp, Homo sapien
tcagacttcccgcacctgaaggggc

SEQ ID NO: 21438 - DNA, 25 bp, Homo sapien
cgcaccgaggggtatgactacgacc

SEQ ID NO: 21439 - DNA, 25 bp, Homo sapien
cgaaacggtcgcaggttcctacaga

SEQ ID NO: 21440 - DNA, 25 bp, Homo sapien
gtagcatccggggactgcatctcag

SEQ ID NO: 21441 - DNA, 25 bp, Homo sapien
gcggcacagccatgaacaccaacga

SEQ ID NO: 21442 - DNA, 25 bp, Homo sapien
caccaacgatgccaaggagtatctg

SEQ ID NO: 21443 - DNA, 25 bp, Homo sapien
tatctggcccggagggaaatccctc

SEQ ID NO: 21444 - DNA, 25 bp, Homo sapien
agacccggaggtaaccgtgtatgtg

SEQ ID NO: 21445 - DNA, 25 bp, Homo sapien
ctgtgtgcgtacaaggtccggagaa

SEQ ID NO: 21446 - DNA, 25 bp, Homo sapien
tggaaacattttcggcgtgcccgtc

SEQ ID NO: 21447 - DNA, 25 bp, Homo sapien
tctgccaacgaggtcccgcgagaat

SEQ ID NO: 21448 - DNA, 25 bp, Homo sapien
gcagcctccctgtcacgtggaaaca

SEQ ID NO: 21449 - DNA, 25 bp, Homo sapien
tacttggctccaaatccgggtccca

SEQ ID NO: 21450 - DNA, 25 bp, Homo sapien
agctcttgctcacctttcacgcggg

SEQ ID NO: 21451 - DNA, 25 bp, Homo sapien
gccaccgctgcaggaagctcgatag

SEQ ID NO: 21452 - DNA, 25 bp, Homo sapien
ctcctttctcctcgttgggactggc

SEQ ID NO: 21453 - DNA, 25 bp, Homo sapien
gcgagcttccactagacccaacatg

SEQ ID NO: 21454 - DNA, 25 bp, Homo sapien
ctcaacagcgccgaaaagcgaaacc

SEQ ID NO: 21455 - DNA, 25 bp, Homo sapien
tgacacctcggtttttccgttcaca

SEQ ID NO: 21456 - DNA, 25 bp, Homo sapien
cactgagagggactggcaagcctga

SEQ ID NO: 21457 - DNA, 25 bp, Homo sapien
cgttgacagggcgaccactagatta

SEQ ID NO: 21458 - DNA, 25 bp, Homo sapien
cactagattatctctgcaacgcaga

SEQ ID NO: 21459 - DNA, 25 bp, Homo sapien
cccagcgcgcggaagcgagaacaga

SEQ ID NO: 21460 - DNA, 25 bp, Homo sapien
gacgcgagcgaaacgcccttgggcc

SEQ ID NO: 21461 - DNA, 25 bp, Homo sapien
gcgctgcagggctttcagtcaccca

SEQ ID NO: 21462 - DNA, 25 bp, Homo sapien
acggcaggccgggtctgctcactca

SEQ ID NO: 21463 - DNA, 25 bp, Homo sapien
accgaaacttagagcagctgcggca

SEQ ID NO: 21464 - DNA, 25 bp, Homo sapien
gagcggtggcccgtcagcacttcca

SEQ ID NO: 21465 - DNA, 25 bp, Homo sapien
gggcgtctacatgccggaccgagcc

SEQ ID NO: 21466 - DNA, 25 bp, Homo sapien
gggaaccgaaacttagagcagctgc

SEQ ID NO: 21467 - DNA, 25 bp, Homo sapien
cgcttccctaattaccgggctgtga

SEQ ID NO: 21468 - DNA, 25 bp, Homo sapien
gggtctgctcactcaccgttcgctg

SEQ ID NO: 21469 - DNA, 25 bp, Homo sapien
aattaccgggctgtgacacggtgtg

SEQ ID NO: 21470 - DNA, 25 bp, Homo sapien
aagtcggcgcctctcctaaaactgg

SEQ ID NO: 21471 - DNA, 25 bp, Homo sapien
ccgacattaacagggccaggaggaa

SEQ ID NO: 21472 - DNA, 25 bp, Homo sapien
ggtcacctccgacatggccggtccc

SEQ ID NO: 21473 - DNA, 25 bp, Homo sapien
agactccgggtcacctccgacatgg

SEQ ID NO: 21474 - DNA, 25 bp, Homo sapien
cagcgctgcagcagactccgggtca

SEQ ID NO: 21475 - DNA, 25 bp, Homo sapien
gtcggcgcctctcctaaaactggcg

SEQ ID NO: 21476 - DNA, 25 bp, Homo sapien
cccaagagtcgaagtcggcgcctct

SEQ ID NO: 21477 - DNA, 25 bp, Homo sapien
gaggaaccgctacggccaccaccgc

SEQ ID NO: 21478 - DNA, 25 bp, Homo sapien
gcacagtccctccacgcggaaagaa

SEQ ID NO: 21479 - DNA, 25 bp, Homo sapien
ctccacgcggaaagaagtaccttcg

SEQ ID NO: 21480 - DNA, 25 bp, Homo sapien
cacgcggaaagaagtaccttcgccg

SEQ ID NO: 21481 - DNA, 25 bp, Homo sapien
ggcgaaccctgccttggagccgcat

SEQ ID NO: 21482 - DNA, 25 bp, Homo sapien
atacagctgtggtccgcgctggccc

SEQ ID NO: 21483 - DNA, 25 bp, Homo sapien
cgccatacagctgtggtccgcgctg

SEQ ID NO: 21484 - DNA, 25 bp, Homo sapien
ggcttctggccgtgctccgctgcag

SEQ ID NO: 21485 - DNA, 25 bp, Homo sapien
taccttcgccggtcaccggctcctg

SEQ ID NO: 21486 - DNA, 25 bp, Homo sapien
ttcagcccggaagaacacctctttc

SEQ ID NO: 21487 - DNA, 25 bp, Homo sapien
agcgggagaaagacttcaggccttc

SEQ ID NO: 21488 - DNA, 25 bp, Homo sapien
ttcaggccttctttgcgtagcacgc

SEQ ID NO: 21489 - DNA, 25 bp, Homo sapien
ccaacatggggaaacgtgtctcttc

SEQ ID NO: 21490 - DNA, 25 bp, Homo sapien
tgcgcttaagggtagcggcctactc

SEQ ID NO: 21491 - DNA, 25 bp, Homo sapien
ggcctactcagtcagcggccaatta

SEQ ID NO: 21492 - DNA, 25 bp, Homo sapien
taccgtgagctttcgggattccgcc

SEQ ID NO: 21493 - DNA, 25 bp, Homo sapien
gggttctggtctctaatcgttatta

SEQ ID NO: 21494 - DNA, 25 bp, Homo sapien
cggtagaattttccgctatgggtca

SEQ ID NO: 21495 - DNA, 25 bp, Homo sapien
cctgaaaacgtctgcccggcgtagc

SEQ ID NO: 21496 - DNA, 25 bp, Homo sapien
atgctcctgaaaacgtctgcccggc

SEQ ID NO: 21497 - DNA, 25 bp, Homo sapien
acgccgcgcggtgatgctcctgaaa

SEQ ID NO: 21498 - DNA, 25 bp, Homo sapien
ccaggagaagtgcgtccgagacgcc

SEQ ID NO: 21499 - DNA, 25 bp, Homo sapien
caacagtgtctcgagagcgctgccg

SEQ ID NO: 21500 - DNA, 25 bp, Homo sapien
cgctatgggtcattctcggtgtccg

SEQ ID NO: 21501 - DNA, 25 bp, Homo sapien
cgtgacggcgaagcaacagtgtctc

SEQ ID NO: 21502 - DNA, 25 bp, Homo sapien
aaatccgatgccgtgttgagtccgc

SEQ ID NO: 21503 - DNA, 25 bp, Homo sapien
gcgtttcccggagcgcgaaatccga

SEQ ID NO: 21504 - DNA, 25 bp, Homo sapien
gaaatctcgccgtcggaggtaaggc

SEQ ID NO: 21505 - DNA, 25 bp, Homo sapien
atcgcgggcgcgtttgaaatctcgc

SEQ ID NO: 21506 - DNA, 25 bp, Homo sapien
agcatccaggagctctacgcccaga

SEQ ID NO: 21507 - DNA, 25 bp, Homo sapien
tggagggcttctccagcatccagga

SEQ ID NO: 21508 - DNA, 25 bp, Homo sapien
cggctgccattggaggctgctttta

SEQ ID NO: 21509 - DNA, 25 bp, Homo sapien
gaagaaggccaagtccaaggagacc

SEQ ID NO: 21510 - DNA, 25 bp, Homo sapien
gcccaccgccatagctgaggtcccg

SEQ ID NO: 21511 - DNA, 25 bp, Homo sapien
ctcggactccacgacttcgcggacg

SEQ ID NO: 21512 - DNA, 25 bp, Homo sapien
ctgagtcggatgcagcaaaggcgaa

SEQ ID NO: 21513 - DNA, 25 bp, Homo sapien
tctgaaaggctgagtcggatgcagc

SEQ ID NO: 21514 - DNA, 25 bp, Homo sapien
tcctacagatctgaaaggctgagtc

SEQ ID NO: 21515 - DNA, 25 bp, Homo sapien
ccgccctgtagtcggacactggagt

SEQ ID NO: 21516 - DNA, 25 bp, Homo sapien
tggagtcccggatcctacagatctg

SEQ ID NO: 21517 - DNA, 25 bp, Homo sapien
tcggacactggagtcccggatccta

SEQ ID NO: 21518 - DNA, 25 bp, Homo sapien
tgttcggctccttcctctgcaactg

SEQ ID NO: 21519 - DNA, 25 bp, Homo sapien
gccgccctgcttaacaagagcaatg

SEQ ID NO: 21520 - DNA, 25 bp, Homo sapien
gttcccgtataccaacgtgtgtgca

SEQ ID NO: 21521 - DNA, 25 bp, Homo sapien
agagcaatggcatcccgttccggaa

SEQ ID NO: 21522 - DNA, 25 bp, Homo sapien
gcgagcaccaggaaatgaccacgtt

SEQ ID NO: 21523 - DNA, 25 bp, Homo sapien
gactgcgactccatccggaagaatg

SEQ ID NO: 21524 - DNA, 25 bp, Homo sapien
cccgtggtggtacccaatatccagg

SEQ ID NO: 21525 - DNA, 25 bp, Homo sapien
cctggtggttctcttcatagtcttc

SEQ ID NO: 21526 - DNA, 25 bp, Homo sapien
gcagaaagtttcagcgagttcgtta

SEQ ID NO: 21527 - DNA, 25 bp, Homo sapien
gcacagattccgcttctcgccgttg

SEQ ID NO: 21528 - DNA, 25 bp, Homo sapien
cggcctgggatgacaaggtaccatc

SEQ ID NO: 21529 - DNA, 25 bp, Homo sapien
tccagaggctgatcccaatgcatcg

SEQ ID NO: 21530 - DNA, 25 bp, Homo sapien
tcggcttcgcttatctagacccaga

SEQ ID NO: 21531 - DNA, 25 bp, Homo sapien
cccaagctagggagacgcatagaga

SEQ ID NO: 21532 - DNA, 25 bp, Homo sapien
cagccctttggcgtttgagcaattg

SEQ ID NO: 21533 - DNA, 25 bp, Homo sapien
agcctgacactgagtttggaccaga

SEQ ID NO: 21534 - DNA, 25 bp, Homo sapien
gacgacctcggcgaccaggggcgct

SEQ ID NO: 21535 - DNA, 25 bp, Homo sapien
ctgagcactcacctaggagcgggag

SEQ ID NO: 21536 - DNA, 25 bp, Homo sapien
gggcgctgagcactcacctaggagc

SEQ ID NO: 21537 - DNA, 25 bp, Homo sapien
gtcccggatccgtcctccgtgacgc

SEQ ID NO: 21538 - DNA, 25 bp, Homo sapien
cggacactttccggcctcttttgtg

SEQ ID NO: 21539 - DNA, 25 bp, Homo sapien
agtgtgtgagtcaagccctgaatcc

SEQ ID NO: 21540 - DNA, 25 bp, Homo sapien
gtgagtcaagccctgaatccgctgg

SEQ ID NO: 21541 - DNA, 25 bp, Homo sapien
agtcaagccctgaatccgctggcca

SEQ ID NO: 21542 - DNA, 25 bp, Homo sapien
acctgtttgctttgcgcctccagtc

SEQ ID NO: 21543 - DNA, 25 bp, Homo sapien
gggcttcgcctgacaaactgagttg

SEQ ID NO: 21544 - DNA, 25 bp, Homo sapien
agcgaacaatgtgcctctgtgccca

SEQ ID NO: 21545 - DNA, 25 bp, Homo sapien
tctgcgcacctctgtcaggcttttg

SEQ ID NO: 21546 - DNA, 25 bp, Homo sapien
tcgggagcttaccagagaattcctt

SEQ ID NO: 21547 - DNA, 25 bp, Homo sapien
gtctgtgtcaggacttcgcattccc

SEQ ID NO: 21548 - DNA, 25 bp, Homo sapien
tccagttcagacctcgcggagagtc

SEQ ID NO: 21549 - DNA, 25 bp, Homo sapien
gacctctctcgaagagcggcgtgtg

SEQ ID NO: 21550 - DNA, 25 bp, Homo sapien
gtggcaggttctactcgggaagcct

SEQ ID NO: 21551 - DNA, 25 bp, Homo sapien
tggaacttatacctcggctgggccc

SEQ ID NO: 21552 - DNA, 25 bp, Homo sapien
caagggtgaagctgtggaacttata

SEQ ID NO: 21553 - DNA, 25 bp, Homo sapien
gcccatatcacaccgacaagggtga

SEQ ID NO: 21554 - DNA, 25 bp, Homo sapien
caactcctagggcacgggaactgcg

SEQ ID NO: 21555 - DNA, 25 bp, Homo sapien
ctcgggaagcctgttttatgtcttc

SEQ ID NO: 21556 - DNA, 25 bp, Homo sapien
gaagaaggcgctcacccaaggacca

SEQ ID NO: 21557 - DNA, 25 bp, Homo sapien
tatgtcttctttcacgcccatatca

SEQ ID NO: 21558 - DNA, 25 bp, Homo sapien
tcgcggaggcttataccacgatgtg

SEQ ID NO: 21559 - DNA, 25 bp, Homo sapien
gggctcctttagaacgcggcaaaca

SEQ ID NO: 21560 - DNA, 25 bp, Homo sapien
agacactgctcgagctttcccgggc

SEQ ID NO: 21561 - DNA, 25 bp, Homo sapien
atcatttgcacgaacgcagcagctc

SEQ ID NO: 21562 - DNA, 25 bp, Homo sapien
cctctcagggcacgaatggtgctga

SEQ ID NO: 21563 - DNA, 25 bp, Homo sapien
cgcggcaaacagaggacttagcaac

SEQ ID NO: 21564 - DNA, 25 bp, Homo sapien
cccatctggagcctaaaaactgagc

SEQ ID NO: 21565 - DNA, 25 bp, Homo sapien
cacgatgtgggaaaacgacggaatt

SEQ ID NO: 21566 - DNA, 25 bp, Homo sapien
cgccgcttggtcaaaggaggtccga

SEQ ID NO: 21567 - DNA, 25 bp, Homo sapien
ccagcctctgctaggtgcgtgacac

SEQ ID NO: 21568 - DNA, 25 bp, Homo sapien
ggggaacctccatccctgggacatg

SEQ ID NO: 21569 - DNA, 25 bp, Homo sapien
gcgtgccacgtgctagagtaaaatt

SEQ ID NO: 21570 - DNA, 25 bp, Homo sapien
gaggccctgcaggaacagcccacag

SEQ ID NO: 21571 - DNA, 25 bp, Homo sapien
gctcaagtgtggacgtgcgtgccac

SEQ ID NO: 21572 - DNA, 25 bp, Homo sapien
acggaaaccttgtcctgctcaagtg

SEQ ID NO: 21573 - DNA, 25 bp, Homo sapien
tgcaggtcactccactgcctgtgtc

SEQ ID NO: 21574 - DNA, 25 bp, Homo sapien
cactatctcagcgatgggcacgcga

SEQ ID NO: 21575 - DNA, 25 bp, Homo sapien
aaccacgaccgtgcctagggaccag

SEQ ID NO: 21576 - DNA, 25 bp, Homo sapien
aggcagccttttagtgaggagccgc

SEQ ID NO: 21577 - DNA, 25 bp, Homo sapien
ggaaaaccacccgagccgctgaaca

SEQ ID NO: 21578 - DNA, 25 bp, Homo sapien
cgttctgcaaagctagcggttccca

SEQ ID NO: 21579 - DNA, 25 bp, Homo sapien
gcgcccgcctgcgaagatacagtcg

SEQ ID NO: 21580 - DNA, 25 bp, Homo sapien
ctaaggagttcgctggagccctttc

SEQ ID NO: 21581 - DNA, 25 bp, Homo sapien
cgctgaacagtattccgcgactgca

SEQ ID NO: 21582 - DNA, 25 bp, Homo sapien
tgagacgccattcccggctcggtga

SEQ ID NO: 21583 - DNA, 25 bp, Homo sapien
gtccaagaggcagcctggcgtcttc

SEQ ID NO: 21584 - DNA, 25 bp, Homo sapien
tccgtgaaagtcttagccagaaact

SEQ ID NO: 21585 - DNA, 25 bp, Homo sapien
agcgaactgcctctccgtgaaagtc

SEQ ID NO: 21586 - DNA, 25 bp, Homo sapien
tgcagctcgttgcacccacggacgt

SEQ ID NO: 21587 - DNA, 25 bp, Homo sapien
cccaaaaacacatcttggccgtgtg

SEQ ID NO: 21588 - DNA, 25 bp, Homo sapien
gaatgccgcaatgaaaaccgctctg

SEQ ID NO: 21589 - DNA, 25 bp, Homo sapien
aggtaagtgatctgcctgtgcgccc

SEQ ID NO: 21590 - DNA, 25 bp, Homo sapien
gcttgcgcgttgttcctgacgctta

SEQ ID NO: 21591 - DNA, 25 bp, Homo sapien
tttccgtacggaagcaaaggagcca

SEQ ID NO: 21592 - DNA, 25 bp, Homo sapien
cggaaagccgctgccgaagaacttc

SEQ ID NO: 21593 - DNA, 25 bp, Homo sapien
ccaggctttagcatttcggagatta

SEQ ID NO: 21594 - DNA, 25 bp, Homo sapien
acagcggcgacacttaatgttcacg

SEQ ID NO: 21595 - DNA, 25 bp, Homo sapien
gcacatctgtggttgtctgctggtc

SEQ ID NO: 21596 - DNA, 25 bp, Homo sapien
aaaagtgttctctgtggctccgtgg

SEQ ID NO: 21597 - DNA, 25 bp, Homo sapien
gtctgctggtctcaaaagtgttctc

SEQ ID NO: 21598 - DNA, 25 bp, Homo sapien
cccgagtttggccaacaggcatttt

SEQ ID NO: 21599 - DNA, 25 bp, Homo sapien
accactttcttcatagcggcgacgc

SEQ ID NO: 21600 - DNA, 25 bp, Homo sapien
gaatgtcggccacggttcaacccag

SEQ ID NO: 21601 - DNA, 25 bp, Homo sapien
cggggctccgaactttgtctctaag

SEQ ID NO: 21602 - DNA, 25 bp, Homo sapien
gccggagctgttgaaccactttctt

SEQ ID NO: 21603 - DNA, 25 bp, Homo sapien
ccgctcacttttacgcggttgagtc

SEQ ID NO: 21604 - DNA, 25 bp, Homo sapien
ctaagtttccggttctgtgctcagc

SEQ ID NO: 21605 - DNA, 25 bp, Homo sapien
ctagcgcgacccgactcttaagttt

SEQ ID NO: 21606 - DNA, 25 bp, Homo sapien
acacggttctcagcccagagctttg

SEQ ID NO: 21607 - DNA, 25 bp, Homo sapien
ggcagcagccgtcactcacacggtt

SEQ ID NO: 21608 - DNA, 25 bp, Homo sapien
gacgtcacctgcagcgtttccttcg

SEQ ID NO: 21609 - DNA, 25 bp, Homo sapien
tgtcctcctatgtgcacgcctgtgc

SEQ ID NO: 21610 - DNA, 25 bp, Homo sapien
cttcctcaatgacgcgggcgcctgt

SEQ ID NO: 21611 - DNA, 25 bp, Homo sapien
cccacgtcacagacggggatgctga

SEQ ID NO: 21612 - DNA, 25 bp, Homo sapien
cgctacgcctacgtggtggatgcct

SEQ ID NO: 21613 - DNA, 25 bp, Homo sapien
ccgaccacagccaagtacatgcaga

SEQ ID NO: 21614 - DNA, 25 bp, Homo sapien
gcgcccacggcacctctccttaggg

SEQ ID NO: 21615 - DNA, 25 bp, Homo sapien
cgctacaggtgggtgaagttaagtg

SEQ ID NO: 21616 - DNA, 25 bp, Homo sapien
acatagcagcaggtctagcgggccg

SEQ ID NO: 21617 - DNA, 25 bp, Homo sapien
gccgggacatagcagcaggtctagc

SEQ ID NO: 21618 - DNA, 25 bp, Homo sapien
agaggaaggcgctgacctcgaaatc

SEQ ID NO: 21619 - DNA, 25 bp, Homo sapien
ctaacttctcttcgtgccctgaagc

SEQ ID NO: 21620 - DNA, 25 bp, Homo sapien
cgttctaccctaacttctcttcgtg

SEQ ID NO: 21621 - DNA, 25 bp, Homo sapien
ctcgaaatctggatggtggcgaatc

SEQ ID NO: 21622 - DNA, 25 bp, Homo sapien
agaggacgctgagaatcgccgttcc

SEQ ID NO: 21623 - DNA, 25 bp, Homo sapien
cctggcgaagggctagaactcacca

SEQ ID NO: 21624 - DNA, 25 bp, Homo sapien
gatgccttctgtcctccaccggaga

SEQ ID NO: 21625 - DNA, 25 bp, Homo sapien
cgcttcacagcgtacaaggtgcctt

SEQ ID NO: 21626 - DNA, 25 bp, Homo sapien
gggtaacatctgcatctccgcttca

SEQ ID NO: 21627 - DNA, 25 bp, Homo sapien
gtgggcttctggttagggtaacatc

SEQ ID NO: 21628 - DNA, 25 bp, Homo sapien
gctctgggctactgggatctcaccc

SEQ ID NO: 21629 - DNA, 25 bp, Homo sapien
ggcaatgggatcacgtcaggctcag

SEQ ID NO: 21630 - DNA, 25 bp, Homo sapien
gcggcacctgttacgcccagtgatt

SEQ ID NO: 21631 - DNA, 25 bp, Homo sapien
agaagaccttatccctgcggtccgc

SEQ ID NO: 21632 - DNA, 25 bp, Homo sapien
cgatgaacaaccgtggcctgcattg

SEQ ID NO: 21633 - DNA, 25 bp, Homo sapien
tccgccagttgctaggcgatgaaca

SEQ ID NO: 21634 - DNA, 25 bp, Homo sapien
tcccgccgaacaacggggcgctgag

SEQ ID NO: 21635 - DNA, 25 bp, Homo sapien
accttgctccatcccagagagggtt

SEQ ID NO: 21636 - DNA, 25 bp, Homo sapien
cggctgcactagcaaatcgccaaac

SEQ ID NO: 21637 - DNA, 25 bp, Homo sapien
gtggctactttagagcacgttttcc

SEQ ID NO: 21638 - DNA, 25 bp, Homo sapien
ctgctgctgtcctcggtgtgaaaag

SEQ ID NO: 21639 - DNA, 25 bp, Homo sapien
caggtctaaaaaagccagagcgttc

SEQ ID NO: 21640 - DNA, 25 bp, Homo sapien
agcgttccgcgctcaattacaatga

SEQ ID NO: 21641 - DNA, 25 bp, Homo sapien
tgacgctaaaatgcatcctgaggcc

SEQ ID NO: 21642 - DNA, 25 bp, Homo sapien
aggcctgtccatcgcggatttgaga

SEQ ID NO: 21643 - DNA, 25 bp, Homo sapien
ccgcttcagtcatagggccgggaaa

SEQ ID NO: 21644 - DNA, 25 bp, Homo sapien
cctgcttgctatctctcgtcggtca

SEQ ID NO: 21645 - DNA, 25 bp, Homo sapien
tagtgacgctgccaatgcccgacac

SEQ ID NO: 21646 - DNA, 25 bp, Homo sapien
agcagcggacgcaacgccgattttg

SEQ ID NO: 21647 - DNA, 25 bp, Homo sapien
gattgctttttgctcctagcgggga

SEQ ID NO: 21648 - DNA, 25 bp, Homo sapien
cgcgtccagagccaaaggaaagttt

SEQ ID NO: 21649 - DNA, 25 bp, Homo sapien
tgcgttcgacgttcccactggagag

SEQ ID NO: 21650 - DNA, 25 bp, Homo sapien
agcgcccactaaaggaccgctagta

SEQ ID NO: 21651 - DNA, 25 bp, Homo sapien
aagcctcacggagccatacctcgga

SEQ ID NO: 21652 - DNA, 25 bp, Homo sapien
tgtgcaaaggcagacgcaacccgtg

SEQ ID NO: 21653 - DNA, 25 bp, Homo sapien
aagttgtgccatacacccgccggga

SEQ ID NO: 21654 - DNA, 25 bp, Homo sapien
ggaaacaccgttcacggccgactca

SEQ ID NO: 21655 - DNA, 25 bp, Homo sapien
tccgccgaagttggagccctgcaaa

SEQ ID NO: 21656 - DNA, 25 bp, Homo sapien
gggacttattccacgcttcagcgga

SEQ ID NO: 21657 - DNA, 25 bp, Homo sapien
ccaagtgcccaacgctgcggtacgg

SEQ ID NO: 21658 - DNA, 25 bp, Homo sapien
acggctacacctgtctgggcgcagg

SEQ ID NO: 21659 - DNA, 25 bp, Homo sapien
gacacctagcgtgggacggctacac

SEQ ID NO: 21660 - DNA, 25 bp, Homo sapien
agagccgaggaagtaagcagtccca

SEQ ID NO: 21661 - DNA, 25 bp, Homo sapien
gtctgccggagaagcgccttacaga

SEQ ID NO: 21662 - DNA, 25 bp, Homo sapien
cagacgcctccagccatcgggatgg

SEQ ID NO: 21663 - DNA, 25 bp, Homo sapien
tgctgctgccttcgggtaccgctgc

SEQ ID NO: 21664 - DNA, 25 bp, Homo sapien
gcccggcctttgttctcgcgccgcg

SEQ ID NO: 21665 - DNA, 25 bp, Homo sapien
acgcctccagccatcgggatgggcg

SEQ ID NO: 21666 - DNA, 25 bp, Homo sapien
ctcagcgccctcgtcgcggcctgac

SEQ ID NO: 21667 - DNA, 25 bp, Homo sapien
acgcgctcgcgtcaccacgcacgcc

SEQ ID NO: 21668 - DNA, 25 bp, Homo sapien
tgtgcgcgtccaaaccgcatcgggc

SEQ ID NO: 21669 - DNA, 25 bp, Homo sapien
ggcccgagagccacgtccggctccc

SEQ ID NO: 21670 - DNA, 25 bp, Homo sapien
cgccgttcgtgaatcttagagatga

SEQ ID NO: 21671 - DNA, 25 bp, Homo sapien
tcttggtgcacgaaaggaagacgcc

SEQ ID NO: 21672 - DNA, 25 bp, Homo sapien
agccgccgttgcttttccctcttgg

SEQ ID NO: 21673 - DNA, 25 bp, Homo sapien
tgggaaatcgaacagacaatcggtc

SEQ ID NO: 21674 - DNA, 25 bp, Homo sapien
aatcggtcgccgttcgtgaatctta

SEQ ID NO: 21675 - DNA, 25 bp, Homo sapien
cttagagatgagagtcgtcagtaca

SEQ ID NO: 21676 - DNA, 25 bp, Homo sapien
cagtacatgaccaaaagccgtgttc

SEQ ID NO: 21677 - DNA, 25 bp, Homo sapien
gaagacgcctgtgggaaatcgaaca

SEQ ID NO: 21678 - DNA, 25 bp, Homo sapien
cggctgctttcagccagcgcagcga

SEQ ID NO: 21679 - DNA, 25 bp, Homo sapien
cctgctcgggtttgccaggtttgct

SEQ ID NO: 21680 - DNA, 25 bp, Homo sapien
aagccggcgttgtgcccgttccctg

SEQ ID NO: 21681 - DNA, 25 bp, Homo sapien
ccgcttttcaggagcacaggtggga

SEQ ID NO: 21682 - DNA, 25 bp, Homo sapien
agtcagcgagcgactccagcagcct

SEQ ID NO: 21683 - DNA, 25 bp, Homo sapien
cggcgcggaacagctgcatctcgcg

SEQ ID NO: 21684 - DNA, 25 bp, Homo sapien
ccgagccgcgtcaaggccatctgga

SEQ ID NO: 21685 - DNA, 25 bp, Homo sapien
acagtccgccttgaaaggggccagc

SEQ ID NO: 21686 - DNA, 25 bp, Homo sapien
gtcgtcttcgtccttgtcgtcttcc

SEQ ID NO: 21687 - DNA, 25 bp, Homo sapien
cgtgcatggcctggatcagcagata

SEQ ID NO: 21688 - DNA, 25 bp, Homo sapien
tggatcagcagataataggcctctc

SEQ ID NO: 21689 - DNA, 25 bp, Homo sapien
taataggcctctcgcaactgggtcc

SEQ ID NO: 21690 - DNA, 25 bp, Homo sapien
cccgcggggaagctgtgatccgcca

SEQ ID NO: 21691 - DNA, 25 bp, Homo sapien
cgtcgtagtcgtcttcgtccttgtc

SEQ ID NO: 21692 - DNA, 25 bp, Homo sapien
caggacggccgcatccgaggagtcc

SEQ ID NO: 21693 - DNA, 25 bp, Homo sapien
gcaggttttcgtagtagtcggcgtc

SEQ ID NO: 21694 - DNA, 25 bp, Homo sapien
ccgcaacccggtgtgtttgtgtatc

SEQ ID NO: 21695 - DNA, 25 bp, Homo sapien
cgcgcctccaggtgatcaccaagga

SEQ ID NO: 21696 - DNA, 25 bp, Homo sapien
ggaggccggcatcttcaagaacccg

SEQ ID NO: 21697 - DNA, 25 bp, Homo sapien
acgcagctcatcgtgatcttcaacg

SEQ ID NO: 21698 - DNA, 25 bp, Homo sapien
tcaacgaaattgactccaccgagcc

SEQ ID NO: 21699 - DNA, 25 bp, Homo sapien
tggccttcagtccatctcgagctgg

SEQ ID NO: 21700 - DNA, 25 bp, Homo sapien
gctacaactggctgcctggccttca

SEQ ID NO: 21701 - DNA, 25 bp, Homo sapien
caccaaggaagtaagcgcctgcatc

SEQ ID NO: 21702 - DNA, 25 bp, Homo sapien
gtgcctctcccagtctatctgtttg

SEQ ID NO: 21703 - DNA, 25 bp, Homo sapien
tgctgctcccgtatgccgcaaaata

SEQ ID NO: 21704 - DNA, 25 bp, Homo sapien
ctaaacagctcgtcaggtcccggga

SEQ ID NO: 21705 - DNA, 25 bp, Homo sapien
ggggagtcaccactgttagtcctcg

SEQ ID NO: 21706 - DNA, 25 bp, Homo sapien
cgcaaaatagctcagagggtccttc

SEQ ID NO: 21707 - DNA, 25 bp, Homo sapien
gctcgatgttatcctcctcgtccga

SEQ ID NO: 21708 - DNA, 25 bp, Homo sapien
tacaaataagcctgcagtctgcgcc

SEQ ID NO: 21709 - DNA, 25 bp, Homo sapien
gggcgagtcacgctcctaaacagct

SEQ ID NO: 21710 - DNA, 25 bp, Homo sapien
acagcgggcgtttcctcaagccacg

SEQ ID NO: 21711 - DNA, 25 bp, Homo sapien
tgtctctgcggcagcctatcgacgc

SEQ ID NO: 21712 - DNA, 25 bp, Homo sapien
cccgggttagcttcctcataaggca

SEQ ID NO: 21713 - DNA, 25 bp, Homo sapien
tcataaggcatcgtttccgtgggtg

SEQ ID NO: 21714 - DNA, 25 bp, Homo sapien
gaggatcctccttgtcctcggactc

SEQ ID NO: 21715 - DNA, 25 bp, Homo sapien
gctgcgttactcacgtccttcttca

SEQ ID NO: 21716 - DNA, 25 bp, Homo sapien
cttcacttcagtgaggtcctcctcg

SEQ ID NO: 21717 - DNA, 25 bp, Homo sapien
gttccttccctctcgtagaggctca

SEQ ID NO: 21718 - DNA, 25 bp, Homo sapien
cacgaagacgcagtccggaaggctc

SEQ ID NO: 21719 - DNA, 25 bp, Homo sapien
ttgtgaactactagcccgagggcca

SEQ ID NO: 21720 - DNA, 25 bp, Homo sapien
ttgaatcggatcctccagaaggctg

SEQ ID NO: 21721 - DNA, 25 bp, Homo sapien
gcccgagaccgtacaaccacattga

SEQ ID NO: 21722 - DNA, 25 bp, Homo sapien
ctcagagttgcactgtcgtcgctgc

SEQ ID NO: 21723 - DNA, 25 bp, Homo sapien
ctcctcttggcagccgctgaatgtg

SEQ ID NO: 21724 - DNA, 25 bp, Homo sapien
tcgtcgctgccgtttaattttcaca

SEQ ID NO: 21725 - DNA, 25 bp, Homo sapien
ccgggaggtgtgaacaatgaacttc

SEQ ID NO: 21726 - DNA, 25 bp, Homo sapien
tctggcacagcacggcaactcgctg

SEQ ID NO: 21727 - DNA, 25 bp, Homo sapien
gcttggtgtccacgcaaacgccatc

SEQ ID NO: 21728 - DNA, 25 bp, Homo sapien
cccgctgggaggactagtcaacagg

SEQ ID NO: 21729 - DNA, 25 bp, Homo sapien
aaaagtgacacaactgggccgcggc

SEQ ID NO: 21730 - DNA, 25 bp, Homo sapien
gccgcggcgcacttttcaggaacgc

SEQ ID NO: 21731 - DNA, 25 bp, Homo sapien
cccgaagctagatgacggagtcttg

SEQ ID NO: 21732 - DNA, 25 bp, Homo sapien
tttcaccaaatatgggccggggctg

SEQ ID NO: 21733 - DNA, 25 bp, Homo sapien
ccgccggaaacctcgattcttggca

SEQ ID NO: 21734 - DNA, 25 bp, Homo sapien
gctcaacgaggactgcagcaaaacg

SEQ ID NO: 21735 - DNA, 25 bp, Homo sapien
caccaaggggctggaatgcaacttc

SEQ ID NO: 21736 - DNA, 25 bp, Homo sapien
tgcacaccagcttgttggcgtcttc

SEQ ID NO: 21737 - DNA, 25 bp, Homo sapien
cttctccacttgaccaggctggtga

SEQ ID NO: 21738 - DNA, 25 bp, Homo sapien
agttggactctccttttgccaccta

SEQ ID NO: 21739 - DNA, 25 bp, Homo sapien
gcgccgagtctcacgcgtatcttct

SEQ ID NO: 21740 - DNA, 25 bp, Homo sapien
agagccgacgtcactgcaacacgcg

SEQ ID NO: 21741 - DNA, 25 bp, Homo sapien
agttcgcgatcgtttgcgggtagcc

SEQ ID NO: 21742 - DNA, 25 bp, Homo sapien
cccagctttgtggaacctgagggcg

SEQ ID NO: 21743 - DNA, 25 bp, Homo sapien
tccagcgaggggacgctggtaagtc

SEQ ID NO: 21744 - DNA, 25 bp, Homo sapien
gcctcctgcaagacaatggccacga

SEQ ID NO: 21745 - DNA, 25 bp, Homo sapien
ctgcaagacaatggccacgacctga

SEQ ID NO: 21746 - DNA, 25 bp, Homo sapien
aatggccacgacctgacgcgcgagc

SEQ ID NO: 21747 - DNA, 25 bp, Homo sapien
agtcacgccgctggcgcttgacgca

SEQ ID NO: 21748 - DNA, 25 bp, Homo sapien
tggcgcttgacgcacgcggagaccc

SEQ ID NO: 21749 - DNA, 25 bp, Homo sapien
cgcgacccgtccctcaggaccgacg

SEQ ID NO: 21750 - DNA, 25 bp, Homo sapien
cggcccacgtgtggagccaagcagc

SEQ ID NO: 21751 - DNA, 25 bp, Homo sapien
gccaagcagccacaaacccggaata

SEQ ID NO: 21752 - DNA, 25 bp, Homo sapien
atagcctgcttgacgcgactgctcg

SEQ ID NO: 21753 - DNA, 25 bp, Homo sapien
gactgctcgaatcgccgtaaagcta

SEQ ID NO: 21754 - DNA, 25 bp, Homo sapien
tctctgggcgaacaagcgtaactgc

SEQ ID NO: 21755 - DNA, 25 bp, Homo sapien
taaagctacgcttttgcgcctcgcc

SEQ ID NO: 21756 - DNA, 25 bp, Homo sapien
cgtaactgcgtgacttgcccgctgg

SEQ ID NO: 21757 - DNA, 25 bp, Homo sapien
ccttcacgacttgtagagctcttta

SEQ ID NO: 21758 - DNA, 25 bp, Homo sapien
agctcccactccaagcggggtgacg

SEQ ID NO: 21759 - DNA, 25 bp, Homo sapien
cgtttggacaacatgacccagctgc

SEQ ID NO: 21760 - DNA, 25 bp, Homo sapien
gggctcctggtacgtttggacaaca

SEQ ID NO: 21761 - DNA, 25 bp, Homo sapien
cccatctgcggtcccttttgggagc

SEQ ID NO: 21762 - DNA, 25 bp, Homo sapien
acattcgaacgaggctgaagaggac

SEQ ID NO: 21763 - DNA, 25 bp, Homo sapien
tgggagtccggaagggaaactcaca

SEQ ID NO: 21764 - DNA, 25 bp, Homo sapien
ccagctgctgtcacattcgaacgag

SEQ ID NO: 21765 - DNA, 25 bp, Homo sapien
cgccgtgttcgcagtgctcgaaatc

SEQ ID NO: 21766 - DNA, 25 bp, Homo sapien
cgcgcccgaacgtttgtcaaacaag

SEQ ID NO: 21767 - DNA, 25 bp, Homo sapien
cctctcgagccaaaagatcgcttta

SEQ ID NO: 21768 - DNA, 25 bp, Homo sapien
cacttgcggttcaaaggcgactctg

SEQ ID NO: 21769 - DNA, 25 bp, Homo sapien
tcctagctctctggctcggtaacga

SEQ ID NO: 21770 - DNA, 25 bp, Homo sapien
ggagacttttccacgccttgttctg

SEQ ID NO: 21771 - DNA, 25 bp, Homo sapien
cggccgctcctaaagccaaaaagtg

SEQ ID NO: 21772 - DNA, 25 bp, Homo sapien
acgaggcatcctttcaaacacggta

SEQ ID NO: 21773 - DNA, 25 bp, Homo sapien
aactgtctgagatctgctggcacga

SEQ ID NO: 21774 - DNA, 25 bp, Homo sapien
gcaatggaaaccgtggcaatccttc

SEQ ID NO: 21775 - DNA, 25 bp, Homo sapien
caatccttcttgtgctctgagtcgg

SEQ ID NO: 21776 - DNA, 25 bp, Homo sapien
gaggtgggaaccaggcgaattccta

SEQ ID NO: 21777 - DNA, 25 bp, Homo sapien
cgaattcctagacctgcttgccgca

SEQ ID NO: 21778 - DNA, 25 bp, Homo sapien
gccgcagaagagtgcccgctcaagt

SEQ ID NO: 21779 - DNA, 25 bp, Homo sapien
ctcaagtggaacaaaagcgcagcta

SEQ ID NO: 21780 - DNA, 25 bp, Homo sapien
tagtaaccggctagtggcttctctg

SEQ ID NO: 21781 - DNA, 25 bp, Homo sapien
gcgccacggctgctgcaatggaaac

SEQ ID NO: 21782 - DNA, 25 bp, Homo sapien
gactctgcactcaaaagttagggtg

SEQ ID NO: 21783 - DNA, 25 bp, Homo sapien
ccttgtcttctgatcttgtccctga

SEQ ID NO: 21784 - DNA, 25 bp, Homo sapien
aggtgagcaccattcctgatgctgg

SEQ ID NO: 21785 - DNA, 25 bp, Homo sapien
caggaaccgcaagctccggaacgca

SEQ ID NO: 21786 - DNA, 25 bp, Homo sapien
ctggtgatcctctccgtgctcagga

SEQ ID NO: 21787 - DNA, 25 bp, Homo sapien
ggctccttcgccaactgctgcgagg

SEQ ID NO: 21788 - DNA, 25 bp, Homo sapien
tgcggaaagttttactggcgcgctt

SEQ ID NO: 21789 - DNA, 25 bp, Homo sapien
tgcgatgtcagagaacggctccttc

SEQ ID NO: 21790 - DNA, 25 bp, Homo sapien
ccgcgcggcacagaatctccatgaa

SEQ ID NO: 21791 - DNA, 25 bp, Homo sapien
cctttgtcacgacgatcctgtccga

SEQ ID NO: 21792 - DNA, 25 bp, Homo sapien
tcagtcctcgtgcaaacattgtgtc

SEQ ID NO: 21793 - DNA, 25 bp, Homo sapien
tgtacgaggacacggtcttcaagcc

SEQ ID NO: 21794 - DNA, 25 bp, Homo sapien
actgccgctgcaagctgtacgagga

SEQ ID NO: 21795 - DNA, 25 bp, Homo sapien
ggcgaggcagcagagatcctctatt

SEQ ID NO: 21796 - DNA, 25 bp, Homo sapien
gtcatctcctcttggatctgccgga

SEQ ID NO: 21797 - DNA, 25 bp, Homo sapien
gcacaggttgggctccacaagcatg

SEQ ID NO: 21798 - DNA, 25 bp, Homo sapien
cgctgttcccgcgataacctcgaga

SEQ ID NO: 21799 - DNA, 25 bp, Homo sapien
tggggaacactaaggctgcactgtc

SEQ ID NO: 21800 - DNA, 25 bp, Homo sapien
catcgtcgacgttagcggccgttct

SEQ ID NO: 21801 - DNA, 25 bp, Homo sapien
cggctgccgcctaggatgaatatca

SEQ ID NO: 21802 - DNA, 25 bp, Homo sapien
cgcaatcctcaaggggtcgctgttc

SEQ ID NO: 21803 - DNA, 25 bp, Homo sapien
cgctctgggttctcgttaagtgcaa

SEQ ID NO: 21804 - DNA, 25 bp, Homo sapien
tgaccgggacctgttatttctaatg

SEQ ID NO: 21805 - DNA, 25 bp, Homo sapien
ttcacggaaacgacagctgcggctg

SEQ ID NO: 21806 - DNA, 25 bp, Homo sapien
ggggctcttccgtccaataagcgga

SEQ ID NO: 21807 - DNA, 25 bp, Homo sapien
tcaggattatgatgccgcccaagtt

SEQ ID NO: 21808 - DNA, 25 bp, Homo sapien
tccagaaactggaggagtcccgctc

SEQ ID NO: 21809 - DNA, 25 bp, Homo sapien
cccgctcgaagctaggtgaggaact

SEQ ID NO: 21810 - DNA, 25 bp, Homo sapien
agcaagtgggcgttcatctaacctg

SEQ ID NO: 21811 - DNA, 25 bp, Homo sapien
gcaaggttgggcttccctagccaaa

SEQ ID NO: 21812 - DNA, 25 bp, Homo sapien
cgagctccaagaatgggttgaatta

SEQ ID NO: 21813 - DNA, 25 bp, Homo sapien
ccgcggtatgtcttgatcccgagca

SEQ ID NO: 21814 - DNA, 25 bp, Homo sapien
taggtggcgccataggaacatcctc

SEQ ID NO: 21815 - DNA, 25 bp, Homo sapien
cacggtgctgtggaattctctggtt

SEQ ID NO: 21816 - DNA, 25 bp, Homo sapien
tctggtttttcacgcaaggtcaggc

SEQ ID NO: 21817 - DNA, 25 bp, Homo sapien
ggagtctccattgccgcgagttcta

SEQ ID NO: 21818 - DNA, 25 bp, Homo sapien
ctattttcgaaaggctgcaggcgcg

SEQ ID NO: 21819 - DNA, 25 bp, Homo sapien
cccagcaccctgttgttattaagga

SEQ ID NO: 21820 - DNA, 25 bp, Homo sapien
ttccgcttcccagtcgatggtcgtc

SEQ ID NO: 21821 - DNA, 25 bp, Homo sapien
gcgagttctacaccacagggccagg

SEQ ID NO: 21822 - DNA, 25 bp, Homo sapien
ctgcattctattcgtggccgcggag

SEQ ID NO: 21823 - DNA, 25 bp, Homo sapien
cattctattcgtggccgcggaggcc

SEQ ID NO: 21824 - DNA, 25 bp, Homo sapien
actgcattctattcgtggccgcgga

SEQ ID NO: 21825 - DNA, 25 bp, Homo sapien
tgactgcattctattcgtggccgcg

SEQ ID NO: 21826 - DNA, 25 bp, Homo sapien
gctgactgcattctattcgtggccg

SEQ ID NO: 21827 - DNA, 25 bp, Homo sapien
ttgctgactgcattctattcgtggc

SEQ ID NO: 21828 - DNA, 25 bp, Homo sapien
tcggacgttgtttgctgactgcatt

SEQ ID NO: 21829 - DNA, 25 bp, Homo sapien
ggtcggacgttgtttgctgactgca

SEQ ID NO: 21830 - DNA, 25 bp, Homo sapien
atgcgctcgctggagtcctcatcct

SEQ ID NO: 21831 - DNA, 25 bp, Homo sapien
ctgttaataaacatgcgctcgctgg

SEQ ID NO: 21832 - DNA, 25 bp, Homo sapien
ggagcgccacgctgctctgttaata

SEQ ID NO: 21833 - DNA, 25 bp, Homo sapien
ccggtgggcagaagccataaatagc

SEQ ID NO: 21834 - DNA, 25 bp, Homo sapien
tgaaacagcttgaacaggcaggccg

SEQ ID NO: 21835 - DNA, 25 bp, Homo sapien
ttccggtggctgacaatatgaaaca

SEQ ID NO: 21836 - DNA, 25 bp, Homo sapien
tttcaggttgtttgattccggtggc

SEQ ID NO: 21837 - DNA, 25 bp, Homo sapien
ccgcggaggccttatttcaggttgt

SEQ ID NO: 21838 - DNA, 25 bp, Homo sapien
gtttccttggcagcccttatttgta

SEQ ID NO: 21839 - DNA, 25 bp, Homo sapien
tccttggcagcccttatttgtaagg

SEQ ID NO: 21840 - DNA, 25 bp, Homo sapien
tggcagcccttatttgtaaggcaaa

SEQ ID NO: 21841 - DNA, 25 bp, Homo sapien
gcagcccttatttgtaaggcaaatc

SEQ ID NO: 21842 - DNA, 25 bp, Homo sapien
agcccttatttgtaaggcaaatcca

SEQ ID NO: 21843 - DNA, 25 bp, Homo sapien
tttgtaaggcaaatccaggcccgcg

SEQ ID NO: 21844 - DNA, 25 bp, Homo sapien
taaggcaaatccaggcccgcgcaca

SEQ ID NO: 21845 - DNA, 25 bp, Homo sapien
tgtaaggcaaatccaggcccgcgca

SEQ ID NO: 21846 - DNA, 25 bp, Homo sapien
tgatgaaagatgcaccttaggtgtc

SEQ ID NO: 21847 - DNA, 25 bp, Homo sapien
gaaggcggctgtgtacagaacagca

SEQ ID NO: 21848 - DNA, 25 bp, Homo sapien
tgtgtacagaacagcacgccctggg

SEQ ID NO: 21849 - DNA, 25 bp, Homo sapien
aacagcacgccctgggaagcaaagg

SEQ ID NO: 21850 - DNA, 25 bp, Homo sapien
aaaggcctgtcggagaagttgatga

SEQ ID NO: 21851 - DNA, 25 bp, Homo sapien
cggagaagttgatgaaagatgcacc

SEQ ID NO: 21852 - DNA, 25 bp, Homo sapien
gtcaggataagcttgcagagtggcc

SEQ ID NO: 21853 - DNA, 25 bp, Homo sapien
cgccgtcctgaactttctcgggagg

SEQ ID NO: 21854 - DNA, 25 bp, Homo sapien
cttgcagcagcgattgcagcagttg

SEQ ID NO: 21855 - DNA, 25 bp, Homo sapien
agtgaagccacattgccaaacttgc

SEQ ID NO: 21856 - DNA, 25 bp, Homo sapien
aacacatgtgtaagagccgcggagg

SEQ ID NO: 21857 - DNA, 25 bp, Homo sapien
cgccgcctctcgcaatattgcaata

SEQ ID NO: 21858 - DNA, 25 bp, Homo sapien
ttattccgcctgaacaatccggccg

SEQ ID NO: 21859 - DNA, 25 bp, Homo sapien
ttttgctctgtcagtaacacatgtg

SEQ ID NO: 21860 - DNA, 25 bp, Homo sapien
gagcggcttcgctcgcatttcaccg

SEQ ID NO: 21861 - DNA, 25 bp, Homo sapien
gagtctcgtttcagtcatccctttg

SEQ ID NO: 21862 - DNA, 25 bp, Homo sapien
ggagcctgctctcggagttttgaca

SEQ ID NO: 21863 - DNA, 25 bp, Homo sapien
tgacagtaccggagctgaaattgtc

SEQ ID NO: 21864 - DNA, 25 bp, Homo sapien
tctctccggcgattactaacttttg

SEQ ID NO: 21865 - DNA, 25 bp, Homo sapien
cgccctctgcagaccatggtgaatc

SEQ ID NO: 21866 - DNA, 25 bp, Homo sapien
attgcggaccgctttctgctctatg

SEQ ID NO: 21867 - DNA, 25 bp, Homo sapien
tgctctatgccatggacagctattg

SEQ ID NO: 21868 - DNA, 25 bp, Homo sapien
agctattggcacagccggtgcctca

SEQ ID NO: 21869 - DNA, 25 bp, Homo sapien
ctgaaattgtcagcggcggcaagcg

SEQ ID NO: 21870 - DNA, 25 bp, Homo sapien
tggccgaaccgagagagaacgccgc

SEQ ID NO: 21871 - DNA, 25 bp, Homo sapien
cccaacgtgttcagagggcttgtcc

SEQ ID NO: 21872 - DNA, 25 bp, Homo sapien
tcgctgggcctccactcaatgcaaa

SEQ ID NO: 21873 - DNA, 25 bp, Homo sapien
cagtgcaagccttgttcgccgcagg

SEQ ID NO: 21874 - DNA, 25 bp, Homo sapien
cacaggacgcctcacgcagcataaa

SEQ ID NO: 21875 - DNA, 25 bp, Homo sapien
agagcaaaccgcgttcgtcgcaggc

SEQ ID NO: 21876 - DNA, 25 bp, Homo sapien
acctggcccagactcgtgaggcgac

SEQ ID NO: 21877 - DNA, 25 bp, Homo sapien
acagaacgcccgctcagagtaaacc

SEQ ID NO: 21878 - DNA, 25 bp, Homo sapien
gcgccccaagtagcttcggaaactc

SEQ ID NO: 21879 - DNA, 25 bp, Homo sapien
tctcttcctcgaaccgtctttcctc

SEQ ID NO: 21880 - DNA, 25 bp, Homo sapien
cacctcgggcccgaagactggcgcg

SEQ ID NO: 21881 - DNA, 25 bp, Homo sapien
actggcgcggaaagtgcagcgagag

SEQ ID NO: 21882 - DNA, 25 bp, Homo sapien
agcgagaggaggaagttcggagacc

SEQ ID NO: 21883 - DNA, 25 bp, Homo sapien
cctcgctccctaggcggccagcacc

SEQ ID NO: 21884 - DNA, 25 bp, Homo sapien
gcgagcgggtcgcgctttctttccc

SEQ ID NO: 21885 - DNA, 25 bp, Homo sapien
ccgggctccactcgggcggttcacg

SEQ ID NO: 21886 - DNA, 25 bp, Homo sapien
agatgacggcgaacttaaatttggg

SEQ ID NO: 21887 - DNA, 25 bp, Homo sapien
cctgtccgtatgcaaggcgttagcg

SEQ ID NO: 21888 - DNA, 25 bp, Homo sapien
taaccggttcctttgcggatgctga

SEQ ID NO: 21889 - DNA, 25 bp, Homo sapien
cggatgctgaccacggggtcagtta

SEQ ID NO: 21890 - DNA, 25 bp, Homo sapien
gggtcagttagcaatcgggcctcaa

SEQ ID NO: 21891 - DNA, 25 bp, Homo sapien
accttagagctagccgagacccggg

SEQ ID NO: 21892 - DNA, 25 bp, Homo sapien
caagttctcggggtcagataaccgg

SEQ ID NO: 21893 - DNA, 25 bp, Homo sapien
gccgaagacccgaggactgctgcga

SEQ ID NO: 21894 - DNA, 25 bp, Homo sapien
tcaaatgccagtcggctgcgtgccc

SEQ ID NO: 21895 - DNA, 25 bp, Homo sapien
aaggtggtgggtgactcaaatgcca

SEQ ID NO: 21896 - DNA, 25 bp, Homo sapien
aaacaattagctggccggctgggga

SEQ ID NO: 21897 - DNA, 25 bp, Homo sapien
gggctcacttctttgacgccgaata

SEQ ID NO: 21898 - DNA, 25 bp, Homo sapien
caccaggccgggctcacttctttga

SEQ ID NO: 21899 - DNA, 25 bp, Homo sapien
cccaggatgagcctcgatggcgaga

SEQ ID NO: 21900 - DNA, 25 bp, Homo sapien
taaccgcgccgaggactgcagcagg

SEQ ID NO: 21901 - DNA, 25 bp, Homo sapien
gcgcgctcgctccttaaccacttcg

SEQ ID NO: 21902 - DNA, 25 bp, Homo sapien
cgagttctagcgttcacagtgaagc

SEQ ID NO: 21903 - DNA, 25 bp, Homo sapien
ttgattctgcctaccagaggggacc

SEQ ID NO: 21904 - DNA, 25 bp, Homo sapien
ggcctgccaccgctttggtttgatt

SEQ ID NO: 21905 - DNA, 25 bp, Homo sapien
ccgggatgtcactcgggaaatgctt

SEQ ID NO: 21906 - DNA, 25 bp, Homo sapien
cctagcccgctaagtgcggaaactc

SEQ ID NO: 21907 - DNA, 25 bp, Homo sapien
gctcacggaactgcaggtaagggcc

SEQ ID NO: 21908 - DNA, 25 bp, Homo sapien
gcctccatgaatccctagttgtttt

SEQ ID NO: 21909 - DNA, 25 bp, Homo sapien
cgctctcgatgaaccggacggaata

SEQ ID NO: 21910 - DNA, 25 bp, Homo sapien
acgcagtcgtagcagagcagggcta

SEQ ID NO: 21911 - DNA, 25 bp, Homo sapien
tttatagacgactcacccacgcagt

SEQ ID NO: 21912 - DNA, 25 bp, Homo sapien
acgcgcagagatgagtttttataga

SEQ ID NO: 21913 - DNA, 25 bp, Homo sapien
gcggtgcccgcaacaagacacaaca

SEQ ID NO: 21914 - DNA, 25 bp, Homo sapien
taaccggctggtagacgccatcttc

SEQ ID NO: 21915 - DNA, 25 bp, Homo sapien
acgtcacgtgctttgcgatttctta

SEQ ID NO: 21916 - DNA, 25 bp, Homo sapien
ggccaagaacagtgagatcccatac

SEQ ID NO: 21917 - DNA, 25 bp, Homo sapien
ctcggcgggacatactaaccggctg

SEQ ID NO: 21918 - DNA, 25 bp, Homo sapien
acggccctagtcagtccgcacggaa

SEQ ID NO: 21919 - DNA, 25 bp, Homo sapien
ctctaggctggaagagactggatga

SEQ ID NO: 21920 - DNA, 25 bp, Homo sapien
tcacctatccggtgcgggaacctcg

SEQ ID NO: 21921 - DNA, 25 bp, Homo sapien
tggaggccagtcacctcggcgcctt

SEQ ID NO: 21922 - DNA, 25 bp, Homo sapien
ctaggctcgagtcccgactgggctt

SEQ ID NO: 21923 - DNA, 25 bp, Homo sapien
caaactgctaatctagggccgactc

SEQ ID NO: 21924 - DNA, 25 bp, Homo sapien
acagggattgactctggggtttgca

SEQ ID NO: 21925 - DNA, 25 bp, Homo sapien
tttgcactcagtgcgcgctttggcg

SEQ ID NO: 21926 - DNA, 25 bp, Homo sapien
ggtgcggttacctgttcacgcctca

SEQ ID NO: 21927 - DNA, 25 bp, Homo sapien
tcacagcaggagcagctaccgaagc

SEQ ID NO: 21928 - DNA, 25 bp, Homo sapien
cacccgcgaacttagtcagcggttc

SEQ ID NO: 21929 - DNA, 25 bp, Homo sapien
gataggtgagtcactggctcccgca

SEQ ID NO: 21930 - DNA, 25 bp, Homo sapien
ctttgtttccagcagtgataggtga

SEQ ID NO: 21931 - DNA, 25 bp, Homo sapien
gagatggcagctgcgctttgtttcc

SEQ ID NO: 21932 - DNA, 25 bp, Homo sapien
cacacgcggtgtagtgccgaagtca

SEQ ID NO: 21933 - DNA, 25 bp, Homo sapien
gaacgcgtcgcgtcacaatggagcc

SEQ ID NO: 21934 - DNA, 25 bp, Homo sapien
ccggctctcagacaggcagaatgtg

SEQ ID NO: 21935 - DNA, 25 bp, Homo sapien
agtcgacactctcgcgcccggaggt

SEQ ID NO: 21936 - DNA, 25 bp, Homo sapien
tcgtgaagcggagagaggatttctc

SEQ ID NO: 21937 - DNA, 25 bp, Homo sapien
tggtattagacgcagccgaatcctc

SEQ ID NO: 21938 - DNA, 25 bp, Homo sapien
gttttccgcgcattgtgagggatga

SEQ ID NO: 21939 - DNA, 25 bp, Homo sapien
gggaaccttccgctactgcggctca

SEQ ID NO: 21940 - DNA, 25 bp, Homo sapien
gaggatctcagcctggcgcccaacg

SEQ ID NO: 21941 - DNA, 25 bp, Homo sapien
ggcgatcgttgttctttcctacctc

SEQ ID NO: 21942 - DNA, 25 bp, Homo sapien
aaggctctgctgagtctcctcttta

SEQ ID NO: 21943 - DNA, 25 bp, Homo sapien
cggggagacacacccttcctgcaga

SEQ ID NO: 21944 - DNA, 25 bp, Homo sapien
tggtctgttagctggactctatctc

SEQ ID NO: 21945 - DNA, 25 bp, Homo sapien
tgtatcgaatccatgcacctcgctg

SEQ ID NO: 21946 - DNA, 25 bp, Homo sapien
ctccgtcgaactgcagtggtctgtt

SEQ ID NO: 21947 - DNA, 25 bp, Homo sapien
tcgctgccaattcgtcttccggacg

SEQ ID NO: 21948 - DNA, 25 bp, Homo sapien
gacgctcgttgtcagtcctctgtga

SEQ ID NO: 21949 - DNA, 25 bp, Homo sapien
aggcgtatcgccagccacgacaagg

SEQ ID NO: 21950 - DNA, 25 bp, Homo sapien
ctcgcaatcacatggaggcccgggc

SEQ ID NO: 21951 - DNA, 25 bp, Homo sapien
cctgggagattgttccgctttctgc

SEQ ID NO: 21952 - DNA, 25 bp, Homo sapien
cccggagtccatgttacgctttgtc

SEQ ID NO: 21953 - DNA, 25 bp, Homo sapien
gccaccggagaaagcgctcgcaatc

SEQ ID NO: 21954 - DNA, 25 bp, Homo sapien
cgatggttatgtaggctgccgttct

SEQ ID NO: 21955 - DNA, 25 bp, Homo sapien
tggacgcttgcgagagcattacggc

SEQ ID NO: 21956 - DNA, 25 bp, Homo sapien
ctgaccatgcctcgcagctaactgg

SEQ ID NO: 21957 - DNA, 25 bp, Homo sapien
ccctcgttacagagtcatgtgctgc

SEQ ID NO: 21958 - DNA, 25 bp, Homo sapien
gtctataacgtgctgccgggtctca

SEQ ID NO: 21959 - DNA, 25 bp, Homo sapien
cgtggagtccattgatctaggtact

SEQ ID NO: 21960 - DNA, 25 bp, Homo sapien
gcccaccatggcagttatgcaagcg

SEQ ID NO: 21961 - DNA, 25 bp, Homo sapien
ttcaaacaggaagtgcacggctgtc

SEQ ID NO: 21962 - DNA, 25 bp, Homo sapien
cacggagcactgctagtgtcggatc

SEQ ID NO: 21963 - DNA, 25 bp, Homo sapien
ggtctctgccaaactctggctgctg

SEQ ID NO: 21964 - DNA, 25 bp, Homo sapien
tgcgaggactccactagggcgcttt

SEQ ID NO: 21965 - DNA, 25 bp, Homo sapien
cgctgccgacacttggatctctcta

SEQ ID NO: 21966 - DNA, 25 bp, Homo sapien
gattgaatgtggggacgcaaaagcc

SEQ ID NO: 21967 - DNA, 25 bp, Homo sapien
cttcaccagaggataaaccgaggca

SEQ ID NO: 21968 - DNA, 25 bp, Homo sapien
gtggcgtctgcttcaccagaggata

SEQ ID NO: 21969 - DNA, 25 bp, Homo sapien
agctgctcacagactgtggcgtctg

SEQ ID NO: 21970 - DNA, 25 bp, Homo sapien
acagagctgctcacagactgtggcg

SEQ ID NO: 21971 - DNA, 25 bp, Homo sapien
acagtagccagtgcggaggggcaca

SEQ ID NO: 21972 - DNA, 25 bp, Homo sapien
gcaaaagccgaccggcgcccgagga

SEQ ID NO: 21973 - DNA, 25 bp, Homo sapien
aggcaagtgcttcccctcgagtgca

SEQ ID NO: 21974 - DNA, 25 bp, Homo sapien
gagggagaggcccaactgcctcgtt

SEQ ID NO: 21975 - DNA, 25 bp, Homo sapien
cgcaggtaatggctcctggccttcc

SEQ ID NO: 21976 - DNA, 25 bp, Homo sapien
cggcgcagcgcaggtaatggctcct

SEQ ID NO: 21977 - DNA, 25 bp, Homo sapien
gtgacatacgcggtcctgcgccctc

SEQ ID NO: 21978 - DNA, 25 bp, Homo sapien
caactgcctcgttggtcgcgcggcg

SEQ ID NO: 21979 - DNA, 25 bp, Homo sapien
aggcccaactgcctcgttggtcgcg

SEQ ID NO: 21980 - DNA, 25 bp, Homo sapien
cgggacagcgaggtcgcgctcgcgc

SEQ ID NO: 21981 - DNA, 25 bp, Homo sapien
gagaggcccaactgcctcgttggtc

SEQ ID NO: 21982 - DNA, 25 bp, Homo sapien
gtacactcggcttgctttcccacaa

SEQ ID NO: 21983 - DNA, 25 bp, Homo sapien
ggggtctgtttaccgtctcaagatg

SEQ ID NO: 21984 - DNA, 25 bp, Homo sapien
ccatggacttcgaggacggtaagcg

SEQ ID NO: 21985 - DNA, 25 bp, Homo sapien
gtcagccaatagcaggccgcgccga

SEQ ID NO: 21986 - DNA, 25 bp, Homo sapien
ggctccagagggtcagcacctccga

SEQ ID NO: 21987 - DNA, 25 bp, Homo sapien
ccaggttcaaacatggcgggccgca

SEQ ID NO: 21988 - DNA, 25 bp, Homo sapien
gcttctttcgctcttgccaggttca

SEQ ID NO: 21989 - DNA, 25 bp, Homo sapien
acctccgagcgtgacagcggacctg

SEQ ID NO: 21990 - DNA, 25 bp, Homo sapien
gcgactcgctgtcccagaccagata

SEQ ID NO: 21991 - DNA, 25 bp, Homo sapien
gggaatccatcagctccacaaagtg

SEQ ID NO: 21992 - DNA, 25 bp, Homo sapien
cgctctcgcgaaggtcctctttttt

SEQ ID NO: 21993 - DNA, 25 bp, Homo sapien
aaatccctggctgcgacgtgtatgc

SEQ ID NO: 21994 - DNA, 25 bp, Homo sapien
cactgagggcctcttcactaaagaa

SEQ ID NO: 21995 - DNA, 25 bp, Homo sapien
tgacagggcccttttatcgtaaatc

SEQ ID NO: 21996 - DNA, 25 bp, Homo sapien
ggtacgcgccgagcaagaacccgca

SEQ ID NO: 21997 - DNA, 25 bp, Homo sapien
ccgagctgtgcgaacagaggaagta

SEQ ID NO: 21998 - DNA, 25 bp, Homo sapien
tgtcatcgctgcccagcgcttcgga

SEQ ID NO: 21999 - DNA, 25 bp, Homo sapien
tcactaggacaagcggctccgcatg

SEQ ID NO: 22000 - DNA, 25 bp, Homo sapien
ggactgagaaggcaacgatcaaagc

SEQ ID NO: 22001 - DNA, 25 bp, Homo sapien
aggcaacgatcaaagccgccacaag

SEQ ID NO: 22002 - DNA, 25 bp, Homo sapien
cgccacaagggtttgttagctggcc

SEQ ID NO: 22003 - DNA, 25 bp, Homo sapien
ggcgtcctaattgctcgtcccacag

SEQ ID NO: 22004 - DNA, 25 bp, Homo sapien
cagcagaacagctgcgaggctcgag

SEQ ID NO: 22005 - DNA, 25 bp, Homo sapien
cgcagcacaacgaactcactaggac

SEQ ID NO: 22006 - DNA, 25 bp, Homo sapien
ggaatcctcccgcttgtcgagtttg

SEQ ID NO: 22007 - DNA, 25 bp, Homo sapien
tgtcctcctgctcgagctttggcct

SEQ ID NO: 22008 - DNA, 25 bp, Homo sapien
gcctgaagctctcgtgcactgcgtt

SEQ ID NO: 22009 - DNA, 25 bp, Homo sapien
gcgggactcaccgtggcatttgatg

SEQ ID NO: 22010 - DNA, 25 bp, Homo sapien
tttgctgtcgcccaagatgtcctta

SEQ ID NO: 22011 - DNA, 25 bp, Homo sapien
tttgatgtcgctctgggaatcctcc

SEQ ID NO: 22012 - DNA, 25 bp, Homo sapien
tgcacatgccgccagaggtttgctg

SEQ ID NO: 22013 - DNA, 25 bp, Homo sapien
gtcgagtttggtcttgctgtcctcc

SEQ ID NO: 22014 - DNA, 25 bp, Homo sapien
cccgaaccagcgaagaaagctatcg

SEQ ID NO: 22015 - DNA, 25 bp, Homo sapien
cattcatcatgcctgggctgcctga

SEQ ID NO: 22016 - DNA, 25 bp, Homo sapien
agcgggcggaaatctccattcatca

SEQ ID NO: 22017 - DNA, 25 bp, Homo sapien
ctggcactggacaaaatcgtgtcta

SEQ ID NO: 22018 - DNA, 25 bp, Homo sapien
tctattccaaaactcgacccgctgg

SEQ ID NO: 22019 - DNA, 25 bp, Homo sapien
cccttccattgtcattgctacatga

SEQ ID NO: 22020 - DNA, 25 bp, Homo sapien
ttgctacatgaggtccacgccactc

SEQ ID NO: 22021 - DNA, 25 bp, Homo sapien
tgcctgggctgcctgaactggcact

SEQ ID NO: 22022 - DNA, 25 bp, Homo sapien
agggacttacctttaggctccagcg

SEQ ID NO: 22023 - DNA, 25 bp, Homo sapien
gggctctgatttctcgcccgacgaa

SEQ ID NO: 22024 - DNA, 25 bp, Homo sapien
aaagtgtgtcacttcaggcgccgga

SEQ ID NO: 22025 - DNA, 25 bp, Homo sapien
cgcgcgggaatagtccgaagacatt

SEQ ID NO: 22026 - DNA, 25 bp, Homo sapien
gattcgcccgttttcttaagtcaga

SEQ ID NO: 22027 - DNA, 25 bp, Homo sapien
tggtcccggtgtccacaatcacgag

SEQ ID NO: 22028 - DNA, 25 bp, Homo sapien
tttgagaacccgcacatccctgagc

SEQ ID NO: 22029 - DNA, 25 bp, Homo sapien
gcgttcgcttgtaatccggctgctg

SEQ ID NO: 22030 - DNA, 25 bp, Homo sapien
ccgaaacacagacggtagacttgtg

SEQ ID NO: 22031 - DNA, 25 bp, Homo sapien
tcggccgcggttaccgaaacacaga

SEQ ID NO: 22032 - DNA, 25 bp, Homo sapien
tcaaatgcctttggcgcgggaactg

SEQ ID NO: 22033 - DNA, 25 bp, Homo sapien
gagcggggttggatcaaatgccttt

SEQ ID NO: 22034 - DNA, 25 bp, Homo sapien
gggcagctctcgctcttctcggaag

SEQ ID NO: 22035 - DNA, 25 bp, Homo sapien
agacttgtggaggtggcttatccga

SEQ ID NO: 22036 - DNA, 25 bp, Homo sapien
gacggaggcaaggagatgcacaatc

SEQ ID NO: 22037 - DNA, 25 bp, Homo sapien
ggagatgcacaatccgggcagctct

SEQ ID NO: 22038 - DNA, 25 bp, Homo sapien
gtctctcccaggtctacagaatacg

SEQ ID NO: 22039 - DNA, 25 bp, Homo sapien
ccgttttctgcctttggtgcaggcg

SEQ ID NO: 22040 - DNA, 25 bp, Homo sapien
ttcccagataccgtgagaggccttg

SEQ ID NO: 22041 - DNA, 25 bp, Homo sapien
gcagcctcggtcagctttctcagtc

SEQ ID NO: 22042 - DNA, 25 bp, Homo sapien
tacgccactggacaagtgcctaagc

SEQ ID NO: 22043 - DNA, 25 bp, Homo sapien
cagcagcagttaacaccgacgtttc

SEQ ID NO: 22044 - DNA, 25 bp, Homo sapien
tcctagaaagagctcccgcaaagcg

SEQ ID NO: 22045 - DNA, 25 bp, Homo sapien
agtgcctaagcagcgacttctggtc

SEQ ID NO: 22046 - DNA, 25 bp, Homo sapien
atccgggcgaaaacgattgtactgc

SEQ ID NO: 22047 - DNA, 25 bp, Homo sapien
tccgatcgtttagagctgctgtttt

SEQ ID NO: 22048 - DNA, 25 bp, Homo sapien
tgatttccttcagagccagcatatg

SEQ ID NO: 22049 - DNA, 25 bp, Homo sapien
ctggagggactgcaagcaattcgtc

SEQ ID NO: 22050 - DNA, 25 bp, Homo sapien
ccggagaggtctatacaatcactta

SEQ ID NO: 22051 - DNA, 25 bp, Homo sapien
gcccagctcagcgaagctcttgtga

SEQ ID NO: 22052 - DNA, 25 bp, Homo sapien
agctacaacgcggaaggcctctgca

SEQ ID NO: 22053 - DNA, 25 bp, Homo sapien
cccaagttcatgcttcagagaggta

SEQ ID NO: 22054 - DNA, 25 bp, Homo sapien
cagatgatcagccagcgtcccaaaa

SEQ ID NO: 22055 - DNA, 25 bp, Homo sapien
agctcagacaacgtccagcaggagg

SEQ ID NO: 22056 - DNA, 25 bp, Homo sapien
tcttctgcccaagcgaaatccaggg

SEQ ID NO: 22057 - DNA, 25 bp, Homo sapien
gggctgagtccctttccctattcca

SEQ ID NO: 22058 - DNA, 25 bp, Homo sapien
tctacctcagggttagccagcggcc

SEQ ID NO: 22059 - DNA, 25 bp, Homo sapien
gacggcatccagatcgggatcctga

SEQ ID NO: 22060 - DNA, 25 bp, Homo sapien
cgggatcgcctcctctcagatgatc

SEQ ID NO: 22061 - DNA, 25 bp, Homo sapien
gggtccggcctacaatctcttcttc

SEQ ID NO: 22062 - DNA, 25 bp, Homo sapien
cagcaaccgggatgcagcgtctcga

SEQ ID NO: 22063 - DNA, 25 bp, Homo sapien
acgggcaggcgagctcgagtccctc

SEQ ID NO: 22064 - DNA, 25 bp, Homo sapien
ggctcagactgtcgcttccgagcga

SEQ ID NO: 22065 - DNA, 25 bp, Homo sapien
gcttccgagcgacctgggttctcgc

SEQ ID NO: 22066 - DNA, 25 bp, Homo sapien
gctgcctccaggaagttcgccctga

SEQ ID NO: 22067 - DNA, 25 bp, Homo sapien
aggaagttcgccctgaccacctctg

SEQ ID NO: 22068 - DNA, 25 bp, Homo sapien
ccggactcttgtccactcccagaga

SEQ ID NO: 22069 - DNA, 25 bp, Homo sapien
caccactgccgggaatacgtggcag

SEQ ID NO: 22070 - DNA, 25 bp, Homo sapien
cccgggcgcactgttgctggtatat

SEQ ID NO: 22071 - DNA, 25 bp, Homo sapien
gggcgcaccgttgctggtatatgcg

SEQ ID NO: 22072 - DNA, 25 bp, Homo sapien
gcgcaccgttgctggtatatgcggt

SEQ ID NO: 22073 - DNA, 25 bp, Homo sapien
actgttgctggtatatgcggtggtc

SEQ ID NO: 22074 - DNA, 25 bp, Homo sapien
cgggcgcacctttgctggtatatgc

SEQ ID NO: 22075 - DNA, 25 bp, Homo sapien
accgttgctggtatatgcggtggtc

SEQ ID NO: 22076 - DNA, 25 bp, Homo sapien
cgcacctttgctggtatatgcgggg

SEQ ID NO: 22077 - DNA, 25 bp, Homo sapien
cccgggcgcaccgttgctggtatat

SEQ ID NO: 22078 - DNA, 25 bp, Homo sapien
ccgcgggagctgttcctacccaggt

SEQ ID NO: 22079 - DNA, 25 bp, Homo sapien
gcccacaggagtccgacagcaggag

SEQ ID NO: 22080 - DNA, 25 bp, Homo sapien
cgggcccacaggagtccgacagcag

SEQ ID NO: 22081 - DNA, 25 bp, Homo sapien
gcagacacgccaacacacgcagctg

SEQ ID NO: 22082 - DNA, 25 bp, Homo sapien
gcaggctgcacattcccggcccatg

SEQ ID NO: 22083 - DNA, 25 bp, Homo sapien
gagctgttcctacccaggtcaccgg

SEQ ID NO: 22084 - DNA, 25 bp, Homo sapien
cgatgccggaggcgagcagactcca

SEQ ID NO: 22085 - DNA, 25 bp, Homo sapien
ggcacaggggctccgtcatggaaac

SEQ ID NO: 22086 - DNA, 25 bp, Homo sapien
ggagaatactcacgctgggcccagc

SEQ ID NO: 22087 - DNA, 25 bp, Homo sapien
tctcacctcaaataaacgggcgctg

SEQ ID NO: 22088 - DNA, 25 bp, Homo sapien
tcccatccagcgatagacaggcgcg

SEQ ID NO: 22089 - DNA, 25 bp, Homo sapien
tggcacacacttttgctggaaactg

SEQ ID NO: 22090 - DNA, 25 bp, Homo sapien
tgctggaaactgaaatcgaagtctc

SEQ ID NO: 22091 - DNA, 25 bp, Homo sapien
ccaactgcaacgtgggaaccagagc

SEQ ID NO: 22092 - DNA, 25 bp, Homo sapien
ccgcaacaggagtagggacattttt

SEQ ID NO: 22093 - DNA, 25 bp, Homo sapien
gccagataggcaagaacccgcaaca

SEQ ID NO: 22094 - DNA, 25 bp, Homo sapien
tctgtacgctactcggctccagcgg

SEQ ID NO: 22095 - DNA, 25 bp, Homo sapien
ctgaaactcacagtttggtgccgtg

SEQ ID NO: 22096 - DNA, 25 bp, Homo sapien
gggtcccagcgaatctgaccaaata

SEQ ID NO: 22097 - DNA, 25 bp, Homo sapien
tgggacccagcctagggcgtagctc

SEQ ID NO: 22098 - DNA, 25 bp, Homo sapien
tgcgtccttttggatggctgggacc

SEQ ID NO: 22099 - DNA, 25 bp, Homo sapien
cgccatcttagcctgtgcggcaaaa

SEQ ID NO: 22100 - DNA, 25 bp, Homo sapien
tctgggccaattagacaaacgaggg

SEQ ID NO: 22101 - DNA, 25 bp, Homo sapien
cgggctccttgtgtagcaccaactc

SEQ ID NO: 22102 - DNA, 25 bp, Homo sapien
ccggcagacggctctagagatcgac

SEQ ID NO: 22103 - DNA, 25 bp, Homo sapien
accgctgtgaaacccgcggctcaga

SEQ ID NO: 22104 - DNA, 25 bp, Homo sapien
gggcgccacacaccggaacacaaga

SEQ ID NO: 22105 - DNA, 25 bp, Homo sapien
ggagacgcctggtgaccaacaactc

SEQ ID NO: 22106 - DNA, 25 bp, Homo sapien
cggctcagacagatgggtacgtccc

SEQ ID NO: 22107 - DNA, 25 bp, Homo sapien
cggacagctcctaggccagtcgagc

SEQ ID NO: 22108 - DNA, 25 bp, Homo sapien
aggcctcaccgctttctgactggaa

SEQ ID NO: 22109 - DNA, 25 bp, Homo sapien
accgaacaccaatcagccgacttta

SEQ ID NO: 22110 - DNA, 25 bp, Homo sapien
taaccgctcttctagctggccaagg

SEQ ID NO: 22111 - DNA, 25 bp, Homo sapien
tggccggcggattcccattcattca

SEQ ID NO: 22112 - DNA, 25 bp, Homo sapien
tctggatcgtgacttcggttttctc

SEQ ID NO: 22113 - DNA, 25 bp, Homo sapien
ccagggtcgtatcagttctccgtca

SEQ ID NO: 22114 - DNA, 25 bp, Homo sapien
ctccgtcaacttgcttggggccttg

SEQ ID NO: 22115 - DNA, 25 bp, Homo sapien
tggcgcttcctgtcagtggcgaaaa

SEQ ID NO: 22116 - DNA, 25 bp, Homo sapien
tgcgcaaacgcccagtagcggaatc

SEQ ID NO: 22117 - DNA, 25 bp, Homo sapien
cgcactaagcatctggttcggtctc

SEQ ID NO: 22118 - DNA, 25 bp, Homo sapien
cacgttggcgatacagaagcttcga

SEQ ID NO: 22119 - DNA, 25 bp, Homo sapien
aaggtgatcacctcgcttttagggc

SEQ ID NO: 22120 - DNA, 25 bp, Homo sapien
cttcgaagcagcatgcggtgggtca

SEQ ID NO: 22121 - DNA, 25 bp, Homo sapien
agcggacaggctgcctaatggccaa

SEQ ID NO: 22122 - DNA, 25 bp, Homo sapien
cctaatggccaacctgggcgaggcg

SEQ ID NO: 22123 - DNA, 25 bp, Homo sapien
cttggacgacggtcttccgcctgga

SEQ ID NO: 22124 - DNA, 25 bp, Homo sapien
gcaggctcattgtgtctgcgacagg

SEQ ID NO: 22125 - DNA, 25 bp, Homo sapien
ttgtcccgagttttcgcagaacacg

SEQ ID NO: 22126 - DNA, 25 bp, Homo sapien
cagtgcgcctcgagtcctcgcaggg

SEQ ID NO: 22127 - DNA, 25 bp, Homo sapien
ggatgctgctggagtgcttgaaccc

SEQ ID NO: 22128 - DNA, 25 bp, Homo sapien
ctggagtgcttgaaccccgaggcct

SEQ ID NO: 22129 - DNA, 25 bp, Homo sapien
agccttgccccctcgtgatcatgga

SEQ ID NO: 22130 - DNA, 25 bp, Homo sapien
gattggctagccttgccccctcgtg

SEQ ID NO: 22131 - DNA, 25 bp, Homo sapien
tggccaccccggattggctagcctt

SEQ ID NO: 22132 - DNA, 25 bp, Homo sapien
ccctcgtgatcatggaagtgggcgg

SEQ ID NO: 22133 - DNA, 25 bp, Homo sapien
agtgcgcctcgagtcctcgcagggc

SEQ ID NO: 22134 - DNA, 25 bp, Homo sapien
gtcgcgggaccatccagttctggcc

SEQ ID NO: 22135 - DNA, 25 bp, Homo sapien
gggaccatccagttctggccccgtg

SEQ ID NO: 22136 - DNA, 25 bp, Homo sapien
aggacgccgtctggtcgctgccctg

SEQ ID NO: 22137 - DNA, 25 bp, Homo sapien
atgtgtcgcgggaccatccagttct

SEQ ID NO: 22138 - DNA, 25 bp, Homo sapien
agacacgatgtgtcgcgggaccatc

SEQ ID NO: 22139 - DNA, 25 bp, Homo sapien
tctaaagctgcagacacgatgtgtc

SEQ ID NO: 22140 - DNA, 25 bp, Homo sapien
gcctctaaagctgcagacacgatgt

SEQ ID NO: 22141 - DNA, 25 bp, Homo sapien
cccgtgcaggaggacaggacgccgt

SEQ ID NO: 22142 - DNA, 25 bp, Homo sapien
gccactttggtataggtgggaatta

SEQ ID NO: 22143 - DNA, 25 bp, Homo sapien
tctgagcgcgtggaaaatctgcttc

SEQ ID NO: 22144 - DNA, 25 bp, Homo sapien
ttacagctgggcagaaatgaccgcg

SEQ ID NO: 22145 - DNA, 25 bp, Homo sapien
tcggaacagtttgcagctggcggct

SEQ ID NO: 22146 - DNA, 25 bp, Homo sapien
aaatgaccgcggtagcactcctggg

SEQ ID NO: 22147 - DNA, 25 bp, Homo sapien
cgtctttcgcttctgcccgcgtggg

SEQ ID NO: 22148 - DNA, 25 bp, Homo sapien
cgcagatctcgagtagttggcctcc

SEQ ID NO: 22149 - DNA, 25 bp, Homo sapien
ggctcgctgattgggtgttatttta

SEQ ID NO: 22150 - DNA, 25 bp, Homo sapien
tattccggaggaatgggatcccagg

SEQ ID NO: 22151 - DNA, 25 bp, Homo sapien
aggcgccttgttgcgaacgcaggta

SEQ ID NO: 22152 - DNA, 25 bp, Homo sapien
tgtccggaccagacccggtaactca

SEQ ID NO: 22153 - DNA, 25 bp, Homo sapien
ccaagagctgggattgtattccgga

SEQ ID NO: 22154 - DNA, 25 bp, Homo sapien
ttctcaggtgagtcagggatgcact

SEQ ID NO: 22155 - DNA, 25 bp, Homo sapien
ctctgagctgcggttactgtgtcca

SEQ ID NO: 22156 - DNA, 25 bp, Homo sapien
agcttaccaggctggcttgctctga

SEQ ID NO: 22157 - DNA, 25 bp, Homo sapien
taactcagtgcgagaggctttgcgc

SEQ ID NO: 22158 - DNA, 25 bp, Homo sapien
ctgggccacggcaattgactgcgaa

SEQ ID NO: 22159 - DNA, 25 bp, Homo sapien
gactgcgaacccacaacaaaccatt

SEQ ID NO: 22160 - DNA, 25 bp, Homo sapien
cgaccctggccggtaagtaggcact

SEQ ID NO: 22161 - DNA, 25 bp, Homo sapien
tgtgtccagcggagatccacccgca

SEQ ID NO: 22162 - DNA, 25 bp, Homo sapien
cacccgcagcaagttggaggaaagc

SEQ ID NO: 22163 - DNA, 25 bp, Homo sapien
tgccctccttcactcgctgggaaga

SEQ ID NO: 22164 - DNA, 25 bp, Homo sapien
ctgtgcttcccttcgggacgaggag

SEQ ID NO: 22165 - DNA, 25 bp, Homo sapien
ccgaatgctgctcgagcctgtgctt

SEQ ID NO: 22166 - DNA, 25 bp, Homo sapien
gtcttctataaaagcgcctgtcgcg

SEQ ID NO: 22167 - DNA, 25 bp, Homo sapien
gtgttaacagcaaacgccttgagtg

SEQ ID NO: 22168 - DNA, 25 bp, Homo sapien
cgcgcgaccgccattacaacaaaaa

SEQ ID NO: 22169 - DNA, 25 bp, Homo sapien
gtcacgtgacaggttcagaccaatg

SEQ ID NO: 22170 - DNA, 25 bp, Homo sapien
ggctcagactcctacaccttttttg

SEQ ID NO: 22171 - DNA, 25 bp, Homo sapien
tgcctgccctaacaggcctgagctg

SEQ ID NO: 22172 - DNA, 25 bp, Homo sapien
tgagtgtagcgctcctactcctaac

SEQ ID NO: 22173 - DNA, 25 bp, Homo sapien
ttacaacaaaaactggcggcgagga

SEQ ID NO: 22174 - DNA, 25 bp, Homo sapien
gtagagccggtcatacatgcagatc

SEQ ID NO: 22175 - DNA, 25 bp, Homo sapien
gagtcctggtagagccggtcataca

SEQ ID NO: 22176 - DNA, 25 bp, Homo sapien
tgtgcacgagcacagagtcctggta

SEQ ID NO: 22177 - DNA, 25 bp, Homo sapien
tccacgctgggcttcggcacccaga

SEQ ID NO: 22178 - DNA, 25 bp, Homo sapien
tcaccgcgtgtgcacgagcacagag

SEQ ID NO: 22179 - DNA, 25 bp, Homo sapien
atgcagatcttcaggtccacgctgg

SEQ ID NO: 22180 - DNA, 25 bp, Homo sapien
ggtcatacatgcagatcttcaggtc

SEQ ID NO: 22181 - DNA, 25 bp, Homo sapien
ggcacccagaccggcacatcgatgg

SEQ ID NO: 22182 - DNA, 25 bp, Homo sapien
tctccgcggaagacagccaagctct

SEQ ID NO: 22183 - DNA, 25 bp, Homo sapien
gaaacgggatctcgctctccgcgga

SEQ ID NO: 22184 - DNA, 25 bp, Homo sapien
ctcccaatggcgaggctgcgggatt

SEQ ID NO: 22185 - DNA, 25 bp, Homo sapien
ctgctcttctggtccctggtctact

SEQ ID NO: 22186 - DNA, 25 bp, Homo sapien
ctggtctactgctactgcgggctct

SEQ ID NO: 22187 - DNA, 25 bp, Homo sapien
ctcaaacttttgtggagcctcggca

SEQ ID NO: 22188 - DNA, 25 bp, Homo sapien
acccactgctacgtgcggatcaagg

SEQ ID NO: 22189 - DNA, 25 bp, Homo sapien
ttctccttccgagacgctggctcag

SEQ ID NO: 22190 - DNA, 25 bp, Homo sapien
gtcgtacctctgtgagacatggctc

SEQ ID NO: 22191 - DNA, 25 bp, Homo sapien
tgtctacaaaccgacgagaggcgtc

SEQ ID NO: 22192 - DNA, 25 bp, Homo sapien
agctcagccaggatttgctcaggta

SEQ ID NO: 22193 - DNA, 25 bp, Homo sapien
gctgcttcagttcctaaatcgccca

SEQ ID NO: 22194 - DNA, 25 bp, Homo sapien
aagctgaggcttctttcggctctgc

SEQ ID NO: 22195 - DNA, 25 bp, Homo sapien
agtggcttcgctcgccctgaataaa

SEQ ID NO: 22196 - DNA, 25 bp, Homo sapien
tgcccgccggcagaagtaaacagag

SEQ ID NO: 22197 - DNA, 25 bp, Homo sapien
cggcttctctgggagactgtctaca

SEQ ID NO: 22198 - DNA, 25 bp, Homo sapien
gtctgcggttgcgcagaagcccagc

SEQ ID NO: 22199 - DNA, 25 bp, Homo sapien
tcggcagacctgtctcttcgcgttt

SEQ ID NO: 22200 - DNA, 25 bp, Homo sapien
accctgagcggtctctgaggacctg

SEQ ID NO: 22201 - DNA, 25 bp, Homo sapien
ttgggaaaccctgagcggtctctga

SEQ ID NO: 22202 - DNA, 25 bp, Homo sapien
gctcacggaacgttctggaagtttg

SEQ ID NO: 22203 - DNA, 25 bp, Homo sapien
agacctgtctcttcgcgtttttctt

SEQ ID NO: 22204 - DNA, 25 bp, Homo sapien
ctctcactgctcacggaacgttctg

SEQ ID NO: 22205 - DNA, 25 bp, Homo sapien
aagcccagcgactgcagaaccctgc

SEQ ID NO: 22206 - DNA, 25 bp, Homo sapien
ccaggtagagtaggccgaaagcttc

SEQ ID NO: 22207 - DNA, 25 bp, Homo sapien
gctgcatcagaggaagccatgtctt

SEQ ID NO: 22208 - DNA, 25 bp, Homo sapien
gtccgcacctcctgggaaagatttc

SEQ ID NO: 22209 - DNA, 25 bp, Homo sapien
ctcgagttatagaccgcagcgcgcg

SEQ ID NO: 22210 - DNA, 25 bp, Homo sapien
gtcttccgattcctgctcgcctagg

SEQ ID NO: 22211 - DNA, 25 bp, Homo sapien
gagcaaggatctcttcccacttttg

SEQ ID NO: 22212 - DNA, 25 bp, Homo sapien
ggccttcaggaggagaccatcgctt

SEQ ID NO: 22213 - DNA, 25 bp, Homo sapien
ttacgccagtgttccaagatttccc

SEQ ID NO: 22214 - DNA, 25 bp, Homo sapien
cgcccaacgaggctgaaaatacctt

SEQ ID NO: 22215 - DNA, 25 bp, Homo sapien
cggtggtcggagctgcaaaattaaa

SEQ ID NO: 22216 - DNA, 25 bp, Homo sapien
tgctttcgggagagaccgctctatc

SEQ ID NO: 22217 - DNA, 25 bp, Homo sapien
gaggtccggacacttaggcactaga

SEQ ID NO: 22218 - DNA, 25 bp, Homo sapien
tccgcagcgagagaagccacagatt

SEQ ID NO: 22219 - DNA, 25 bp, Homo sapien
cttgacacccaatccgagaggtttg

SEQ ID NO: 22220 - DNA, 25 bp, Homo sapien
agaggtttgctcatttcccttcgga

SEQ ID NO: 22221 - DNA, 25 bp, Homo sapien
cgctcagccttcgactaatttccgg

SEQ ID NO: 22222 - DNA, 25 bp, Homo sapien
gggcacattgacttctccgaggctg

SEQ ID NO: 22223 - DNA, 25 bp, Homo sapien
ggccgctccatgagtacggtttgaa

SEQ ID NO: 22224 - DNA, 25 bp, Homo sapien
acttgatgcacttgtaggagccgcc

SEQ ID NO: 22225 - DNA, 25 bp, Homo sapien
gggagcctcaccttgctgcacttga

SEQ ID NO: 22226 - DNA, 25 bp, Homo sapien
tctcgcaggcaaagggtctggtacc

SEQ ID NO: 22227 - DNA, 25 bp, Homo sapien
ggccactataggaggcagaacagta

SEQ ID NO: 22228 - DNA, 25 bp, Homo sapien
gggcacccagcgcttgtagaacact

SEQ ID NO: 22229 - DNA, 25 bp, Homo sapien
ctcgggagaggaggtcgtaaattct

SEQ ID NO: 22230 - DNA, 25 bp, Homo sapien
tcccagctccggactaatggtgtgc

SEQ ID NO: 22231 - DNA, 25 bp, Homo sapien
cttttgacgagaaatgagcgcggca

SEQ ID NO: 22232 - DNA, 25 bp, Homo sapien
gcgcttaccaggtggcacttggaca

SEQ ID NO: 22233 - DNA, 25 bp, Homo sapien
ggccatggcacctaggagacaaacc

SEQ ID NO: 22234 - DNA, 25 bp, Homo sapien
gcgaagctcgctccggcaatcaaac

SEQ ID NO: 22235 - DNA, 25 bp, Homo sapien
catcgcctgcctggctgtgctttac

SEQ ID NO: 22236 - DNA, 25 bp, Homo sapien
taggcgccggtacattctctaaacg

SEQ ID NO: 22237 - DNA, 25 bp, Homo sapien
tctaaacggagggaatagtctggtc

SEQ ID NO: 22238 - DNA, 25 bp, Homo sapien
ccctcaccttggaaacgttgagtag

SEQ ID NO: 22239 - DNA, 25 bp, Homo sapien
cgttgagtagacttcgccgtaaaca

SEQ ID NO: 22240 - DNA, 25 bp, Homo sapien
caccgacgcggagcctgactttcag

SEQ ID NO: 22241 - DNA, 25 bp, Homo sapien
ttcagtcctgcaagtcgccgacttc

SEQ ID NO: 22242 - DNA, 25 bp, Homo sapien
aagggaaccgacttctggcctcgag

SEQ ID NO: 22243 - DNA, 25 bp, Homo sapien
tgggacgccacagttagacccgccg

SEQ ID NO: 22244 - DNA, 25 bp, Homo sapien
ggtcagtgtcctccacgggatttac

SEQ ID NO: 22245 - DNA, 25 bp, Homo sapien
cggcagcctctaccgcagaatgggt

SEQ ID NO: 22246 - DNA, 25 bp, Homo sapien
ttcgtgggttttccaggagaatgtc

SEQ ID NO: 22247 - DNA, 25 bp, Homo sapien
tcgacctccgagtaccgagtacttc

SEQ ID NO: 22248 - DNA, 25 bp, Homo sapien
ttagatgcatggaggttcccttttc

SEQ ID NO: 22249 - DNA, 25 bp, Homo sapien
tttcttgcccgtatgccagcctagg

SEQ ID NO: 22250 - DNA, 25 bp, Homo sapien
ccggatggcgttagattgctagctc

SEQ ID NO: 22251 - DNA, 25 bp, Homo sapien
gtcgcaagcagtcgacctcagccta

SEQ ID NO: 22252 - DNA, 25 bp, Homo sapien
tgacttggtcgaggtgcagttccca

SEQ ID NO: 22253 - DNA, 25 bp, Homo sapien
agttcccagcgtggccttaaatggc

SEQ ID NO: 22254 - DNA, 25 bp, Homo sapien
gctttacccggagctaacgctgtga

SEQ ID NO: 22255 - DNA, 25 bp, Homo sapien
tccggactctgggtgttttgctacc

SEQ ID NO: 22256 - DNA, 25 bp, Homo sapien
cggagctctagctcgcgtattctga

SEQ ID NO: 22257 - DNA, 25 bp, Homo sapien
cccaagtaatagtcaggccgaaatc

SEQ ID NO: 22258 - DNA, 25 bp, Homo sapien
gcctggtgtcctagagctctgtaca

SEQ ID NO: 22259 - DNA, 25 bp, Homo sapien
caaccacgtttgtgtgggactcata

SEQ ID NO: 22260 - DNA, 25 bp, Homo sapien
cggcgcgagtaatgggtacctcaca

SEQ ID NO: 22261 - DNA, 25 bp, Homo sapien
gcctggctttctaaatctggtcccg

SEQ ID NO: 22262 - DNA, 25 bp, Homo sapien
cccatggactcttctcctggagtca

SEQ ID NO: 22263 - DNA, 25 bp, Homo sapien
tctggacgggttgtttggaaattca

SEQ ID NO: 22264 - DNA, 25 bp, Homo sapien
ctcctggagtcaggacgtgtctgga

SEQ ID NO: 22265 - DNA, 25 bp, Homo sapien
atcgactgcgcctggagcttaaagg

SEQ ID NO: 22266 - DNA, 25 bp, Homo sapien
cataaaggggagtcgcacctcgcct

SEQ ID NO: 22267 - DNA, 25 bp, Homo sapien
aggctgctgccgactccgccataaa

SEQ ID NO: 22268 - DNA, 25 bp, Homo sapien
ggacagagactcctcgccatggtaa

SEQ ID NO: 22269 - DNA, 25 bp, Homo sapien
ccgccggcctacctggaggtaatag

SEQ ID NO: 22270 - DNA, 25 bp, Homo sapien
tcctgtataacagtgccagcctgcc

SEQ ID NO: 22271 - DNA, 25 bp, Homo sapien
gtgcccagtaagtgctcggactcgc

SEQ ID NO: 22272 - DNA, 25 bp, Homo sapien
ctcggtttgtgcgtgcatatgtgcc

SEQ ID NO: 22273 - DNA, 25 bp, Homo sapien
ccttgtctccaaggacctcggtttg

SEQ ID NO: 22274 - DNA, 25 bp, Homo sapien
ggccggtgtaagaacgctcattcta

SEQ ID NO: 22275 - DNA, 25 bp, Homo sapien
ctgagcctcactgcaacgttaaaga

SEQ ID NO: 22276 - DNA, 25 bp, Homo sapien
ccgacgatcaggagcgcagctttca

SEQ ID NO: 22277 - DNA, 25 bp, Homo sapien
ggtcgcacacgacccttttcctgta

SEQ ID NO: 22278 - DNA, 25 bp, Homo sapien
cgtcaggtactgttgtctccgctcc

SEQ ID NO: 22279 - DNA, 25 bp, Homo sapien
ggctggtttatcctccgcacttact

SEQ ID NO: 22280 - DNA, 25 bp, Homo sapien
cgcacttacttggtactcgatctcc

SEQ ID NO: 22281 - DNA, 25 bp, Homo sapien
catgggctggtagaagcactccttc

SEQ ID NO: 22282 - DNA, 25 bp, Homo sapien
ggctagcagtcctattccgcaaccg

SEQ ID NO: 22283 - DNA, 25 bp, Homo sapien
ggcggcgaacactccctccgaaaga

SEQ ID NO: 22284 - DNA, 25 bp, Homo sapien
tctctggactcctcgtggttgacag

SEQ ID NO: 22285 - DNA, 25 bp, Homo sapien
cagggccgtccaccagaagtttcta

SEQ ID NO: 22286 - DNA, 25 bp, Homo sapien
gcgcaccacgcgaagacagacagga

SEQ ID NO: 22287 - DNA, 25 bp, Homo sapien
cgaacgctcccaagtgtgcactggc

SEQ ID NO: 22288 - DNA, 25 bp, Homo sapien
ggagacgcaagcgattcccgatggc

SEQ ID NO: 22289 - DNA, 25 bp, Homo sapien
ggaggtttctggatctcgatgcgta

SEQ ID NO: 22290 - DNA, 25 bp, Homo sapien
ggacggatctagaacccgaggctct

SEQ ID NO: 22291 - DNA, 25 bp, Homo sapien
gtgcactggcagaaggacggatcta

SEQ ID NO: 22292 - DNA, 25 bp, Homo sapien
gcgcgtctaacaacagccacagctg

SEQ ID NO: 22293 - DNA, 25 bp, Homo sapien
tcgatgcgtatgtgggaaaacgatc

SEQ ID NO: 22294 - DNA, 25 bp, Homo sapien
tcttcggcttccacgatctgcgttc

SEQ ID NO: 22295 - DNA, 25 bp, Homo sapien
gcctggctctgtccatattagttcc

SEQ ID NO: 22296 - DNA, 25 bp, Homo sapien
gcaaaccttccctggcatctggagg

SEQ ID NO: 22297 - DNA, 25 bp, Homo sapien
ggaaatctgagggaacgaggcttcc

SEQ ID NO: 22298 - DNA, 25 bp, Homo sapien
cttgccaggaccgtagcaggcggaa

SEQ ID NO: 22299 - DNA, 25 bp, Homo sapien
cctggctagggtccctgtgaaggaa

SEQ ID NO: 22300 - DNA, 25 bp, Homo sapien
tgcttggagctctccggtacagtga

SEQ ID NO: 22301 - DNA, 25 bp, Homo sapien
ctctgaggagacacgaaggtggttc

SEQ ID NO: 22302 - DNA, 25 bp, Homo sapien
tctttctcactcactggggagcccg

SEQ ID NO: 22303 - DNA, 25 bp, Homo sapien
tcggacagactgtggagccgacaga

SEQ ID NO: 22304 - DNA, 25 bp, Homo sapien
gcggctcctctcttcctttgtatct

SEQ ID NO: 22305 - DNA, 25 bp, Homo sapien
cccgctcgtctttgtgtgcagactc

SEQ ID NO: 22306 - DNA, 25 bp, Homo sapien
ggcaccgccagacggccagaaagtt

SEQ ID NO: 22307 - DNA, 25 bp, Homo sapien
cgacagactgaaggacagcggcacc

SEQ ID NO: 22308 - DNA, 25 bp, Homo sapien
aggcttctccagtcgcgtctttctc

SEQ ID NO: 22309 - DNA, 25 bp, Homo sapien
gcacctttcgaggtagacccgctga

SEQ ID NO: 22310 - DNA, 25 bp, Homo sapien
cgggctctcaggatctctggacctc

SEQ ID NO: 22311 - DNA, 25 bp, Homo sapien
tcagcggcctaagtgggtaaggaca

SEQ ID NO: 22312 - DNA, 25 bp, Homo sapien
tgtcaacagttacagggcaggctcc

SEQ ID NO: 22313 - DNA, 25 bp, Homo sapien
tgcaaacttcccaagagattaccgg

SEQ ID NO: 22314 - DNA, 25 bp, Homo sapien
agaaactcgcctcctcggagccttg

SEQ ID NO: 22315 - DNA, 25 bp, Homo sapien
tttgtccaacaaacttcctagcgtg

SEQ ID NO: 22316 - DNA, 25 bp, Homo sapien
tcgagtgccaccgagcaagatgcct

SEQ ID NO: 22317 - DNA, 25 bp, Homo sapien
tagggaccaacaaacgccggctcta

SEQ ID NO: 22318 - DNA, 25 bp, Homo sapien
acgcggctttgaccgtctatttcaa

SEQ ID NO: 22319 - DNA, 25 bp, Homo sapien
ggcttaacggtgcaacggctggcct

SEQ ID NO: 22320 - DNA, 25 bp, Homo sapien
cagagcccggatacctcagaaattc

SEQ ID NO: 22321 - DNA, 25 bp, Homo sapien
gcctctcagattcgtggcgaccgca

SEQ ID NO: 22322 - DNA, 25 bp, Homo sapien
agtcgcagagcaaccacgcggcttt

SEQ ID NO: 22323 - DNA, 25 bp, Homo sapien
tctgtggggagcgaaatgcaaccca

SEQ ID NO: 22324 - DNA, 25 bp, Homo sapien
ctcacaggcgcgacgtaaaggcccg

SEQ ID NO: 22325 - DNA, 25 bp, Homo sapien
atcactgcgggcactggaaacctgc

SEQ ID NO: 22326 - DNA, 25 bp, Homo sapien
gagaaaacacgcctacgccctgcgt

SEQ ID NO: 22327 - DNA, 25 bp, Homo sapien
gagcgggactgtggttgcgagggag

SEQ ID NO: 22328 - DNA, 25 bp, Homo sapien
ttgcgagggagggacgagaaaacac

SEQ ID NO: 22329 - DNA, 25 bp, Homo sapien
gaaaacacgcctacgccctgcgtgc

SEQ ID NO: 22330 - DNA, 25 bp, Homo sapien
agaaaacacgcctacgccctgcgtg

SEQ ID NO: 22331 - DNA, 25 bp, Homo sapien
aaaacacgcctacgccctgcgtgcg

SEQ ID NO: 22332 - DNA, 25 bp, Homo sapien
gagggacgagaaaacacgcctacgc

SEQ ID NO: 22333 - DNA, 25 bp, Homo sapien
gacgagaaaacacgcctacgccctg

SEQ ID NO: 22334 - DNA, 25 bp, Homo sapien
gcggcgaaggaaaagcgacactgaa

SEQ ID NO: 22335 - DNA, 25 bp, Homo sapien
cccacgccttgagcgggactgtggt

SEQ ID NO: 22336 - DNA, 25 bp, Homo sapien
cgcagttcactgcattcggttcttg

SEQ ID NO: 22337 - DNA, 25 bp, Homo sapien
ttcttgcggtcctttcttaagcggc

SEQ ID NO: 22338 - DNA, 25 bp, Homo sapien
tttcttaagcggctcgcagggtccc

SEQ ID NO: 22339 - DNA, 25 bp, Homo sapien
gcagtcgatgtaggtcctgagaaga

SEQ ID NO: 22340 - DNA, 25 bp, Homo sapien
cactgaagcgaaggctcgcggtttc

SEQ ID NO: 22341 - DNA, 25 bp, Homo sapien
ccagctcagccgactgggcagtcga

SEQ ID NO: 22342 - DNA, 25 bp, Homo sapien
gaagactggatttcctaccttttgc

SEQ ID NO: 22343 - DNA, 25 bp, Homo sapien
ttgcccggaactttcagccgacgcg

SEQ ID NO: 22344 - DNA, 25 bp, Homo sapien
gccttagcccgtgcagatctggtaa

SEQ ID NO: 22345 - DNA, 25 bp, Homo sapien
gatctggtaaccaccatctttccgg

SEQ ID NO: 22346 - DNA, 25 bp, Homo sapien
ctccggaaatgcgtcagagaactgc

SEQ ID NO: 22347 - DNA, 25 bp, Homo sapien
agagaactgcctcgagcgcgttttc

SEQ ID NO: 22348 - DNA, 25 bp, Homo sapien
cgttttccgcgcagatccgagaatt

SEQ ID NO: 22349 - DNA, 25 bp, Homo sapien
tctgtcggcaggtcctcacccttaa

SEQ ID NO: 22350 - DNA, 25 bp, Homo sapien
tgggccagctcctttgtttccagtc

SEQ ID NO: 22351 - DNA, 25 bp, Homo sapien
tccctctagcggaagcgtaaggata

SEQ ID NO: 22352 - DNA, 25 bp, Homo sapien
gcctgcccagttttgctccgaaaga

SEQ ID NO: 22353 - DNA, 25 bp, Homo sapien
gcgagaacttttgagtgtccctcta

SEQ ID NO: 22354 - DNA, 25 bp, Homo sapien
tctggcccagcggatagacttcagc

SEQ ID NO: 22355 - DNA, 25 bp, Homo sapien
cccgctgtccatgtcgcagaatctg

SEQ ID NO: 22356 - DNA, 25 bp, Homo sapien
gcgcagtgcggatcagcatcgaatc

SEQ ID NO: 22357 - DNA, 25 bp, Homo sapien
tgccggacaaggtaggacacgactt

SEQ ID NO: 22358 - DNA, 25 bp, Homo sapien
cacgtctctttaaagggcagcctga

SEQ ID NO: 22359 - DNA, 25 bp, Homo sapien
tggacccaaggtcgcgtcgacactg

SEQ ID NO: 22360 - DNA, 25 bp, Homo sapien
tccaaactgagggagctgtttcctg

SEQ ID NO: 22361 - DNA, 25 bp, Homo sapien
atcgtagccgagaaagtgcttcgta

SEQ ID NO: 22362 - DNA, 25 bp, Homo sapien
ggcccgcaagtgactggcccttggc

SEQ ID NO: 22363 - DNA, 25 bp, Homo sapien
ggtgggcttcctacacgtctcttta

SEQ ID NO: 22364 - DNA, 25 bp, Homo sapien
caccgggactcggaaatgctacgta

SEQ ID NO: 22365 - DNA, 25 bp, Homo sapien
ccgcctggtgaggtagacaccgcct

SEQ ID NO: 22366 - DNA, 25 bp, Homo sapien
cagtcctggctcgaggacacccgtc

SEQ ID NO: 22367 - DNA, 25 bp, Homo sapien
gacgctgtcccagcatcacgggctg

SEQ ID NO: 22368 - DNA, 25 bp, Homo sapien
gatcgtcaccgtctgctcccggcca

SEQ ID NO: 22369 - DNA, 25 bp, Homo sapien
acccttcccgtggactccagtcctg

SEQ ID NO: 22370 - DNA, 25 bp, Homo sapien
accctggacggcaattcgcgggcgc

SEQ ID NO: 22371 - DNA, 25 bp, Homo sapien
gaggcaactagctcgcgcgcagaac

SEQ ID NO: 22372 - DNA, 25 bp, Homo sapien
cgcgcagaacgcgaccgtcagttgc

SEQ ID NO: 22373 - DNA, 25 bp, Homo sapien
aacgcgaccgtcagttgcgcgcggc

SEQ ID NO: 22374 - DNA, 25 bp, Homo sapien
ggcctgaagttgtcccaaccgcggc

SEQ ID NO: 22375 - DNA, 25 bp, Homo sapien
ggcgtcacacaactcagagcgcgca

SEQ ID NO: 22376 - DNA, 25 bp, Homo sapien
cgtcggtcgcccttttgacttgcag

SEQ ID NO: 22377 - DNA, 25 bp, Homo sapien
agacgcccggccaagtggcagccgc

SEQ ID NO: 22378 - DNA, 25 bp, Homo sapien
gaccctggacggcaactagccggcg

SEQ ID NO: 22379 - DNA, 25 bp, Homo sapien
gcccgcgtcctctcgctcgtccgcg

SEQ ID NO: 22380 - DNA, 25 bp, Homo sapien
cttttgacttgcagcagggcgggca

SEQ ID NO: 22381 - DNA, 25 bp, Homo sapien
ggtcgcccttttgacttgcagcagg

SEQ ID NO: 22382 - DNA, 25 bp, Homo sapien
gccaaagtacaaagtgggctccaga

SEQ ID NO: 22383 - DNA, 25 bp, Homo sapien
aggcccgctcatccagttattgtga

SEQ ID NO: 22384 - DNA, 25 bp, Homo sapien
cagggctgagtagcaacagctcctc

SEQ ID NO: 22385 - DNA, 25 bp, Homo sapien
ccatggcggccttcagcaagtactt

SEQ ID NO: 22386 - DNA, 25 bp, Homo sapien
ggccgacaggtctctttgcccgacg

SEQ ID NO: 22387 - DNA, 25 bp, Homo sapien
cgactgccgtgggacttcaatgtca

SEQ ID NO: 22388 - DNA, 25 bp, Homo sapien
tgcgaattcttctgtgcccgcgggc

SEQ ID NO: 22389 - DNA, 25 bp, Homo sapien
cttgacggcgcgaaactcctcgctg

SEQ ID NO: 22390 - DNA, 25 bp, Homo sapien
gttagcagagcacggacagcccagc

SEQ ID NO: 22391 - DNA, 25 bp, Homo sapien
tagcggttagcagagcacggacagc

SEQ ID NO: 22392 - DNA, 25 bp, Homo sapien
gccgctccaccgtgcgctccaggat

SEQ ID NO: 22393 - DNA, 25 bp, Homo sapien
atgtccttgtccatctttgtcccgc

SEQ ID NO: 22394 - DNA, 25 bp, Homo sapien
ggatgtccttgtccatctttgtccc

SEQ ID NO: 22395 - DNA, 25 bp, Homo sapien
ttgtccatctttgtcccgcccacgg

SEQ ID NO: 22396 - DNA, 25 bp, Homo sapien
tttcggtccacgtcctccttgggca

SEQ ID NO: 22397 - DNA, 25 bp, Homo sapien
gctggggctgttagcggctccacct

SEQ ID NO: 22398 - DNA, 25 bp, Homo sapien
cgaagtaaacgtgtggctgtgagca

SEQ ID NO: 22399 - DNA, 25 bp, Homo sapien
ctcgggacctgcagcgaagtaaacg

SEQ ID NO: 22400 - DNA, 25 bp, Homo sapien
atttcccggatgctttgcccacctg

SEQ ID NO: 22401 - DNA, 25 bp, Homo sapien
ggagaggcggcatttacaacattta

SEQ ID NO: 22402 - DNA, 25 bp, Homo sapien
agaattcttcccttccatttggtga

SEQ ID NO: 22403 - DNA, 25 bp, Homo sapien
gagggcgccttggaagaattcttcc

SEQ ID NO: 22404 - DNA, 25 bp, Homo sapien
ggcaggggtctccatgtctaccagt

SEQ ID NO: 22405 - DNA, 25 bp, Homo sapien
atgtctaccagttggcggcgagatc

SEQ ID NO: 22406 - DNA, 25 bp, Homo sapien
gcagggaagcgtctgagcctcttcc

SEQ ID NO: 22407 - DNA, 25 bp, Homo sapien
cgccggctcagctttagtcgtcaaa

SEQ ID NO: 22408 - DNA, 25 bp, Homo sapien
tgggcagaaacccatgccgggaaga

SEQ ID NO: 22409 - DNA, 25 bp, Homo sapien
cgagtacctggtaagcgctcgcagc

SEQ ID NO: 22410 - DNA, 25 bp, Homo sapien
aacctggaccctgctccagtgctgg

SEQ ID NO: 22411 - DNA, 25 bp, Homo sapien
cgcaaacttggggtcgtcctcaggt

SEQ ID NO: 22412 - DNA, 25 bp, Homo sapien
tcgtcctcaggtgcacctccaggta

SEQ ID NO: 22413 - DNA, 25 bp, Homo sapien
acctccaggtaagcacttggcggca

SEQ ID NO: 22414 - DNA, 25 bp, Homo sapien
ttgttcttgacttcggccgagagcc

SEQ ID NO: 22415 - DNA, 25 bp, Homo sapien
gtccaactgggtgctacagagcctc

SEQ ID NO: 22416 - DNA, 25 bp, Homo sapien
ccctctccaggaaaacggtgagcca

SEQ ID NO: 22417 - DNA, 25 bp, Homo sapien
cgagccaggcgtaccttgttcttga

SEQ ID NO: 22418 - DNA, 25 bp, Homo sapien
gagcccataggaagggcccttgttg

SEQ ID NO: 22419 - DNA, 25 bp, Homo sapien
ggatgctcgaactccctcctctggg

SEQ ID NO: 22420 - DNA, 25 bp, Homo sapien
ggcgcgttctgcagtcaccaaacgg

SEQ ID NO: 22421 - DNA, 25 bp, Homo sapien
ccacagcgcgaagagcaaacgaagc

SEQ ID NO: 22422 - DNA, 25 bp, Homo sapien
tcgcaggattaggaaaaccgccaca

SEQ ID NO: 22423 - DNA, 25 bp, Homo sapien
ggaccagccgctgtcaaagttcaca

SEQ ID NO: 22424 - DNA, 25 bp, Homo sapien
aacggcgcatgcgtccaacttccgg

SEQ ID NO: 22425 - DNA, 25 bp, Homo sapien
agtcgcctcctcgatacttaccgga

SEQ ID NO: 22426 - DNA, 25 bp, Homo sapien
cgtccatggaacgaagcactaccca

SEQ ID NO: 22427 - DNA, 25 bp, Homo sapien
gccgcagctagaacgagaacgcaca

SEQ ID NO: 22428 - DNA, 25 bp, Homo sapien
cactctggggtttgtagtgaccaac

SEQ ID NO: 22429 - DNA, 25 bp, Homo sapien
gtgaccaacccaagtccgacagtcg

SEQ ID NO: 22430 - DNA, 25 bp, Homo sapien
tggctcccgtgagcatctcaccggg

SEQ ID NO: 22431 - DNA, 25 bp, Homo sapien
tgtgcggaaggctcagcatcgtccc

SEQ ID NO: 22432 - DNA, 25 bp, Homo sapien
tgcctctcgggtctgagcttaaagc

SEQ ID NO: 22433 - DNA, 25 bp, Homo sapien
gcccggatgagcagactcctgtaga

SEQ ID NO: 22434 - DNA, 25 bp, Homo sapien
agttccagggcaagaaggtctgctc

SEQ ID NO: 22435 - DNA, 25 bp, Homo sapien
cattcctctcgcgtttctcgggctg

SEQ ID NO: 22436 - DNA, 25 bp, Homo sapien
aggagcagctctgcggtaacccgag

SEQ ID NO: 22437 - DNA, 25 bp, Homo sapien
tcgctccgggagcaaatggtgtccc

SEQ ID NO: 22438 - DNA, 25 bp, Homo sapien
tcccggacgctgtgggacacacggc

SEQ ID NO: 22439 - DNA, 25 bp, Homo sapien
gggcactccttcctctggcagctga

SEQ ID NO: 22440 - DNA, 25 bp, Homo sapien
agctgagcacgggaagcactcgcca

SEQ ID NO: 22441 - DNA, 25 bp, Homo sapien
tcacctgctcaggatgcggctccgg

SEQ ID NO: 22442 - DNA, 25 bp, Homo sapien
gctttgcggtagacgatgatgcctg

SEQ ID NO: 22443 - DNA, 25 bp, Homo sapien
caccaccacgaagacggggaggctc

SEQ ID NO: 22444 - DNA, 25 bp, Homo sapien
gagcctgggtgtccgtgccgtccac

SEQ ID NO: 22445 - DNA, 25 bp, Homo sapien
agggtgaccagcacaactgccagga

SEQ ID NO: 22446 - DNA, 25 bp, Homo sapien
gcctgccagccgagctcaccgcgcg

SEQ ID NO: 22447 - DNA, 25 bp, Homo sapien
ttactctgcagacagcgggctgcgg

SEQ ID NO: 22448 - DNA, 25 bp, Homo sapien
ccctcagccggacaaggtgggcgag

SEQ ID NO: 22449 - DNA, 25 bp, Homo sapien
gcgaagagtcctagggagatgcctc

SEQ ID NO: 22450 - DNA, 25 bp, Homo sapien
gggagatgcctcgggtcttcctcct

SEQ ID NO: 22451 - DNA, 25 bp, Homo sapien
ggcagaggcctcatgggcgagcccg

SEQ ID NO: 22452 - DNA, 25 bp, Homo sapien
cccggagcttactctgcagacagcg

SEQ ID NO: 22453 - DNA, 25 bp, Homo sapien
agcttactctgcagacagcgggctg

SEQ ID NO: 22454 - DNA, 25 bp, Homo sapien
gaaacactaagagagcggcgcggcc

SEQ ID NO: 22455 - DNA, 25 bp, Homo sapien
tgctgagccgctcaggtgactaccc

SEQ ID NO: 22456 - DNA, 25 bp, Homo sapien
acccgcgttcgctttgcgtctcctc

SEQ ID NO: 22457 - DNA, 25 bp, Homo sapien
agttgaatgatggaatgacacgccc

SEQ ID NO: 22458 - DNA, 25 bp, Homo sapien
tgatggaatgacacgcccggaggcc

SEQ ID NO: 22459 - DNA, 25 bp, Homo sapien
cccagaaacactaagagagcggcgc

SEQ ID NO: 22460 - DNA, 25 bp, Homo sapien
ggtcctggccgcgattttctgcagg

SEQ ID NO: 22461 - DNA, 25 bp, Homo sapien
ctcaggtgactacccgcgcgcggga

SEQ ID NO: 22462 - DNA, 25 bp, Homo sapien
cggtctgcagcagaacgccaggttc

SEQ ID NO: 22463 - DNA, 25 bp, Homo sapien
cagggctgggctgccgttacccaac

SEQ ID NO: 22464 - DNA, 25 bp, Homo sapien
tgagagaggagttggaccgtccttc

SEQ ID NO: 22465 - DNA, 25 bp, Homo sapien
caatggacgggtatgtaatcgggcc

SEQ ID NO: 22466 - DNA, 25 bp, Homo sapien
ttcggcaatggacgggtatgtaatc

SEQ ID NO: 22467 - DNA, 25 bp, Homo sapien
agcgaagctttgtccggttcggcaa

SEQ ID NO: 22468 - DNA, 25 bp, Homo sapien
ctcggttcttgtgagcgaagctttg

SEQ ID NO: 22469 - DNA, 25 bp, Homo sapien
attttctcgccgcttgtgtggctcg

SEQ ID NO: 22470 - DNA, 25 bp, Homo sapien
tgcgtcctcaagctccagccagaga

SEQ ID NO: 22471 - DNA, 25 bp, Homo sapien
gtctgccagtgacaaaccctccttg

SEQ ID NO: 22472 - DNA, 25 bp, Homo sapien
tggcagtgcctacagtctcgagtct

SEQ ID NO: 22473 - DNA, 25 bp, Homo sapien
gtccttactgagcacaggggccatg

SEQ ID NO: 22474 - DNA, 25 bp, Homo sapien
tcgatgtccgccgagtccttactga

SEQ ID NO: 22475 - DNA, 25 bp, Homo sapien
taaacaggtcccgacgcaaagggca

SEQ ID NO: 22476 - DNA, 25 bp, Homo sapien
gcgcgaagtccgtacctcgatgtcc

SEQ ID NO: 22477 - DNA, 25 bp, Homo sapien
gcgcgagtcgaaaacaggcagacta

SEQ ID NO: 22478 - DNA, 25 bp, Homo sapien
tgctaccttggcaaccacgggcgtt

SEQ ID NO: 22479 - DNA, 25 bp, Homo sapien
cgggattcgcgaagtcacgcgcttc

SEQ ID NO: 22480 - DNA, 25 bp, Homo sapien
gctcaaggcctttcagtcgttccca

SEQ ID NO: 22481 - DNA, 25 bp, Homo sapien
ttccggtggaaccagtgcgaaaaca

SEQ ID NO: 22482 - DNA, 25 bp, Homo sapien
atgcgttcctgagagacccgccaca

SEQ ID NO: 22483 - DNA, 25 bp, Homo sapien
ctggtactctcctcgactacgcgta

SEQ ID NO: 22484 - DNA, 25 bp, Homo sapien
cgactacgcgtattcttaagcaata

SEQ ID NO: 22485 - DNA, 25 bp, Homo sapien
gcgaacccattttccagtcctggtc

SEQ ID NO: 22486 - DNA, 25 bp, Homo sapien
ccgggctaaactctcgtctggcgaa

SEQ ID NO: 22487 - DNA, 25 bp, Homo sapien
tcttaagcagctccgagaaggctcc

SEQ ID NO: 22488 - DNA, 25 bp, Homo sapien
ctccaggatttgtcaggtcttaagc

SEQ ID NO: 22489 - DNA, 25 bp, Homo sapien
tgtcctcccgagtttgggccagaga

SEQ ID NO: 22490 - DNA, 25 bp, Homo sapien
acaaatcgttgcctctctaagtggg

SEQ ID NO: 22491 - DNA, 25 bp, Homo sapien
tctggccacaggaactctagtttca

SEQ ID NO: 22492 - DNA, 25 bp, Homo sapien
accaccttggatttcagatcgagga

SEQ ID NO: 22493 - DNA, 25 bp, Homo sapien
ctgagcccaatacgcccggagaaga

SEQ ID NO: 22494 - DNA, 25 bp, Homo sapien
agatctcgggctcagctaacgtttc

SEQ ID NO: 22495 - DNA, 25 bp, Homo sapien
tgcttctccaatagtacacggagta

SEQ ID NO: 22496 - DNA, 25 bp, Homo sapien
ggagtagctcagagtcattccctca

SEQ ID NO: 22497 - DNA, 25 bp, Homo sapien
ggtccgtctgcaagcgtctaaagga

SEQ ID NO: 22498 - DNA, 25 bp, Homo sapien
tgtagtcttcattccaaagcccaga

SEQ ID NO: 22499 - DNA, 25 bp, Homo sapien
ccctggataagctcactggaaacga

SEQ ID NO: 22500 - DNA, 25 bp, Homo sapien
ggaaacgacttccagcaaccgagag

SEQ ID NO: 22501 - DNA, 25 bp, Homo sapien
tacctggtatggcttgtagtcttca

SEQ ID NO: 22502 - DNA, 25 bp, Homo sapien
aggacgacctggaggtgttcagcaa

SEQ ID NO: 22503 - DNA, 25 bp, Homo sapien
cgttgccagcattgcgccgacggct

SEQ ID NO: 22504 - DNA, 25 bp, Homo sapien
tttctccaacgtagccggagtccga

SEQ ID NO: 22505 - DNA, 25 bp, Homo sapien
tgggtcaatgcgaggacgcccacct

SEQ ID NO: 22506 - DNA, 25 bp, Homo sapien
actgcggaaaccgtcactcggtggc

SEQ ID NO: 22507 - DNA, 25 bp, Homo sapien
tcccgcgaagtggacggttcgcttc

SEQ ID NO: 22508 - DNA, 25 bp, Homo sapien
acttccaaggcaactccgggcgttg

SEQ ID NO: 22509 - DNA, 25 bp, Homo sapien
gtgccttccagcctcgctgtggatc

SEQ ID NO: 22510 - DNA, 25 bp, Homo sapien
agaagccctgcacgttcacggtgaa

SEQ ID NO: 22511 - DNA, 25 bp, Homo sapien
agcctgcatccctcgaattccttga

SEQ ID NO: 22512 - DNA, 25 bp, Homo sapien
cccagagtttcaaccggtgcgttca

SEQ ID NO: 22513 - DNA, 25 bp, Homo sapien
ccgcacaacgcctgggaaaatggtg

SEQ ID NO: 22514 - DNA, 25 bp, Homo sapien
ttccgaggcaccagctgagaggttt

SEQ ID NO: 22515 - DNA, 25 bp, Homo sapien
ggagcttccagaaactcttccgagg

SEQ ID NO: 22516 - DNA, 25 bp, Homo sapien
acgtgtccgtatactcgaagtagta

SEQ ID NO: 22517 - DNA, 25 bp, Homo sapien
gtccctgccatgatcaccatctgga

SEQ ID NO: 22518 - DNA, 25 bp, Homo sapien
gagttggcccagtgccttggcataa

SEQ ID NO: 22519 - DNA, 25 bp, Homo sapien
aaagtgatcaaggacagcgtcaccc

SEQ ID NO: 22520 - DNA, 25 bp, Homo sapien
tatttcgtcgaggtgagttggccca

SEQ ID NO: 22521 - DNA, 25 bp, Homo sapien
ggccaaagggcaaagtgatcaagga

SEQ ID NO: 22522 - DNA, 25 bp, Homo sapien
cttggcataatgcagatcctctggg

SEQ ID NO: 22523 - DNA, 25 bp, Homo sapien
ctctgggcatctcctgagcgaattc

SEQ ID NO: 22524 - DNA, 25 bp, Homo sapien
gcgaattcaggtcctggacagtgtt

SEQ ID NO: 22525 - DNA, 25 bp, Homo sapien
tcctgccctgcttttatttcgtcga

SEQ ID NO: 22526 - DNA, 25 bp, Homo sapien
accgcgggattttaatgtgcaactg

SEQ ID NO: 22527 - DNA, 25 bp, Homo sapien
aagtgctaggaatgccgctggcctc

SEQ ID NO: 22528 - DNA, 25 bp, Homo sapien
aactccctcggcgtaagtgctagga

SEQ ID NO: 22529 - DNA, 25 bp, Homo sapien
agaagccgcacgtataactccctcg

SEQ ID NO: 22530 - DNA, 25 bp, Homo sapien
ccgtagcaccagagtcgcgggtcct

SEQ ID NO: 22531 - DNA, 25 bp, Homo sapien
gtcgctgagactctgcctgcttctc

SEQ ID NO: 22532 - DNA, 25 bp, Homo sapien
gctgttaaaggaaggccgcgccttg

SEQ ID NO: 22533 - DNA, 25 bp, Homo sapien
gcaactgtgagctcgcaggctgtta

SEQ ID NO: 22534 - DNA, 25 bp, Homo sapien
gcgcatgctccgtaggtctttagta

SEQ ID NO: 22535 - DNA, 25 bp, Homo sapien
gtctttagtaagtgtggctccctgc

SEQ ID NO: 22536 - DNA, 25 bp, Homo sapien
gtggctccctgcaaattcccaggtt

SEQ ID NO: 22537 - DNA, 25 bp, Homo sapien
ttcccaggttgtgtctccacagttc

SEQ ID NO: 22538 - DNA, 25 bp, Homo sapien
gtctccacagttccggccgacagag

SEQ ID NO: 22539 - DNA, 25 bp, Homo sapien
agagacttttacttatgtgcacaga

SEQ ID NO: 22540 - DNA, 25 bp, Homo sapien
gacgcaagaggggaaaggtaccaca

SEQ ID NO: 22541 - DNA, 25 bp, Homo sapien
cgaaaagcagcacgtggacgcaaga

SEQ ID NO: 22542 - DNA, 25 bp, Homo sapien
tgacacgttgtaactccgacggacg

SEQ ID NO: 22543 - DNA, 25 bp, Homo sapien
tcctaggagaggtgtagcagaaagc

SEQ ID NO: 22544 - DNA, 25 bp, Homo sapien
ccacgcgacggtgaagcaggaacca

SEQ ID NO: 22545 - DNA, 25 bp, Homo sapien
gggacggtatcgaagacctgaaata

SEQ ID NO: 22546 - DNA, 25 bp, Homo sapien
cctgaaatacagtgctagctaagta

SEQ ID NO: 22547 - DNA, 25 bp, Homo sapien
cagaggccctcgacgagtgtcactc

SEQ ID NO: 22548 - DNA, 25 bp, Homo sapien
actccatctgtttcgcgctcctagg

SEQ ID NO: 22549 - DNA, 25 bp, Homo sapien
aagacggcagtgtgtgcctcagcgc

SEQ ID NO: 22550 - DNA, 25 bp, Homo sapien
gccggagcacgaagttgtacaggta

SEQ ID NO: 22551 - DNA, 25 bp, Homo sapien
tcgtcggctgatcgcacgattgtga

SEQ ID NO: 22552 - DNA, 25 bp, Homo sapien
tgctggccaagaagatcatcattaa

SEQ ID NO: 22553 - DNA, 25 bp, Homo sapien
tcccatatgttgctaacggggtggc

SEQ ID NO: 22554 - DNA, 25 bp, Homo sapien
gttgtacaggtagccagcagcaccc

SEQ ID NO: 22555 - DNA, 25 bp, Homo sapien
tttccacgtctctctgcgtcggtgc

SEQ ID NO: 22556 - DNA, 25 bp, Homo sapien
tcatcattaaggacggaggcacggt

SEQ ID NO: 22557 - DNA, 25 bp, Homo sapien
ggccgcgaaccgcagtatcatgctg

SEQ ID NO: 22558 - DNA, 25 bp, Homo sapien
ttggtggaacagcacttggctcatg

SEQ ID NO: 22559 - DNA, 25 bp, Homo sapien
gacaccggaagcgagccctagaatt

SEQ ID NO: 22560 - DNA, 25 bp, Homo sapien
ctgggttccctatccgcttcctagg

SEQ ID NO: 22561 - DNA, 25 bp, Homo sapien
gggccgactcgacacctaggtgcaa

SEQ ID NO: 22562 - DNA, 25 bp, Homo sapien
tggatgacgcggaccttacctctcc

SEQ ID NO: 22563 - DNA, 25 bp, Homo sapien
ttccgggtattaacctgtgtggcgc

SEQ ID NO: 22564 - DNA, 25 bp, Homo sapien
gcctcggctggtgtgcagaaaagcc

SEQ ID NO: 22565 - DNA, 25 bp, Homo sapien
ccctagaattatggcgacctccgcg

SEQ ID NO: 22566 - DNA, 25 bp, Homo sapien
ctggaccgtcatccgctatcctacc

SEQ ID NO: 22567 - DNA, 25 bp, Homo sapien
tacctcgtcacacggacacccaccc

SEQ ID NO: 22568 - DNA, 25 bp, Homo sapien
tcctacctcgtcacacggacaccca

SEQ ID NO: 22569 - DNA, 25 bp, Homo sapien
actcctacctcgtcacacggacacc

SEQ ID NO: 22570 - DNA, 25 bp, Homo sapien
ctactcctacctcgtcacacggaca

SEQ ID NO: 22571 - DNA, 25 bp, Homo sapien
gccctactcctacctcgtcacacgg

SEQ ID NO: 22572 - DNA, 25 bp, Homo sapien
agctggaccgtcatccgctatccta

SEQ ID NO: 22573 - DNA, 25 bp, Homo sapien
gctggaccgtcatccgctatcctac

SEQ ID NO: 22574 - DNA, 25 bp, Homo sapien
gcctacaacctggaggccggccagg

SEQ ID NO: 22575 - DNA, 25 bp, Homo sapien
gtctgcctcagaggggcccgagcca

SEQ ID NO: 22576 - DNA, 25 bp, Homo sapien
ccgcccgcctacaacctggaggccg

SEQ ID NO: 22577 - DNA, 25 bp, Homo sapien
gcccgcacggctacggcgccatccc

SEQ ID NO: 22578 - DNA, 25 bp, Homo sapien
cccgcacggctacggcgccatcccc

SEQ ID NO: 22579 - DNA, 25 bp, Homo sapien
atcccagggtctacaacatccacag

SEQ ID NO: 22580 - DNA, 25 bp, Homo sapien
tcccagggtctacaacatccacagc

SEQ ID NO: 22581 - DNA, 25 bp, Homo sapien
gccgcccgcctacaacctggaggcc

SEQ ID NO: 22582 - DNA, 25 bp, Homo sapien
gcgggagccaacgtctcttctttct

SEQ ID NO: 22583 - DNA, 25 bp, Homo sapien
tcctttaagccgagctacgcgcatg

SEQ ID NO: 22584 - DNA, 25 bp, Homo sapien
cccaggcatgaaccaaggtttctga

SEQ ID NO: 22585 - DNA, 25 bp, Homo sapien
tttctgaactactgggcgggagcca

SEQ ID NO: 22586 - DNA, 25 bp, Homo sapien
tgactccagtgtcccgagaggcgcc

SEQ ID NO: 22587 - DNA, 25 bp, Homo sapien
ggggttcgtttctgctgactccagt

SEQ ID NO: 22588 - DNA, 25 bp, Homo sapien
cgcatgcgcactgactgcggaactg

SEQ ID NO: 22589 - DNA, 25 bp, Homo sapien
agtgtcccgagaggcgccgcttctt

SEQ ID NO: 22590 - DNA, 25 bp, Homo sapien
tggtggacggcaacaaagccttagc

SEQ ID NO: 22591 - DNA, 25 bp, Homo sapien
gcgcgatcgggaccagaagtctcct

SEQ ID NO: 22592 - DNA, 25 bp, Homo sapien
gtccaaataggagcggccacagcca

SEQ ID NO: 22593 - DNA, 25 bp, Homo sapien
ccgtgcgtatctcgcttaagatggc

SEQ ID NO: 22594 - DNA, 25 bp, Homo sapien
ctaatcggggcttgtgagttcatga

SEQ ID NO: 22595 - DNA, 25 bp, Homo sapien
ttagcaaccggctcctagtgacccg

SEQ ID NO: 22596 - DNA, 25 bp, Homo sapien
ctctcggcctcgtaatgggacagca

SEQ ID NO: 22597 - DNA, 25 bp, Homo sapien
gcttccggcttctctttcttgtgtc

SEQ ID NO: 22598 - DNA, 25 bp, Homo sapien
gactgtatctaagccaccggcacag

SEQ ID NO: 22599 - DNA, 25 bp, Homo sapien
taagccaccggcacagatcgcagtg

SEQ ID NO: 22600 - DNA, 25 bp, Homo sapien
acgggtgaacgagagactgtatcta

SEQ ID NO: 22601 - DNA, 25 bp, Homo sapien
gagagactgtatctaagccaccggc

SEQ ID NO: 22602 - DNA, 25 bp, Homo sapien
gaacgagagactgtatctaagccac

SEQ ID NO: 22603 - DNA, 25 bp, Homo sapien
ctaagccaccggcacagatcgcagt

SEQ ID NO: 22604 - DNA, 25 bp, Homo sapien
agagactgtatctaagccaccggca

SEQ ID NO: 22605 - DNA, 25 bp, Homo sapien
gacgggtgaacgagagactgtatct

SEQ ID NO: 22606 - DNA, 25 bp, Homo sapien
gcccgtgagtccacagacgcttctg

SEQ ID NO: 22607 - DNA, 25 bp, Homo sapien
tgtcccagagccacaacggaggcct

SEQ ID NO: 22608 - DNA, 25 bp, Homo sapien
caggtgctgtttccagaacgcggtt

SEQ ID NO: 22609 - DNA, 25 bp, Homo sapien
gaaaccgagaccatcacgcctgctg

SEQ ID NO: 22610 - DNA, 25 bp, Homo sapien
tcccgtctccaagatgattccaagg

SEQ ID NO: 22611 - DNA, 25 bp, Homo sapien
ccttgcgtgcagagatgctggtcct

SEQ ID NO: 22612 - DNA, 25 bp, Homo sapien
tgctggccaggaaatgcccgtgagt

SEQ ID NO: 22613 - DNA, 25 bp, Homo sapien
tgcgggtgagacacatgcagcatcc

SEQ ID NO: 22614 - DNA, 25 bp, Homo sapien
agcgggtcagcgtgctcaacttcca

SEQ ID NO: 22615 - DNA, 25 bp, Homo sapien
atctatctcgtgtcgtccttccgaa

SEQ ID NO: 22616 - DNA, 25 bp, Homo sapien
tcgtccttccgaaagctgcagacca

SEQ ID NO: 22617 - DNA, 25 bp, Homo sapien
ctgctggccacgcagccactggtgt

SEQ ID NO: 22618 - DNA, 25 bp, Homo sapien
ctgctgcactgctacctgggcatcg

SEQ ID NO: 22619 - DNA, 25 bp, Homo sapien
acctaccaggcgctgtaccagaggc

SEQ ID NO: 22620 - DNA, 25 bp, Homo sapien
tgggcctcggactcacggtgtccct

SEQ ID NO: 22621 - DNA, 25 bp, Homo sapien
tccgctgctctacacgtggaggaac

SEQ ID NO: 22622 - DNA, 25 bp, Homo sapien
tgcacgttgctgaaactggcctgga

SEQ ID NO: 22623 - DNA, 25 bp, Homo sapien
agaccggcacgaattctagagtttc

SEQ ID NO: 22624 - DNA, 25 bp, Homo sapien
tgacctggaagcgaaagagaccggc

SEQ ID NO: 22625 - DNA, 25 bp, Homo sapien
catccaccgcgggtgcccaggaaag

SEQ ID NO: 22626 - DNA, 25 bp, Homo sapien
ctggcctggaggttctgacaagaat

SEQ ID NO: 22627 - DNA, 25 bp, Homo sapien
agcttctgcctgcacgttgctgaaa

SEQ ID NO: 22628 - DNA, 25 bp, Homo sapien
accgaggggccagcttctgcctgca

SEQ ID NO: 22629 - DNA, 25 bp, Homo sapien
ctgacaagaattagagcggcggccg

SEQ ID NO: 22630 - DNA, 25 bp, Homo sapien
cccggacaagcgctggggattcccg

SEQ ID NO: 22631 - DNA, 25 bp, Homo sapien
tttcctgtcccaggacgcgttgcgc

SEQ ID NO: 22632 - DNA, 25 bp, Homo sapien
acaagcgctggggattcccgtttga

SEQ ID NO: 22633 - DNA, 25 bp, Homo sapien
ggattcccgtttgaggcgtcactac

SEQ ID NO: 22634 - DNA, 25 bp, Homo sapien
cgtttgaggcgtcactactgtcact

SEQ ID NO: 22635 - DNA, 25 bp, Homo sapien
tgtctgtctgtgtctcgcagcggcg

SEQ ID NO: 22636 - DNA, 25 bp, Homo sapien
cccacggagccacttctagagggga

SEQ ID NO: 22637 - DNA, 25 bp, Homo sapien
aagtaagcgaattcccgggtgtgtg

SEQ ID NO: 22638 - DNA, 25 bp, Homo sapien
acatggggatcttcctggtcatcga

SEQ ID NO: 22639 - DNA, 25 bp, Homo sapien
caggactacaaggtgagctcgggcc

SEQ ID NO: 22640 - DNA, 25 bp, Homo sapien
tgttcatccgactgcaccaggacta

SEQ ID NO: 22641 - DNA, 25 bp, Homo sapien
tggtcatcgagacccacgggatggc

SEQ ID NO: 22642 - DNA, 25 bp, Homo sapien
agagctacgagctgatcctccaaga

SEQ ID NO: 22643 - DNA, 25 bp, Homo sapien
ctacaagatacgctacatggggatc

SEQ ID NO: 22644 - DNA, 25 bp, Homo sapien
ggaccggaagaccagcgtgttcatc

SEQ ID NO: 22645 - DNA, 25 bp, Homo sapien
tggggacccaccctacaagatacgc

SEQ ID NO: 22646 - DNA, 25 bp, Homo sapien
ttactgcactttacgactagcggga

SEQ ID NO: 22647 - DNA, 25 bp, Homo sapien
ccgcaaaatgctggtgcctttactg

SEQ ID NO: 22648 - DNA, 25 bp, Homo sapien
agagcccggctccactgaagaaacc

SEQ ID NO: 22649 - DNA, 25 bp, Homo sapien
agccaccgtttcatagcctcaggga

SEQ ID NO: 22650 - DNA, 25 bp, Homo sapien
cgagccctctaacccatggcttaaa

SEQ ID NO: 22651 - DNA, 25 bp, Homo sapien
cgcttcctaagcctgggtaagtgca

SEQ ID NO: 22652 - DNA, 25 bp, Homo sapien
aagtgcagtagctcttcgctcgaga

SEQ ID NO: 22653 - DNA, 25 bp, Homo sapien
gcctcacctacggtgccgcaaaatg

SEQ ID NO: 22654 - DNA, 25 bp, Homo sapien
ttgtctcctccgtacctctcgcagc

SEQ ID NO: 22655 - DNA, 25 bp, Homo sapien
ggctgcttgtctcctccgtacctct

SEQ ID NO: 22656 - DNA, 25 bp, Homo sapien
gccgcggctcaggttttctgctgct

SEQ ID NO: 22657 - DNA, 25 bp, Homo sapien
ccggttcattctccctcccgggctg

SEQ ID NO: 22658 - DNA, 25 bp, Homo sapien
gtctcctccgtacctctcgcagccc

SEQ ID NO: 22659 - DNA, 25 bp, Homo sapien
cagttgcgagtagcacgaggatctg

SEQ ID NO: 22660 - DNA, 25 bp, Homo sapien
cgcagttgcgagtagcacgaggatc

SEQ ID NO: 22661 - DNA, 25 bp, Homo sapien
agtagcacgaggatctggggtggcg

SEQ ID NO: 22662 - DNA, 25 bp, Homo sapien
agcaagatgcgaagcgagccgtaca

SEQ ID NO: 22663 - DNA, 25 bp, Homo sapien
gatgcgaagcgagccgtacagatcc

SEQ ID NO: 22664 - DNA, 25 bp, Homo sapien
gcgagccgtacagatcccgggctct

SEQ ID NO: 22665 - DNA, 25 bp, Homo sapien
cgaacgcaacttcgccctgcttgag

SEQ ID NO: 22666 - DNA, 25 bp, Homo sapien
cttcgccctgcttgagcgaggtagg

SEQ ID NO: 22667 - DNA, 25 bp, Homo sapien
tgtcagaaacgaatttttaagtcga

SEQ ID NO: 22668 - DNA, 25 bp, Homo sapien
gcagcagcaagatgcgaagcgagcc

SEQ ID NO: 22669 - DNA, 25 bp, Homo sapien
ttgcgagagcactacgcagtcagtc

SEQ ID NO: 22670 - DNA, 25 bp, Homo sapien
tatcaaggggatgcacgagctcctc

SEQ ID NO: 22671 - DNA, 25 bp, Homo sapien
tctcgcgagaaggtgactttctttc

SEQ ID NO: 22672 - DNA, 25 bp, Homo sapien
ctggtttccagaatccttagcgcga

SEQ ID NO: 22673 - DNA, 25 bp, Homo sapien
tagcgcgaggcggaaaaaatatttc

SEQ ID NO: 22674 - DNA, 25 bp, Homo sapien
cccagcttgtgttgatgccgcgatt

SEQ ID NO: 22675 - DNA, 25 bp, Homo sapien
ccgcgattttgactgagacttcttc

SEQ ID NO: 22676 - DNA, 25 bp, Homo sapien
cttctccaaggaaaatggcagctcc

SEQ ID NO: 22677 - DNA, 25 bp, Homo sapien
cccgagcagccgcttgcgatatcaa

SEQ ID NO: 22678 - DNA, 25 bp, Homo sapien
ttatcttccgccgtccagatgggcc

SEQ ID NO: 22679 - DNA, 25 bp, Homo sapien
ccgcatcgcggactcgtgtaaactt

SEQ ID NO: 22680 - DNA, 25 bp, Homo sapien
aggagccatccagcttatcttccgc

SEQ ID NO: 22681 - DNA, 25 bp, Homo sapien
ttttcttcagggcttccggttcaca

SEQ ID NO: 22682 - DNA, 25 bp, Homo sapien
ccggttcacaggttcgcatgctgtc

SEQ ID NO: 22683 - DNA, 25 bp, Homo sapien
gctcatctgcttgcacgggctctga

SEQ ID NO: 22684 - DNA, 25 bp, Homo sapien
cgtctcctccagtagtcgctgttaa

SEQ ID NO: 22685 - DNA, 25 bp, Homo sapien
cagtcgtagccatcttcatcgggga

SEQ ID NO: 22686 - DNA, 25 bp, Homo sapien
tgccatctggttccaggtgaccttc

SEQ ID NO: 22687 - DNA, 25 bp, Homo sapien
aacgggaccagctgtactacgagtg

SEQ ID NO: 22688 - DNA, 25 bp, Homo sapien
tatccttcggaactgggcagcactg

SEQ ID NO: 22689 - DNA, 25 bp, Homo sapien
gggcaccggcattctgagcatcttc

SEQ ID NO: 22690 - DNA, 25 bp, Homo sapien
tcctgcacgagtccatgctgagctc

SEQ ID NO: 22691 - DNA, 25 bp, Homo sapien
ctcactggaaacaggcgctcctcta

SEQ ID NO: 22692 - DNA, 25 bp, Homo sapien
ccgcagcgctttgctcagctagagc

SEQ ID NO: 22693 - DNA, 25 bp, Homo sapien
gccaagatgtcgcagcccaagaaaa

SEQ ID NO: 22694 - DNA, 25 bp, Homo sapien
tagaggatcttcttggcgccaatgc

SEQ ID NO: 22695 - DNA, 25 bp, Homo sapien
tgcatttcggaagaggacgtcaacg

SEQ ID NO: 22696 - DNA, 25 bp, Homo sapien
ggcgccaatgctaattgtcctgatt

SEQ ID NO: 22697 - DNA, 25 bp, Homo sapien
accagaaaatcgtcctgcggcttga

SEQ ID NO: 22698 - DNA, 25 bp, Homo sapien
ggcacgacctccgaaggctgagatc

SEQ ID NO: 22699 - DNA, 25 bp, Homo sapien
tggagggagaggcacctttctcatc

SEQ ID NO: 22700 - DNA, 25 bp, Homo sapien
gcaagggcaaacgagccacacggta

SEQ ID NO: 22701 - DNA, 25 bp, Homo sapien
cgggcgaaattggtattagaggatc

SEQ ID NO: 22702 - DNA, 25 bp, Homo sapien
tggtccgacccaccaccgaccgcgc

SEQ ID NO: 22703 - DNA, 25 bp, Homo sapien
ggaggcacagacaccccgggctgct

SEQ ID NO: 22704 - DNA, 25 bp, Homo sapien
ggtccttggcgattgccctccgcgg

SEQ ID NO: 22705 - DNA, 25 bp, Homo sapien
cgggcagctccatggcaacggaaga

SEQ ID NO: 22706 - DNA, 25 bp, Homo sapien
gcagctccatggcaacggaagactc

SEQ ID NO: 22707 - DNA, 25 bp, Homo sapien
tccatggcaacggaagactccatcg

SEQ ID NO: 22708 - DNA, 25 bp, Homo sapien
gcggcggtccttggcgattgccctc

SEQ ID NO: 22709 - DNA, 25 bp, Homo sapien
tggcaacggaagactccatcgtggc

SEQ ID NO: 22710 - DNA, 25 bp, Homo sapien
cgagctcctgcactgccagaacgga

SEQ ID NO: 22711 - DNA, 25 bp, Homo sapien
ccagaacggagggacgtgccacaac

SEQ ID NO: 22712 - DNA, 25 bp, Homo sapien
tacacgggcatcctctgcgagaagc

SEQ ID NO: 22713 - DNA, 25 bp, Homo sapien
gtgccacaacaacgtgcgctgcctg

SEQ ID NO: 22714 - DNA, 25 bp, Homo sapien
aacaacgtgcgctgcctgtgcccgg

SEQ ID NO: 22715 - DNA, 25 bp, Homo sapien
tgtgcccggccgcatacacgggcat

SEQ ID NO: 22716 - DNA, 25 bp, Homo sapien
gcatcctctgcgagaagctgcggtg

SEQ ID NO: 22717 - DNA, 25 bp, Homo sapien
aatgtctgcgacaacgagctcctgc

SEQ ID NO: 22718 - DNA, 25 bp, Homo sapien
cgcattactgtgctggacgcttggc

SEQ ID NO: 22719 - DNA, 25 bp, Homo sapien
gacgcttggcagtgtccatctccgc

SEQ ID NO: 22720 - DNA, 25 bp, Homo sapien
cagagctcaccagatgccgctggaa

SEQ ID NO: 22721 - DNA, 25 bp, Homo sapien
tctgggatccttcgcattactgtgc

SEQ ID NO: 22722 - DNA, 25 bp, Homo sapien
ggcgccctgcccttcacaaggagaa

SEQ ID NO: 22723 - DNA, 25 bp, Homo sapien
tccaggcgaacccaattccagggcg

SEQ ID NO: 22724 - DNA, 25 bp, Homo sapien
agcgcgacgctttccaaggcgcgga

SEQ ID NO: 22725 - DNA, 25 bp, Homo sapien
ccgccactccggattcgggatctga

SEQ ID NO: 22726 - DNA, 25 bp, Homo sapien
acaccgctcgattggccttttatgg

SEQ ID NO: 22727 - DNA, 25 bp, Homo sapien
tcccatccacagaaagagtcgcttg

SEQ ID NO: 22728 - DNA, 25 bp, Homo sapien
gcagccatggccatcgctcaactgg

SEQ ID NO: 22729 - DNA, 25 bp, Homo sapien
ttcttgctgaaggagcccacggagc

SEQ ID NO: 22730 - DNA, 25 bp, Homo sapien
gaatttccaaaggtgccgctcagtg

SEQ ID NO: 22731 - DNA, 25 bp, Homo sapien
gccttcgcgcaggagatctcgattg

SEQ ID NO: 22732 - DNA, 25 bp, Homo sapien
gccgctcagtgggaaaatccctttg

SEQ ID NO: 22733 - DNA, 25 bp, Homo sapien
cacggagtacgtgttctcggatttc

SEQ ID NO: 22734 - DNA, 25 bp, Homo sapien
tgagccgagtcccaggtcacccggt

SEQ ID NO: 22735 - DNA, 25 bp, Homo sapien
gcaccttgcaatggatgagccactg

SEQ ID NO: 22736 - DNA, 25 bp, Homo sapien
tgcggcctcaggttgatctccttca

SEQ ID NO: 22737 - DNA, 25 bp, Homo sapien
tccttcaggttgatggagtgcgccc

SEQ ID NO: 22738 - DNA, 25 bp, Homo sapien
tgcgcccggaggttgttaagcagct

SEQ ID NO: 22739 - DNA, 25 bp, Homo sapien
agcaggactccatcgcggagggtct

SEQ ID NO: 22740 - DNA, 25 bp, Homo sapien
ggtctgcgcaaggtcgaacacctga

SEQ ID NO: 22741 - DNA, 25 bp, Homo sapien
gcaaggtcgaacacctgagccgagt

SEQ ID NO: 22742 - DNA, 25 bp, Homo sapien
ggggcgccaaacacaatgcaccttc

SEQ ID NO: 22743 - DNA, 25 bp, Homo sapien
ggagtccatcgaggatgtctccctc

SEQ ID NO: 22744 - DNA, 25 bp, Homo sapien
agagggctcatcctaacggcttcag

SEQ ID NO: 22745 - DNA, 25 bp, Homo sapien
gcaccttcatcggttaaagctctgg

SEQ ID NO: 22746 - DNA, 25 bp, Homo sapien
ggcctaagacagcatcctcctcagg

SEQ ID NO: 22747 - DNA, 25 bp, Homo sapien
tgcgaccgacgaacgggatctctgc

SEQ ID NO: 22748 - DNA, 25 bp, Homo sapien
cctaacggcttcagcgcaaaggcgc

SEQ ID NO: 22749 - DNA, 25 bp, Homo sapien
ctctggaaggagagggctcatccta

SEQ ID NO: 22750 - DNA, 25 bp, Homo sapien
cctcggcgtcctggcccagagggat

SEQ ID NO: 22751 - DNA, 25 bp, Homo sapien
cccgcctccagagagccggaagtga

SEQ ID NO: 22752 - DNA, 25 bp, Homo sapien
gcagccagcgcaacatggtcccaga

SEQ ID NO: 22753 - DNA, 25 bp, Homo sapien
tgggcagcacgaagtcccgcagcca

SEQ ID NO: 22754 - DNA, 25 bp, Homo sapien
ccagtgcctggaagagggtctcgta

SEQ ID NO: 22755 - DNA, 25 bp, Homo sapien
ccattgcggtccagtgcctggaaga

SEQ ID NO: 22756 - DNA, 25 bp, Homo sapien
cagagggatgcccaggttcctgagc

SEQ ID NO: 22757 - DNA, 25 bp, Homo sapien
tcccgctgtcagcatgcgggtccga

SEQ ID NO: 22758 - DNA, 25 bp, Homo sapien
catgctgctctggatgcagggcttc

SEQ ID NO: 22759 - DNA, 25 bp, Homo sapien
gccctttcaagcctgctggggaatg

SEQ ID NO: 22760 - DNA, 25 bp, Homo sapien
caactcacatctggcgtctcaactg

SEQ ID NO: 22761 - DNA, 25 bp, Homo sapien
gcggctccgctagacagttgcagaa

SEQ ID NO: 22762 - DNA, 25 bp, Homo sapien
tggcctgccaggataacgatgacta

SEQ ID NO: 22763 - DNA, 25 bp, Homo sapien
cgctacgggatcctcttcgaagacc

SEQ ID NO: 22764 - DNA, 25 bp, Homo sapien
cgagaatcttaaacacccgcgagtg

SEQ ID NO: 22765 - DNA, 25 bp, Homo sapien
aacgatgactacttacgctacggga

SEQ ID NO: 22766 - DNA, 25 bp, Homo sapien
tcttcgaagaggatcccgtagcgta

SEQ ID NO: 22767 - DNA, 25 bp, Homo sapien
ccagcaggcttgaaagggcactcgc

SEQ ID NO: 22768 - DNA, 25 bp, Homo sapien
ccagatgtgagttgaggtgccagac

SEQ ID NO: 22769 - DNA, 25 bp, Homo sapien
cgcgacagttgagacgccagatgtg

SEQ ID NO: 22770 - DNA, 25 bp, Homo sapien
ttctgcaactgtctagcggagccgc

SEQ ID NO: 22771 - DNA, 25 bp, Homo sapien
tagtcatcgttatcctggcaggcca

SEQ ID NO: 22772 - DNA, 25 bp, Homo sapien
cactcgcgggtgtttaagattctcg

SEQ ID NO: 22773 - DNA, 25 bp, Homo sapien
cccgtagcgtaagtagtcatcgtta

SEQ ID NO: 22774 - DNA, 25 bp, Homo sapien
gacgtgctaactgccgtcgcgggtt

SEQ ID NO: 22775 - DNA, 25 bp, Homo sapien
tgagcaccaaaagggcgctcacctc

SEQ ID NO: 22776 - DNA, 25 bp, Homo sapien
cttgcaggcgcctggctctcacgat

SEQ ID NO: 22777 - DNA, 25 bp, Homo sapien
cgcctggctctcacgatgatgaaga

SEQ ID NO: 22778 - DNA, 25 bp, Homo sapien
taagtttaaggtggacttcgagctc

SEQ ID NO: 22779 - DNA, 25 bp, Homo sapien
ctcagtgcccttcgtcaatggggtc

SEQ ID NO: 22780 - DNA, 25 bp, Homo sapien
cttctgcaagatgcggctgctggac

SEQ ID NO: 22781 - DNA, 25 bp, Homo sapien
tgcccttcgtcaatggggtcctctt

SEQ ID NO: 22782 - DNA, 25 bp, Homo sapien
tggcccagtgacacctgcgttcaga

SEQ ID NO: 22783 - DNA, 25 bp, Homo sapien
gtcgcttccatcatcctgcggtaag

SEQ ID NO: 22784 - DNA, 25 bp, Homo sapien
tctaggctctcagttccaaggcgtc

SEQ ID NO: 22785 - DNA, 25 bp, Homo sapien
gttttgcgtctcgtaacggccgctg

SEQ ID NO: 22786 - DNA, 25 bp, Homo sapien
ggcgcatgcccagaagccattttca

SEQ ID NO: 22787 - DNA, 25 bp, Homo sapien
gctttcatcccagagcagtccacgg

SEQ ID NO: 22788 - DNA, 25 bp, Homo sapien
cgcttctgtctttgtacgggccgtc

SEQ ID NO: 22789 - DNA, 25 bp, Homo sapien
aggtcctcttccgaaccttggcgag

SEQ ID NO: 22790 - DNA, 25 bp, Homo sapien
ttcgatggagtagggtcccagaccg

SEQ ID NO: 22791 - DNA, 25 bp, Homo sapien
gtcactgcagcgacttcagcgtgca

SEQ ID NO: 22792 - DNA, 25 bp, Homo sapien
cagcccaactgagcgtctctgattg

SEQ ID NO: 22793 - DNA, 25 bp, Homo sapien
cgccatcttgttcccaggggcagtt

SEQ ID NO: 22794 - DNA, 25 bp, Homo sapien
ctcgccttctgcgtggagttctcgc

SEQ ID NO: 22795 - DNA, 25 bp, Homo sapien
gaagaggacgctccagcccaactga

SEQ ID NO: 22796 - DNA, 25 bp, Homo sapien
tcccagaccgttgtcccgaagagcg

SEQ ID NO: 22797 - DNA, 25 bp, Homo sapien
ccttctcccgacgacgttcgatgga

SEQ ID NO: 22798 - DNA, 25 bp, Homo sapien
ccctcgttggactcgcccggacgct

SEQ ID NO: 22799 - DNA, 25 bp, Homo sapien
aggaaagacctgagaactcggtgcg

SEQ ID NO: 22800 - DNA, 25 bp, Homo sapien
ttgaggagaggaaagacctgagaac

SEQ ID NO: 22801 - DNA, 25 bp, Homo sapien
gcccggtgctgtccgccgtcctggt

SEQ ID NO: 22802 - DNA, 25 bp, Homo sapien
tcccatgaagacacccggagggtcc

SEQ ID NO: 22803 - DNA, 25 bp, Homo sapien
accgcctcgggacgaggttctgccg

SEQ ID NO: 22804 - DNA, 25 bp, Homo sapien
ctggtgctgaacctgggctgggcga

SEQ ID NO: 22805 - DNA, 25 bp, Homo sapien
gccggtgtcgcctcccatgaagaca

SEQ ID NO: 22806 - DNA, 25 bp, Homo sapien
tgggacctgtgtgaggacttcttcc

SEQ ID NO: 22807 - DNA, 25 bp, Homo sapien
caccagttggggatgtctctccatc

SEQ ID NO: 22808 - DNA, 25 bp, Homo sapien
agccgccgcgagcacttgttgcttt

SEQ ID NO: 22809 - DNA, 25 bp, Homo sapien
ggaaattcccttgctgacgcgcgtg

SEQ ID NO: 22810 - DNA, 25 bp, Homo sapien
tcccacggaggttccacctgtactg

SEQ ID NO: 22811 - DNA, 25 bp, Homo sapien
ccttggctcacgatcggtttggcac

SEQ ID NO: 22812 - DNA, 25 bp, Homo sapien
tcggaatttcatagacggccttggc

SEQ ID NO: 22813 - DNA, 25 bp, Homo sapien
tccgagacaattcgggcgctgttta

SEQ ID NO: 22814 - DNA, 25 bp, Homo sapien
tgcccacaaagttctgccagtcgga

SEQ ID NO: 22815 - DNA, 25 bp, Homo sapien
agcgcgtacacactcgcgtggtgtc

SEQ ID NO: 22816 - DNA, 25 bp, Homo sapien
tgaaactcctccgacagggcttcgc

SEQ ID NO: 22817 - DNA, 25 bp, Homo sapien
gggtttgttggagcacttttatatc

SEQ ID NO: 22818 - DNA, 25 bp, Homo sapien
gcacagcatacaaggccgtcccgag

SEQ ID NO: 22819 - DNA, 25 bp, Homo sapien
tgagggaccattttgcaggagccac

SEQ ID NO: 22820 - DNA, 25 bp, Homo sapien
ccagtcggagaaggtgtagttgttc

SEQ ID NO: 22821 - DNA, 25 bp, Homo sapien
tccaagagaagaagtgcgaggcatt

SEQ ID NO: 22822 - DNA, 25 bp, Homo sapien
gggcgttgtcggtttgaatgagagc

SEQ ID NO: 22823 - DNA, 25 bp, Homo sapien
tgcgtgtggggcttctgtgtccaga

SEQ ID NO: 22824 - DNA, 25 bp, Homo sapien
ccgcgacgcgggttctgaggcgttt

SEQ ID NO: 22825 - DNA, 25 bp, Homo sapien
ctgcaccttcaccgcgtacccggga

SEQ ID NO: 22826 - DNA, 25 bp, Homo sapien
cgtgaccacccgtctgtcgcccgag

SEQ ID NO: 22827 - DNA, 25 bp, Homo sapien
gcgctacgagctctggcccacgtga

SEQ ID NO: 22828 - DNA, 25 bp, Homo sapien
aggggcgctacgagctctggcccac

SEQ ID NO: 22829 - DNA, 25 bp, Homo sapien
cggagggacgctccgggaaagcgag

SEQ ID NO: 22830 - DNA, 25 bp, Homo sapien
tctgcgcgcgggttattttcgccgc

SEQ ID NO: 22831 - DNA, 25 bp, Homo sapien
gtgcgctcaggtctcgctttgccct

SEQ ID NO: 22832 - DNA, 25 bp, Homo sapien
cagaagaggtcgcacagcttgccgc

SEQ ID NO: 22833 - DNA, 25 bp, Homo sapien
gcccagggtttcagcgtgcttcctg

SEQ ID NO: 22834 - DNA, 25 bp, Homo sapien
gcttcctgggcctcgtcatcgaatt

SEQ ID NO: 22835 - DNA, 25 bp, Homo sapien
gggccgctgattggcctcgttgatt

SEQ ID NO: 22836 - DNA, 25 bp, Homo sapien
ctgcggaactctttctgcgaaggaa

SEQ ID NO: 22837 - DNA, 25 bp, Homo sapien
catcgaattgttcggctgacggctg

SEQ ID NO: 22838 - DNA, 25 bp, Homo sapien
aaatgcgacagtctctaagggagga

SEQ ID NO: 22839 - DNA, 25 bp, Homo sapien
cctccctgtaatcccgaaggaattg

SEQ ID NO: 22840 - DNA, 25 bp, Homo sapien
tggttacactacttccgccgcctca

SEQ ID NO: 22841 - DNA, 25 bp, Homo sapien
gtagctgggcctagccctctgcggc

SEQ ID NO: 22842 - DNA, 25 bp, Homo sapien
gtgctttccggcctagcggcggaaa

SEQ ID NO: 22843 - DNA, 25 bp, Homo sapien
tagcggcggaaatgcgacagtctct

SEQ ID NO: 22844 - DNA, 25 bp, Homo sapien
atcacgggctaggtcgcgagtatct

SEQ ID NO: 22845 - DNA, 25 bp, Homo sapien
caaagaaaaggaaatcacgggctag

SEQ ID NO: 22846 - DNA, 25 bp, Homo sapien
taccacggccaagtacgaagccttc

SEQ ID NO: 22847 - DNA, 25 bp, Homo sapien
agccttcgagatagcgttcttctta

SEQ ID NO: 22848 - DNA, 25 bp, Homo sapien
cgaagccttcgagatagcgttcttc

SEQ ID NO: 22849 - DNA, 25 bp, Homo sapien
ccacggccaagtacgaagccttcga

SEQ ID NO: 22850 - DNA, 25 bp, Homo sapien
gtacgaagccttcgagatagcgttc

SEQ ID NO: 22851 - DNA, 25 bp, Homo sapien
acggccaagtacgaagccttcgaga

SEQ ID NO: 22852 - DNA, 25 bp, Homo sapien
gccttcgagatagcgttcttcttac

SEQ ID NO: 22853 - DNA, 25 bp, Homo sapien
ggccaagtacgaagccttcgagata

SEQ ID NO: 22854 - DNA, 25 bp, Homo sapien
cgcaggggcacgcagaaaagactta

SEQ ID NO: 22855 - DNA, 25 bp, Homo sapien
cgccatgacgaacggtgagaactga

SEQ ID NO: 22856 - DNA, 25 bp, Homo sapien
aggtccagggccagccgccatgacg

SEQ ID NO: 22857 - DNA, 25 bp, Homo sapien
tcctgatagcgttcggcgctcgcct

SEQ ID NO: 22858 - DNA, 25 bp, Homo sapien
cggctagccactcctgatagcgttc

SEQ ID NO: 22859 - DNA, 25 bp, Homo sapien
cgagctcgacaatcggctagccact

SEQ ID NO: 22860 - DNA, 25 bp, Homo sapien
aacggtgagaactgatgccctgagc

SEQ ID NO: 22861 - DNA, 25 bp, Homo sapien
acgcagtttcccgagctcgacaatc

SEQ ID NO: 22862 - DNA, 25 bp, Homo sapien
cccgcttacactttgatcttatttg

SEQ ID NO: 22863 - DNA, 25 bp, Homo sapien
gcgattctgatctgggcacggccac

SEQ ID NO: 22864 - DNA, 25 bp, Homo sapien
cggccactgattatcgaggcgattc

SEQ ID NO: 22865 - DNA, 25 bp, Homo sapien
attgatcagatagacgaggccgggc

SEQ ID NO: 22866 - DNA, 25 bp, Homo sapien
ggccgacccgaaatgaaaagctctc

SEQ ID NO: 22867 - DNA, 25 bp, Homo sapien
tgctcggtggtttctcccagaatcc

SEQ ID NO: 22868 - DNA, 25 bp, Homo sapien
agcaacgcgcgcactctgaggaaca

SEQ ID NO: 22869 - DNA, 25 bp, Homo sapien
gcccggcgctcagaagtgatgaatt

SEQ ID NO: 22870 - DNA, 25 bp, Homo sapien
aattgcggctaaggcaaactcctcg

SEQ ID NO: 22871 - DNA, 25 bp, Homo sapien
aggcaaactcctcgcttaaactcgg

SEQ ID NO: 22872 - DNA, 25 bp, Homo sapien
aaggcaaactcctcgcttaaactcg

SEQ ID NO: 22873 - DNA, 25 bp, Homo sapien
ggctaaggcaaactcctcgcttaaa

SEQ ID NO: 22874 - DNA, 25 bp, Homo sapien
cggctaaggcaaactcctcgcttaa

SEQ ID NO: 22875 - DNA, 25 bp, Homo sapien
gcggctaaggcaaactcctcgctta

SEQ ID NO: 22876 - DNA, 25 bp, Homo sapien
tgcggctaaggcaaactcctcgctt

SEQ ID NO: 22877 - DNA, 25 bp, Homo sapien
ttgcggctaaggcaaactcctcgct

SEQ ID NO: 22878 - DNA, 25 bp, Homo sapien
cgccacgtgtgcaacatcggagatg

SEQ ID NO: 22879 - DNA, 25 bp, Homo sapien
tttctctcggttcacacgccacgtg

SEQ ID NO: 22880 - DNA, 25 bp, Homo sapien
acgacgtctggagggtgatctctcc

SEQ ID NO: 22881 - DNA, 25 bp, Homo sapien
ggaacacgtactggggcctcttcca

SEQ ID NO: 22882 - DNA, 25 bp, Homo sapien
tggccttcgtaggagggaacacgta

SEQ ID NO: 22883 - DNA, 25 bp, Homo sapien
agggcttctcttctagccggttgta

SEQ ID NO: 22884 - DNA, 25 bp, Homo sapien
acggaaatttgttggctggcttgga

SEQ ID NO: 22885 - DNA, 25 bp, Homo sapien
ggatcaactacagtgtcagggcttc

SEQ ID NO: 22886 - DNA, 25 bp, Homo sapien
tctggatttgtttcgggtggataaa

SEQ ID NO: 22887 - DNA, 25 bp, Homo sapien
acgcacgcgcatcgggagctgtcaa

SEQ ID NO: 22888 - DNA, 25 bp, Homo sapien
cgaaaacacagcctggtcgccgggg

SEQ ID NO: 22889 - DNA, 25 bp, Homo sapien
ggcgggttacctccttgatgctaaa

SEQ ID NO: 22890 - DNA, 25 bp, Homo sapien
cagcgagtggcgacgatgtaagtac

SEQ ID NO: 22891 - DNA, 25 bp, Homo sapien
gccctcatccgagagacgcaggaga

SEQ ID NO: 22892 - DNA, 25 bp, Homo sapien
cgcgatccttgcttccctgagcgtt

SEQ ID NO: 22893 - DNA, 25 bp, Homo sapien
agcgcttcaaggacccgggactagt

SEQ ID NO: 22894 - DNA, 25 bp, Homo sapien
ctatggtaatgagccgccgccgcga

SEQ ID NO: 22895 - DNA, 25 bp, Homo sapien
cggctgtgtggcttccgatcgctaa

SEQ ID NO: 22896 - DNA, 25 bp, Homo sapien
atcgctaattcgcaccgggcatctg

SEQ ID NO: 22897 - DNA, 25 bp, Homo sapien
attcgcaccgggcatctggcgaggc

SEQ ID NO: 22898 - DNA, 25 bp, Homo sapien
cgcgagcaggtctatggtaatgagc

SEQ ID NO: 22899 - DNA, 25 bp, Homo sapien
tgtggcttccgatcgctaattcgca

SEQ ID NO: 22900 - DNA, 25 bp, Homo sapien
ccgccgagccatccagacgcaggcc

SEQ ID NO: 22901 - DNA, 25 bp, Homo sapien
aggtctatggtaatgagccgccgcc

SEQ ID NO: 22902 - DNA, 25 bp, Homo sapien
tgatcctgtacagcatccggtgagc

SEQ ID NO: 22903 - DNA, 25 bp, Homo sapien
atccgctccaaggtcgccgacagga

SEQ ID NO: 22904 - DNA, 25 bp, Homo sapien
gctgctggggaaacatccgctccaa

SEQ ID NO: 22905 - DNA, 25 bp, Homo sapien
ggcttggaaaagctcgagcggcttc

SEQ ID NO: 22906 - DNA, 25 bp, Homo sapien
cgtgacggtggagaacaagctcatc

SEQ ID NO: 22907 - DNA, 25 bp, Homo sapien
tggctgcccgacaccttcatcgtga

SEQ ID NO: 22908 - DNA, 25 bp, Homo sapien
agaagctgcgcggttatttatatcc

SEQ ID NO: 22909 - DNA, 25 bp, Homo sapien
tcgtgaacgccaagtcggcctggtt

SEQ ID NO: 22910 - DNA, 25 bp, Homo sapien
ggcggcgattttcccttctgtcagg

SEQ ID NO: 22911 - DNA, 25 bp, Homo sapien
gggaacctcggaatcagaacgctga

SEQ ID NO: 22912 - DNA, 25 bp, Homo sapien
ctgtcccggacctcgctttttgatg

SEQ ID NO: 22913 - DNA, 25 bp, Homo sapien
ctctcattggctaccgcacgcagtg

SEQ ID NO: 22914 - DNA, 25 bp, Homo sapien
cgtttctctcgcgacacttcatgga

SEQ ID NO: 22915 - DNA, 25 bp, Homo sapien
acacggtctgaacttgcctctgaga

SEQ ID NO: 22916 - DNA, 25 bp, Homo sapien
ttccgcctgggaacctgcagaaaca

SEQ ID NO: 22917 - DNA, 25 bp, Homo sapien
tggaccggcgccatctaagaactcc

SEQ ID NO: 22918 - DNA, 25 bp, Homo sapien
gcgcgctgcgtgtgaccatcatcac

SEQ ID NO: 22919 - DNA, 25 bp, Homo sapien
acctgcctctgtcgtgatggctaca

SEQ ID NO: 22920 - DNA, 25 bp, Homo sapien
tgcgagaactacatgcgctgcgtgt

SEQ ID NO: 22921 - DNA, 25 bp, Homo sapien
tgcaggagcgcctatacctcaaccg

SEQ ID NO: 22922 - DNA, 25 bp, Homo sapien
accacgtggtggtcttcaacgtaca

SEQ ID NO: 22923 - DNA, 25 bp, Homo sapien
gctaggcctcttcatccaggcggtg

SEQ ID NO: 22924 - DNA, 25 bp, Homo sapien
cttcacgggtgactactgcgagacc

SEQ ID NO: 22925 - DNA, 25 bp, Homo sapien
tggaggacatgtcacccgagcgctt

SEQ ID NO: 22926 - DNA, 25 bp, Homo sapien
tcagcacaaaggtctcccgccgagg

SEQ ID NO: 22927 - DNA, 25 bp, Homo sapien
ccgcgtcaaagagttcacagtgggc

SEQ ID NO: 22928 - DNA, 25 bp, Homo sapien
cagcaggtctcggacaggactatcc

SEQ ID NO: 22929 - DNA, 25 bp, Homo sapien
gtctcccgccgaggactgggcttca

SEQ ID NO: 22930 - DNA, 25 bp, Homo sapien
agggcacactgctccagctgagcgg

SEQ ID NO: 22931 - DNA, 25 bp, Homo sapien
agcggccagccggttggcctcatcg

SEQ ID NO: 22932 - DNA, 25 bp, Homo sapien
ggtgctccgcgtcaaagagttcaca

SEQ ID NO: 22933 - DNA, 25 bp, Homo sapien
gactgggcttcactcggcgaggccc

SEQ ID NO: 22934 - DNA, 25 bp, Homo sapien
cgctaaccgacgctctacgggagga

SEQ ID NO: 22935 - DNA, 25 bp, Homo sapien
gctgcctaacgtggccgctaaccga

SEQ ID NO: 22936 - DNA, 25 bp, Homo sapien
gtctccagaacggttgtgctgccta

SEQ ID NO: 22937 - DNA, 25 bp, Homo sapien
ggagactctctttcccgtaggcaga

SEQ ID NO: 22938 - DNA, 25 bp, Homo sapien
ttcccagaagactgcatcccggtgg

SEQ ID NO: 22939 - DNA, 25 bp, Homo sapien
acctagtcccgggaatcagctccga

SEQ ID NO: 22940 - DNA, 25 bp, Homo sapien
gcactcaatatgcaggcgccgcatt

SEQ ID NO: 22941 - DNA, 25 bp, Homo sapien
aaattcgttttcttgggcgcactca

SEQ ID NO: 22942 - DNA, 25 bp, Homo sapien
tcccgggcccggcttgtggagttca

SEQ ID NO: 22943 - DNA, 25 bp, Homo sapien
agcgcggcgctccttggatacgcgc

SEQ ID NO: 22944 - DNA, 25 bp, Homo sapien
gtcctggattcggatgctaagatgc

SEQ ID NO: 22945 - DNA, 25 bp, Homo sapien
ccgctcacctggtgcgtgttgttgg

SEQ ID NO: 22946 - DNA, 25 bp, Homo sapien
cggatgctaagatgcgggactgatt

SEQ ID NO: 22947 - DNA, 25 bp, Homo sapien
tccatcgccgccgaatgccgccgac

SEQ ID NO: 22948 - DNA, 25 bp, Homo sapien
gtaggagcttctcataccttcccgc

SEQ ID NO: 22949 - DNA, 25 bp, Homo sapien
tgtggagttcacgtaggagcttctc

SEQ ID NO: 22950 - DNA, 25 bp, Homo sapien
acgcggggattctgaggaccaacac

SEQ ID NO: 22951 - DNA, 25 bp, Homo sapien
gctgcacggacctgtcgtactcaga

SEQ ID NO: 22952 - DNA, 25 bp, Homo sapien
tagggttcctccacggtgttctcca

SEQ ID NO: 22953 - DNA, 25 bp, Homo sapien
tgacataataggtccctcgccggct

SEQ ID NO: 22954 - DNA, 25 bp, Homo sapien
ttgtagagaagatgtgagcccgccc

SEQ ID NO: 22955 - DNA, 25 bp, Homo sapien
tcccgcctaggtgattgggccaacg

SEQ ID NO: 22956 - DNA, 25 bp, Homo sapien
tactaaggaccaactgcgcgtgcga

SEQ ID NO: 22957 - DNA, 25 bp, Homo sapien
gctccaggactttgggcggtaatga

SEQ ID NO: 22958 - DNA, 25 bp, Homo sapien
gcggaactaaccacggaggcctctg

SEQ ID NO: 22959 - DNA, 25 bp, Homo sapien
gcgctcacatttcacccgggcgaga

SEQ ID NO: 22960 - DNA, 25 bp, Homo sapien
cccggattcggtccttctatgtgca

SEQ ID NO: 22961 - DNA, 25 bp, Homo sapien
gctgtgacgctgacctgaagcaatg

SEQ ID NO: 22962 - DNA, 25 bp, Homo sapien
caaagttctccagtgggtgagtcgc

SEQ ID NO: 22963 - DNA, 25 bp, Homo sapien
gcgccagcatgtcctcgaccgagag

SEQ ID NO: 22964 - DNA, 25 bp, Homo sapien
ctccacctagatgtcgggctgcaca

SEQ ID NO: 22965 - DNA, 25 bp, Homo sapien
gccgctgggcttcatcaaagttctc

SEQ ID NO: 22966 - DNA, 25 bp, Homo sapien
tgacggtgagtaaagccaccctaaa

SEQ ID NO: 22967 - DNA, 25 bp, Homo sapien
cgagtctcgatgacttcgcgggaca

SEQ ID NO: 22968 - DNA, 25 bp, Homo sapien
tctcgatgacttcgcgggacagagc

SEQ ID NO: 22969 - DNA, 25 bp, Homo sapien
ccgcggctgacggtgagtaaagcca

SEQ ID NO: 22970 - DNA, 25 bp, Homo sapien
agccgccgactggagccgccgtccg

SEQ ID NO: 22971 - DNA, 25 bp, Homo sapien
gcccgctccgtcaccttcgcgcctc

SEQ ID NO: 22972 - DNA, 25 bp, Homo sapien
ggtcctagcgcctgctcaccgctcg

SEQ ID NO: 22973 - DNA, 25 bp, Homo sapien
acctgcccgcggctgacggtgagta

SEQ ID NO: 22974 - DNA, 25 bp, Homo sapien
ctgtcccggccaggaaccagtgagt

SEQ ID NO: 22975 - DNA, 25 bp, Homo sapien
acccggaagacgtgttcgggcagct

SEQ ID NO: 22976 - DNA, 25 bp, Homo sapien
aggtaggtctggttcccgctccagc

SEQ ID NO: 22977 - DNA, 25 bp, Homo sapien
agccgagactgacccgctggctgcg

SEQ ID NO: 22978 - DNA, 25 bp, Homo sapien
ggatcttggcgcacctggtagcttt

SEQ ID NO: 22979 - DNA, 25 bp, Homo sapien
gggcttcaccatctttctgacagcg

SEQ ID NO: 22980 - DNA, 25 bp, Homo sapien
catctttctgacagcgctgtcccgg

SEQ ID NO: 22981 - DNA, 25 bp, Homo sapien
tccgcgatcgcaaacccggaagacg

SEQ ID NO: 22982 - DNA, 25 bp, Homo sapien
gggtcgttccctcaaccagcgagct

SEQ ID NO: 22983 - DNA, 25 bp, Homo sapien
gacgcgcgcggggtcgttccctcaa

SEQ ID NO: 22984 - DNA, 25 bp, Homo sapien
ccaccgaccgcggtcgctgcctcca

SEQ ID NO: 22985 - DNA, 25 bp, Homo sapien
ccctgccaccgcctcgaccgctgag

SEQ ID NO: 22986 - DNA, 25 bp, Homo sapien
tgtcactgcgcccaccttacgcagg

SEQ ID NO: 22987 - DNA, 25 bp, Homo sapien
gtctcagcccatggccggtctggga

SEQ ID NO: 22988 - DNA, 25 bp, Homo sapien
tcggcgaggacgtgtctcagcccat

SEQ ID NO: 22989 - DNA, 25 bp, Homo sapien
gtcactgcacctgctcggcgaggac

SEQ ID NO: 22990 - DNA, 25 bp, Homo sapien
ccgtgacttccgctttcggtctcaa

SEQ ID NO: 22991 - DNA, 25 bp, Homo sapien
cgggcagcgaacttgacagaacctc

SEQ ID NO: 22992 - DNA, 25 bp, Homo sapien
gaacctcgaaactctgcagatccgc

SEQ ID NO: 22993 - DNA, 25 bp, Homo sapien
ctccctgaggagagtggtttaaacg

SEQ ID NO: 22994 - DNA, 25 bp, Homo sapien
agtgtcgtaaacgtcggatatccgg

SEQ ID NO: 22995 - DNA, 25 bp, Homo sapien
gcccagcaatagacggtgcctcagc

SEQ ID NO: 22996 - DNA, 25 bp, Homo sapien
atcgaccgcaacttacgggaggacg

SEQ ID NO: 22997 - DNA, 25 bp, Homo sapien
cctaggcgcttggaaggcctgaacg

SEQ ID NO: 22998 - DNA, 25 bp, Homo sapien
agttcagctccagccgcggacgcta

SEQ ID NO: 22999 - DNA, 25 bp, Homo sapien
gggagaatcggcagtcactatggca

SEQ ID NO: 23000 - DNA, 25 bp, Homo sapien
acggccagcagtgtgagttcagctc

SEQ ID NO: 23001 - DNA, 25 bp, Homo sapien
ctcggaagaccgctgcggcatgaca

SEQ ID NO: 23002 - DNA, 25 bp, Homo sapien
gaaaccgtgcccagggctctcggaa

SEQ ID NO: 23003 - DNA, 25 bp, Homo sapien
tgcctgcgactgagctgagaaggaa

SEQ ID NO: 23004 - DNA, 25 bp, Homo sapien
atggcaacccgagacgcctcgcatg

SEQ ID NO: 23005 - DNA, 25 bp, Homo sapien
cgcggaatacctagggcctcggaag

SEQ ID NO: 23006 - DNA, 25 bp, Homo sapien
ccagacggttactcatcggaggaca

SEQ ID NO: 23007 - DNA, 25 bp, Homo sapien
tgaacttcaagtccggtaacatatg

SEQ ID NO: 23008 - DNA, 25 bp, Homo sapien
taccgcttcaccacggagctgatga

SEQ ID NO: 23009 - DNA, 25 bp, Homo sapien
ttcatgctttttagtcaagcgcccg

SEQ ID NO: 23010 - DNA, 25 bp, Homo sapien
cggaggacatcgtctactactggtc

SEQ ID NO: 23011 - DNA, 25 bp, Homo sapien
tgtgtgcttttcctccagacggtta

SEQ ID NO: 23012 - DNA, 25 bp, Homo sapien
cgcccgcctgtggttttcatgcttt

SEQ ID NO: 23013 - DNA, 25 bp, Homo sapien
caggagcacatccacgggctggaca

SEQ ID NO: 23014 - DNA, 25 bp, Homo sapien
cgctcccttgggagcacgtggccta

SEQ ID NO: 23015 - DNA, 25 bp, Homo sapien
gcccagggagtgttgagagaaatct

SEQ ID NO: 23016 - DNA, 25 bp, Homo sapien
atctggacgagtttcgggtcccgct

SEQ ID NO: 23017 - DNA, 25 bp, Homo sapien
ggggtctcacctgttgcgtgactcc

SEQ ID NO: 23018 - DNA, 25 bp, Homo sapien
taccagcctctcgattgcagggttg

SEQ ID NO: 23019 - DNA, 25 bp, Homo sapien
cgacaccggggtcgccttgaggcca

SEQ ID NO: 23020 - DNA, 25 bp, Homo sapien
gggagtccgaccctgaatgcccagg

SEQ ID NO: 23021 - DNA, 25 bp, Homo sapien
acgtggcctaccagcctctcgattg

SEQ ID NO: 23022 - DNA, 25 bp, Homo sapien
aggtggcgcctaacgggctgtccct

SEQ ID NO: 23023 - DNA, 25 bp, Homo sapien
ctggactctccccagaaatcgggcg

SEQ ID NO: 23024 - DNA, 25 bp, Homo sapien
ttgcaggtgggtagcgctgagagca

SEQ ID NO: 23025 - DNA, 25 bp, Homo sapien
cttgcaggtgggtagcgctgagagc

SEQ ID NO: 23026 - DNA, 25 bp, Homo sapien
cagagccgtgccccttgcaggtggg

SEQ ID NO: 23027 - DNA, 25 bp, Homo sapien
gctgtccctctactgtggtcagagc

SEQ ID NO: 23028 - DNA, 25 bp, Homo sapien
ggtggcgcctaacgggctgtccctc

SEQ ID NO: 23029 - DNA, 25 bp, Homo sapien
tggcgcctaacgggctgtccctcta

SEQ ID NO: 23030 - DNA, 25 bp, Homo sapien
gaagaacttttctcttacgatctgg

SEQ ID NO: 23031 - DNA, 25 bp, Homo sapien
cgatctggctttactctcacgcgca

SEQ ID NO: 23032 - DNA, 25 bp, Homo sapien
cgcctgttggttggaagtgacgacc

SEQ ID NO: 23033 - DNA, 25 bp, Homo sapien
tgaggatccagcaacctgctccgtg

SEQ ID NO: 23034 - DNA, 25 bp, Homo sapien
gtggcggtggatcttactccttcca

SEQ ID NO: 23035 - DNA, 25 bp, Homo sapien
gaggtcgcagttcagcccagctgag

SEQ ID NO: 23036 - DNA, 25 bp, Homo sapien
ggaccttgctccctgaacactcgga

SEQ ID NO: 23037 - DNA, 25 bp, Homo sapien
ccttccagccagtgaggatccagca

SEQ ID NO: 23038 - DNA, 25 bp, Homo sapien
cttgccgctgtctgtgcgtgtggct

SEQ ID NO: 23039 - DNA, 25 bp, Homo sapien
ctgtgcttgccgctgtctgtgcgtg

SEQ ID NO: 23040 - DNA, 25 bp, Homo sapien
ggctgtccctgacagcggggtctgt

SEQ ID NO: 23041 - DNA, 25 bp, Homo sapien
cttcagggctgtccctgacagcggg

SEQ ID NO: 23042 - DNA, 25 bp, Homo sapien
tctgggcctctcacaaacgctgagc

SEQ ID NO: 23043 - DNA, 25 bp, Homo sapien
ctctgggcctctcacaaacgctgag

SEQ ID NO: 23044 - DNA, 25 bp, Homo sapien
gggtcgcagcaaggcttcccctcta

SEQ ID NO: 23045 - DNA, 25 bp, Homo sapien
tccagattggcccgtttcgggggca

SEQ ID NO: 23046 - DNA, 25 bp, Homo sapien
agccctgctcggtttaggcctgtct

SEQ ID NO: 23047 - DNA, 25 bp, Homo sapien
ggaatccgcaccaaccagcaccatg

SEQ ID NO: 23048 - DNA, 25 bp, Homo sapien
ctcttatactctgagccctgctcgg

SEQ ID NO: 23049 - DNA, 25 bp, Homo sapien
cctctccggagctcttatactctga

SEQ ID NO: 23050 - DNA, 25 bp, Homo sapien
ccagaatggcgcctttcgggttgtg

SEQ ID NO: 23051 - DNA, 25 bp, Homo sapien
cgggcctccagaatggcgcctttcg

SEQ ID NO: 23052 - DNA, 25 bp, Homo sapien
ggaggaagtcttactgagtgcagcc

SEQ ID NO: 23053 - DNA, 25 bp, Homo sapien
ttaggcctgtctgcggaatccgcac

SEQ ID NO: 23054 - DNA, 25 bp, Homo sapien
ggctctaccgttgagacggcactca

SEQ ID NO: 23055 - DNA, 25 bp, Homo sapien
cctcataagaggtatccgtgaactc

SEQ ID NO: 23056 - DNA, 25 bp, Homo sapien
cagtctctttgaccgagcggctcta

SEQ ID NO: 23057 - DNA, 25 bp, Homo sapien
acgtgtaccgtttctcctcataaga

SEQ ID NO: 23058 - DNA, 25 bp, Homo sapien
ccaccaccctctgggcgtaagaaga

SEQ ID NO: 23059 - DNA, 25 bp, Homo sapien
ttcgcgccgtttttaccgagccagc

SEQ ID NO: 23060 - DNA, 25 bp, Homo sapien
tggtgccagtgaagacgcgaaaagc

SEQ ID NO: 23061 - DNA, 25 bp, Homo sapien
cttccgagccttcgaggactaggga

SEQ ID NO: 23062 - DNA, 25 bp, Homo sapien
gtcctctcttaaaaggctgtgccga

SEQ ID NO: 23063 - DNA, 25 bp, Homo sapien
gggtgatttcccataaaccacatgc

SEQ ID NO: 23064 - DNA, 25 bp, Homo sapien
cctggccagggtgatttcccataaa

SEQ ID NO: 23065 - DNA, 25 bp, Homo sapien
cagcgcagaagacagagggtgacta

SEQ ID NO: 23066 - DNA, 25 bp, Homo sapien
gcttggaagtgcagcgcagaagaca

SEQ ID NO: 23067 - DNA, 25 bp, Homo sapien
gcccgcgctcgtttgctgaaggctt

SEQ ID NO: 23068 - DNA, 25 bp, Homo sapien
aagtgaaagtttgcctgggtcctct

SEQ ID NO: 23069 - DNA, 25 bp, Homo sapien
acgaaccgcctttgcgcacggactg

SEQ ID NO: 23070 - DNA, 25 bp, Homo sapien
gctctggctagtttgggacttctgg

SEQ ID NO: 23071 - DNA, 25 bp, Homo sapien
aatgtcgatgcctgacgcgatgccg

SEQ ID NO: 23072 - DNA, 25 bp, Homo sapien
ctgccttgggctgccgaacagacaa

SEQ ID NO: 23073 - DNA, 25 bp, Homo sapien
tgacgtcacgacagagtgccctttc

SEQ ID NO: 23074 - DNA, 25 bp, Homo sapien
aagtactccttcatggccaccgtca

SEQ ID NO: 23075 - DNA, 25 bp, Homo sapien
tgccagtacttgacgtggcgtcacc

SEQ ID NO: 23076 - DNA, 25 bp, Homo sapien
agctgctgttctggttctcttgtgg

SEQ ID NO: 23077 - DNA, 25 bp, Homo sapien
taccctcgctttgcgtgcgtgtttg

SEQ ID NO: 23078 - DNA, 25 bp, Homo sapien
atgagtccttgctctagctccgccg

SEQ ID NO: 23079 - DNA, 25 bp, Homo sapien
tcactatacagcgaaaggagcagga

SEQ ID NO: 23080 - DNA, 25 bp, Homo sapien
tccggccgagaactgtcactataca

SEQ ID NO: 23081 - DNA, 25 bp, Homo sapien
caaagactcagaggtcaggagcttc

SEQ ID NO: 23082 - DNA, 25 bp, Homo sapien
ttcaaccgcaaccagcgcaaagact

SEQ ID NO: 23083 - DNA, 25 bp, Homo sapien
ggcaaagcccgcgagttcaaccgca

SEQ ID NO: 23084 - DNA, 25 bp, Homo sapien
ccgggcccactgatcgtgaacaaca

SEQ ID NO: 23085 - DNA, 25 bp, Homo sapien
aacctaatcatctcgggcgtctgtc

SEQ ID NO: 23086 - DNA, 25 bp, Homo sapien
cgcagctacagcatgagagccggtg

SEQ ID NO: 23087 - DNA, 25 bp, Homo sapien
tttggatgaacttcgagtcgccctc

SEQ ID NO: 23088 - DNA, 25 bp, Homo sapien
aggctcaggccgtgcttttccacca

SEQ ID NO: 23089 - DNA, 25 bp, Homo sapien
cggacgtctttgtgccttatggcta

SEQ ID NO: 23090 - DNA, 25 bp, Homo sapien
gcttgacgtgtacggcgctgatcac

SEQ ID NO: 23091 - DNA, 25 bp, Homo sapien
ttcaactggacgctctcctaccggg

SEQ ID NO: 23092 - DNA, 25 bp, Homo sapien
cgctgatcacctacgcttgctgggg

SEQ ID NO: 23093 - DNA, 25 bp, Homo sapien
ctggcaagtaacctcttcaactgga

SEQ ID NO: 23094 - DNA, 25 bp, Homo sapien
tgccttcaggcgcattctcggatgc

SEQ ID NO: 23095 - DNA, 25 bp, Homo sapien
tctcggtatttcgttgtcaaggcca

SEQ ID NO: 23096 - DNA, 25 bp, Homo sapien
gagccaggccaactgcttctcatta

SEQ ID NO: 23097 - DNA, 25 bp, Homo sapien
ctgtggtttttatcaggaaagcctc

SEQ ID NO: 23098 - DNA, 25 bp, Homo sapien
gcctctttcaaagggcacagacacg

SEQ ID NO: 23099 - DNA, 25 bp, Homo sapien
cgaagctccgcggactcgttcattt

SEQ ID NO: 23100 - DNA, 25 bp, Homo sapien
aagccgagacgccttacaggtcata

SEQ ID NO: 23101 - DNA, 25 bp, Homo sapien
gccgcgctctccgttgttttgttca

SEQ ID NO: 23102 - DNA, 25 bp, Homo sapien
ttacgcacgttctggtctctccgtg

SEQ ID NO: 23103 - DNA, 25 bp, Homo sapien
gcccgacctgctaggggcctcagaa

SEQ ID NO: 23104 - DNA, 25 bp, Homo sapien
gcctcagaacaagcggtgtggcccg

SEQ ID NO: 23105 - DNA, 25 bp, Homo sapien
cggtgtggcccgaggccgtcacaca

SEQ ID NO: 23106 - DNA, 25 bp, Homo sapien
gccaagctcaccagccaatgtgcag

SEQ ID NO: 23107 - DNA, 25 bp, Homo sapien
cacagcacctgtgctgagagtgagc

SEQ ID NO: 23108 - DNA, 25 bp, Homo sapien
ctcatcgggcctgttacgcacgttc

SEQ ID NO: 23109 - DNA, 25 bp, Homo sapien
aggccgtcacacagcacctgtgctg

SEQ ID NO: 23110 - DNA, 25 bp, Homo sapien
ggtggagtacgcctttgctcatttc

SEQ ID NO: 23111 - DNA, 25 bp, Homo sapien
tggatctgctatgtcttcgtgtttg

SEQ ID NO: 23112 - DNA, 25 bp, Homo sapien
ggcactggacgtctacttctggatc

SEQ ID NO: 23113 - DNA, 25 bp, Homo sapien
acgggcatcagccatcaaggcactg

SEQ ID NO: 23114 - DNA, 25 bp, Homo sapien
tgaccacgctcatggtcagtgcccg

SEQ ID NO: 23115 - DNA, 25 bp, Homo sapien
acggtgctgacgatgaccacgctca

SEQ ID NO: 23116 - DNA, 25 bp, Homo sapien
ggctacgacaatggcaccacctgtg

SEQ ID NO: 23117 - DNA, 25 bp, Homo sapien
ccggcaggcatcaccacggtgctga

SEQ ID NO: 23118 - DNA, 25 bp, Homo sapien
gccgcgttggtgactccttcccaaa

SEQ ID NO: 23119 - DNA, 25 bp, Homo sapien
ccagatcaaagggaacaggcgtttg

SEQ ID NO: 23120 - DNA, 25 bp, Homo sapien
agcagcgacgttccgcattccatcg

SEQ ID NO: 23121 - DNA, 25 bp, Homo sapien
ggccacgaaagaccgaccgactgtc

SEQ ID NO: 23122 - DNA, 25 bp, Homo sapien
taattgataacaacccgctgggtgc

SEQ ID NO: 23123 - DNA, 25 bp, Homo sapien
tgcccgtgaacttggggcctgaata

SEQ ID NO: 23124 - DNA, 25 bp, Homo sapien
caggcgtttggtttcttcccagatc

SEQ ID NO: 23125 - DNA, 25 bp, Homo sapien
gtccaagggctcgagcatcgcaacc

SEQ ID NO: 23126 - DNA, 25 bp, Homo sapien
ctcggtttgacgtcaggctctcacg

SEQ ID NO: 23127 - DNA, 25 bp, Homo sapien
actgtattttcagcctcggtttgac

SEQ ID NO: 23128 - DNA, 25 bp, Homo sapien
gccgcgtgactttccagactgtatt

SEQ ID NO: 23129 - DNA, 25 bp, Homo sapien
caggctctcacggtcccaaaggatg

SEQ ID NO: 23130 - DNA, 25 bp, Homo sapien
ccaaaggatgggctttgtacatttc

SEQ ID NO: 23131 - DNA, 25 bp, Homo sapien
tgtacatttccaggccgcagaccgg

SEQ ID NO: 23132 - DNA, 25 bp, Homo sapien
aaggaagtccaggtgagacaggccc

SEQ ID NO: 23133 - DNA, 25 bp, Homo sapien
gcacgtttgtctcaggcagctcatc

SEQ ID NO: 23134 - DNA, 25 bp, Homo sapien
ctcaggcctgtgaccttgacagtaa

SEQ ID NO: 23135 - DNA, 25 bp, Homo sapien
ctgtcacgcccgagatgaatattta

SEQ ID NO: 23136 - DNA, 25 bp, Homo sapien
tggtgctcagaagggcccaagaact

SEQ ID NO: 23137 - DNA, 25 bp, Homo sapien
attcggagctagcagagagcccttc

SEQ ID NO: 23138 - DNA, 25 bp, Homo sapien
tacccacgcgtgacaggtgagtcgc

SEQ ID NO: 23139 - DNA, 25 bp, Homo sapien
ttggcaagcgaagcagaactgtcac

SEQ ID NO: 23140 - DNA, 25 bp, Homo sapien
actccggaggaaattgggcttagct

SEQ ID NO: 23141 - DNA, 25 bp, Homo sapien
gcgcagttccactgggagcctctta

SEQ ID NO: 23142 - DNA, 25 bp, Homo sapien
ataggcaggggcaagcccaagccgc

SEQ ID NO: 23143 - DNA, 25 bp, Homo sapien
caaccacctgtgtaccggagaaatc

SEQ ID NO: 23144 - DNA, 25 bp, Homo sapien
gtgtaccggagaaatccaactcctc

SEQ ID NO: 23145 - DNA, 25 bp, Homo sapien
cagagcgtttgtgtgtcccgtcgta

SEQ ID NO: 23146 - DNA, 25 bp, Homo sapien
gactgtgcgcttcctcgtctttggt

SEQ ID NO: 23147 - DNA, 25 bp, Homo sapien
gccgcctcgtgttgaccgcaagcag

SEQ ID NO: 23148 - DNA, 25 bp, Homo sapien
ggcgcgcttgttttccagctgccgc

SEQ ID NO: 23149 - DNA, 25 bp, Homo sapien
ctattccggggcttggtgcggtctt

SEQ ID NO: 23150 - DNA, 25 bp, Homo sapien
tgacagagatcctccgcgtagggaa

SEQ ID NO: 23151 - DNA, 25 bp, Homo sapien
gctgtggttcacactggagttcctg

SEQ ID NO: 23152 - DNA, 25 bp, Homo sapien
gctggacttcgtcaagaacctgctc

SEQ ID NO: 23153 - DNA, 25 bp, Homo sapien
gcgcatcctgcgtatcttcaagctc

SEQ ID NO: 23154 - DNA, 25 bp, Homo sapien
tacatcgagggcgtatgtgtgctgt

SEQ ID NO: 23155 - DNA, 25 bp, Homo sapien
ttcaagctcacacgccacttcgtgg

SEQ ID NO: 23156 - DNA, 25 bp, Homo sapien
gaggtagagacagagcccatcctga

SEQ ID NO: 23157 - DNA, 25 bp, Homo sapien
ggaacatcaccagcgtgcacttccg

SEQ ID NO: 23158 - DNA, 25 bp, Homo sapien
gagtgctggggcacaggccataccc

SEQ ID NO: 23159 - DNA, 25 bp, Homo sapien
ttgtacggcgaacgactgaaggagc

SEQ ID NO: 23160 - DNA, 25 bp, Homo sapien
tgtccgccacagtaacgcactatgg

SEQ ID NO: 23161 - DNA, 25 bp, Homo sapien
ctgaaggagccaaacgaggtggatc

SEQ ID NO: 23162 - DNA, 25 bp, Homo sapien
gtggtgacctcagcgctgcgtccct

SEQ ID NO: 23163 - DNA, 25 bp, Homo sapien
cagtctaaaggctgtggtgacctca

SEQ ID NO: 23164 - DNA, 25 bp, Homo sapien
agggctgcagacagtctaaaggctg

SEQ ID NO: 23165 - DNA, 25 bp, Homo sapien
taacgcactatggaaaggaaagttg

SEQ ID NO: 23166 - DNA, 25 bp, Homo sapien
agggagcttaccgtctctcgcgata

SEQ ID NO: 23167 - DNA, 25 bp, Homo sapien
gggcagactttttgtccaatcaaca

SEQ ID NO: 23168 - DNA, 25 bp, Homo sapien
gccagtgaaggccaaacgctcccgt

SEQ ID NO: 23169 - DNA, 25 bp, Homo sapien
cagtcagcctcctccgttatacagg

SEQ ID NO: 23170 - DNA, 25 bp, Homo sapien
ccctttaagcgagtgatggacagtt

SEQ ID NO: 23171 - DNA, 25 bp, Homo sapien
tgatggcccgacctcccaaatagtg

SEQ ID NO: 23172 - DNA, 25 bp, Homo sapien
ctcgcgatatcgctgtgagcctgcc

SEQ ID NO: 23173 - DNA, 25 bp, Homo sapien
cctgcctctctggaaaaaacgccga

SEQ ID NO: 23174 - DNA, 25 bp, Homo sapien
cagtgagtttgtggaagcctcgccc

SEQ ID NO: 23175 - DNA, 25 bp, Homo sapien
cgcgggaaaacttcgcggctcctcg

SEQ ID NO: 23176 - DNA, 25 bp, Homo sapien
ttcgtcctgaatggtagcgattcga

SEQ ID NO: 23177 - DNA, 25 bp, Homo sapien
tcctacagcccagacgagttaggta

SEQ ID NO: 23178 - DNA, 25 bp, Homo sapien
gttaggtaagtctgctcattttgtc

SEQ ID NO: 23179 - DNA, 25 bp, Homo sapien
tggtcgcaattctgcccgagaactg

SEQ ID NO: 23180 - DNA, 25 bp, Homo sapien
ggggcgtccataggaactcagctag

SEQ ID NO: 23181 - DNA, 25 bp, Homo sapien
gtttctgcggcgatttgtcactccc

SEQ ID NO: 23182 - DNA, 25 bp, Homo sapien
cgcagaaccaccctgaccgtaaaga

SEQ ID NO: 23183 - DNA, 25 bp, Homo sapien
aggcgcgcactactcacgtgtcttc

SEQ ID NO: 23184 - DNA, 25 bp, Homo sapien
tcgcgcctttcgttccgctcaagtt

SEQ ID NO: 23185 - DNA, 25 bp, Homo sapien
acgtgtcttccaagtgctgctccaa

SEQ ID NO: 23186 - DNA, 25 bp, Homo sapien
cggcgcctccaaagggacaaaattg

SEQ ID NO: 23187 - DNA, 25 bp, Homo sapien
cacggtgcaacgtccgcgttcttta

SEQ ID NO: 23188 - DNA, 25 bp, Homo sapien
tgcggtgcccggcaggattttaatt

SEQ ID NO: 23189 - DNA, 25 bp, Homo sapien
ttactggaaaacatcactgcgcttc

SEQ ID NO: 23190 - DNA, 25 bp, Homo sapien
gcttctggggcaggtcatggctatt

SEQ ID NO: 23191 - DNA, 25 bp, Homo sapien
gctattgcaaccaaagggaggcccg

SEQ ID NO: 23192 - DNA, 25 bp, Homo sapien
ttctgccgcagtcctccgagggctg

SEQ ID NO: 23193 - DNA, 25 bp, Homo sapien
gcagtcctccgagggctgggcttct

SEQ ID NO: 23194 - DNA, 25 bp, Homo sapien
gtcatggctattgcaaccaaaggga

SEQ ID NO: 23195 - DNA, 25 bp, Homo sapien
agcgggccgcactcttgggacgccc

SEQ ID NO: 23196 - DNA, 25 bp, Homo sapien
cctggtcacggactccgccggcagc

SEQ ID NO: 23197 - DNA, 25 bp, Homo sapien
ggcaggtcatggctattgcaaccaa

SEQ ID NO: 23198 - DNA, 25 bp, Homo sapien
ctcttcttgagcagggtgcaagttc

SEQ ID NO: 23199 - DNA, 25 bp, Homo sapien
gggcccaagcgcagttcagctctta

SEQ ID NO: 23200 - DNA, 25 bp, Homo sapien
gccgaggctcagtgtccaacccaaa

SEQ ID NO: 23201 - DNA, 25 bp, Homo sapien
aagccgtttgttattctgtgccgaa

SEQ ID NO: 23202 - DNA, 25 bp, Homo sapien
gccgtcccaagtggttcaggtccta

SEQ ID NO: 23203 - DNA, 25 bp, Homo sapien
aacccgcgctatttaccagacatgg

SEQ ID NO: 23204 - DNA, 25 bp, Homo sapien
agacatggttatgctgccagctgca

SEQ ID NO: 23205 - DNA, 25 bp, Homo sapien
tccatgttcctaggttacggccagc

SEQ ID NO: 23206 - DNA, 25 bp, Homo sapien
accattgacatttacgcccgcgctg

SEQ ID NO: 23207 - DNA, 25 bp, Homo sapien
ccgcgctgtgttccctgcggcgttt

SEQ ID NO: 23208 - DNA, 25 bp, Homo sapien
cgtttgcggccgtcaatgtcatcta

SEQ ID NO: 23209 - DNA, 25 bp, Homo sapien
atgtcatctactgggcggcatacgc

SEQ ID NO: 23210 - DNA, 25 bp, Homo sapien
gcggcatacgccatgtgagcacagg

SEQ ID NO: 23211 - DNA, 25 bp, Homo sapien
cttcctgggagaaagagccctcggg

SEQ ID NO: 23212 - DNA, 25 bp, Homo sapien
ctctgcgtgtttcgaagtgggatga

SEQ ID NO: 23213 - DNA, 25 bp, Homo sapien
ttcgaagtgggatgacagtcggcca

SEQ ID NO: 23214 - DNA, 25 bp, Homo sapien
cggctgcttcgaatgagtcctgcga

SEQ ID NO: 23215 - DNA, 25 bp, Homo sapien
tagtccttctcgtcgcggaactccg

SEQ ID NO: 23216 - DNA, 25 bp, Homo sapien
cctcggagaaaatgtcgatgggcac

SEQ ID NO: 23217 - DNA, 25 bp, Homo sapien
gtcgaagtacctcatgcgccgcttg

SEQ ID NO: 23218 - DNA, 25 bp, Homo sapien
aagccgcgatgctctgtctgggtct

SEQ ID NO: 23219 - DNA, 25 bp, Homo sapien
cctgttgcagccaaagccgcgatgc

SEQ ID NO: 23220 - DNA, 25 bp, Homo sapien
ccgcgtagccgtggttcaccagcgt

SEQ ID NO: 23221 - DNA, 25 bp, Homo sapien
ctggcaaagggtcttcagctgcgtc

SEQ ID NO: 23222 - DNA, 25 bp, Homo sapien
aatgctcacgcccaattcgcagggg

SEQ ID NO: 23223 - DNA, 25 bp, Homo sapien
tcacgcccaattcgcaggggcgacg

SEQ ID NO: 23224 - DNA, 25 bp, Homo sapien
ccgtcctttgtatcaaatgctcacg

SEQ ID NO: 23225 - DNA, 25 bp, Homo sapien
tgaggaggtctaaaacgtgaagctc

SEQ ID NO: 23226 - DNA, 25 bp, Homo sapien
aaatcctccgtgaagcgggccctca

SEQ ID NO: 23227 - DNA, 25 bp, Homo sapien
ccctcagcttgagcgcaggctttga

SEQ ID NO: 23228 - DNA, 25 bp, Homo sapien
cgggagtgaatccagcctgggtcct

SEQ ID NO: 23229 - DNA, 25 bp, Homo sapien
taaaacgtgaagctctagcgctgca

SEQ ID NO: 23230 - DNA, 25 bp, Homo sapien
tcgtcacgtccggttgccaaggtga

SEQ ID NO: 23231 - DNA, 25 bp, Homo sapien
ccggggtcaatcataaattttctgc

SEQ ID NO: 23232 - DNA, 25 bp, Homo sapien
ccgcccactgaagccgatagctgga

SEQ ID NO: 23233 - DNA, 25 bp, Homo sapien
cacagccctacgctgagagagaatc

SEQ ID NO: 23234 - DNA, 25 bp, Homo sapien
cacagcaactgtgaggggttcgacc

SEQ ID NO: 23235 - DNA, 25 bp, Homo sapien
tactcggtccgcctattaaacttga

SEQ ID NO: 23236 - DNA, 25 bp, Homo sapien
tctcccgtggagatctactcggtcc

SEQ ID NO: 23237 - DNA, 25 bp, Homo sapien
tcgctaaagcccaacccttatgatg

SEQ ID NO: 23238 - DNA, 25 bp, Homo sapien
gctccgctttgcctgggaccaggaa

SEQ ID NO: 23239 - DNA, 25 bp, Homo sapien
cggtcaccggacgtgaaggatttga

SEQ ID NO: 23240 - DNA, 25 bp, Homo sapien
ccctctggcgcctggcataaggtag

SEQ ID NO: 23241 - DNA, 25 bp, Homo sapien
tctgacgcacccttctagagggagc

SEQ ID NO: 23242 - DNA, 25 bp, Homo sapien
cgacttaccttaccagaccgactag

SEQ ID NO: 23243 - DNA, 25 bp, Homo sapien
ggaactcggcatcaggcactgcttg

SEQ ID NO: 23244 - DNA, 25 bp, Homo sapien
tatagctgtgtatggactcgcgcga

SEQ ID NO: 23245 - DNA, 25 bp, Homo sapien
aaagtgtcgtgaacgtgctgccgcc

SEQ ID NO: 23246 - DNA, 25 bp, Homo sapien
tggctccgaggaactgggcaaagac

SEQ ID NO: 23247 - DNA, 25 bp, Homo sapien
gaacaccctgcagtccgcaaaagcg

SEQ ID NO: 23248 - DNA, 25 bp, Homo sapien
gaggcttgacttagcgaacaccctg

SEQ ID NO: 23249 - DNA, 25 bp, Homo sapien
gcgggtccgacactttcactttcac

SEQ ID NO: 23250 - DNA, 25 bp, Homo sapien
tgcggttgcaccacaagcttcctgg

SEQ ID NO: 23251 - DNA, 25 bp, Homo sapien
cgctttcaggcacactgcggttgca

SEQ ID NO: 23252 - DNA, 25 bp, Homo sapien
cagtgcctctgggaggacaccacaa

SEQ ID NO: 23253 - DNA, 25 bp, Homo sapien
aggccacactctgaagggcacctgg

SEQ ID NO: 23254 - DNA, 25 bp, Homo sapien
cctcttgccggcactgaaggaaccg

SEQ ID NO: 23255 - DNA, 25 bp, Homo sapien
tgtccggtaggaatagcactgagct

SEQ ID NO: 23256 - DNA, 25 bp, Homo sapien
agagcctgtccttggtcgctccgac

SEQ ID NO: 23257 - DNA, 25 bp, Homo sapien
gaacccaacctgagtgccagcgaga

SEQ ID NO: 23258 - DNA, 25 bp, Homo sapien
aacagcctattcctcccgtgtgtga

SEQ ID NO: 23259 - DNA, 25 bp, Homo sapien
ccggccctctctactgatggatgga

SEQ ID NO: 23260 - DNA, 25 bp, Homo sapien
ccacttagggcaatgaaaggtcatc

SEQ ID NO: 23261 - DNA, 25 bp, Homo sapien
gcggaggcgccaaaatctccactta

SEQ ID NO: 23262 - DNA, 25 bp, Homo sapien
acaataatctgctttcgcggggaga

SEQ ID NO: 23263 - DNA, 25 bp, Homo sapien
agcctgcggtgaaaggtaaccagcc

SEQ ID NO: 23264 - DNA, 25 bp, Homo sapien
gtctccgagtctcccacgcgaagaa

SEQ ID NO: 23265 - DNA, 25 bp, Homo sapien
ccgcgacccacgttgactgaagttg

SEQ ID NO: 23266 - DNA, 25 bp, Homo sapien
ggcgcagccatatggccagacactc

SEQ ID NO: 23267 - DNA, 25 bp, Homo sapien
cgcgttagctgctgctccttctttg

SEQ ID NO: 23268 - DNA, 25 bp, Homo sapien
ccgagggactgaactagccatgatc

SEQ ID NO: 23269 - DNA, 25 bp, Homo sapien
gcctgttagggctgcctttacaata

SEQ ID NO: 23270 - DNA, 25 bp, Homo sapien
aacgcgctcacgtagacccaggtgc

SEQ ID NO: 23271 - DNA, 25 bp, Homo sapien
aggtgccgtccctcacgtggagcct

SEQ ID NO: 23272 - DNA, 25 bp, Homo sapien
tccgcagctgggaatcacgggacta

SEQ ID NO: 23273 - DNA, 25 bp, Homo sapien
cacgggactagccttcgtttccttg

SEQ ID NO: 23274 - DNA, 25 bp, Homo sapien
cgtttccttggcaacgcagtacaca

SEQ ID NO: 23275 - DNA, 25 bp, Homo sapien
gcagtacacaagtgctagccctagc

SEQ ID NO: 23276 - DNA, 25 bp, Homo sapien
tcgcgatgtgcttcagcagagcagg

SEQ ID NO: 23277 - DNA, 25 bp, Homo sapien
ctagccctagcagctcgcgatgtgc

SEQ ID NO: 23278 - DNA, 25 bp, Homo sapien
ctggactttcgttgaccatgctgtc

SEQ ID NO: 23279 - DNA, 25 bp, Homo sapien
gacagattctcctatcggggtcaca

SEQ ID NO: 23280 - DNA, 25 bp, Homo sapien
gccatcttggtcctgccctgacaga

SEQ ID NO: 23281 - DNA, 25 bp, Homo sapien
tgcgataggctctcagcgttacttg

SEQ ID NO: 23282 - DNA, 25 bp, Homo sapien
ctcgcgagaattgcttctatggctc

SEQ ID NO: 23283 - DNA, 25 bp, Homo sapien
tagactcaaactggacgccggccgg

SEQ ID NO: 23284 - DNA, 25 bp, Homo sapien
cgacccagggtcaggataacatgca

SEQ ID NO: 23285 - DNA, 25 bp, Homo sapien
cgctaagattgctacctggactttc

SEQ ID NO: 23286 - DNA, 25 bp, Homo sapien
accatttatatgtcagggagcggcg

SEQ ID NO: 23287 - DNA, 25 bp, Homo sapien
cccagaagtcgcagtggcgtcggct

SEQ ID NO: 23288 - DNA, 25 bp, Homo sapien
ctcccttgctctactgcggctggtg

SEQ ID NO: 23289 - DNA, 25 bp, Homo sapien
gcgggactgtcgacctgattcatcc

SEQ ID NO: 23290 - DNA, 25 bp, Homo sapien
gattcatccaagacacaatttgagg

SEQ ID NO: 23291 - DNA, 25 bp, Homo sapien
caatttgaggatgctggtgctgcgc

SEQ ID NO: 23292 - DNA, 25 bp, Homo sapien
agcccagactggaggaactgaccgc

SEQ ID NO: 23293 - DNA, 25 bp, Homo sapien
gaccgcggcgttcctaccatttata

SEQ ID NO: 23294 - DNA, 25 bp, Homo sapien
accgacccggtcgactgtaggcctg

SEQ ID NO: 23295 - DNA, 25 bp, Homo sapien
ccggtagctccaggctttcccggct

SEQ ID NO: 23296 - DNA, 25 bp, Homo sapien
ccagccatcgccaacttggaggggc

SEQ ID NO: 23297 - DNA, 25 bp, Homo sapien
aggcggctcatgtcgccggtcagtc

SEQ ID NO: 23298 - DNA, 25 bp, Homo sapien
atgtcgccggtcagtcgcctggctc

SEQ ID NO: 23299 - DNA, 25 bp, Homo sapien
ggccagagccaaccacgcccgcgga

SEQ ID NO: 23300 - DNA, 25 bp, Homo sapien
gaagcccagccatcgccaacttgga

SEQ ID NO: 23301 - DNA, 25 bp, Homo sapien
tcctccgcgttccatcggtgtcggg

SEQ ID NO: 23302 - DNA, 25 bp, Homo sapien
tctcgggagaggttctccactctga

SEQ ID NO: 23303 - DNA, 25 bp, Homo sapien
gccgcgtctgaaataaccccaggga

SEQ ID NO: 23304 - DNA, 25 bp, Homo sapien
gttctccactctgagggcgtgtcca

SEQ ID NO: 23305 - DNA, 25 bp, Homo sapien
cacaggtctcgggagaggttctcca

SEQ ID NO: 23306 - DNA, 25 bp, Homo sapien
tgctgaccggttggtcttgggccct

SEQ ID NO: 23307 - DNA, 25 bp, Homo sapien
cagggcccgtctgcagtgcaggagt

SEQ ID NO: 23308 - DNA, 25 bp, Homo sapien
accacccagcagcaactgttggacc

SEQ ID NO: 23309 - DNA, 25 bp, Homo sapien
actctgagggcgtgtccagtccaga

SEQ ID NO: 23310 - DNA, 25 bp, Homo sapien
aggcgaggtccctgctctcaagaac

SEQ ID NO: 23311 - DNA, 25 bp, Homo sapien
gccggttcacgcctgtcacacaaag

SEQ ID NO: 23312 - DNA, 25 bp, Homo sapien
agtgccatagtgtcagtcccttttc

SEQ ID NO: 23313 - DNA, 25 bp, Homo sapien
tgcgcccatttgtcgggttcggttc

SEQ ID NO: 23314 - DNA, 25 bp, Homo sapien
agcacgtgaccctcgtgtggtcata

SEQ ID NO: 23315 - DNA, 25 bp, Homo sapien
cggaccctaccgcagtgtttgcaca

SEQ ID NO: 23316 - DNA, 25 bp, Homo sapien
ggcgacggagatagcagtccatttc

SEQ ID NO: 23317 - DNA, 25 bp, Homo sapien
tagagtgaaatcctcgcagccctgc

SEQ ID NO: 23318 - DNA, 25 bp, Homo sapien
tgcgcgctctctgccagcacagagg

SEQ ID NO: 23319 - DNA, 25 bp, Homo sapien
caacacccgggcctgtgaggatcct

SEQ ID NO: 23320 - DNA, 25 bp, Homo sapien
ccgacttcgagtcactgctgctttc

SEQ ID NO: 23321 - DNA, 25 bp, Homo sapien
cggtgcagctcaaggccatcccgtt

SEQ ID NO: 23322 - DNA, 25 bp, Homo sapien
tgtcttcgcgggaaaactgccaata

SEQ ID NO: 23323 - DNA, 25 bp, Homo sapien
cttggggctttcctcaggccacatt

SEQ ID NO: 23324 - DNA, 25 bp, Homo sapien
cgcaccgggcgcatcacaaagaacg

SEQ ID NO: 23325 - DNA, 25 bp, Homo sapien
cttaagcaccgcgagatctgacggc

SEQ ID NO: 23326 - DNA, 25 bp, Homo sapien
cacgtagtagaagaccagggccagc

SEQ ID NO: 23327 - DNA, 25 bp, Homo sapien
aagtactccttggtgtcctcgttga

SEQ ID NO: 23328 - DNA, 25 bp, Homo sapien
agggcatggactcctggttgttctc

SEQ ID NO: 23329 - DNA, 25 bp, Homo sapien
tccgagtcgttgtcgtccatgagcc

SEQ ID NO: 23330 - DNA, 25 bp, Homo sapien
ttgcggtccttgtactcctcgtagc

SEQ ID NO: 23331 - DNA, 25 bp, Homo sapien
cgtcgtcgtaggcagagatgcactc

SEQ ID NO: 23332 - DNA, 25 bp, Homo sapien
cgcccactcacgttgaggacaatca

SEQ ID NO: 23333 - DNA, 25 bp, Homo sapien
acgtcctcgttgttggtcatgacca

SEQ ID NO: 23334 - DNA, 25 bp, Homo sapien
aggaatcctagggtgtgcctggagg

SEQ ID NO: 23335 - DNA, 25 bp, Homo sapien
gcgtggggtatgtgtgcacctagct

SEQ ID NO: 23336 - DNA, 25 bp, Homo sapien
tccctcgctcggtcggttcgtgcgt

SEQ ID NO: 23337 - DNA, 25 bp, Homo sapien
cctcgccagcgcagtctcgctcgct

SEQ ID NO: 23338 - DNA, 25 bp, Homo sapien
acgaggcagagcctagtgcgtctcc

SEQ ID NO: 23339 - DNA, 25 bp, Homo sapien
tccccgggcgagtggaggaatccta

SEQ ID NO: 23340 - DNA, 25 bp, Homo sapien
ctcggtcggttcgtgcgtccgtccg

SEQ ID NO: 23341 - DNA, 25 bp, Homo sapien
cgggctgcctctcccgaggtccctt

SEQ ID NO: 23342 - DNA, 25 bp, Homo sapien
gcacgaagcactagtcacggtcctg

SEQ ID NO: 23343 - DNA, 25 bp, Homo sapien
cgcgtacagtcaggtaaaagcacga

SEQ ID NO: 23344 - DNA, 25 bp, Homo sapien
tgcccagacttttcacgcagaggtg

SEQ ID NO: 23345 - DNA, 25 bp, Homo sapien
agcctgaatgactttggagaagccc

SEQ ID NO: 23346 - DNA, 25 bp, Homo sapien
cgtcgtggaaaggtaggagcaacta

SEQ ID NO: 23347 - DNA, 25 bp, Homo sapien
taggagcaactatccctggggcttg

SEQ ID NO: 23348 - DNA, 25 bp, Homo sapien
ggccgggttctcaagagcaaagcaa

SEQ ID NO: 23349 - DNA, 25 bp, Homo sapien
ccgagggtcctcacagctacttttt

SEQ ID NO: 23350 - DNA, 25 bp, Homo sapien
gcgtgcgcccgcgaacatgacttct

SEQ ID NO: 23351 - DNA, 25 bp, Homo sapien
acagaatgtgagtggcgccgcgtcc

SEQ ID NO: 23352 - DNA, 25 bp, Homo sapien
catcgaagcgaaccctcgggctgct

SEQ ID NO: 23353 - DNA, 25 bp, Homo sapien
ccctgagaagtctggccgtgcccgg

SEQ ID NO: 23354 - DNA, 25 bp, Homo sapien
aagctggatttcctcccggacatga

SEQ ID NO: 23355 - DNA, 25 bp, Homo sapien
ccgcctgctcgttcctgacagaatg

SEQ ID NO: 23356 - DNA, 25 bp, Homo sapien
ctcccggacatgatggtcgagggcc

SEQ ID NO: 23357 - DNA, 25 bp, Homo sapien
tgacttctgccttcaagctggattt

SEQ ID NO: 23358 - DNA, 25 bp, Homo sapien
ttggctataaccagaaactcgctgc

SEQ ID NO: 23359 - DNA, 25 bp, Homo sapien
cagcaggctccgaagatcatacaga

SEQ ID NO: 23360 - DNA, 25 bp, Homo sapien
ctagcgcctacgacccggaagcaaa

SEQ ID NO: 23361 - DNA, 25 bp, Homo sapien
gcgggcgtttgaaatcagtgcctta

SEQ ID NO: 23362 - DNA, 25 bp, Homo sapien
gactccttcattccggtactgcgtg

SEQ ID NO: 23363 - DNA, 25 bp, Homo sapien
cctcccgtgagctagtctttggcta

SEQ ID NO: 23364 - DNA, 25 bp, Homo sapien
ccgtcccatcgcgataagaaagata

SEQ ID NO: 23365 - DNA, 25 bp, Homo sapien
acctggggttcgctttacgcagtag

SEQ ID NO: 23366 - DNA, 25 bp, Homo sapien
ttcggaaagctgacttacttgcgcc

SEQ ID NO: 23367 - DNA, 25 bp, Homo sapien
ccggcgtaaacgaggatgcgcctcc

SEQ ID NO: 23368 - DNA, 25 bp, Homo sapien
cgcctccctggtgtctaagttcgga

SEQ ID NO: 23369 - DNA, 25 bp, Homo sapien
gttcggagcacagcagcttaccctg

SEQ ID NO: 23370 - DNA, 25 bp, Homo sapien
ttaccctgcctgaaaagcggaacga

SEQ ID NO: 23371 - DNA, 25 bp, Homo sapien
cctggtgtttcacatgctgtgaatc

SEQ ID NO: 23372 - DNA, 25 bp, Homo sapien
aaagcggaacgaagcctagactgcg

SEQ ID NO: 23373 - DNA, 25 bp, Homo sapien
gtgaatctctcacgaccgaggtctg

SEQ ID NO: 23374 - DNA, 25 bp, Homo sapien
cctgctgaaagcatccggacagctc

SEQ ID NO: 23375 - DNA, 25 bp, Homo sapien
cgcttcgtctgcaggtaggagttgt

SEQ ID NO: 23376 - DNA, 25 bp, Homo sapien
gacagaagcaaagtaggccacactc

SEQ ID NO: 23377 - DNA, 25 bp, Homo sapien
gctcctaaggttttcttcgggcaga

SEQ ID NO: 23378 - DNA, 25 bp, Homo sapien
cccaagaagacgaagctcaggctgc

SEQ ID NO: 23379 - DNA, 25 bp, Homo sapien
ggaaagcgcccggaatcttggctaa

SEQ ID NO: 23380 - DNA, 25 bp, Homo sapien
ttggctaaagctcagcgttctcctc

SEQ ID NO: 23381 - DNA, 25 bp, Homo sapien
agctgcccgtccctgctgaaagcat

SEQ ID NO: 23382 - DNA, 25 bp, Homo sapien
ggcgctcctgtaggcagtgttgaaa

SEQ ID NO: 23383 - DNA, 25 bp, Homo sapien
ttaagacctccaactcccggtggca

SEQ ID NO: 23384 - DNA, 25 bp, Homo sapien
ggtggcagggactctacccatttca

SEQ ID NO: 23385 - DNA, 25 bp, Homo sapien
catttcacagaagcgcaaggatgga

SEQ ID NO: 23386 - DNA, 25 bp, Homo sapien
gcctggccgtcacccatagaagtgg

SEQ ID NO: 23387 - DNA, 25 bp, Homo sapien
cgtcggcttccggacatcgcaactt

SEQ ID NO: 23388 - DNA, 25 bp, Homo sapien
gtcttcggggagctatgctgagacc

SEQ ID NO: 23389 - DNA, 25 bp, Homo sapien
tgaggtaggagcagcctgagtaccc

SEQ ID NO: 23390 - DNA, 25 bp, Homo sapien
ccgcttccaaacgaaatgagggtca

SEQ ID NO: 23391 - DNA, 25 bp, Homo sapien
cggacctgaagttggcctctgtgaa

SEQ ID NO: 23392 - DNA, 25 bp, Homo sapien
ggacagcagcgcctattctggagga

SEQ ID NO: 23393 - DNA, 25 bp, Homo sapien
gctgccagcgcccattagatggatg

SEQ ID NO: 23394 - DNA, 25 bp, Homo sapien
cgctggcgttaggagacgtcactcc

SEQ ID NO: 23395 - DNA, 25 bp, Homo sapien
cgcgcataactgacatggggccctc

SEQ ID NO: 23396 - DNA, 25 bp, Homo sapien
tccctccagcctagcgtcgggttta

SEQ ID NO: 23397 - DNA, 25 bp, Homo sapien
tgtctcaagattggggctacctgtt

SEQ ID NO: 23398 - DNA, 25 bp, Homo sapien
cccagtaagttcagctgccggcagc

SEQ ID NO: 23399 - DNA, 25 bp, Homo sapien
cgagcggctgcggaccatttataac

SEQ ID NO: 23400 - DNA, 25 bp, Homo sapien
acttcaagatcaggtacgggccggc

SEQ ID NO: 23401 - DNA, 25 bp, Homo sapien
ggaccatttataaccgcgacttcaa

SEQ ID NO: 23402 - DNA, 25 bp, Homo sapien
agtttcatttccacggaccctcctg

SEQ ID NO: 23403 - DNA, 25 bp, Homo sapien
cgggccagtgtttcgagagtttcct

SEQ ID NO: 23404 - DNA, 25 bp, Homo sapien
ctggacatggagacagatcgcgagc

SEQ ID NO: 23405 - DNA, 25 bp, Homo sapien
gcgactttcagtttcatttccacgg

SEQ ID NO: 23406 - DNA, 25 bp, Homo sapien
tgccaggcctgaaacgccgccggag

SEQ ID NO: 23407 - DNA, 25 bp, Homo sapien
ggacgacttaaaaacaggattgctg

SEQ ID NO: 23408 - DNA, 25 bp, Homo sapien
cgacttaaaaacaggattgctgagc

SEQ ID NO: 23409 - DNA, 25 bp, Homo sapien
gcggcccggaaggatggactccgag

SEQ ID NO: 23410 - DNA, 25 bp, Homo sapien
cgcagattttaagcggggacgactt

SEQ ID NO: 23411 - DNA, 25 bp, Homo sapien
aggaatggtacccagaagctcgggc

SEQ ID NO: 23412 - DNA, 25 bp, Homo sapien
cgccggaggaatggtacccagaagc

SEQ ID NO: 23413 - DNA, 25 bp, Homo sapien
tcctgggcaagctccgcattgcgcg

SEQ ID NO: 23414 - DNA, 25 bp, Homo sapien
gcgtcgggaaagttaagaggtgctc

SEQ ID NO: 23415 - DNA, 25 bp, Homo sapien
cacgacccgggtggactcagactct

SEQ ID NO: 23416 - DNA, 25 bp, Homo sapien
gctccgactcggacctcaggaggcc

SEQ ID NO: 23417 - DNA, 25 bp, Homo sapien
cgtctgagttgaagttccctcgccc

SEQ ID NO: 23418 - DNA, 25 bp, Homo sapien
tggggcgtctgagttgaagttccct

SEQ ID NO: 23419 - DNA, 25 bp, Homo sapien
aaagtgctctcctggggacgagttc

SEQ ID NO: 23420 - DNA, 25 bp, Homo sapien
tcctggggacgagttcccaagacgc

SEQ ID NO: 23421 - DNA, 25 bp, Homo sapien
cggtgccggaggctcagactgaccc

SEQ ID NO: 23422 - DNA, 25 bp, Homo sapien
gggcatctaaatgggaccctcctct

SEQ ID NO: 23423 - DNA, 25 bp, Homo sapien
cggcccgaagaccagaggatagcaa

SEQ ID NO: 23424 - DNA, 25 bp, Homo sapien
cttagcctttaagctgccgggccgc

SEQ ID NO: 23425 - DNA, 25 bp, Homo sapien
aggtccacggaaaagggagctcctg

SEQ ID NO: 23426 - DNA, 25 bp, Homo sapien
ggctcagctgcagaaaggtcggtct

SEQ ID NO: 23427 - DNA, 25 bp, Homo sapien
agcgcacccggtttagcatgctgcc

SEQ ID NO: 23428 - DNA, 25 bp, Homo sapien
ggtgagcgagtcttcccaaccgcta

SEQ ID NO: 23429 - DNA, 25 bp, Homo sapien
ggggaactggccaactcatccttcg

SEQ ID NO: 23430 - DNA, 25 bp, Homo sapien
tgcgtctcggctgtgcccatccgtt

SEQ ID NO: 23431 - DNA, 25 bp, Homo sapien
ggctgtgcccatccgttcagccgag

SEQ ID NO: 23432 - DNA, 25 bp, Homo sapien
gcccatccgttcagccgagcgcctg

SEQ ID NO: 23433 - DNA, 25 bp, Homo sapien
gcctgccggcaggaaccttggaaaa

SEQ ID NO: 23434 - DNA, 25 bp, Homo sapien
aaaaaacccggctgagttctgcaga

SEQ ID NO: 23435 - DNA, 25 bp, Homo sapien
gccctgcggatgatgccaacctgac

SEQ ID NO: 23436 - DNA, 25 bp, Homo sapien
gatgatgccaacctgaccagaaccc

SEQ ID NO: 23437 - DNA, 25 bp, Homo sapien
gcggatgatgccaacctgaccagaa

SEQ ID NO: 23438 - DNA, 25 bp, Homo sapien
aaccgcatcgaggagcgctcccaga

SEQ ID NO: 23439 - DNA, 25 bp, Homo sapien
atgctcctgtttttctggccaggtg

SEQ ID NO: 23440 - DNA, 25 bp, Homo sapien
aggtgattgcggctcaccgctgctg

SEQ ID NO: 23441 - DNA, 25 bp, Homo sapien
ctcagtgcttgtgcagcagggcacc

SEQ ID NO: 23442 - DNA, 25 bp, Homo sapien
gcgggcaaagccctcctgcgtggac

SEQ ID NO: 23443 - DNA, 25 bp, Homo sapien
tgctgcaaccggaaccgcatcgagg

SEQ ID NO: 23444 - DNA, 25 bp, Homo sapien
cacctgcgaggtgattgcggctcac

SEQ ID NO: 23445 - DNA, 25 bp, Homo sapien
gctcccagacggtgaaatgctcctg

SEQ ID NO: 23446 - DNA, 25 bp, Homo sapien
agtgccgcgccagtttccaggcccg

SEQ ID NO: 23447 - DNA, 25 bp, Homo sapien
gtgccgcgccagtttccaggcccgg

SEQ ID NO: 23448 - DNA, 25 bp, Homo sapien
tatagcctgtctatctacaggagat

SEQ ID NO: 23449 - DNA, 25 bp, Homo sapien
atagcctgtctatctacaggagatc

SEQ ID NO: 23450 - DNA, 25 bp, Homo sapien
tagcctgtctatctacaggagatct

SEQ ID NO: 23451 - DNA, 25 bp, Homo sapien
agcctgtctatctacaggagatctc

SEQ ID NO: 23452 - DNA, 25 bp, Homo sapien
gcctgtctatctacaggagatctcg

SEQ ID NO: 23453 - DNA, 25 bp, Homo sapien
cagtgccgcgccagtttccaggccc

SEQ ID NO: 23454 - DNA, 25 bp, Homo sapien
actacagccgatctccctacaggga

SEQ ID NO: 23455 - DNA, 25 bp, Homo sapien
ggtcccgcagcagatctcactatgg

SEQ ID NO: 23456 - DNA, 25 bp, Homo sapien
cgatctccctacagacgatctcatt

SEQ ID NO: 23457 - DNA, 25 bp, Homo sapien
acagacgatctcattacaggggatc

SEQ ID NO: 23458 - DNA, 25 bp, Homo sapien
cagctactctaggtcccgcagcaga

SEQ ID NO: 23459 - DNA, 25 bp, Homo sapien
atctccctacagtcgatcttacagc

SEQ ID NO: 23460 - DNA, 25 bp, Homo sapien
aatctcgctacaggaggtctcccta

SEQ ID NO: 23461 - DNA, 25 bp, Homo sapien
cattacaggggatctcgctacggcc

SEQ ID NO: 23462 - DNA, 25 bp, Homo sapien
tgagctgcatcgatcaaggaccatc

SEQ ID NO: 23463 - DNA, 25 bp, Homo sapien
aggcctgcagctgtgactaaactcg

SEQ ID NO: 23464 - DNA, 25 bp, Homo sapien
cttccctctgattagctgagctgca

SEQ ID NO: 23465 - DNA, 25 bp, Homo sapien
ggtgtccacaaaatgcgcctctgtg

SEQ ID NO: 23466 - DNA, 25 bp, Homo sapien
atcagccaaactcgacgggcccttg

SEQ ID NO: 23467 - DNA, 25 bp, Homo sapien
gaggggtcttctcgcaagtcttctc

SEQ ID NO: 23468 - DNA, 25 bp, Homo sapien
acgggcgcatgccttaagctgctct

SEQ ID NO: 23469 - DNA, 25 bp, Homo sapien
tctggagtctgtcgtctggacctct

SEQ ID NO: 23470 - DNA, 25 bp, Homo sapien
acagccgcgcgcacagactggttct

SEQ ID NO: 23471 - DNA, 25 bp, Homo sapien
agctgcctgcgaagccctcagtgag

SEQ ID NO: 23472 - DNA, 25 bp, Homo sapien
aactaaccattaagcgcggagccga

SEQ ID NO: 23473 - DNA, 25 bp, Homo sapien
gtctggtctgcgctctcggcaccat

SEQ ID NO: 23474 - DNA, 25 bp, Homo sapien
ctgctgcccgaaacaagcgcgtgga

SEQ ID NO: 23475 - DNA, 25 bp, Homo sapien
ggaaagcttggtcggggcttctcac

SEQ ID NO: 23476 - DNA, 25 bp, Homo sapien
gtccggcacacaaacgtcggtctca

SEQ ID NO: 23477 - DNA, 25 bp, Homo sapien
aaacaagcgcgtggaaagcttggtc

SEQ ID NO: 23478 - DNA, 25 bp, Homo sapien
agtctactcgaaccctgcagtcacg

SEQ ID NO: 23479 - DNA, 25 bp, Homo sapien
ctcgcaagtcaccaggtggggcaag

SEQ ID NO: 23480 - DNA, 25 bp, Homo sapien
cactctcgcaagtcaccaggtgggg

SEQ ID NO: 23481 - DNA, 25 bp, Homo sapien
cctgcagtcacgccttggctgtggg

SEQ ID NO: 23482 - DNA, 25 bp, Homo sapien
gcaaagtctactcgaaccctgcagt

SEQ ID NO: 23483 - DNA, 25 bp, Homo sapien
ccacaggttgaatgacaaagagccc

SEQ ID NO: 23484 - DNA, 25 bp, Homo sapien
cagccacaggttgaatgacaaagag

SEQ ID NO: 23485 - DNA, 25 bp, Homo sapien
ggggaatgcggctctccgcaccact

SEQ ID NO: 23486 - DNA, 25 bp, Homo sapien
ccctcagtttctgccagagaaaaag

SEQ ID NO: 23487 - DNA, 25 bp, Homo sapien
ctcgctgcctcgtttgcttgttcca

SEQ ID NO: 23488 - DNA, 25 bp, Homo sapien
cttgttccagtacccacgcagctag

SEQ ID NO: 23489 - DNA, 25 bp, Homo sapien
agtcacgtcgcagctcaccactttg

SEQ ID NO: 23490 - DNA, 25 bp, Homo sapien
cgaggctgccttataacccgccggg

SEQ ID NO: 23491 - DNA, 25 bp, Homo sapien
tgtctgacgagctctaggcaatctg

SEQ ID NO: 23492 - DNA, 25 bp, Homo sapien
aggcaatctgccctcgttcgggaca

SEQ ID NO: 23493 - DNA, 25 bp, Homo sapien
gttcgggacacaaccatcggtctca

SEQ ID NO: 23494 - DNA, 25 bp, Homo sapien
tctcctcaagatactcggctgcgtc

SEQ ID NO: 23495 - DNA, 25 bp, Homo sapien
gtgctttctcggttactcttcattg

SEQ ID NO: 23496 - DNA, 25 bp, Homo sapien
aggcagctcttctaggccacgtcca

SEQ ID NO: 23497 - DNA, 25 bp, Homo sapien
gccgatcctccttttctagcaggca

SEQ ID NO: 23498 - DNA, 25 bp, Homo sapien
catgcctttagatggtacagccttc

SEQ ID NO: 23499 - DNA, 25 bp, Homo sapien
ccgggcgcaacctcatcttatggca

SEQ ID NO: 23500 - DNA, 25 bp, Homo sapien
tactgcgccctccagcggaagaaca

SEQ ID NO: 23501 - DNA, 25 bp, Homo sapien
tgcgtctgctccttgcatgccttta

SEQ ID NO: 23502 - DNA, 25 bp, Homo sapien
ggacctcgagcagctagctgctgga

SEQ ID NO: 23503 - DNA, 25 bp, Homo sapien
ctgtacagtgcgcaccagtggtgcc

SEQ ID NO: 23504 - DNA, 25 bp, Homo sapien
cggcgtggacctcgagcagctagct

SEQ ID NO: 23505 - DNA, 25 bp, Homo sapien
cgtggacctcgagcagctagctgct

SEQ ID NO: 23506 - DNA, 25 bp, Homo sapien
gtggacctcgagcagctagctgctg

SEQ ID NO: 23507 - DNA, 25 bp, Homo sapien
tcgagcagctagctgctggacatgt

SEQ ID NO: 23508 - DNA, 25 bp, Homo sapien
acctcgagcagctagctgctggaca

SEQ ID NO: 23509 - DNA, 25 bp, Homo sapien
tgtacagtgcgcaccagtggtgccg

SEQ ID NO: 23510 - DNA, 25 bp, Homo sapien
cgtccgcctcaaggcgcattacggg

SEQ ID NO: 23511 - DNA, 25 bp, Homo sapien
tcctggcgggtttcttaaaatcagc

SEQ ID NO: 23512 - DNA, 25 bp, Homo sapien
cctgtaaggactgaaagttttcatc

SEQ ID NO: 23513 - DNA, 25 bp, Homo sapien
tccggccgcaaacctgtaaggactg

SEQ ID NO: 23514 - DNA, 25 bp, Homo sapien
cggcccggtcattgtggtagacgtt

SEQ ID NO: 23515 - DNA, 25 bp, Homo sapien
tcacccgcggacacgtcgtggacag

SEQ ID NO: 23516 - DNA, 25 bp, Homo sapien
tcgctttagccaaaatccggagacc

SEQ ID NO: 23517 - DNA, 25 bp, Homo sapien
actgaccctggggtttgcgtcgcac

SEQ ID NO: 23518 - DNA, 25 bp, Homo sapien
cggctggtttgaaagcggcagtttc

SEQ ID NO: 23519 - DNA, 25 bp, Homo sapien
aacttcagtcattctagtgcccgcc

SEQ ID NO: 23520 - DNA, 25 bp, Homo sapien
cactggctcagcaaggtgcaggagt

SEQ ID NO: 23521 - DNA, 25 bp, Homo sapien
ctttcttcagcctaacccgcggtgg

SEQ ID NO: 23522 - DNA, 25 bp, Homo sapien
cgcgacgggtctacgcgcgcttctg

SEQ ID NO: 23523 - DNA, 25 bp, Homo sapien
cagtttcctggcagcttgggcaggc

SEQ ID NO: 23524 - DNA, 25 bp, Homo sapien
ggccacgatcgatcccgcgacgggt

SEQ ID NO: 23525 - DNA, 25 bp, Homo sapien
aggcgttggtctccgcgctacagct

SEQ ID NO: 23526 - DNA, 25 bp, Homo sapien
aggctttgtgcccagctggaaaaga

SEQ ID NO: 23527 - DNA, 25 bp, Homo sapien
cgccacggcgacagcaaaaggcttt

SEQ ID NO: 23528 - DNA, 25 bp, Homo sapien
attaaaagtgaaggcctccagtcgc

SEQ ID NO: 23529 - DNA, 25 bp, Homo sapien
gccgcctacagggtcacggactgac

SEQ ID NO: 23530 - DNA, 25 bp, Homo sapien
gatgcagtgactcagccgtctgaga

SEQ ID NO: 23531 - DNA, 25 bp, Homo sapien
ctctgcaatatatcgggcgagcgtg

SEQ ID NO: 23532 - DNA, 25 bp, Homo sapien
ggcgaccggagaagcctctgcaata

SEQ ID NO: 23533 - DNA, 25 bp, Homo sapien
ggcggcaaatcgatcgccggtcaga

SEQ ID NO: 23534 - DNA, 25 bp, Homo sapien
cctgcttgtccttgtgcttgagatc

SEQ ID NO: 23535 - DNA, 25 bp, Homo sapien
ccgcgcaaagcgtcatgggagctgt

SEQ ID NO: 23536 - DNA, 25 bp, Homo sapien
tattgtaaagcaccctatgccgcgc

SEQ ID NO: 23537 - DNA, 25 bp, Homo sapien
gcctctccaaccgagcttctattgt

SEQ ID NO: 23538 - DNA, 25 bp, Homo sapien
gaagcggccgttcccagcttttctc

SEQ ID NO: 23539 - DNA, 25 bp, Homo sapien
tcggccgttcttcgtccagagatga

SEQ ID NO: 23540 - DNA, 25 bp, Homo sapien
ctagatcggcgctgccgtttaactc

SEQ ID NO: 23541 - DNA, 25 bp, Homo sapien
tgccgctccttgtggcccttatgct

SEQ ID NO: 23542 - DNA, 25 bp, Homo sapien
tggttacagtaactctcgctacagc

SEQ ID NO: 23543 - DNA, 25 bp, Homo sapien
ctccaaatcgagctctgcgcgacga

SEQ ID NO: 23544 - DNA, 25 bp, Homo sapien
gatctcgctataggggttctcgcta

SEQ ID NO: 23545 - DNA, 25 bp, Homo sapien
gatctccttacagccggtcgcgcta

SEQ ID NO: 23546 - DNA, 25 bp, Homo sapien
tcgctacagccgatatcacagcagc

SEQ ID NO: 23547 - DNA, 25 bp, Homo sapien
tcacagcagccggtctcactcgaag

SEQ ID NO: 23548 - DNA, 25 bp, Homo sapien
ggcggatctcactacagctcatctg

SEQ ID NO: 23549 - DNA, 25 bp, Homo sapien
gggaatctcgctacggcggatctca

SEQ ID NO: 23550 - DNA, 25 bp, Homo sapien
ctacttctaggtcctccgccggatt

SEQ ID NO: 23551 - DNA, 25 bp, Homo sapien
ctcatcgcggataggcccaatcttg

SEQ ID NO: 23552 - DNA, 25 bp, Homo sapien
cccaatcttgctttctgcggaagtc

SEQ ID NO: 23553 - DNA, 25 bp, Homo sapien
agtcccgactccgaccttaggatgc

SEQ ID NO: 23554 - DNA, 25 bp, Homo sapien
cgggcaatcggaaatcggctacttt

SEQ ID NO: 23555 - DNA, 25 bp, Homo sapien
atcggctactttggcctgtctcctc

SEQ ID NO: 23556 - DNA, 25 bp, Homo sapien
cgagcgctaagcgtagtcccgactc

SEQ ID NO: 23557 - DNA, 25 bp, Homo sapien
agatcgctcccgctacttctaggtc

SEQ ID NO: 23558 - DNA, 25 bp, Homo sapien
tgcgatcgtcctagagagtccattc

SEQ ID NO: 23559 - DNA, 25 bp, Homo sapien
tgagaaccagacacaccggcggtga

SEQ ID NO: 23560 - DNA, 25 bp, Homo sapien
ccttaagtgacaggggaccgccttg

SEQ ID NO: 23561 - DNA, 25 bp, Homo sapien
agagtccattcagctgcacttccgc

SEQ ID NO: 23562 - DNA, 25 bp, Homo sapien
cctgggcgtgttgtccttaagtgac

SEQ ID NO: 23563 - DNA, 25 bp, Homo sapien
ctgcaatcagtactatgcgatcgtc

SEQ ID NO: 23564 - DNA, 25 bp, Homo sapien
acttccgcctcagtaggtgtcatgg

SEQ ID NO: 23565 - DNA, 25 bp, Homo sapien
ggcacctttaaatcaccgcagagtc

SEQ ID NO: 23566 - DNA, 25 bp, Homo sapien
cccgcattccgcagtagtaatacag

SEQ ID NO: 23567 - DNA, 25 bp, Homo sapien
tcccgagctggggagttctctctag

SEQ ID NO: 23568 - DNA, 25 bp, Homo sapien
aggcaagccctattcctcagccggg

SEQ ID NO: 23569 - DNA, 25 bp, Homo sapien
tcgacactcgctaggaggcaagccc

SEQ ID NO: 23570 - DNA, 25 bp, Homo sapien
acaaagacctcgtgccagccgcaga

SEQ ID NO: 23571 - DNA, 25 bp, Homo sapien
ggaaggacgccgcaacaccctcata

SEQ ID NO: 23572 - DNA, 25 bp, Homo sapien
tcttggcaaagtcggctagaggcgc

SEQ ID NO: 23573 - DNA, 25 bp, Homo sapien
gcagctcgaagctccgacaagtctc

SEQ ID NO: 23574 - DNA, 25 bp, Homo sapien
cctgacgggagcagttagactggcc

SEQ ID NO: 23575 - DNA, 25 bp, Homo sapien
aggaccttggccgaggttcctgacg

SEQ ID NO: 23576 - DNA, 25 bp, Homo sapien
cccgagtcccagcttcggaggtaga

SEQ ID NO: 23577 - DNA, 25 bp, Homo sapien
cgggcgatgcgaactgcaagacttt

SEQ ID NO: 23578 - DNA, 25 bp, Homo sapien
gcaagactttccgagctccgcaatc

SEQ ID NO: 23579 - DNA, 25 bp, Homo sapien
cgcggtacccgcatgttgctatggc

SEQ ID NO: 23580 - DNA, 25 bp, Homo sapien
aaagtttctggcaaacaggaatggg

SEQ ID NO: 23581 - DNA, 25 bp, Homo sapien
gtaacagaaagagcgacggtcaggc

SEQ ID NO: 23582 - DNA, 25 bp, Homo sapien
tcgaagccagttccttgcgtcagtg

SEQ ID NO: 23583 - DNA, 25 bp, Homo sapien
aactccgacacagcggtggtgcata

SEQ ID NO: 23584 - DNA, 25 bp, Homo sapien
tctgcaagctctgctgacacacggc

SEQ ID NO: 23585 - DNA, 25 bp, Homo sapien
cgccatgttttcctctttgaacccg

SEQ ID NO: 23586 - DNA, 25 bp, Homo sapien
tcagtgccgcggctctttaacccga

SEQ ID NO: 23587 - DNA, 25 bp, Homo sapien
ttttaaagccagaggccgttgacgc

SEQ ID NO: 23588 - DNA, 25 bp, Homo sapien
ctggggttggttatgaactccgaca

SEQ ID NO: 23589 - DNA, 25 bp, Homo sapien
cgccgcctttgttttccgccatgtt

SEQ ID NO: 23590 - DNA, 25 bp, Homo sapien
cctcaagtccgctgtatggccagaa

SEQ ID NO: 23591 - DNA, 25 bp, Homo sapien
caggacctcggtcactgcagttcca

SEQ ID NO: 23592 - DNA, 25 bp, Homo sapien
aacgttgtctcctgtggccaagcta

SEQ ID NO: 23593 - DNA, 25 bp, Homo sapien
ccctggcaaggctcagttcttattg

SEQ ID NO: 23594 - DNA, 25 bp, Homo sapien
tacctgtctgtacctcaacgttgtc

SEQ ID NO: 23595 - DNA, 25 bp, Homo sapien
agctgggcccaacaaccggttgctc

SEQ ID NO: 23596 - DNA, 25 bp, Homo sapien
ggccacgagaggacgtcccaaagct

SEQ ID NO: 23597 - DNA, 25 bp, Homo sapien
ccaagctagtctcccgggtatcact

SEQ ID NO: 23598 - DNA, 25 bp, Homo sapien
gatcttctcgatggtgcagctcata

SEQ ID NO: 23599 - DNA, 25 bp, Homo sapien
cgtagcctctccagcagcgtcttgg

SEQ ID NO: 23600 - DNA, 25 bp, Homo sapien
gcagcctattttgcgggttgacccg

SEQ ID NO: 23601 - DNA, 25 bp, Homo sapien
ccgggcacgtttacaaggtgtcttg

SEQ ID NO: 23602 - DNA, 25 bp, Homo sapien
cattacaggcgtcatttccgggcac

SEQ ID NO: 23603 - DNA, 25 bp, Homo sapien
cgtcttggcgtctgtcaggatcttc

SEQ ID NO: 23604 - DNA, 25 bp, Homo sapien
tctgggagtctgtctcagcattaca

SEQ ID NO: 23605 - DNA, 25 bp, Homo sapien
tacgcgactcgctcagatcttctgg

SEQ ID NO: 23606 - DNA, 25 bp, Homo sapien
tttcggaggttcaccctcgtggagc

SEQ ID NO: 23607 - DNA, 25 bp, Homo sapien
cggtctcgcatgttacggggttgaa

SEQ ID NO: 23608 - DNA, 25 bp, Homo sapien
ggcctgccatgtccgggagaagaca

SEQ ID NO: 23609 - DNA, 25 bp, Homo sapien
ttcctccgtgagactgttgagtggc

SEQ ID NO: 23610 - DNA, 25 bp, Homo sapien
tcagcctgactgaggcgggacttcc

SEQ ID NO: 23611 - DNA, 25 bp, Homo sapien
gccttgcgtgaagtccacgtgctca

SEQ ID NO: 23612 - DNA, 25 bp, Homo sapien
aaagtcggagcctggcctacgtaga

SEQ ID NO: 23613 - DNA, 25 bp, Homo sapien
gcagggtcttgacgctgtctctttc

SEQ ID NO: 23614 - DNA, 25 bp, Homo sapien
ttctgttgccctcatagaccgtatg

SEQ ID NO: 23615 - DNA, 25 bp, Homo sapien
cctcctggcgatgtgatggaattta

SEQ ID NO: 23616 - DNA, 25 bp, Homo sapien
tcccgctagttcttcaaaggtgagg

SEQ ID NO: 23617 - DNA, 25 bp, Homo sapien
ccactccgcggtaagcgacgttgta

SEQ ID NO: 23618 - DNA, 25 bp, Homo sapien
tagaccgtatgtagcagttcgcgtg

SEQ ID NO: 23619 - DNA, 25 bp, Homo sapien
cgagttattttcctggggactgagc

SEQ ID NO: 23620 - DNA, 25 bp, Homo sapien
cagccctccgctgttttcttttggg

SEQ ID NO: 23621 - DNA, 25 bp, Homo sapien
atttagccgttgaactgccagccgc

SEQ ID NO: 23622 - DNA, 25 bp, Homo sapien
ggacccatttaatcagcgccctgtg

SEQ ID NO: 23623 - DNA, 25 bp, Homo sapien
tgacctcgggtagaagagctaagtg

SEQ ID NO: 23624 - DNA, 25 bp, Homo sapien
gcaggttgaagccaagcagcaggta

SEQ ID NO: 23625 - DNA, 25 bp, Homo sapien
cccgagggagcacgttcgctcttct

SEQ ID NO: 23626 - DNA, 25 bp, Homo sapien
gcttgagggataagcacttggtctc

SEQ ID NO: 23627 - DNA, 25 bp, Homo sapien
ttggtctcgtggctatggaaatcta

SEQ ID NO: 23628 - DNA, 25 bp, Homo sapien
tggaaatctaggaaggtgacctcgg

SEQ ID NO: 23629 - DNA, 25 bp, Homo sapien
cggctcctggtctcacccagaagag

SEQ ID NO: 23630 - DNA, 25 bp, Homo sapien
atgagggtcgctccactctcctgcg

SEQ ID NO: 23631 - DNA, 25 bp, Homo sapien
gcttcctccgcgtccatcgcccttg

SEQ ID NO: 23632 - DNA, 25 bp, Homo sapien
ggcgagtagatccagacctggagtc

SEQ ID NO: 23633 - DNA, 25 bp, Homo sapien
tgcgcacaccggagaccgaaccggg

SEQ ID NO: 23634 - DNA, 25 bp, Homo sapien
gagcagggcccatacccgctggacg

SEQ ID NO: 23635 - DNA, 25 bp, Homo sapien
ggagcagggcccatacccgctggac

SEQ ID NO: 23636 - DNA, 25 bp, Homo sapien
tcctccgggacctgcacctgcgccg

SEQ ID NO: 23637 - DNA, 25 bp, Homo sapien
atgcgcacaccggagaccgaaccgg

SEQ ID NO: 23638 - DNA, 25 bp, Homo sapien
tcctggggactacagacggatcgct

SEQ ID NO: 23639 - DNA, 25 bp, Homo sapien
ctgagtcacacgctccaaatcctgg

SEQ ID NO: 23640 - DNA, 25 bp, Homo sapien
tgctctcacacaggcttcttgaatt

SEQ ID NO: 23641 - DNA, 25 bp, Homo sapien
gccagaccggtatccttgcaaactc

SEQ ID NO: 23642 - DNA, 25 bp, Homo sapien
tcgggacatttctcagggctgctct

SEQ ID NO: 23643 - DNA, 25 bp, Homo sapien
agggactccacgaccagaactaacg

SEQ ID NO: 23644 - DNA, 25 bp, Homo sapien
agccctcgagctagaccctggcatg

SEQ ID NO: 23645 - DNA, 25 bp, Homo sapien
gcgttatccacttctagccctcgag

SEQ ID NO: 23646 - DNA, 25 bp, Homo sapien
tcacaaaaaattgagccggccctgg

SEQ ID NO: 23647 - DNA, 25 bp, Homo sapien
caggacctcatttccttctgcagtc

SEQ ID NO: 23648 - DNA, 25 bp, Homo sapien
cgcaacaggcaggtaggagtttact

SEQ ID NO: 23649 - DNA, 25 bp, Homo sapien
ggtctgtgtgcacacctcgctcaca

SEQ ID NO: 23650 - DNA, 25 bp, Homo sapien
ctccgggtagtgcttcctctgactc

SEQ ID NO: 23651 - DNA, 25 bp, Homo sapien
acaggaagcggaaagcagcagtgca

SEQ ID NO: 23652 - DNA, 25 bp, Homo sapien
cggcagcgctagctgttcttggctc

SEQ ID NO: 23653 - DNA, 25 bp, Homo sapien
tctgcccaaggtgtccctgctggag

SEQ ID NO: 23654 - DNA, 25 bp, Homo sapien
cgcagacagcgaggtgtcatcatta

SEQ ID NO: 23655 - DNA, 25 bp, Homo sapien
agtgccgtcagaagacacgtcagtc

SEQ ID NO: 23656 - DNA, 25 bp, Homo sapien
ctgtgtggaggatgtttctgttttc

SEQ ID NO: 23657 - DNA, 25 bp, Homo sapien
cgagcggcttatcctagactgaaga

SEQ ID NO: 23658 - DNA, 25 bp, Homo sapien
gccaacttggggcagggatcaccgt

SEQ ID NO: 23659 - DNA, 25 bp, Homo sapien
cagcctccgagtgacttccaaggtc

SEQ ID NO: 23660 - DNA, 25 bp, Homo sapien
ttatcgccggttacgtccgacagcc

SEQ ID NO: 23661 - DNA, 25 bp, Homo sapien
acacttccagtgtgaggcgttcgcc

SEQ ID NO: 23662 - DNA, 25 bp, Homo sapien
tactagactggacacctcgacttgc

SEQ ID NO: 23663 - DNA, 25 bp, Homo sapien
aaattgactccgatgccctcgcagg

SEQ ID NO: 23664 - DNA, 25 bp, Homo sapien
tcgcgcttctccgaaatcgtaaaga

SEQ ID NO: 23665 - DNA, 25 bp, Homo sapien
cttcccggacaaacgagcgatttcg

SEQ ID NO: 23666 - DNA, 25 bp, Homo sapien
tcgcgactgggtttttgtgcctctt

SEQ ID NO: 23667 - DNA, 25 bp, Homo sapien
ttggtccggactcagcatcattttg

SEQ ID NO: 23668 - DNA, 25 bp, Homo sapien
tctggcgaccaccttgcgggaaaat

SEQ ID NO: 23669 - DNA, 25 bp, Homo sapien
cgcggttgacccaggccgcatacta

SEQ ID NO: 23670 - DNA, 25 bp, Homo sapien
gggagatgggcatctaccagatgta

SEQ ID NO: 23671 - DNA, 25 bp, Homo sapien
gatgtttcttctcaggccctcagcc

SEQ ID NO: 23672 - DNA, 25 bp, Homo sapien
ggacgcggtcccgatgtttcttctc

SEQ ID NO: 23673 - DNA, 25 bp, Homo sapien
gcagacagcggtccctctcaaaaca

SEQ ID NO: 23674 - DNA, 25 bp, Homo sapien
taccagatgtacttgtgcttcctgc

SEQ ID NO: 23675 - DNA, 25 bp, Homo sapien
gaggccgaggctctgcaaacaccga

SEQ ID NO: 23676 - DNA, 25 bp, Homo sapien
caaacaccgaggtgtggcgagcgtc

SEQ ID NO: 23677 - DNA, 25 bp, Homo sapien
tcctcactttaaggcgcagacagcg

SEQ ID NO: 23678 - DNA, 25 bp, Homo sapien
cgggctcttgaaggagcagcgagga

SEQ ID NO: 23679 - DNA, 25 bp, Homo sapien
gggaagactcacagggactacggtc

SEQ ID NO: 23680 - DNA, 25 bp, Homo sapien
gactcacagggactacggtctacgg

SEQ ID NO: 23681 - DNA, 25 bp, Homo sapien
tcacagggactacggtctacgggga

SEQ ID NO: 23682 - DNA, 25 bp, Homo sapien
aaattcctcccgctgaaggcagaga

SEQ ID NO: 23683 - DNA, 25 bp, Homo sapien
gactgggacactgcggttcccgaga

SEQ ID NO: 23684 - DNA, 25 bp, Homo sapien
gaagactagctgacggcggccccca

SEQ ID NO: 23685 - DNA, 25 bp, Homo sapien
gacactgcggttcccgagagccgca

SEQ ID NO: 23686 - DNA, 25 bp, Homo sapien
tcagataagactcgttctgcctctg

SEQ ID NO: 23687 - DNA, 25 bp, Homo sapien
gcccattcccgtcgagttgaaaatg

SEQ ID NO: 23688 - DNA, 25 bp, Homo sapien
ccgtcgagttgaaaatgtcaaaggc

SEQ ID NO: 23689 - DNA, 25 bp, Homo sapien
tcaaaggcttccagagtgcgacgtg

SEQ ID NO: 23690 - DNA, 25 bp, Homo sapien
tgcgacgtgaactcagataagactc

SEQ ID NO: 23691 - DNA, 25 bp, Homo sapien
ctgccttgcagccttcgtgtatgag

SEQ ID NO: 23692 - DNA, 25 bp, Homo sapien
ccttgcagccttcgtgtatgagccc

SEQ ID NO: 23693 - DNA, 25 bp, Homo sapien
ccagagtgcgacgtgaactcagata

SEQ ID NO: 23694 - DNA, 25 bp, Homo sapien
tacccgcacggtgaattgtcttcca

SEQ ID NO: 23695 - DNA, 25 bp, Homo sapien
ggtcgaggaaaactgctgccgcgcc

SEQ ID NO: 23696 - DNA, 25 bp, Homo sapien
cccgcacggtgaattgtcttccacg

SEQ ID NO: 23697 - DNA, 25 bp, Homo sapien
tgccgcgccccactgggttttaaca

SEQ ID NO: 23698 - DNA, 25 bp, Homo sapien
gggaagggctcccacttgcgcccca

SEQ ID NO: 23699 - DNA, 25 bp, Homo sapien
catgcggagaaggttcggcagcgcc

SEQ ID NO: 23700 - DNA, 25 bp, Homo sapien
aagggtcgaggaaaactgctgccgc

SEQ ID NO: 23701 - DNA, 25 bp, Homo sapien
cctacccgcacggtgaattgtcttc

SEQ ID NO: 23702 - DNA, 25 bp, Homo sapien
acgggaaggaagatgcctccctgca

SEQ ID NO: 23703 - DNA, 25 bp, Homo sapien
gttaaatatctgctcctcgcgctcg

SEQ ID NO: 23704 - DNA, 25 bp, Homo sapien
tcgagcctccctgcctattgtcggg

SEQ ID NO: 23705 - DNA, 25 bp, Homo sapien
cgcagcatcagctcgtcaacgggaa

SEQ ID NO: 23706 - DNA, 25 bp, Homo sapien
gccgcgcacagagcataaagaatct

SEQ ID NO: 23707 - DNA, 25 bp, Homo sapien
tgcacagatgctccgggcagcaaca

SEQ ID NO: 23708 - DNA, 25 bp, Homo sapien
gacagccggccttccgttaaatatc

SEQ ID NO: 23709 - DNA, 25 bp, Homo sapien
gcccgagtcagcattttgggtctga

SEQ ID NO: 23710 - DNA, 25 bp, Homo sapien
tcccgggacacggtggacacgcttg

SEQ ID NO: 23711 - DNA, 25 bp, Homo sapien
actgagcaccgccaccatggggaag

SEQ ID NO: 23712 - DNA, 25 bp, Homo sapien
tgattctccagcgacaggacccggc

SEQ ID NO: 23713 - DNA, 25 bp, Homo sapien
acacgtggcaacagcggtagcagcc

SEQ ID NO: 23714 - DNA, 25 bp, Homo sapien
gccagcacgcaggttgcatatttta

SEQ ID NO: 23715 - DNA, 25 bp, Homo sapien
tgtcaggttgctccggtaacggtga

SEQ ID NO: 23716 - DNA, 25 bp, Homo sapien
cgcggcttaaaagacgacgcagttt

SEQ ID NO: 23717 - DNA, 25 bp, Homo sapien
tggacacgcttgtcccagacctggg

SEQ ID NO: 23718 - DNA, 25 bp, Homo sapien
tcacgactacgagctgcgggttctc

SEQ ID NO: 23719 - DNA, 25 bp, Homo sapien
tccagctggtacaatgggcaccgcc

SEQ ID NO: 23720 - DNA, 25 bp, Homo sapien
tgtgcgccaacagccaacagagtcc

SEQ ID NO: 23721 - DNA, 25 bp, Homo sapien
agcttcccgacatgccgctggagga

SEQ ID NO: 23722 - DNA, 25 bp, Homo sapien
agggtaccaggtatgccctgtgctg

SEQ ID NO: 23723 - DNA, 25 bp, Homo sapien
gcggagactttgagacgtttgaaaa

SEQ ID NO: 23724 - DNA, 25 bp, Homo sapien
cagcaaccgaaaagaccaccctatg

SEQ ID NO: 23725 - DNA, 25 bp, Homo sapien
ttctctgctgcgaatacgtgccctg

SEQ ID NO: 23726 - DNA, 25 bp, Homo sapien
gcctccgtctgcaaggagagcagag

SEQ ID NO: 23727 - DNA, 25 bp, Homo sapien
gcggccatcacacggcattttaaaa

SEQ ID NO: 23728 - DNA, 25 bp, Homo sapien
cgttacagaagtattgcggccatca

SEQ ID NO: 23729 - DNA, 25 bp, Homo sapien
ggagcgcggattcgtctctgcgcta

SEQ ID NO: 23730 - DNA, 25 bp, Homo sapien
gccagtgaagggctccgtgcttaaa

SEQ ID NO: 23731 - DNA, 25 bp, Homo sapien
tcgtctctgcgctacggcggctgca

SEQ ID NO: 23732 - DNA, 25 bp, Homo sapien
tgggatgcctccaaacccggcgcgg

SEQ ID NO: 23733 - DNA, 25 bp, Homo sapien
gggctccgtgcttaaacatcattcg

SEQ ID NO: 23734 - DNA, 25 bp, Homo sapien
gacgaggacgtctactttttcttga

SEQ ID NO: 23735 - DNA, 25 bp, Homo sapien
gacttagaatggctcaccagttaaa

SEQ ID NO: 23736 - DNA, 25 bp, Homo sapien
caataaatgggagacttagaatggc

SEQ ID NO: 23737 - DNA, 25 bp, Homo sapien
tttcctttcccaaaagtgactctgc

SEQ ID NO: 23738 - DNA, 25 bp, Homo sapien
aagcctgaatgctcctccgggtgcg

SEQ ID NO: 23739 - DNA, 25 bp, Homo sapien
aacgggaagcctgaatgctcctccg

SEQ ID NO: 23740 - DNA, 25 bp, Homo sapien
gatgctcacgatgaccatcgcccta

SEQ ID NO: 23741 - DNA, 25 bp, Homo sapien
agtgactctgctttgtctgaaaata

SEQ ID NO: 23742 - DNA, 25 bp, Homo sapien
gccgactgggcttcctagttgccta

SEQ ID NO: 23743 - DNA, 25 bp, Homo sapien
ctaagttcaagcaccgcctacgcgg

SEQ ID NO: 23744 - DNA, 25 bp, Homo sapien
tggggcaggcttcactcaccaaagc

SEQ ID NO: 23745 - DNA, 25 bp, Homo sapien
cttgctgactccatgagggacactg

SEQ ID NO: 23746 - DNA, 25 bp, Homo sapien
tcagcgacgttactggggaagccca

SEQ ID NO: 23747 - DNA, 25 bp, Homo sapien
gttcacggctgggaaaaattttgca

SEQ ID NO: 23748 - DNA, 25 bp, Homo sapien
tcctctctgctgatacggcggacgc

SEQ ID NO: 23749 - DNA, 25 bp, Homo sapien
ggcgattctgaaaagtcctctctgc

SEQ ID NO: 23750 - DNA, 25 bp, Homo sapien
gtccttcagtccatccaggcgcacg

SEQ ID NO: 23751 - DNA, 25 bp, Homo sapien
aagggagtccggagctccgctttca

SEQ ID NO: 23752 - DNA, 25 bp, Homo sapien
gggtgtttatatctcgctgattgga

SEQ ID NO: 23753 - DNA, 25 bp, Homo sapien
tgttttaccttgcagggtgtttata

SEQ ID NO: 23754 - DNA, 25 bp, Homo sapien
ccgctattgttttaccttgcagggt

SEQ ID NO: 23755 - DNA, 25 bp, Homo sapien
ggcaagttaatcagggcttcacacc

SEQ ID NO: 23756 - DNA, 25 bp, Homo sapien
cgagcagcccggcaagttaatcagg

SEQ ID NO: 23757 - DNA, 25 bp, Homo sapien
cctccgccagggcaaatcgggaagg

SEQ ID NO: 23758 - DNA, 25 bp, Homo sapien
agctacactcctcttgcagtgcctg

SEQ ID NO: 23759 - DNA, 25 bp, Homo sapien
tgccgcagatctcatgcagtgcaga

SEQ ID NO: 23760 - DNA, 25 bp, Homo sapien
ctcatgcagtgcagacgccgtgaca

SEQ ID NO: 23761 - DNA, 25 bp, Homo sapien
gcagacgccgtgacatcacgtcaca

SEQ ID NO: 23762 - DNA, 25 bp, Homo sapien
atcacgtcacacttgagggcgtccc

SEQ ID NO: 23763 - DNA, 25 bp, Homo sapien
ctcctgctggcggtgccacaggtag

SEQ ID NO: 23764 - DNA, 25 bp, Homo sapien
aggtagctacactcctcttgcagtg

SEQ ID NO: 23765 - DNA, 25 bp, Homo sapien
gcggtgccacaggtagctacactcc

SEQ ID NO: 23766 - DNA, 25 bp, Homo sapien
acgcctcctcgcctttaagcgggtg

SEQ ID NO: 23767 - DNA, 25 bp, Homo sapien
gtcctcggctcgagagcggaaatgt

SEQ ID NO: 23768 - DNA, 25 bp, Homo sapien
ccagcgctgggatttatcggctcgc

SEQ ID NO: 23769 - DNA, 25 bp, Homo sapien
tcccttctgctttcgggaagcggtc

SEQ ID NO: 23770 - DNA, 25 bp, Homo sapien
cgctgcggttcttcccttctgcttt

SEQ ID NO: 23771 - DNA, 25 bp, Homo sapien
gaaagtttgtgtttgttgctggcaa

SEQ ID NO: 23772 - DNA, 25 bp, Homo sapien
ggctcttcctccgttacctggagcg

SEQ ID NO: 23773 - DNA, 25 bp, Homo sapien
ggaaatgtgagcctttgatatgccc

SEQ ID NO: 23774 - DNA, 25 bp, Homo sapien
gggctcctacaggtgtatcgtcagc

SEQ ID NO: 23775 - DNA, 25 bp, Homo sapien
tgtatcgtcagcgagtggatcgccg

SEQ ID NO: 23776 - DNA, 25 bp, Homo sapien
cgctaccacagtggggacgtgcgcc

SEQ ID NO: 23777 - DNA, 25 bp, Homo sapien
ctggggtacgagcagcgctaccaca

SEQ ID NO: 23778 - DNA, 25 bp, Homo sapien
tcgccctgacccacgagggcaggtt

SEQ ID NO: 23779 - DNA, 25 bp, Homo sapien
tggacgggctactgacctagctttc

SEQ ID NO: 23780 - DNA, 25 bp, Homo sapien
gacctagctttctctctccgcagtg

SEQ ID NO: 23781 - DNA, 25 bp, Homo sapien
acgtgcgcctcgacaccgtgggcag

SEQ ID NO: 23782 - DNA, 25 bp, Homo sapien
agagttgcccttccgtcttccaaga

SEQ ID NO: 23783 - DNA, 25 bp, Homo sapien
tttgcggtgtcaggaccctttaagc

SEQ ID NO: 23784 - DNA, 25 bp, Homo sapien
cagcctgcaaaagccgggtccttta

SEQ ID NO: 23785 - DNA, 25 bp, Homo sapien
aaagagcttctacgtgtgccgggca

SEQ ID NO: 23786 - DNA, 25 bp, Homo sapien
tggcccgaataaaggaaagagcttc

SEQ ID NO: 23787 - DNA, 25 bp, Homo sapien
tctgctttcttaagaccggcgtccg

SEQ ID NO: 23788 - DNA, 25 bp, Homo sapien
cgtggcgtaatcgttgttcactttc

SEQ ID NO: 23789 - DNA, 25 bp, Homo sapien
ccgtatttgatttcggcgcgcgcca

SEQ ID NO: 23790 - DNA, 25 bp, Homo sapien
tcgtcccacgaacgcagactgggtt

SEQ ID NO: 23791 - DNA, 25 bp, Homo sapien
gtagctcacaggtccctcaggccta

SEQ ID NO: 23792 - DNA, 25 bp, Homo sapien
ggcgagtccaatcaccgtccgagag

SEQ ID NO: 23793 - DNA, 25 bp, Homo sapien
gagtgacgccactaagcatccaata

SEQ ID NO: 23794 - DNA, 25 bp, Homo sapien
cgtcaccgtttcacagggactgtcc

SEQ ID NO: 23795 - DNA, 25 bp, Homo sapien
tgtccctctctctgtggtgaccaga

SEQ ID NO: 23796 - DNA, 25 bp, Homo sapien
gtcctcaggcgcttactgtagctca

SEQ ID NO: 23797 - DNA, 25 bp, Homo sapien
ctcccattggtggatggcactgtca

SEQ ID NO: 23798 - DNA, 25 bp, Homo sapien
cggctcgttgaaccttgggcgctgc

SEQ ID NO: 23799 - DNA, 25 bp, Homo sapien
ctgtgcccggctcgatgaaccttgg

SEQ ID NO: 23800 - DNA, 25 bp, Homo sapien
cggctcgatgaaccttgggcgctgc

SEQ ID NO: 23801 - DNA, 25 bp, Homo sapien
accttgggcgctgcccgttctgagg

SEQ ID NO: 23802 - DNA, 25 bp, Homo sapien
cccggctcgatgaaccttgggcgct

SEQ ID NO: 23803 - DNA, 25 bp, Homo sapien
gcccggctcgttgaaccttgggcgc

SEQ ID NO: 23804 - DNA, 25 bp, Homo sapien
cccggctcgttgaaccttgggcgct

SEQ ID NO: 23805 - DNA, 25 bp, Homo sapien
tgcccggctcgttgaaccttgggcg

SEQ ID NO: 23806 - DNA, 25 bp, Homo sapien
cttggagctgcatcgggcacagcct

SEQ ID NO: 23807 - DNA, 25 bp, Homo sapien
ctagaaccttctgcctgatgcacaa

SEQ ID NO: 23808 - DNA, 25 bp, Homo sapien
tgggagcctgcttgtctctagaacc

SEQ ID NO: 23809 - DNA, 25 bp, Homo sapien
tagcgcagccacatcccttgggagc

SEQ ID NO: 23810 - DNA, 25 bp, Homo sapien
gggtgaccctcctgtttgtcctgtc

SEQ ID NO: 23811 - DNA, 25 bp, Homo sapien
agtgctgcctgacacgtgtgtctgc

SEQ ID NO: 23812 - DNA, 25 bp, Homo sapien
gaactcttctcctaccatgatggtg

SEQ ID NO: 23813 - DNA, 25 bp, Homo sapien
gttgcagcccttggccgggcactaa

SEQ ID NO: 23814 - DNA, 25 bp, Homo sapien
tggcgcccagtccatgcgactatct

SEQ ID NO: 23815 - DNA, 25 bp, Homo sapien
aacagcaatccctacgccttcggtg

SEQ ID NO: 23816 - DNA, 25 bp, Homo sapien
gcggccgattcccacgtgaagatct

SEQ ID NO: 23817 - DNA, 25 bp, Homo sapien
tgacaagttcttctacgccgggacc

SEQ ID NO: 23818 - DNA, 25 bp, Homo sapien
gccttcggtgccttgggccaagaaa

SEQ ID NO: 23819 - DNA, 25 bp, Homo sapien
ccggctttggcgaatgtgacaagtt

SEQ ID NO: 23820 - DNA, 25 bp, Homo sapien
gcagcccagggtacgttgtcagcat

SEQ ID NO: 23821 - DNA, 25 bp, Homo sapien
ttctccactcttggtagcgcgcgtc

SEQ ID NO: 23822 - DNA, 25 bp, Homo sapien
agtgaggaatgagccggcgcctacc

SEQ ID NO: 23823 - DNA, 25 bp, Homo sapien
ccagcgaagtgggagaccttcctcc

SEQ ID NO: 23824 - DNA, 25 bp, Homo sapien
gcttcggcttcccagcgaagtggga

SEQ ID NO: 23825 - DNA, 25 bp, Homo sapien
tttcggacgctattgcccttcgcgc

SEQ ID NO: 23826 - DNA, 25 bp, Homo sapien
ccggactcaggtgtttcggacgcta

SEQ ID NO: 23827 - DNA, 25 bp, Homo sapien
aggaagttccgctccctgacagacc

SEQ ID NO: 23828 - DNA, 25 bp, Homo sapien
agcagtacgctttcgggctgctgga

SEQ ID NO: 23829 - DNA, 25 bp, Homo sapien
ctgacagacccgtgcggtagcaaca

SEQ ID NO: 23830 - DNA, 25 bp, Homo sapien
attcacccgaagagccaatcagagg

SEQ ID NO: 23831 - DNA, 25 bp, Homo sapien
ccctcctctaaaggtgcggcgatgc

SEQ ID NO: 23832 - DNA, 25 bp, Homo sapien
gagctacaactttccagagacctgg

SEQ ID NO: 23833 - DNA, 25 bp, Homo sapien
ggatttactcgtctcttggcaacca

SEQ ID NO: 23834 - DNA, 25 bp, Homo sapien
tcccaaagggccagaagagacgctc

SEQ ID NO: 23835 - DNA, 25 bp, Homo sapien
cccgccgagtgtgaattcgaattcg

SEQ ID NO: 23836 - DNA, 25 bp, Homo sapien
attcggcggtttcactaggcgcagc

SEQ ID NO: 23837 - DNA, 25 bp, Homo sapien
cccactaagtggtgctcaggtcttt

SEQ ID NO: 23838 - DNA, 25 bp, Homo sapien
ctgaggatgatatgaccgtgtgttc

SEQ ID NO: 23839 - DNA, 25 bp, Homo sapien
acagcactctggtggtcccatccgg

SEQ ID NO: 23840 - DNA, 25 bp, Homo sapien
tttcacttctcgtagagacggcgtc

SEQ ID NO: 23841 - DNA, 25 bp, Homo sapien
ccgagtacggcgagtcaaagtccca

SEQ ID NO: 23842 - DNA, 25 bp, Homo sapien
aaatgctctgggctgcgaaacaccg

SEQ ID NO: 23843 - DNA, 25 bp, Homo sapien
ggctttctccgtcatttcctcctag

SEQ ID NO: 23844 - DNA, 25 bp, Homo sapien
tgcggctccgattttgcagattctg

SEQ ID NO: 23845 - DNA, 25 bp, Homo sapien
ggcgccaggctcgttcttcaagaga

SEQ ID NO: 23846 - DNA, 25 bp, Homo sapien
tcgcaggtcgggctacgttcttcta

SEQ ID NO: 23847 - DNA, 25 bp, Homo sapien
gcaggaaagctgcacaactggagga

SEQ ID NO: 23848 - DNA, 25 bp, Homo sapien
gacttttcagcaggaaagctgcaca

SEQ ID NO: 23849 - DNA, 25 bp, Homo sapien
ggtcaaattttaggacttttcagca

SEQ ID NO: 23850 - DNA, 25 bp, Homo sapien
caacggagtttcagagcgcgcggca

SEQ ID NO: 23851 - DNA, 25 bp, Homo sapien
tcggaatccttgggtcaaccgcctc

SEQ ID NO: 23852 - DNA, 25 bp, Homo sapien
ctacgttcttctacggtctgaggcg

SEQ ID NO: 23853 - DNA, 25 bp, Homo sapien
tccacagcaacggagtttcagagcg

SEQ ID NO: 23854 - DNA, 25 bp, Homo sapien
cgggctggcacaccgaggcctcgca

SEQ ID NO: 23855 - DNA, 25 bp, Homo sapien
cacgcggcgcgatgcggcgaggcga

SEQ ID NO: 23856 - DNA, 25 bp, Homo sapien
agccccaggcgcgagaacaggaact

SEQ ID NO: 23857 - DNA, 25 bp, Homo sapien
agaacaggaactcgggctggcacac

SEQ ID NO: 23858 - DNA, 25 bp, Homo sapien
aactcgggctggcacaccgaggcct

SEQ ID NO: 23859 - DNA, 25 bp, Homo sapien
cctcgcagccaagccgcgcctgacc

SEQ ID NO: 23860 - DNA, 25 bp, Homo sapien
cgcgcctgacccgttcgccgttccg

SEQ ID NO: 23861 - DNA, 25 bp, Homo sapien
caggaactcgggctggcacaccgag

SEQ ID NO: 23862 - DNA, 25 bp, Homo sapien
gagaatgcgagacctgccacgtgta

SEQ ID NO: 23863 - DNA, 25 bp, Homo sapien
ggagcagctgttccagccgatccta

SEQ ID NO: 23864 - DNA, 25 bp, Homo sapien
gccgccgagcgcctgaaatatactt

SEQ ID NO: 23865 - DNA, 25 bp, Homo sapien
cgggaaaggcccaagccctagctga

SEQ ID NO: 23866 - DNA, 25 bp, Homo sapien
tcggcagcacttagcagaagatttt

SEQ ID NO: 23867 - DNA, 25 bp, Homo sapien
gtttacattatttcgctccgcggga

SEQ ID NO: 23868 - DNA, 25 bp, Homo sapien
ttgcaaggccgcagcaatatacttg

SEQ ID NO: 23869 - DNA, 25 bp, Homo sapien
cgtgtccttggatgtgcctgtctag

SEQ ID NO: 23870 - DNA, 25 bp, Homo sapien
tcatccacggacacccagaaagctg

SEQ ID NO: 23871 - DNA, 25 bp, Homo sapien
gctgcgctctccacccaaaagaaaa

SEQ ID NO: 23872 - DNA, 25 bp, Homo sapien
tccttgcttaggctggcgacgaaaa

SEQ ID NO: 23873 - DNA, 25 bp, Homo sapien
ctcagggcatttgcgcgaagaaaca

SEQ ID NO: 23874 - DNA, 25 bp, Homo sapien
gggctcagcgcctccatagacaggt

SEQ ID NO: 23875 - DNA, 25 bp, Homo sapien
ctcagggcgactgcagatcttctcc

SEQ ID NO: 23876 - DNA, 25 bp, Homo sapien
ctcccagtctcgcagtttccgtttt

SEQ ID NO: 23877 - DNA, 25 bp, Homo sapien
cccgagttctcagaagcgagtccta

SEQ ID NO: 23878 - DNA, 25 bp, Homo sapien
cagagaaagctcaaaccggcagcga

SEQ ID NO: 23879 - DNA, 25 bp, Homo sapien
caaaccggcagcgaagtcggtccta

SEQ ID NO: 23880 - DNA, 25 bp, Homo sapien
cgaagtcggtcctagccaagctgaa

SEQ ID NO: 23881 - DNA, 25 bp, Homo sapien
tcctagtgccctggtcgagacggtt

SEQ ID NO: 23882 - DNA, 25 bp, Homo sapien
ccaagctgaaaaaacgtctcggatt

SEQ ID NO: 23883 - DNA, 25 bp, Homo sapien
cgagacggttctatccttttgcaaa

SEQ ID NO: 23884 - DNA, 25 bp, Homo sapien
aacgtctcggatttcgcggacagcg

SEQ ID NO: 23885 - DNA, 25 bp, Homo sapien
tagacacagcccgatcttccagtcc

SEQ ID NO: 23886 - DNA, 25 bp, Homo sapien
ctgacttcggtctgcgcaggagcag

SEQ ID NO: 23887 - DNA, 25 bp, Homo sapien
acggcgtttcgtgcaacgccgcagc

SEQ ID NO: 23888 - DNA, 25 bp, Homo sapien
ccaagaggtgaggaaatcctgttcc

SEQ ID NO: 23889 - DNA, 25 bp, Homo sapien
ctccacaaagggagccttgtgtggc

SEQ ID NO: 23890 - DNA, 25 bp, Homo sapien
aattgcgcgattgttcgctgacttc

SEQ ID NO: 23891 - DNA, 25 bp, Homo sapien
cggcgggccgcaaaattgcgcgatt

SEQ ID NO: 23892 - DNA, 25 bp, Homo sapien
ccgcgcccaagaggtgaggaaatcc

SEQ ID NO: 23893 - DNA, 25 bp, Homo sapien
gcagcccgaccttcgactgcagggt

SEQ ID NO: 23894 - DNA, 25 bp, Homo sapien
gctttccttaatcgaagagcgggta

SEQ ID NO: 23895 - DNA, 25 bp, Homo sapien
aacctgcctccggagtcagatgagc

SEQ ID NO: 23896 - DNA, 25 bp, Homo sapien
ttgagagctctttctgcggaacctg

SEQ ID NO: 23897 - DNA, 25 bp, Homo sapien
caggagattatcttggagcccagcg

SEQ ID NO: 23898 - DNA, 25 bp, Homo sapien
ccgcctcttagctttcgccaggaga

SEQ ID NO: 23899 - DNA, 25 bp, Homo sapien
tttttgcggcggaagaagctgaatc

SEQ ID NO: 23900 - DNA, 25 bp, Homo sapien
tagatgccggccaagcaaagtgctc

SEQ ID NO: 23901 - DNA, 25 bp, Homo sapien
tcgaaagtgtagctgggacgcccac

SEQ ID NO: 23902 - DNA, 25 bp, Homo sapien
tggcatcgagcaggcccagcgcaaa

SEQ ID NO: 23903 - DNA, 25 bp, Homo sapien
gcccagcgcaaacgcaaggtctctt

SEQ ID NO: 23904 - DNA, 25 bp, Homo sapien
aatgctgctacccacaacgcacaga

SEQ ID NO: 23905 - DNA, 25 bp, Homo sapien
gcctagaatggcctggcatcgagca

SEQ ID NO: 23906 - DNA, 25 bp, Homo sapien
ccaggatagacagaagcctagaatg

SEQ ID NO: 23907 - DNA, 25 bp, Homo sapien
cgcacagaccagaaaccaggataga

SEQ ID NO: 23908 - DNA, 25 bp, Homo sapien
ccggctattgcgcaccttctggagc

SEQ ID NO: 23909 - DNA, 25 bp, Homo sapien
ggcgtaatacgccaatgctgctacc

SEQ ID NO: 23910 - DNA, 25 bp, Homo sapien
gcactggtgtgcagttctctgtctc

SEQ ID NO: 23911 - DNA, 25 bp, Homo sapien
ctcagtggatgcgtcctctctcctt

SEQ ID NO: 23912 - DNA, 25 bp, Homo sapien
gcttttttcccgcacgtcacgtgtc

SEQ ID NO: 23913 - DNA, 25 bp, Homo sapien
tgaggcaggtcctgctccagacctg

SEQ ID NO: 23914 - DNA, 25 bp, Homo sapien
acactgaggcgggattgcgtcctcc

SEQ ID NO: 23915 - DNA, 25 bp, Homo sapien
tctccctggccaagcaacactgagg

SEQ ID NO: 23916 - DNA, 25 bp, Homo sapien
tgagtgctgcctgcaccaacagccg

SEQ ID NO: 23917 - DNA, 25 bp, Homo sapien
tctctgtctcgtgattcgtgtaaca

SEQ ID NO: 23918 - DNA, 25 bp, Homo sapien
gaacagggctgggaaactgccgtca

SEQ ID NO: 23919 - DNA, 25 bp, Homo sapien
ccggagcctgcctgccataaagtgt

SEQ ID NO: 23920 - DNA, 25 bp, Homo sapien
tgccataaagtgtgaccggaagccc

SEQ ID NO: 23921 - DNA, 25 bp, Homo sapien
agcttcactgaacaaattgtcccta

SEQ ID NO: 23922 - DNA, 25 bp, Homo sapien
ctttagagctgcgaagagcggatca

SEQ ID NO: 23923 - DNA, 25 bp, Homo sapien
tctattgtctgagaagcttcactga

SEQ ID NO: 23924 - DNA, 25 bp, Homo sapien
cgaacgcaacgtccaggaaacctca

SEQ ID NO: 23925 - DNA, 25 bp, Homo sapien
atcagggcaggttctagtgtggccc

SEQ ID NO: 23926 - DNA, 25 bp, Homo sapien
cacgggctctcaatgctaatttgga

SEQ ID NO: 23927 - DNA, 25 bp, Homo sapien
cgccttatttctaggggcttggaga

SEQ ID NO: 23928 - DNA, 25 bp, Homo sapien
agtgagcccgtatccagcttcgctg

SEQ ID NO: 23929 - DNA, 25 bp, Homo sapien
ggccaagcccttcgaagaactctga

SEQ ID NO: 23930 - DNA, 25 bp, Homo sapien
tctgagttctctgcctgacgttttg

SEQ ID NO: 23931 - DNA, 25 bp, Homo sapien
tttgtccctcaggaagtgtcccttc

SEQ ID NO: 23932 - DNA, 25 bp, Homo sapien
ccggcgatgtggcaaaaaggcaacc

SEQ ID NO: 23933 - DNA, 25 bp, Homo sapien
tatccgctggcacgcgaaggtcaca

SEQ ID NO: 23934 - DNA, 25 bp, Homo sapien
gcaggccgacagtcatagacgagta

SEQ ID NO: 23935 - DNA, 25 bp, Homo sapien
acgtctgttcagagagccaatccca

SEQ ID NO: 23936 - DNA, 25 bp, Homo sapien
gcaacgtcactacgctctgagcagg

SEQ ID NO: 23937 - DNA, 25 bp, Homo sapien
agcgctcacgcgctttccgcattga

SEQ ID NO: 23938 - DNA, 25 bp, Homo sapien
cccttatgaagtgcccggatgaagc

SEQ ID NO: 23939 - DNA, 25 bp, Homo sapien
ggagcagctgcggatcccttatgaa

SEQ ID NO: 23940 - DNA, 25 bp, Homo sapien
ggcatgtactttccctaagaagcgg

SEQ ID NO: 23941 - DNA, 25 bp, Homo sapien
tttccgcattgagtgcagcgccatc

SEQ ID NO: 23942 - DNA, 25 bp, Homo sapien
ctgtgcaccggcctgtgtactgtaa

SEQ ID NO: 23943 - DNA, 25 bp, Homo sapien
gtgtcagcacgcgatatatttcttg

SEQ ID NO: 23944 - DNA, 25 bp, Homo sapien
tcacgttctcgctccagcctggggt

SEQ ID NO: 23945 - DNA, 25 bp, Homo sapien
gcccgggtcgtaaaagtgtcagcac

SEQ ID NO: 23946 - DNA, 25 bp, Homo sapien
gcggaggagttaattgctgtcactc

SEQ ID NO: 23947 - DNA, 25 bp, Homo sapien
ctgacttcagcgaaagaggtcgatc

SEQ ID NO: 23948 - DNA, 25 bp, Homo sapien
ctagccgggcctgcaaacagcggat

SEQ ID NO: 23949 - DNA, 25 bp, Homo sapien
gatatatttcttgcaggggatcctc

SEQ ID NO: 23950 - DNA, 25 bp, Homo sapien
tggagaagtcgctgaagcgcttctc

SEQ ID NO: 23951 - DNA, 25 bp, Homo sapien
gtgcgaacggcgcacgaagcccttg

SEQ ID NO: 23952 - DNA, 25 bp, Homo sapien
cgccggtggctcaacagatgcgagc

SEQ ID NO: 23953 - DNA, 25 bp, Homo sapien
tcaacagatgcgagctgaggctgaa

SEQ ID NO: 23954 - DNA, 25 bp, Homo sapien
gcgcgtccatgatgctggccaccag

SEQ ID NO: 23955 - DNA, 25 bp, Homo sapien
gatgctggccaccaggctatccagc

SEQ ID NO: 23956 - DNA, 25 bp, Homo sapien
gcttctcgcactggccacagcggaa

SEQ ID NO: 23957 - DNA, 25 bp, Homo sapien
ttcaccaggtgcgagttacgcccga

SEQ ID NO: 23958 - DNA, 25 bp, Homo sapien
tgtagggctggacaaaggacatttc

SEQ ID NO: 23959 - DNA, 25 bp, Homo sapien
tttacgaggcacaacttcgcccagc

SEQ ID NO: 23960 - DNA, 25 bp, Homo sapien
ggacaacggtccactttacgaggca

SEQ ID NO: 23961 - DNA, 25 bp, Homo sapien
cctgagggagctcagtcctggcttt

SEQ ID NO: 23962 - DNA, 25 bp, Homo sapien
agcatgcctcgatttgtagttcccg

SEQ ID NO: 23963 - DNA, 25 bp, Homo sapien
ctgtcccatggttcgggagggctct

SEQ ID NO: 23964 - DNA, 25 bp, Homo sapien
cgggacggtcctattccctcttgca

SEQ ID NO: 23965 - DNA, 25 bp, Homo sapien
cgggagaatgttcccagcatgcctc

SEQ ID NO: 23966 - DNA, 25 bp, Homo sapien
ggcgattcttcccaaccaagttctg

SEQ ID NO: 23967 - DNA, 25 bp, Homo sapien
agcgcgcaattgttctggcagcctc

SEQ ID NO: 23968 - DNA, 25 bp, Homo sapien
tatcaattagttccggggcctcctg

SEQ ID NO: 23969 - DNA, 25 bp, Homo sapien
tgcctccgctagcattgcaaagtgc

SEQ ID NO: 23970 - DNA, 25 bp, Homo sapien
tgatgcaagactgctccgtgctttc

SEQ ID NO: 23971 - DNA, 25 bp, Homo sapien
gccctcgtaaggcagcaaacacgta

SEQ ID NO: 23972 - DNA, 25 bp, Homo sapien
cggcggcgagatgcaaacttttctt

SEQ ID NO: 23973 - DNA, 25 bp, Homo sapien
tttgcaaccgcgtctttcacgttgg

SEQ ID NO: 23974 - DNA, 25 bp, Homo sapien
ctgttaggacacagccattgtgggc

SEQ ID NO: 23975 - DNA, 25 bp, Homo sapien
agggaaaatcttcgtcaacatcacg

SEQ ID NO: 23976 - DNA, 25 bp, Homo sapien
acacagccattgtgggcaacaagga

SEQ ID NO: 23977 - DNA, 25 bp, Homo sapien
gggacctgttaggacacagccattg

SEQ ID NO: 23978 - DNA, 25 bp, Homo sapien
cggacgggacctgttaggacacagc

SEQ ID NO: 23979 - DNA, 25 bp, Homo sapien
ccatctacagcctcatggcggacgg

SEQ ID NO: 23980 - DNA, 25 bp, Homo sapien
gtcccagggaaaatcttcgtcaaca

SEQ ID NO: 23981 - DNA, 25 bp, Homo sapien
agcgagggctactgcacagctagca

SEQ ID NO: 23982 - DNA, 25 bp, Homo sapien
cgcatccagttcgttttccgggccg

SEQ ID NO: 23983 - DNA, 25 bp, Homo sapien
agtcagatttctgggggccgccgct

SEQ ID NO: 23984 - DNA, 25 bp, Homo sapien
cgctagaggcgcctgagctcaaaac

SEQ ID NO: 23985 - DNA, 25 bp, Homo sapien
aggcgcctgagctcaaaacccggct

SEQ ID NO: 23986 - DNA, 25 bp, Homo sapien
tcccagggctcggtctagctggcgt

SEQ ID NO: 23987 - DNA, 25 bp, Homo sapien
tctagctggcgtccgcaatgcgcgc

SEQ ID NO: 23988 - DNA, 25 bp, Homo sapien
cgcaatgcgcgcgtgacctgtccaa

SEQ ID NO: 23989 - DNA, 25 bp, Homo sapien
tgacctgtccaacgcatccagttcg

SEQ ID NO: 23990 - DNA, 25 bp, Homo sapien
tgccctaccctttggagctcctgga

SEQ ID NO: 23991 - DNA, 25 bp, Homo sapien
ctggaccctctaaccgctcggtggg

SEQ ID NO: 23992 - DNA, 25 bp, Homo sapien
tgcttccacaatgagggccacctgt

SEQ ID NO: 23993 - DNA, 25 bp, Homo sapien
gcctttgagagtcagcgacgcctta

SEQ ID NO: 23994 - DNA, 25 bp, Homo sapien
gggccacctgttaatttgcacgaga

SEQ ID NO: 23995 - DNA, 25 bp, Homo sapien
tgcagtgacatcaggctcggacagc

SEQ ID NO: 23996 - DNA, 25 bp, Homo sapien
tcctcgcaaggtgatcggatacttc

SEQ ID NO: 23997 - DNA, 25 bp, Homo sapien
gccttagactcctcccagaaaaatg

SEQ ID NO: 23998 - DNA, 25 bp, Homo sapien
cgcggaacctgaagggcaaaactgc

SEQ ID NO: 23999 - DNA, 25 bp, Homo sapien
tggctgaaactttctcgggtgtgca

SEQ ID NO: 24000 - DNA, 25 bp, Homo sapien
ctgcaccctggcactacgaaaaagg

SEQ ID NO: 24001 - DNA, 25 bp, Homo sapien
gtttctgagacttgctgccggcctc

SEQ ID NO: 24002 - DNA, 25 bp, Homo sapien
tgtcaaaactcaggcgcgccgcaaa

SEQ ID NO: 24003 - DNA, 25 bp, Homo sapien
agaatctggcattccttcgctcagc

SEQ ID NO: 24004 - DNA, 25 bp, Homo sapien
gccgccgcccgaagtttggctgaaa

SEQ ID NO: 24005 - DNA, 25 bp, Homo sapien
tcctgcttcaaaggctcaggccctg

SEQ ID NO: 24006 - DNA, 25 bp, Homo sapien
gagtccataggacatggagagtccc

SEQ ID NO: 24007 - DNA, 25 bp, Homo sapien
aaagccgtcatcctggagccgggcg

SEQ ID NO: 24008 - DNA, 25 bp, Homo sapien
agccgccggggaaagccgtcatcct

SEQ ID NO: 24009 - DNA, 25 bp, Homo sapien
cgtgccacgtcgctcagattttgtg

SEQ ID NO: 24010 - DNA, 25 bp, Homo sapien
attgtacagcccagcctgtagaggc

SEQ ID NO: 24011 - DNA, 25 bp, Homo sapien
ggcggtgctaggtccacctcattta

SEQ ID NO: 24012 - DNA, 25 bp, Homo sapien
cgagtggcttcagcgagagtccata

SEQ ID NO: 24013 - DNA, 25 bp, Homo sapien
ctcatttacggggtcgggctctcat

SEQ ID NO: 24014 - DNA, 25 bp, Homo sapien
tcgaccggcggcaaggccccgagga

SEQ ID NO: 24015 - DNA, 25 bp, Homo sapien
tgttcgaagacacgaacctgtgcgc

SEQ ID NO: 24016 - DNA, 25 bp, Homo sapien
ggctgttcgaagacacgaacctgtg

SEQ ID NO: 24017 - DNA, 25 bp, Homo sapien
gtggggctgttcgaagacacgaacc

SEQ ID NO: 24018 - DNA, 25 bp, Homo sapien
cgaagacacgaacctgtgcgccatc

SEQ ID NO: 24019 - DNA, 25 bp, Homo sapien
ttcgaagacacgaacctgtgcgcca

SEQ ID NO: 24020 - DNA, 25 bp, Homo sapien
ggggctgttcgaagacacgaacctg

SEQ ID NO: 24021 - DNA, 25 bp, Homo sapien
ctgttcgaagacacgaacctgtgcg

SEQ ID NO: 24022 - DNA, 25 bp, Homo sapien
cataaccagcccgttttgcggtagt

SEQ ID NO: 24023 - DNA, 25 bp, Homo sapien
gcgaaatccgctcctgctcccaaga

SEQ ID NO: 24024 - DNA, 25 bp, Homo sapien
aatgccggatccagcgaaatccgct

SEQ ID NO: 24025 - DNA, 25 bp, Homo sapien
caaaaatgccggatccagcgaaatc

SEQ ID NO: 24026 - DNA, 25 bp, Homo sapien
ttcgcgcaaaaatgccggatccagc

SEQ ID NO: 24027 - DNA, 25 bp, Homo sapien
tttttcgcgcaaaaatgccggatcc

SEQ ID NO: 24028 - DNA, 25 bp, Homo sapien
tcttttttcgcgcaaaaatgccgga

SEQ ID NO: 24029 - DNA, 25 bp, Homo sapien
tgcggtagttcggattacttcttta

SEQ ID NO: 24030 - DNA, 25 bp, Homo sapien
gctgcaatatgcacatgcggccaca

SEQ ID NO: 24031 - DNA, 25 bp, Homo sapien
tggcggcagctgcaacctccacaga

SEQ ID NO: 24032 - DNA, 25 bp, Homo sapien
tccggctgctcttgcgacaagccaa

SEQ ID NO: 24033 - DNA, 25 bp, Homo sapien
gctcccttcctgcttttgacggtga

SEQ ID NO: 24034 - DNA, 25 bp, Homo sapien
ccttcttgcccgctggcttgctgat

SEQ ID NO: 24035 - DNA, 25 bp, Homo sapien
cgaacttccattctgccgccgggtt

SEQ ID NO: 24036 - DNA, 25 bp, Homo sapien
tgactcgggcgaatgggacacgaac

SEQ ID NO: 24037 - DNA, 25 bp, Homo sapien
tacagctcatttctcgctcctgcag

SEQ ID NO: 24038 - DNA, 25 bp, Homo sapien
agcagtctccacgagaactgaggcg

SEQ ID NO: 24039 - DNA, 25 bp, Homo sapien
cacgagaactgaggcggaccctctg

SEQ ID NO: 24040 - DNA, 25 bp, Homo sapien
tgcagccgggagtagcaccgcacat

SEQ ID NO: 24041 - DNA, 25 bp, Homo sapien
agtgtgcggagggattccggacacc

SEQ ID NO: 24042 - DNA, 25 bp, Homo sapien
gtctccacgagaactgaggcggacc

SEQ ID NO: 24043 - DNA, 25 bp, Homo sapien
ctgagctgaaccctggaactggtgc

SEQ ID NO: 24044 - DNA, 25 bp, Homo sapien
ccgggagtagcaccgcacatccggg

SEQ ID NO: 24045 - DNA, 25 bp, Homo sapien
cacctgagctgaaccctggaactgg

SEQ ID NO: 24046 - DNA, 25 bp, Homo sapien
cccttcctatatggcccagtggagt

SEQ ID NO: 24047 - DNA, 25 bp, Homo sapien
gtggagttagcagtgcttgtctctg

SEQ ID NO: 24048 - DNA, 25 bp, Homo sapien
cagtggagttagcagtgcttgtctc

SEQ ID NO: 24049 - DNA, 25 bp, Homo sapien
cccagtggagttagcagtgcttgtc

SEQ ID NO: 24050 - DNA, 25 bp, Homo sapien
tgcgcccttcctatatggcccagtg

SEQ ID NO: 24051 - DNA, 25 bp, Homo sapien
ttccactctcacctctcttcaaagg

SEQ ID NO: 24052 - DNA, 25 bp, Homo sapien
ggatgtctggttcacaactcccctg

SEQ ID NO: 24053 - DNA, 25 bp, Homo sapien
cgcccttcctatatggcccagtgga

SEQ ID NO: 24054 - DNA, 25 bp, Homo sapien
cgcaaggtcacttgcgtcacgcgca

SEQ ID NO: 24055 - DNA, 25 bp, Homo sapien
aaggtcacttgcgtcacgcgcatcc

SEQ ID NO: 24056 - DNA, 25 bp, Homo sapien
ggagccatcctagccctaacacaca

SEQ ID NO: 24057 - DNA, 25 bp, Homo sapien
taacacacagctgcgactctccggt

SEQ ID NO: 24058 - DNA, 25 bp, Homo sapien
gaagtgacttatgcctgtcccttct

SEQ ID NO: 24059 - DNA, 25 bp, Homo sapien
gtgacttatgcctgtcccttctttc

SEQ ID NO: 24060 - DNA, 25 bp, Homo sapien
tacacgcaaggtcacttgcgtcacg

SEQ ID NO: 24061 - DNA, 25 bp, Homo sapien
ctttacacgcaaggtcacttgcgtc

SEQ ID NO: 24062 - DNA, 25 bp, Homo sapien
aggaagcgaccctcgccggcaggac

SEQ ID NO: 24063 - DNA, 25 bp, Homo sapien
agcactttccggcagttggtacaga

SEQ ID NO: 24064 - DNA, 25 bp, Homo sapien
ctcagcctcctcaaggcgggatgtc

SEQ ID NO: 24065 - DNA, 25 bp, Homo sapien
cgactgcctgaaagctagcggcact

SEQ ID NO: 24066 - DNA, 25 bp, Homo sapien
tagcggcactgccagaggcgaccac

SEQ ID NO: 24067 - DNA, 25 bp, Homo sapien
ccaatgagcaacgagagcccgactg

SEQ ID NO: 24068 - DNA, 25 bp, Homo sapien
cgaggaagccttgaatctccgggca

SEQ ID NO: 24069 - DNA, 25 bp, Homo sapien
aagttaagtttatctccgaggctcg

SEQ ID NO: 24070 - DNA, 25 bp, Homo sapien
gcggcgccaggtcacacaacctgtt

SEQ ID NO: 24071 - DNA, 25 bp, Homo sapien
atgccggcggtcaagaaggagttcc

SEQ ID NO: 24072 - DNA, 25 bp, Homo sapien
tacgtgcgcaaactctgccagggca

SEQ ID NO: 24073 - DNA, 25 bp, Homo sapien
ctcggaaggtctctgcgaggctcct

SEQ ID NO: 24074 - DNA, 25 bp, Homo sapien
caacgagttccagttcgtcagcggc

SEQ ID NO: 24075 - DNA, 25 bp, Homo sapien
gccaaggactggaagcgcagcatcc

SEQ ID NO: 24076 - DNA, 25 bp, Homo sapien
aggcctcggtgaacacggacagatc

SEQ ID NO: 24077 - DNA, 25 bp, Homo sapien
acacaacctgttttggcgcctgcgg

SEQ ID NO: 24078 - DNA, 25 bp, Homo sapien
ttcgagcttttgtcttgggatccgg

SEQ ID NO: 24079 - DNA, 25 bp, Homo sapien
cggccttggtgcctgcagatagttt

SEQ ID NO: 24080 - DNA, 25 bp, Homo sapien
ggctgaattctccacgtcttatgta

SEQ ID NO: 24081 - DNA, 25 bp, Homo sapien
atgtatccaccctcatcttgcgagg

SEQ ID NO: 24082 - DNA, 25 bp, Homo sapien
gtcccggcttttggccacagacatc

SEQ ID NO: 24083 - DNA, 25 bp, Homo sapien
cgcatctttcatgtgggcacaccca

SEQ ID NO: 24084 - DNA, 25 bp, Homo sapien
gaaacagacgtttccctcgcgtggc

SEQ ID NO: 24085 - DNA, 25 bp, Homo sapien
ctgatccgtgtgtagcttgtcctct

SEQ ID NO: 24086 - DNA, 25 bp, Homo sapien
acgacgtcgatatccttctgaattc

SEQ ID NO: 24087 - DNA, 25 bp, Homo sapien
gctcgccgctgctggattccaattt

SEQ ID NO: 24088 - DNA, 25 bp, Homo sapien
ctggacttctggatcacgacgtcga

SEQ ID NO: 24089 - DNA, 25 bp, Homo sapien
tcagttaaaaatgaaacctctggcc

SEQ ID NO: 24090 - DNA, 25 bp, Homo sapien
tctctttgccagtcggaggggacta

SEQ ID NO: 24091 - DNA, 25 bp, Homo sapien
ggggctggaaataccacgcactgcc

SEQ ID NO: 24092 - DNA, 25 bp, Homo sapien
tgcagcagctgttgccaaatgaacc

SEQ ID NO: 24093 - DNA, 25 bp, Homo sapien
tctggaaaagcaagaactcacctgc

SEQ ID NO: 24094 - DNA, 25 bp, Homo sapien
cttcgccaggaaagatttctcgtgc

SEQ ID NO: 24095 - DNA, 25 bp, Homo sapien
ctagtccaggacttccggttggacg

SEQ ID NO: 24096 - DNA, 25 bp, Homo sapien
agctagtccaggacttccggttgga

SEQ ID NO: 24097 - DNA, 25 bp, Homo sapien
aggaaagatttctcgtgctgtggga

SEQ ID NO: 24098 - DNA, 25 bp, Homo sapien
tgctgcttcgccaggaaagatttct

SEQ ID NO: 24099 - DNA, 25 bp, Homo sapien
gatagggcgattcctatgcagagga

SEQ ID NO: 24100 - DNA, 25 bp, Homo sapien
cacagatagggcgattcctatgcag

SEQ ID NO: 24101 - DNA, 25 bp, Homo sapien
ctgtgggagctagtccaggacttcc

SEQ ID NO: 24102 - DNA, 25 bp, Homo sapien
ctgtctatccgctcggttactcctt

SEQ ID NO: 24103 - DNA, 25 bp, Homo sapien
ctgggtcgagctgcggctgtcgcaa

SEQ ID NO: 24104 - DNA, 25 bp, Homo sapien
gaggcggccatgtacctttaaggcc

SEQ ID NO: 24105 - DNA, 25 bp, Homo sapien
atccgctcggttactccttttcctg

SEQ ID NO: 24106 - DNA, 25 bp, Homo sapien
tgcactctgtctatccgctcggtta

SEQ ID NO: 24107 - DNA, 25 bp, Homo sapien
cggtctctgctgcactctgtctatc

SEQ ID NO: 24108 - DNA, 25 bp, Homo sapien
cagaggcggccatgtacctttaagg

SEQ ID NO: 24109 - DNA, 25 bp, Homo sapien
tgctgcactctgtctatccgctcgg

SEQ ID NO: 24110 - DNA, 25 bp, Homo sapien
agaaagcgcttcaatccgggcaata

SEQ ID NO: 24111 - DNA, 25 bp, Homo sapien
agccagccgctttcatctgctaaga

SEQ ID NO: 24112 - DNA, 25 bp, Homo sapien
cctcggggatggaggatcagatttc

SEQ ID NO: 24113 - DNA, 25 bp, Homo sapien
ctactgggtgaccactcaatggctc

SEQ ID NO: 24114 - DNA, 25 bp, Homo sapien
ctcgggcacagatcctgcaaatctc

SEQ ID NO: 24115 - DNA, 25 bp, Homo sapien
ggtttccacacagctctcgggcaca

SEQ ID NO: 24116 - DNA, 25 bp, Homo sapien
aacctggagattgagcttggacgcc

SEQ ID NO: 24117 - DNA, 25 bp, Homo sapien
ccgggcaataactgtgtcgaatcga

SEQ ID NO: 24118 - DNA, 25 bp, Homo sapien
acaaccagtgtgctggggcagaatc

SEQ ID NO: 24119 - DNA, 25 bp, Homo sapien
agagagcttagaggacgcggtacca

SEQ ID NO: 24120 - DNA, 25 bp, Homo sapien
ctctctcgctggctcagatgaatga

SEQ ID NO: 24121 - DNA, 25 bp, Homo sapien
accagctgagctgtcaaccgcgagc

SEQ ID NO: 24122 - DNA, 25 bp, Homo sapien
gcacgagttgctcggcaccagctga

SEQ ID NO: 24123 - DNA, 25 bp, Homo sapien
cacaagggagggactgttctcagta

SEQ ID NO: 24124 - DNA, 25 bp, Homo sapien
atggatttgacgtggccgaacctgc

SEQ ID NO: 24125 - DNA, 25 bp, Homo sapien
gagctctgctccctgcttttttaga

SEQ ID NO: 24126 - DNA, 25 bp, Homo sapien
ggttcccgatgctagacgcccgcaa

SEQ ID NO: 24127 - DNA, 25 bp, Homo sapien
ccaggtctcccgaaggggctagcaa

SEQ ID NO: 24128 - DNA, 25 bp, Homo sapien
ctagcaatgcgcgtccgagtcgaat

SEQ ID NO: 24129 - DNA, 25 bp, Homo sapien
tccgagtcgaatgcgggttcccgat

SEQ ID NO: 24130 - DNA, 25 bp, Homo sapien
tgctcccgagtgagaacaaaggccg

SEQ ID NO: 24131 - DNA, 25 bp, Homo sapien
aacctgattggtgcccggtcctcac

SEQ ID NO: 24132 - DNA, 25 bp, Homo sapien
ctgcggagagaaggcagacttgact

SEQ ID NO: 24133 - DNA, 25 bp, Homo sapien
cgcagagcgagaacctgattggtgc

SEQ ID NO: 24134 - DNA, 25 bp, Homo sapien
agcagccaaagtcgcatcggcggcg

SEQ ID NO: 24135 - DNA, 25 bp, Homo sapien
acagcagcagccaaagtcgcatcgg

SEQ ID NO: 24136 - DNA, 25 bp, Homo sapien
gaccggtaaggcgtgtagtgagccc

SEQ ID NO: 24137 - DNA, 25 bp, Homo sapien
ctcatccagggtgtggccgccgcag

SEQ ID NO: 24138 - DNA, 25 bp, Homo sapien
tggccatgctctcacctcatccagg

SEQ ID NO: 24139 - DNA, 25 bp, Homo sapien
cccatcgcgttcctcagcctcccgg

SEQ ID NO: 24140 - DNA, 25 bp, Homo sapien
tcaggcgtcgggatcttcagtccgg

SEQ ID NO: 24141 - DNA, 25 bp, Homo sapien
ccctctcaggcgtcgggatcttcag

SEQ ID NO: 24142 - DNA, 25 bp, Homo sapien
ggagacctttgtgacttcccgggca

SEQ ID NO: 24143 - DNA, 25 bp, Homo sapien
gacgcaagcagctggatctccggta

SEQ ID NO: 24144 - DNA, 25 bp, Homo sapien
ccgacctctctgaagtgcgctttta

SEQ ID NO: 24145 - DNA, 25 bp, Homo sapien
cgcgctttgccctcagcatcggatt

SEQ ID NO: 24146 - DNA, 25 bp, Homo sapien
tgagctgcttactcacgacccgcga

SEQ ID NO: 24147 - DNA, 25 bp, Homo sapien
gttgctaacaatgatcgcccgagtg

SEQ ID NO: 24148 - DNA, 25 bp, Homo sapien
gccagtgttggatccctgtagtttg

SEQ ID NO: 24149 - DNA, 25 bp, Homo sapien
tccggtaactgagacatagggtata

SEQ ID NO: 24150 - DNA, 25 bp, Homo sapien
acgctagcgcgggtcactggaacca

SEQ ID NO: 24151 - DNA, 25 bp, Homo sapien
tcactggaaccagggtgccgagatg

SEQ ID NO: 24152 - DNA, 25 bp, Homo sapien
cgccacgcggagacagttgcgaaga

SEQ ID NO: 24153 - DNA, 25 bp, Homo sapien
acttcatcatagaggcgggctcctg

SEQ ID NO: 24154 - DNA, 25 bp, Homo sapien
tgggcttgaacttcatcatagaggc

SEQ ID NO: 24155 - DNA, 25 bp, Homo sapien
agacagttgcgaagacccgctccca

SEQ ID NO: 24156 - DNA, 25 bp, Homo sapien
agttgtccgccgctctccatggagc

SEQ ID NO: 24157 - DNA, 25 bp, Homo sapien
tgccgagatgaaagctccgcctctg

SEQ ID NO: 24158 - DNA, 25 bp, Homo sapien
tcctttttcgtagtgccagggtgca

SEQ ID NO: 24159 - DNA, 25 bp, Homo sapien
ggcagttttgcccttcaggttccgc

SEQ ID NO: 24160 - DNA, 25 bp, Homo sapien
ggccggcagcaagtctcagaaactc

SEQ ID NO: 24161 - DNA, 25 bp, Homo sapien
gctgagcgaaggaatgccagattct

SEQ ID NO: 24162 - DNA, 25 bp, Homo sapien
cagggcctgagcctttgaagcagga

SEQ ID NO: 24163 - DNA, 25 bp, Homo sapien
tttcagccaaacttcgggcggcggc

SEQ ID NO: 24164 - DNA, 25 bp, Homo sapien
tgcacacccgagaaagtttcagcca

SEQ ID NO: 24165 - DNA, 25 bp, Homo sapien
gcggaaggacacacgaggctgcttc

SEQ ID NO: 24166 - DNA, 25 bp, Homo sapien
ccaggagcgagcgtttctgagcttt

SEQ ID NO: 24167 - DNA, 25 bp, Homo sapien
gggagcaaatggtcctcgtttctga

SEQ ID NO: 24168 - DNA, 25 bp, Homo sapien
ctcgtttctgagctgcgaggctctc

SEQ ID NO: 24169 - DNA, 25 bp, Homo sapien
ggctctcccagagaataagccattt

SEQ ID NO: 24170 - DNA, 25 bp, Homo sapien
gtttctgagctttgacggagcagca

SEQ ID NO: 24171 - DNA, 25 bp, Homo sapien
atgcttgtgtctctctcgggcgaga

SEQ ID NO: 24172 - DNA, 25 bp, Homo sapien
gcactcctgggcctcgaaggtgttt

SEQ ID NO: 24173 - DNA, 25 bp, Homo sapien
ataagccatttctccggggcactcc

SEQ ID NO: 24174 - DNA, 25 bp, Homo sapien
ggggcggagagtgcaataactcata

SEQ ID NO: 24175 - DNA, 25 bp, Homo sapien
gaaacttgactgtataatttgtggc

SEQ ID NO: 24176 - DNA, 25 bp, Homo sapien
gccattgttcgaagaagggtgccca

SEQ ID NO: 24177 - DNA, 25 bp, Homo sapien
agctggtcgccgaaagcttgctccg

SEQ ID NO: 24178 - DNA, 25 bp, Homo sapien
gcttgctccgcaatacaggctaagg

SEQ ID NO: 24179 - DNA, 25 bp, Homo sapien
acctggcaggagagataccctggtc

SEQ ID NO: 24180 - DNA, 25 bp, Homo sapien
gagagataccctggtcacgaaggtg

SEQ ID NO: 24181 - DNA, 25 bp, Homo sapien
tggtttttccagagcgagtcttatc

SEQ ID NO: 24182 - DNA, 25 bp, Homo sapien
cccggcggaaatgactgtgagctca

SEQ ID NO: 24183 - DNA, 25 bp, Homo sapien
gtgaggacaccacgggttctggtcc

SEQ ID NO: 24184 - DNA, 25 bp, Homo sapien
ccggcgacttttgagacggtgaaga

SEQ ID NO: 24185 - DNA, 25 bp, Homo sapien
aagctgcagttgtcgcctgtagagg

SEQ ID NO: 24186 - DNA, 25 bp, Homo sapien
cttccgccggagaagctgcagttgt

SEQ ID NO: 24187 - DNA, 25 bp, Homo sapien
aaagcgagtgacttccgccggagaa

SEQ ID NO: 24188 - DNA, 25 bp, Homo sapien
taagaatgggaaagcgagtgacttc

SEQ ID NO: 24189 - DNA, 25 bp, Homo sapien
tgactgtgagctcaaggtgtgaagc

SEQ ID NO: 24190 - DNA, 25 bp, Homo sapien
tcgaagacctgatgatccagcacaa

SEQ ID NO: 24191 - DNA, 25 bp, Homo sapien
gccctccgctcctatgcgctctgca

SEQ ID NO: 24192 - DNA, 25 bp, Homo sapien
ggacctcgccttccattcggcggta

SEQ ID NO: 24193 - DNA, 25 bp, Homo sapien
tccattcggcggtacatggcatcga

SEQ ID NO: 24194 - DNA, 25 bp, Homo sapien
cggggttcttgcattgcgcttcctt

SEQ ID NO: 24195 - DNA, 25 bp, Homo sapien
gttttcccggctgcatggtcgtccc

SEQ ID NO: 24196 - DNA, 25 bp, Homo sapien
gcggtacatggcatcgaagacctga

SEQ ID NO: 24197 - DNA, 25 bp, Homo sapien
cttgtgactatgaaggccggttttc

SEQ ID NO: 24198 - DNA, 25 bp, Homo sapien
gggtcacttatttccggtctcactc

SEQ ID NO: 24199 - DNA, 25 bp, Homo sapien
tcccggagctccctattggtgagtt

SEQ ID NO: 24200 - DNA, 25 bp, Homo sapien
ggtgagttttctcggccaatgcagg

SEQ ID NO: 24201 - DNA, 25 bp, Homo sapien
ggaagtccgccctcttgaagcctag

SEQ ID NO: 24202 - DNA, 25 bp, Homo sapien
ttgcagaatcagctggggtcactta

SEQ ID NO: 24203 - DNA, 25 bp, Homo sapien
accgagggaacgtgacactcatatc

SEQ ID NO: 24204 - DNA, 25 bp, Homo sapien
gccgcgaccaacttgaaatgtactg

SEQ ID NO: 24205 - DNA, 25 bp, Homo sapien
tcctcaagtcggtggcgttctaagc

SEQ ID NO: 24206 - DNA, 25 bp, Homo sapien
gacgtcacagcaccgaaggccctga

SEQ ID NO: 24207 - DNA, 25 bp, Homo sapien
tgccacactgctggacgcctgcaag

SEQ ID NO: 24208 - DNA, 25 bp, Homo sapien
ggcaccaagaagacccggcagtatc

SEQ ID NO: 24209 - DNA, 25 bp, Homo sapien
caaggcacgcatggtacgctacctc

SEQ ID NO: 24210 - DNA, 25 bp, Homo sapien
tacgcttggcccgtttgcttctgga

SEQ ID NO: 24211 - DNA, 25 bp, Homo sapien
tcgagcgcttgactgccgaattcaa

SEQ ID NO: 24212 - DNA, 25 bp, Homo sapien
tctgcacgtcgccttcggaaatcca

SEQ ID NO: 24213 - DNA, 25 bp, Homo sapien
caagggtacggaggtcatcatcatc

SEQ ID NO: 24214 - DNA, 25 bp, Homo sapien
cgcggagagaactctgttcccatgg

SEQ ID NO: 24215 - DNA, 25 bp, Homo sapien
tggcacacatccacgatgcagatgg

SEQ ID NO: 24216 - DNA, 25 bp, Homo sapien
ggttcatacgcagtgccatcctctg

SEQ ID NO: 24217 - DNA, 25 bp, Homo sapien
gtgccctcgggcactggttcatacg

SEQ ID NO: 24218 - DNA, 25 bp, Homo sapien
agccaggggctcaccttctctggtc

SEQ ID NO: 24219 - DNA, 25 bp, Homo sapien
aaacgcatctgcacccacgtggggc

SEQ ID NO: 24220 - DNA, 25 bp, Homo sapien
gctgccaagctcagaaacgcatctg

SEQ ID NO: 24221 - DNA, 25 bp, Homo sapien
atggcctcgagcagctgccaagctc

SEQ ID NO: 24222 - DNA, 25 bp, Homo sapien
tgcggtcgcggctatttctaacagc

SEQ ID NO: 24223 - DNA, 25 bp, Homo sapien
cctttctgtgtaagctgtgagcgta

SEQ ID NO: 24224 - DNA, 25 bp, Homo sapien
gaggcggattctctcctactacaga

SEQ ID NO: 24225 - DNA, 25 bp, Homo sapien
cgttacgcgctaccttgtgacgtca

SEQ ID NO: 24226 - DNA, 25 bp, Homo sapien
actcgcccacgcttcttactggagg

SEQ ID NO: 24227 - DNA, 25 bp, Homo sapien
cgtggagtgctttaacttcgccttc

SEQ ID NO: 24228 - DNA, 25 bp, Homo sapien
aggggtttccaagcccagcaccagc

SEQ ID NO: 24229 - DNA, 25 bp, Homo sapien
gaaaggctcgttctctgccgcaact

SEQ ID NO: 24230 - DNA, 25 bp, Homo sapien
cccacttgactgaaggttcggccct

SEQ ID NO: 24231 - DNA, 25 bp, Homo sapien
tgagtctgcgggtctggcctcctgc

SEQ ID NO: 24232 - DNA, 25 bp, Homo sapien
aggagcttcgccaagcacacgcagg

SEQ ID NO: 24233 - DNA, 25 bp, Homo sapien
tggagactatgcgagcgcagcggct

SEQ ID NO: 24234 - DNA, 25 bp, Homo sapien
gcgctactccattggcggccgggat

SEQ ID NO: 24235 - DNA, 25 bp, Homo sapien
gctccggggcgctactccattggcg

SEQ ID NO: 24236 - DNA, 25 bp, Homo sapien
ggaccgttagctcggcaggctggca

SEQ ID NO: 24237 - DNA, 25 bp, Homo sapien
ttgactgaaggttcggccctggcac

SEQ ID NO: 24238 - DNA, 25 bp, Homo sapien
cgacagtttcccgaggtacctagtg

SEQ ID NO: 24239 - DNA, 25 bp, Homo sapien
tcttgggtggattagagattccgcc

SEQ ID NO: 24240 - DNA, 25 bp, Homo sapien
gaaggtgcgagagaaggctataata

SEQ ID NO: 24241 - DNA, 25 bp, Homo sapien
ccctctgcgacagtttcccgaggta

SEQ ID NO: 24242 - DNA, 25 bp, Homo sapien
tcgtaaggatgggaatcgaggaacc

SEQ ID NO: 24243 - DNA, 25 bp, Homo sapien
tgaccgggaaggcactaagactgga

SEQ ID NO: 24244 - DNA, 25 bp, Homo sapien
ttcctcggtcgtaaggatgggaatc

SEQ ID NO: 24245 - DNA, 25 bp, Homo sapien
aggctataataggaaaatttactct

SEQ ID NO: 24246 - DNA, 25 bp, Homo sapien
tcaagaagggtcaactccggctacg

SEQ ID NO: 24247 - DNA, 25 bp, Homo sapien
gatactgtttgtccctcgcgaggca

SEQ ID NO: 24248 - DNA, 25 bp, Homo sapien
cccgcccttggtcatgaatatttaa

SEQ ID NO: 24249 - DNA, 25 bp, Homo sapien
agggccaagctttcttttctgatac

SEQ ID NO: 24250 - DNA, 25 bp, Homo sapien
tgaaattccgcttccagggccaagc

SEQ ID NO: 24251 - DNA, 25 bp, Homo sapien
agccgctgttgagatgattcctttc

SEQ ID NO: 24252 - DNA, 25 bp, Homo sapien
tgtgacgcagacacgcacagtaata

SEQ ID NO: 24253 - DNA, 25 bp, Homo sapien
tggaggctcaaaagacacgagtttc

SEQ ID NO: 24254 - DNA, 25 bp, Homo sapien
tcggaccacgagctgcactgtagtt

SEQ ID NO: 24255 - DNA, 25 bp, Homo sapien
tggaagacctctcgattttagttga

SEQ ID NO: 24256 - DNA, 25 bp, Homo sapien
gcgctcgcccatttcccgagttgga

SEQ ID NO: 24257 - DNA, 25 bp, Homo sapien
gaattactgaatgccgactccacgg

SEQ ID NO: 24258 - DNA, 25 bp, Homo sapien
gctgccgagtttgagtcctacgatc

SEQ ID NO: 24259 - DNA, 25 bp, Homo sapien
ggaccgaacttctgccgtgcggaca

SEQ ID NO: 24260 - DNA, 25 bp, Homo sapien
gagctctagcagttcccgatacttt

SEQ ID NO: 24261 - DNA, 25 bp, Homo sapien
tccacggcttccctaagacggatca

SEQ ID NO: 24262 - DNA, 25 bp, Homo sapien
cctgctcgagaggacaagccgtcct

SEQ ID NO: 24263 - DNA, 25 bp, Homo sapien
acgcgactctggagtcgctgcggcc

SEQ ID NO: 24264 - DNA, 25 bp, Homo sapien
acctcggccataacgcgactctgga

SEQ ID NO: 24265 - DNA, 25 bp, Homo sapien
ggaggccacacacactccgtgcgaa

SEQ ID NO: 24266 - DNA, 25 bp, Homo sapien
aatgggccacgtcccgagccctggt

SEQ ID NO: 24267 - DNA, 25 bp, Homo sapien
aagccgtcctcgcttcaagctgcag

SEQ ID NO: 24268 - DNA, 25 bp, Homo sapien
cccttctgccgacctggagcggaag

SEQ ID NO: 24269 - DNA, 25 bp, Homo sapien
caagctgcagtgaatgggccacgtc

SEQ ID NO: 24270 - DNA, 25 bp, Homo sapien
cccagctgtgcgtcagtccctcagc

SEQ ID NO: 24271 - DNA, 25 bp, Homo sapien
actgattgaactcgaaggatgtcca

SEQ ID NO: 24272 - DNA, 25 bp, Homo sapien
ccagttggcgcattttcagggtttc

SEQ ID NO: 24273 - DNA, 25 bp, Homo sapien
ttttcagggtttcccaggcgcactg

SEQ ID NO: 24274 - DNA, 25 bp, Homo sapien
cccaagctgtgcgtccttccctcag

SEQ ID NO: 24275 - DNA, 25 bp, Homo sapien
agctgcgcgtccgttcctcagctca

SEQ ID NO: 24276 - DNA, 25 bp, Homo sapien
tcattctctttactgattgaactcg

SEQ ID NO: 24277 - DNA, 25 bp, Homo sapien
aggatgtccagttggcgcattttca

SEQ ID NO: 24278 - DNA, 25 bp, Homo sapien
agtgccgccacgttcagacagcatt

SEQ ID NO: 24279 - DNA, 25 bp, Homo sapien
gtttcggacgtggtctcttggtcca

SEQ ID NO: 24280 - DNA, 25 bp, Homo sapien
acgtggtctcttggtccagtcagtg

SEQ ID NO: 24281 - DNA, 25 bp, Homo sapien
ggtccagtcagtgccgccacgttca

SEQ ID NO: 24282 - DNA, 25 bp, Homo sapien
gccacgttcagacagcattttccac

SEQ ID NO: 24283 - DNA, 25 bp, Homo sapien
acagcattttccactaacctcaggg

SEQ ID NO: 24284 - DNA, 25 bp, Homo sapien
taacctcagggtcagcgcaatccgg

SEQ ID NO: 24285 - DNA, 25 bp, Homo sapien
tctcttggtccagtcagtgccgcca

SEQ ID NO: 24286 - DNA, 25 bp, Homo sapien
atcggtctgccgaatacctgctgcc

SEQ ID NO: 24287 - DNA, 25 bp, Homo sapien
attgactcgcccgacatcggtctgc

SEQ ID NO: 24288 - DNA, 25 bp, Homo sapien
ggagctttctgcacatcattgactc

SEQ ID NO: 24289 - DNA, 25 bp, Homo sapien
cttgggaacctcatagattcctggc

SEQ ID NO: 24290 - DNA, 25 bp, Homo sapien
gagcgctgtgttctctatacttggg

SEQ ID NO: 24291 - DNA, 25 bp, Homo sapien
ccaaactaccggtaagagcgctgtg

SEQ ID NO: 24292 - DNA, 25 bp, Homo sapien
tgccacttttgcaagggcgaggtca

SEQ ID NO: 24293 - DNA, 25 bp, Homo sapien
tgtagccgcccaccggtttttctgc

SEQ ID NO: 24294 - DNA, 25 bp, Homo sapien
cttaaaacgttgtgagccccagcgc

SEQ ID NO: 24295 - DNA, 25 bp, Homo sapien
tgcccgtggagttggcatcctcatc

SEQ ID NO: 24296 - DNA, 25 bp, Homo sapien
tggcatcctcatctttgatggtccc

SEQ ID NO: 24297 - DNA, 25 bp, Homo sapien
tctctcaggcgacagctcacagacg

SEQ ID NO: 24298 - DNA, 25 bp, Homo sapien
acagctcacagacggcgggaaactc

SEQ ID NO: 24299 - DNA, 25 bp, Homo sapien
cacagacggcgggaaactcttccct

SEQ ID NO: 24300 - DNA, 25 bp, Homo sapien
attttccgggcccactacacgccag

SEQ ID NO: 24301 - DNA, 25 bp, Homo sapien
gtcgtgagaagtctgggaattttcc

SEQ ID NO: 24302 - DNA, 25 bp, Homo sapien
tagtgtctgccctccaacctgcggg

SEQ ID NO: 24303 - DNA, 25 bp, Homo sapien
cgggatccaagagccgccgttgcag

SEQ ID NO: 24304 - DNA, 25 bp, Homo sapien
ccgggatccaagagccgccgttgca

SEQ ID NO: 24305 - DNA, 25 bp, Homo sapien
tgcccgggatccaagagccgccgtt

SEQ ID NO: 24306 - DNA, 25 bp, Homo sapien
cacggttccacgctgggtggacgct

SEQ ID NO: 24307 - DNA, 25 bp, Homo sapien
tgccacggttccacgctgggtggac

SEQ ID NO: 24308 - DNA, 25 bp, Homo sapien
agagccgccgttgcaggcgggagtt

SEQ ID NO: 24309 - DNA, 25 bp, Homo sapien
agtgtctgccctccaacctgcgggg

SEQ ID NO: 24310 - DNA, 25 bp, Homo sapien
ttggggcaacaatccagcaggtccc

SEQ ID NO: 24311 - DNA, 25 bp, Homo sapien
tccggcgtagccttcagaaaccaga

SEQ ID NO: 24312 - DNA, 25 bp, Homo sapien
ggctgaagcagtcttcgcggctaca

SEQ ID NO: 24313 - DNA, 25 bp, Homo sapien
tgcgcagctcagacgccggcatcga

SEQ ID NO: 24314 - DNA, 25 bp, Homo sapien
aagactctcgcagctcgagctcttc

SEQ ID NO: 24315 - DNA, 25 bp, Homo sapien
tacctggacaaggagtccacgctgg

SEQ ID NO: 24316 - DNA, 25 bp, Homo sapien
ctgggcgtcctggttacctggacaa

SEQ ID NO: 24317 - DNA, 25 bp, Homo sapien
ccagaatccgcgaattggggcaaca

SEQ ID NO: 24318 - DNA, 25 bp, Homo sapien
tccgcctagcattggatgggcgctt

SEQ ID NO: 24319 - DNA, 25 bp, Homo sapien
ctctgcatggtgatgccggagcgag

SEQ ID NO: 24320 - DNA, 25 bp, Homo sapien
tggctccgcctagcattggatgggc

SEQ ID NO: 24321 - DNA, 25 bp, Homo sapien
ggtcgactgtccgtatgtcgcagtc

SEQ ID NO: 24322 - DNA, 25 bp, Homo sapien
aaagacggtggctccgcctagcatt

SEQ ID NO: 24323 - DNA, 25 bp, Homo sapien
tgcaaaagacggtggctccgcctag

SEQ ID NO: 24324 - DNA, 25 bp, Homo sapien
agcgagggtcgactgtccgtatgtc

SEQ ID NO: 24325 - DNA, 25 bp, Homo sapien
ctagcattggatgggcgcttgctct

SEQ ID NO: 24326 - DNA, 25 bp, Homo sapien
cgggttctcgcagtggcccggacca

SEQ ID NO: 24327 - DNA, 25 bp, Homo sapien
tgacgttcagaaactctgcgctgtg

SEQ ID NO: 24328 - DNA, 25 bp, Homo sapien
catccagtcgggatcagcgagcctg

SEQ ID NO: 24329 - DNA, 25 bp, Homo sapien
cacagggaaattgccgagtcatcca

SEQ ID NO: 24330 - DNA, 25 bp, Homo sapien
ttcagaaactctgcgctgtgggcct

SEQ ID NO: 24331 - DNA, 25 bp, Homo sapien
ttgccgagtcatccagtcgggatca

SEQ ID NO: 24332 - DNA, 25 bp, Homo sapien
tcctggcacccagcaatcggaggcc

SEQ ID NO: 24333 - DNA, 25 bp, Homo sapien
gctgtctgagcctcgcgatgtaccc

SEQ ID NO: 24334 - DNA, 25 bp, Homo sapien
ctcagtcgcattcggggcgctgcag

SEQ ID NO: 24335 - DNA, 25 bp, Homo sapien
ctgccttcttcggatcctgcgttcg

SEQ ID NO: 24336 - DNA, 25 bp, Homo sapien
ttcttcggatcctgcgttcggcacc

SEQ ID NO: 24337 - DNA, 25 bp, Homo sapien
tttacgaaacgtttattcagattga

SEQ ID NO: 24338 - DNA, 25 bp, Homo sapien
acgtttattcagattgatttctcgg

SEQ ID NO: 24339 - DNA, 25 bp, Homo sapien
ccggagagcggtagaccagacatct

SEQ ID NO: 24340 - DNA, 25 bp, Homo sapien
gacatctagacctgaaaggctcgtg

SEQ ID NO: 24341 - DNA, 25 bp, Homo sapien
cggtagaccagacatctagacctga

SEQ ID NO: 24342 - DNA, 25 bp, Homo sapien
tgggctcctgggatgcatcttcgcg

SEQ ID NO: 24343 - DNA, 25 bp, Homo sapien
taggacttgaattaatccatcgtcg

SEQ ID NO: 24344 - DNA, 25 bp, Homo sapien
cacgactaggacttgaattaatcca

SEQ ID NO: 24345 - DNA, 25 bp, Homo sapien
ctcctgggatgcatcttcgcgttct

SEQ ID NO: 24346 - DNA, 25 bp, Homo sapien
cgcgttgggatattctagagcacga

SEQ ID NO: 24347 - DNA, 25 bp, Homo sapien
ctgggatgcatcttcgcgttctttg

SEQ ID NO: 24348 - DNA, 25 bp, Homo sapien
gggatattctagagcacgaaggaca

SEQ ID NO: 24349 - DNA, 25 bp, Homo sapien
ctcgcgggaaacagggtatggcact

SEQ ID NO: 24350 - DNA, 25 bp, Homo sapien
cgtttattccgatggatttcctggc

SEQ ID NO: 24351 - DNA, 25 bp, Homo sapien
ccgatggatttcctggcatcccgtg

SEQ ID NO: 24352 - DNA, 25 bp, Homo sapien
cctggcatcccgtggggcggacaac

SEQ ID NO: 24353 - DNA, 25 bp, Homo sapien
tgaggcctccagtaaaccttctgcg

SEQ ID NO: 24354 - DNA, 25 bp, Homo sapien
cagtaaaccttctgcgcgatggagc

SEQ ID NO: 24355 - DNA, 25 bp, Homo sapien
aaccttctgcgcgatggagctgcgg

SEQ ID NO: 24356 - DNA, 25 bp, Homo sapien
tgggtccaacgggtaactgcaagga

SEQ ID NO: 24357 - DNA, 25 bp, Homo sapien
taactgcaaggaggagagcaaggaa

SEQ ID NO: 24358 - DNA, 25 bp, Homo sapien
cgacttccagtacagccagcgcgag

SEQ ID NO: 24359 - DNA, 25 bp, Homo sapien
ctcctgcatgtatgttcgctgcgtg

SEQ ID NO: 24360 - DNA, 25 bp, Homo sapien
gtctcctgcatgtatgttcgctgcg

SEQ ID NO: 24361 - DNA, 25 bp, Homo sapien
tccagtacagccagcgcgagctgga

SEQ ID NO: 24362 - DNA, 25 bp, Homo sapien
acttccagtacagccagcgcgagct

SEQ ID NO: 24363 - DNA, 25 bp, Homo sapien
ggccgcatcgctgccaagctcgcct

SEQ ID NO: 24364 - DNA, 25 bp, Homo sapien
gagacctgtggttgcgaggctccct

SEQ ID NO: 24365 - DNA, 25 bp, Homo sapien
ttccagtacagccagcgcgagctgg

SEQ ID NO: 24366 - DNA, 25 bp, Homo sapien
agtggcctgtcgcagctgcaccctg

SEQ ID NO: 24367 - DNA, 25 bp, Homo sapien
accctgcgtgggctcgtggctgcca

SEQ ID NO: 24368 - DNA, 25 bp, Homo sapien
tggggtgacttcacggctccactgt

SEQ ID NO: 24369 - DNA, 25 bp, Homo sapien
ggctccactgtcagcaagcggccgt

SEQ ID NO: 24370 - DNA, 25 bp, Homo sapien
cggccgtcccgtggtggatcctgtc

SEQ ID NO: 24371 - DNA, 25 bp, Homo sapien
tggtggatcctgtccgccctgcgag

SEQ ID NO: 24372 - DNA, 25 bp, Homo sapien
tgacaccatgaggatcatgtgagga

SEQ ID NO: 24373 - DNA, 25 bp, Homo sapien
cgaggccgtgacaccatgaggatca

SEQ ID NO: 24374 - DNA, 25 bp, Homo sapien
actcaatctcaataccaggaaaatg

SEQ ID NO: 24375 - DNA, 25 bp, Homo sapien
gtggggtaactggaatattccctgc

SEQ ID NO: 24376 - DNA, 25 bp, Homo sapien
ttttaactgacaagcatcagcaagg

SEQ ID NO: 24377 - DNA, 25 bp, Homo sapien
tggaagttgaaaccgcattgatata

SEQ ID NO: 24378 - DNA, 25 bp, Homo sapien
caggcacttcataaaagaggacata

SEQ ID NO: 24379 - DNA, 25 bp, Homo sapien
gcacctctacgagaataacaaaata

SEQ ID NO: 24380 - DNA, 25 bp, Homo sapien
gatatattactgcacctctacgaga

SEQ ID NO: 24381 - DNA, 25 bp, Homo sapien
catcagcaaggatgtggggtaactg

SEQ ID NO: 24382 - DNA, 25 bp, Homo sapien
acgcacaggagtcggaaggcagccc

SEQ ID NO: 24383 - DNA, 25 bp, Homo sapien
agttcccagaaagaacggcctcgag

SEQ ID NO: 24384 - DNA, 25 bp, Homo sapien
gcgaggaatcaagcgcagggaactt

SEQ ID NO: 24385 - DNA, 25 bp, Homo sapien
cagcaacttgcttgcggcccgctgg

SEQ ID NO: 24386 - DNA, 25 bp, Homo sapien
tgcctctaccgcacagcgggttcgg

SEQ ID NO: 24387 - DNA, 25 bp, Homo sapien
aagcccggagctacccagcgtttag

SEQ ID NO: 24388 - DNA, 25 bp, Homo sapien
cccagcgtttaggactgcaggcttc

SEQ ID NO: 24389 - DNA, 25 bp, Homo sapien
atagtctgacttccgggctcggccc

SEQ ID NO: 24390 - DNA, 25 bp, Homo sapien
cggagacagtcccacgcagaggtat

SEQ ID NO: 24391 - DNA, 25 bp, Homo sapien
aggtatgcccaaacaccgagttact

SEQ ID NO: 24392 - DNA, 25 bp, Homo sapien
atctatccgcgtagagatgaggggc

SEQ ID NO: 24393 - DNA, 25 bp, Homo sapien
aagcgtgtgggaatctatccgcgta

SEQ ID NO: 24394 - DNA, 25 bp, Homo sapien
tcagcggcccaaggaaaagggaagc

SEQ ID NO: 24395 - DNA, 25 bp, Homo sapien
ctatggagcgaggatcaagaaggtc

SEQ ID NO: 24396 - DNA, 25 bp, Homo sapien
ttaggccacgtctcactatggagcg

SEQ ID NO: 24397 - DNA, 25 bp, Homo sapien
ctgggctttccgctacgttaggcca

SEQ ID NO: 24398 - DNA, 25 bp, Homo sapien
tcataaaccattagcaccgggagcg

SEQ ID NO: 24399 - DNA, 25 bp, Homo sapien
ggtatagtctttctcacggctgctg

SEQ ID NO: 24400 - DNA, 25 bp, Homo sapien
ctctgtcgtaactttggggtgtggc

SEQ ID NO: 24401 - DNA, 25 bp, Homo sapien
gaagggtgccagtccttgactccta

SEQ ID NO: 24402 - DNA, 25 bp, Homo sapien
ttttctcttagtccgcgaggaggca

SEQ ID NO: 24403 - DNA, 25 bp, Homo sapien
gagctctgcaccgagaaaacaatta

SEQ ID NO: 24404 - DNA, 25 bp, Homo sapien
gaccctcaggccaagcttcgcgatg

SEQ ID NO: 24405 - DNA, 25 bp, Homo sapien
taggctcttcggctctctgtcgtaa

SEQ ID NO: 24406 - DNA, 25 bp, Homo sapien
agtttcccttgagacgctgcaaagc

SEQ ID NO: 24407 - DNA, 25 bp, Homo sapien
cgaagtggtcgagcgcccagatccc

SEQ ID NO: 24408 - DNA, 25 bp, Homo sapien
cgctgcaaagcgcatcgtccttgag

SEQ ID NO: 24409 - DNA, 25 bp, Homo sapien
atccgttgagatctagtttcccttg

SEQ ID NO: 24410 - DNA, 25 bp, Homo sapien
cagacttctggtatccgttgagatc

SEQ ID NO: 24411 - DNA, 25 bp, Homo sapien
gaagacgctccagacttctggtatc

SEQ ID NO: 24412 - DNA, 25 bp, Homo sapien
attcacaccgaagtggtcgagcgcc

SEQ ID NO: 24413 - DNA, 25 bp, Homo sapien
gatgagcggacggaagattcacacc

SEQ ID NO: 24414 - DNA, 25 bp, Homo sapien
gccgggaggagtcccaagctctggg

SEQ ID NO: 24415 - DNA, 25 bp, Homo sapien
gcttcagtcggaacaacaaggaagg

SEQ ID NO: 24416 - DNA, 25 bp, Homo sapien
ctgtctgttcgtgagcttcagtcgg

SEQ ID NO: 24417 - DNA, 25 bp, Homo sapien
gtctgttcgtgagcttcagtcggaa

SEQ ID NO: 24418 - DNA, 25 bp, Homo sapien
ttcgtgagcttcagtcggaacaaca

SEQ ID NO: 24419 - DNA, 25 bp, Homo sapien
gagcttcagtcggaacaacaaggaa

SEQ ID NO: 24420 - DNA, 25 bp, Homo sapien
cggaagggtctctagcggcgatatc

SEQ ID NO: 24421 - DNA, 25 bp, Homo sapien
gtgagcttcagtcggaacaacaagg

SEQ ID NO: 24422 - DNA, 25 bp, Homo sapien
tgaggaaacaatcacagctaaattg

SEQ ID NO: 24423 - DNA, 25 bp, Homo sapien
ctaaggaggagaaaaattcagattc

SEQ ID NO: 24424 - DNA, 25 bp, Homo sapien
ggaaccttagccctgcggtcaccgc

SEQ ID NO: 24425 - DNA, 25 bp, Homo sapien
tcaaaatgccaatctcggcctctgc

SEQ ID NO: 24426 - DNA, 25 bp, Homo sapien
tctggcctggattcttcaaaatgcc

SEQ ID NO: 24427 - DNA, 25 bp, Homo sapien
gaggaatattatctggcctggattc

SEQ ID NO: 24428 - DNA, 25 bp, Homo sapien
cacagctaaattgaggaatattatc

SEQ ID NO: 24429 - DNA, 25 bp, Homo sapien
aattcagattcgaaacatccctcct

SEQ ID NO: 24430 - DNA, 25 bp, Homo sapien
atggacagtcaactgtcgctcccgc

SEQ ID NO: 24431 - DNA, 25 bp, Homo sapien
cctagctcaactcggcttcggtcgg

SEQ ID NO: 24432 - DNA, 25 bp, Homo sapien
ctgacctccaaacttggaagcaagc

SEQ ID NO: 24433 - DNA, 25 bp, Homo sapien
cgacacacgaatggacagtcaactg

SEQ ID NO: 24434 - DNA, 25 bp, Homo sapien
ggtccgcgacttcccaaaggaagca

SEQ ID NO: 24435 - DNA, 25 bp, Homo sapien
gagcacgcgcccatccaacactagg

SEQ ID NO: 24436 - DNA, 25 bp, Homo sapien
tcacccgactttctacgccgcttgg

SEQ ID NO: 24437 - DNA, 25 bp, Homo sapien
cccgactgcgacacacgaatggaca

SEQ ID NO: 24438 - DNA, 25 bp, Homo sapien
aggcgcatctctaggtcggtggtca

SEQ ID NO: 24439 - DNA, 25 bp, Homo sapien
tcaggttctgcccggacgctgcaac

SEQ ID NO: 24440 - DNA, 25 bp, Homo sapien
aactggctccgggacttgtgtcctt

SEQ ID NO: 24441 - DNA, 25 bp, Homo sapien
gctccgggacttgtgtccttggtga

SEQ ID NO: 24442 - DNA, 25 bp, Homo sapien
tccgggacttgtgtccttggtgagc

SEQ ID NO: 24443 - DNA, 25 bp, Homo sapien
tccttggtgagcctagcggagtgct

SEQ ID NO: 24444 - DNA, 25 bp, Homo sapien
tgccgcttcacaaaggcgcatctct

SEQ ID NO: 24445 - DNA, 25 bp, Homo sapien
cccgctactgtctctccatgcgctg

SEQ ID NO: 24446 - DNA, 25 bp, Homo sapien
gggtaacgtgcttcttaggccttca

SEQ ID NO: 24447 - DNA, 25 bp, Homo sapien
ctcacctccgttcgcgggtaacgtg

SEQ ID NO: 24448 - DNA, 25 bp, Homo sapien
ccaggaccgctcgtttgtagactga

SEQ ID NO: 24449 - DNA, 25 bp, Homo sapien
acagcacgtggagcaggcacaaatg

SEQ ID NO: 24450 - DNA, 25 bp, Homo sapien
caggtgtgaaaatcactaggtcgtc

SEQ ID NO: 24451 - DNA, 25 bp, Homo sapien
agtcaaatcccgcaatgtctgtcta

SEQ ID NO: 24452 - DNA, 25 bp, Homo sapien
tctaccaagcaattgcgcacgtttc

SEQ ID NO: 24453 - DNA, 25 bp, Homo sapien
tgtgcgtgccacaaattatcagctg

SEQ ID NO: 24454 - DNA, 25 bp, Homo sapien
cagcgtccacagagtgtggaaccgc

SEQ ID NO: 24455 - DNA, 25 bp, Homo sapien
cagagtgtggaaccgccgcagccgc

SEQ ID NO: 24456 - DNA, 25 bp, Homo sapien
cacagagtgtggaaccgccgcagcc

SEQ ID NO: 24457 - DNA, 25 bp, Homo sapien
ctcgctggcgggcagcgtccacaga

SEQ ID NO: 24458 - DNA, 25 bp, Homo sapien
ctcactgaagctctcgaacagacag

SEQ ID NO: 24459 - DNA, 25 bp, Homo sapien
tctcactgaagctctcgaacagaca

SEQ ID NO: 24460 - DNA, 25 bp, Homo sapien
gtccacagagtgtggaaccgccgca

SEQ ID NO: 24461 - DNA, 25 bp, Homo sapien
ccacagagtgtggaaccgccgcagc

SEQ ID NO: 24462 - DNA, 25 bp, Homo sapien
atccatgcacgagagacctagcctc

SEQ ID NO: 24463 - DNA, 25 bp, Homo sapien
cgggagctacgccaaggttctcctg

SEQ ID NO: 24464 - DNA, 25 bp, Homo sapien
agaaagagctggtgcatgatgacga

SEQ ID NO: 24465 - DNA, 25 bp, Homo sapien
ccaaggttctcctggtgcggttgaa

SEQ ID NO: 24466 - DNA, 25 bp, Homo sapien
gcggttgaagaagaatgaccaaatt

SEQ ID NO: 24467 - DNA, 25 bp, Homo sapien
tgaccaaatttacgccatgaaagtg

SEQ ID NO: 24468 - DNA, 25 bp, Homo sapien
tgacgaggtaggtgccgcttctcat

SEQ ID NO: 24469 - DNA, 25 bp, Homo sapien
cgggctttagcggaattaatccatg

SEQ ID NO: 24470 - DNA, 25 bp, Homo sapien
gagctctgcgcgcttgaccacttcg

SEQ ID NO: 24471 - DNA, 25 bp, Homo sapien
cgcgcttgaccacttcggggtgaag

SEQ ID NO: 24472 - DNA, 25 bp, Homo sapien
ttcctggaagaaggtggccgaaggc

SEQ ID NO: 24473 - DNA, 25 bp, Homo sapien
ttgcagtgtctcaaccgagaccaga

SEQ ID NO: 24474 - DNA, 25 bp, Homo sapien
cgggaaatgctcctgcggaagctgg

SEQ ID NO: 24475 - DNA, 25 bp, Homo sapien
cgatgccctttgcagtgtctcaacc

SEQ ID NO: 24476 - DNA, 25 bp, Homo sapien
ccatccttccttcgaggggccttgg

SEQ ID NO: 24477 - DNA, 25 bp, Homo sapien
cggggtgaagcttccgtccgcccat

SEQ ID NO: 24478 - DNA, 25 bp, Homo sapien
ccctcgaggcctcctagccctgata

SEQ ID NO: 24479 - DNA, 25 bp, Homo sapien
ccagtcagcttttccatcccaccct

SEQ ID NO: 24480 - DNA, 25 bp, Homo sapien
agccgaacaacatgctgccacagcc

SEQ ID NO: 24481 - DNA, 25 bp, Homo sapien
cgggagaagtgacgtttgcctctcc

SEQ ID NO: 24482 - DNA, 25 bp, Homo sapien
cgaacaacatgctgccacagcctgc

SEQ ID NO: 24483 - DNA, 25 bp, Homo sapien
cctgcgggagaagtgacgtttgcct

SEQ ID NO: 24484 - DNA, 25 bp, Homo sapien
tcgaggcctcctagccctgatacac

SEQ ID NO: 24485 - DNA, 25 bp, Homo sapien
tgcgggagaagtgacgtttgcctct

SEQ ID NO: 24486 - DNA, 25 bp, Homo sapien
agaggatgcgttacctgggtcccgt

SEQ ID NO: 24487 - DNA, 25 bp, Homo sapien
cccgggaggacacagccagtcagag

SEQ ID NO: 24488 - DNA, 25 bp, Homo sapien
ggcgccgcacctacttcccaatata

SEQ ID NO: 24489 - DNA, 25 bp, Homo sapien
tcccaatataaccaactacggcgtg

SEQ ID NO: 24490 - DNA, 25 bp, Homo sapien
ggcggcagccaaagtgccattaaag

SEQ ID NO: 24491 - DNA, 25 bp, Homo sapien
cgcgcggacgcattggaggaaaaca

SEQ ID NO: 24492 - DNA, 25 bp, Homo sapien
cgttacctgggtcccgtctgctgcg

SEQ ID NO: 24493 - DNA, 25 bp, Homo sapien
aagtgccattaaagctcggggcgga

SEQ ID NO: 24494 - DNA, 25 bp, Homo sapien
gcatgggacgcttaccttggagtca

SEQ ID NO: 24495 - DNA, 25 bp, Homo sapien
agtactgacaccaactgcgggcatg

SEQ ID NO: 24496 - DNA, 25 bp, Homo sapien
ggcctgcgggaacgcctgcaaatac

SEQ ID NO: 24497 - DNA, 25 bp, Homo sapien
tggccctagctcaggaaacccgcta

SEQ ID NO: 24498 - DNA, 25 bp, Homo sapien
gcgaccagcgattcctcctaaaatg

SEQ ID NO: 24499 - DNA, 25 bp, Homo sapien
tggcctctgagactacccggcagaa

SEQ ID NO: 24500 - DNA, 25 bp, Homo sapien
gccagcacgttttctgggcagcatc

SEQ ID NO: 24501 - DNA, 25 bp, Homo sapien
gcccagaaatcaacccgctgcagta

SEQ ID NO: 24502 - DNA, 25 bp, Homo sapien
tagtcccattagcaaaggctgattg

SEQ ID NO: 24503 - DNA, 25 bp, Homo sapien
ggaccctgaatctgatcctggaaca

SEQ ID NO: 24504 - DNA, 25 bp, Homo sapien
ttgctcctgagtatgaagctgcagc

SEQ ID NO: 24505 - DNA, 25 bp, Homo sapien
ctggtgtggacactgcaagagactt

SEQ ID NO: 24506 - DNA, 25 bp, Homo sapien
agctgcagctaccagattaaaagga

SEQ ID NO: 24507 - DNA, 25 bp, Homo sapien
tggagtcagtggatatccaaccctg

SEQ ID NO: 24508 - DNA, 25 bp, Homo sapien
tgcactgccaacactaacacctgta

SEQ ID NO: 24509 - DNA, 25 bp, Homo sapien
ctaggactcagggacgacaacttgg

SEQ ID NO: 24510 - DNA, 25 bp, Homo sapien
caacctattgggactgcctcttgcg

SEQ ID NO: 24511 - DNA, 25 bp, Homo sapien
ctagcccttacggagagtctgcaaa

SEQ ID NO: 24512 - DNA, 25 bp, Homo sapien
aattctccggatcgagttacgtgcg

SEQ ID NO: 24513 - DNA, 25 bp, Homo sapien
tgcgcgcgcagttattggagaattc

SEQ ID NO: 24514 - DNA, 25 bp, Homo sapien
ctggtgcaccaaggatgtaggtttc

SEQ ID NO: 24515 - DNA, 25 bp, Homo sapien
cgcctggcttcttactgcggcttca

SEQ ID NO: 24516 - DNA, 25 bp, Homo sapien
ctccgctccggatatcttggcagga

SEQ ID NO: 24517 - DNA, 25 bp, Homo sapien
cttctccgtttactgtgcgcgcgca

SEQ ID NO: 24518 - DNA, 25 bp, Homo sapien
cgggcgtgcctatgcaaaccaggag

SEQ ID NO: 24519 - DNA, 25 bp, Homo sapien
gtgcctatgcaaaccaggaggtggt

SEQ ID NO: 24520 - DNA, 25 bp, Homo sapien
agcgactttccctgaaggggcacga

SEQ ID NO: 24521 - DNA, 25 bp, Homo sapien
actttccctgaaggggcacgagcga

SEQ ID NO: 24522 - DNA, 25 bp, Homo sapien
tgaaggggcacgagcgactttccct

SEQ ID NO: 24523 - DNA, 25 bp, Homo sapien
ccggctgtacctttcgtggcgcggt

SEQ ID NO: 24524 - DNA, 25 bp, Homo sapien
gttggggactagagctctgccgctt

SEQ ID NO: 24525 - DNA, 25 bp, Homo sapien
ccctggcgggcgtgcctatgcaaac

SEQ ID NO: 24526 - DNA, 25 bp, Homo sapien
gtgacacctcgcctggagactcaga

SEQ ID NO: 24527 - DNA, 25 bp, Homo sapien
ccagtgatcatggtggtaggccctc

SEQ ID NO: 24528 - DNA, 25 bp, Homo sapien
ctgcaggaggcaaacacaagtcttc

SEQ ID NO: 24529 - DNA, 25 bp, Homo sapien
tgcccgacgaggaacattaaacttg

SEQ ID NO: 24530 - DNA, 25 bp, Homo sapien
agtttggcctccagcactcttgaag

SEQ ID NO: 24531 - DNA, 25 bp, Homo sapien
ggctccaccagcaaggactactcga

SEQ ID NO: 24532 - DNA, 25 bp, Homo sapien
aaaacgagtcctgtggtgacacctc

SEQ ID NO: 24533 - DNA, 25 bp, Homo sapien
ctggggtccacaagcgcatgctgaa

SEQ ID NO: 24534 - DNA, 25 bp, Homo sapien
tctgctacgacgaggcctttcccat

SEQ ID NO: 24535 - DNA, 25 bp, Homo sapien
cgtgcttttcatcttccggatcctc

SEQ ID NO: 24536 - DNA, 25 bp, Homo sapien
gaccagggcagcgtcaagaagagca

SEQ ID NO: 24537 - DNA, 25 bp, Homo sapien
catggaggagaagcgcaaaagccgc

SEQ ID NO: 24538 - DNA, 25 bp, Homo sapien
cccgtccctgatgtacgtggggcac

SEQ ID NO: 24539 - DNA, 25 bp, Homo sapien
gagcaatccgacttcgtgtgcaaca

SEQ ID NO: 24540 - DNA, 25 bp, Homo sapien
cagagtctggctcaccgtgcttttc

SEQ ID NO: 24541 - DNA, 25 bp, Homo sapien
ggcacgcggtgcactacgtccgcat

SEQ ID NO: 24542 - DNA, 25 bp, Homo sapien
gagccttccttacacttcgccatga

SEQ ID NO: 24543 - DNA, 25 bp, Homo sapien
gccatgagtttcctgatcgactcca

SEQ ID NO: 24544 - DNA, 25 bp, Homo sapien
cagcatcatgattacctcccaggtg

SEQ ID NO: 24545 - DNA, 25 bp, Homo sapien
tgcagcacctgggagaaggcagacc

SEQ ID NO: 24546 - DNA, 25 bp, Homo sapien
tccacttttggaagcggtccgccga

SEQ ID NO: 24547 - DNA, 25 bp, Homo sapien
ggctgcgccaactgatcctggactg

SEQ ID NO: 24548 - DNA, 25 bp, Homo sapien
tgcattgctgcttttagcaccgccc

SEQ ID NO: 24549 - DNA, 25 bp, Homo sapien
cgttaacgctaccttgcattgctgc

SEQ ID NO: 24550 - DNA, 25 bp, Homo sapien
acgcgtgattgaccctttaactgta

SEQ ID NO: 24551 - DNA, 25 bp, Homo sapien
tttccacggaaacagaactcgatgc

SEQ ID NO: 24552 - DNA, 25 bp, Homo sapien
ttaaccaccgcatatgcatgccagg

SEQ ID NO: 24553 - DNA, 25 bp, Homo sapien
gatgcactgacctgctccgccagga

SEQ ID NO: 24554 - DNA, 25 bp, Homo sapien
tccgccaggaaagtgagcgtgtagc

SEQ ID NO: 24555 - DNA, 25 bp, Homo sapien
tctctgtcgtggacacgcgtgattg

SEQ ID NO: 24556 - DNA, 25 bp, Homo sapien
gctgctgggagcagaacagtccctc

SEQ ID NO: 24557 - DNA, 25 bp, Homo sapien
tgcggtttccaaggtgcacattttc

SEQ ID NO: 24558 - DNA, 25 bp, Homo sapien
aactgccggaagtgtctgcgcgccg

SEQ ID NO: 24559 - DNA, 25 bp, Homo sapien
gatgcgtccagatgacaacaacctg

SEQ ID NO: 24560 - DNA, 25 bp, Homo sapien
cgcgttccgaacgacgatgcgtcca

SEQ ID NO: 24561 - DNA, 25 bp, Homo sapien
cgcgccgtgagagaaactttcctgc

SEQ ID NO: 24562 - DNA, 25 bp, Homo sapien
acgccgacgactgtcaagagagttg

SEQ ID NO: 24563 - DNA, 25 bp, Homo sapien
ggtgcgatttgcaagcgctctgagc

SEQ ID NO: 24564 - DNA, 25 bp, Homo sapien
gagaaactttcctgctccggccgcg

SEQ ID NO: 24565 - DNA, 25 bp, Homo sapien
tgtgcgctgcttctggctcacaacg

SEQ ID NO: 24566 - DNA, 25 bp, Homo sapien
ccgagaagtcaacctgaataaacgc

SEQ ID NO: 24567 - DNA, 25 bp, Homo sapien
tgcagtgtgaccagcgcgactcacc

SEQ ID NO: 24568 - DNA, 25 bp, Homo sapien
atccgggtagctcacccggcgttca

SEQ ID NO: 24569 - DNA, 25 bp, Homo sapien
accggaagagccatccgggtagctc

SEQ ID NO: 24570 - DNA, 25 bp, Homo sapien
tggaccctccgtgcgggacacagca

SEQ ID NO: 24571 - DNA, 25 bp, Homo sapien
cgctcttcagaggactaaaagataa

SEQ ID NO: 24572 - DNA, 25 bp, Homo sapien
caacgctcttcagaggactaaaaga

SEQ ID NO: 24573 - DNA, 25 bp, Homo sapien
gtcaacctgaataaacgccttgtaa

SEQ ID NO: 24574 - DNA, 25 bp, Homo sapien
gacaggctctggtagcatgttagtc

SEQ ID NO: 24575 - DNA, 25 bp, Homo sapien
ccaacatgttttagtctgcgcatta

SEQ ID NO: 24576 - DNA, 25 bp, Homo sapien
gtctgcgcattacaaaccattattt

SEQ ID NO: 24577 - DNA, 25 bp, Homo sapien
ggaggtgtgcaaatccgtagttacc

SEQ ID NO: 24578 - DNA, 25 bp, Homo sapien
ttacctgggagggaagatagtattg

SEQ ID NO: 24579 - DNA, 25 bp, Homo sapien
tgaagatcgtttttccagagtgagg

SEQ ID NO: 24580 - DNA, 25 bp, Homo sapien
ctattgtgtgtactgatccttgcga

SEQ ID NO: 24581 - DNA, 25 bp, Homo sapien
tccttgcgattttcctaaatgtagg

SEQ ID NO: 24582 - DNA, 25 bp, Homo sapien
tggtccgggccactgtgataactcg

SEQ ID NO: 24583 - DNA, 25 bp, Homo sapien
gcctccgattgcacggggctaggag

SEQ ID NO: 24584 - DNA, 25 bp, Homo sapien
gcaggctcggtgatcccaacaggat

SEQ ID NO: 24585 - DNA, 25 bp, Homo sapien
cccaacaggatgattcagcaatttc

SEQ ID NO: 24586 - DNA, 25 bp, Homo sapien
acgaagagggtgacatcgcgaggct

SEQ ID NO: 24587 - DNA, 25 bp, Homo sapien
cgggccactgtgataactcggtttc

SEQ ID NO: 24588 - DNA, 25 bp, Homo sapien
tgtgataactcggtttctgggaccc

SEQ ID NO: 24589 - DNA, 25 bp, Homo sapien
ctcggtgatcccaacaggatgattc

SEQ ID NO: 24590 - DNA, 25 bp, Homo sapien
ggcgtcagacccagcatcccaggaa

SEQ ID NO: 24591 - DNA, 25 bp, Homo sapien
ccgattctctactgctgcttgcgct

SEQ ID NO: 24592 - DNA, 25 bp, Homo sapien
ccgccttcacccgattctctactgc

SEQ ID NO: 24593 - DNA, 25 bp, Homo sapien
gattctctactgctgcttgcgctcc

SEQ ID NO: 24594 - DNA, 25 bp, Homo sapien
ggcctgagccgcgtgggtcccaggg

SEQ ID NO: 24595 - DNA, 25 bp, Homo sapien
gcgtcagacccagcatcccaggaaa

SEQ ID NO: 24596 - DNA, 25 bp, Homo sapien
aggcgtcagacccagcatcccagga

SEQ ID NO: 24597 - DNA, 25 bp, Homo sapien
cgattctctactgctgcttgcgctc

SEQ ID NO: 24598 - DNA, 25 bp, Homo sapien
atgtgccggcaagatgtgcctctca

SEQ ID NO: 24599 - DNA, 25 bp, Homo sapien
tgcacggcaagatgtgccggcaaga

SEQ ID NO: 24600 - DNA, 25 bp, Homo sapien
tgccggcaagatgtgcctctcaggt

SEQ ID NO: 24601 - DNA, 25 bp, Homo sapien
ctacaaaaggcagtagctccgccga

SEQ ID NO: 24602 - DNA, 25 bp, Homo sapien
caaaaggcagtagctccgccgaacg

SEQ ID NO: 24603 - DNA, 25 bp, Homo sapien
aaggcagtagctccgccgaacgttg

SEQ ID NO: 24604 - DNA, 25 bp, Homo sapien
agtagctccgccgaacgttggatcg

SEQ ID NO: 24605 - DNA, 25 bp, Homo sapien
tcacccaatgcacggcaagatgtgc

SEQ ID NO: 24606 - DNA, 25 bp, Homo sapien
ccgggctacaggatccggattcttc

SEQ ID NO: 24607 - DNA, 25 bp, Homo sapien
ccacgaaaatgttaggcgccgcctt

SEQ ID NO: 24608 - DNA, 25 bp, Homo sapien
caactgcgtattgctgcctgtgaca

SEQ ID NO: 24609 - DNA, 25 bp, Homo sapien
ttcgactgcatctggacattcccgc

SEQ ID NO: 24610 - DNA, 25 bp, Homo sapien
tgcgatccctcaggtaagaagactg

SEQ ID NO: 24611 - DNA, 25 bp, Homo sapien
ctgctgatcgcaataggcccggtct

SEQ ID NO: 24612 - DNA, 25 bp, Homo sapien
gcttgctcccgaaatgaagacactg

SEQ ID NO: 24613 - DNA, 25 bp, Homo sapien
gattcgcctggctaacactctccgg

SEQ ID NO: 24614 - DNA, 25 bp, Homo sapien
gagtcgcgctgatcacgttgcacac

SEQ ID NO: 24615 - DNA, 25 bp, Homo sapien
gactcgtcgagtgaatccattgtcg

SEQ ID NO: 24616 - DNA, 25 bp, Homo sapien
gcgcaggactaagactcgtcgagtg

SEQ ID NO: 24617 - DNA, 25 bp, Homo sapien
tgagagttcctcgtggtcccctcgc

SEQ ID NO: 24618 - DNA, 25 bp, Homo sapien
cggatcctgtgtccgcaggcgggct

SEQ ID NO: 24619 - DNA, 25 bp, Homo sapien
cccagtctgcgacccgggcccgagc

SEQ ID NO: 24620 - DNA, 25 bp, Homo sapien
ctgatcacgttgcacacccgcgggt

SEQ ID NO: 24621 - DNA, 25 bp, Homo sapien
tcacgttgcacacccgcgggttggg

SEQ ID NO: 24622 - DNA, 25 bp, Homo sapien
tgctcagcttgagaacgcgctcatc

SEQ ID NO: 24623 - DNA, 25 bp, Homo sapien
cacgtcttctgtgctttcggccaag

SEQ ID NO: 24624 - DNA, 25 bp, Homo sapien
tgtttccacaccgtgcccgtgagga

SEQ ID NO: 24625 - DNA, 25 bp, Homo sapien
ctgtgtctcaacaagcctctctatg

SEQ ID NO: 24626 - DNA, 25 bp, Homo sapien
cctctctatgggattctggcgcctg

SEQ ID NO: 24627 - DNA, 25 bp, Homo sapien
tgtgcagctcacgtcagagaattgg

SEQ ID NO: 24628 - DNA, 25 bp, Homo sapien
gatggcgctcaccacgtcacgtctt

SEQ ID NO: 24629 - DNA, 25 bp, Homo sapien
ctcaccacggagaaggacgccgtca

SEQ ID NO: 24630 - DNA, 25 bp, Homo sapien
tcagcactgtgacattgaccgcttc

SEQ ID NO: 24631 - DNA, 25 bp, Homo sapien
ggctgccatttctacgcagtgtgca

SEQ ID NO: 24632 - DNA, 25 bp, Homo sapien
tctacgcagtgtgcaatcagcactg

SEQ ID NO: 24633 - DNA, 25 bp, Homo sapien
tggctgtgacaatgccatccctctc

SEQ ID NO: 24634 - DNA, 25 bp, Homo sapien
aatgccatccctctccggcaggtgg

SEQ ID NO: 24635 - DNA, 25 bp, Homo sapien
tcccgtgctgcgtgcacacggtctg

SEQ ID NO: 24636 - DNA, 25 bp, Homo sapien
gaccgagccggctgccatttctacg

SEQ ID NO: 24637 - DNA, 25 bp, Homo sapien
cattgaccgcttccagggcgcctgt

SEQ ID NO: 24638 - DNA, 25 bp, Homo sapien
gtttccgtcttgctactgctccaca

SEQ ID NO: 24639 - DNA, 25 bp, Homo sapien
ttcaggtctgaacagcggtcctgga

SEQ ID NO: 24640 - DNA, 25 bp, Homo sapien
ctttcaggtctgaacagcggtcctg

SEQ ID NO: 24641 - DNA, 25 bp, Homo sapien
cagctgggactttcaggtctgaaca

SEQ ID NO: 24642 - DNA, 25 bp, Homo sapien
cacagctgggactttcaggtctgaa

SEQ ID NO: 24643 - DNA, 25 bp, Homo sapien
cacgcctcaccctttttacacacgg

SEQ ID NO: 24644 - DNA, 25 bp, Homo sapien
ccttcgtagcgaagcagccggtggc

SEQ ID NO: 24645 - DNA, 25 bp, Homo sapien
tcttgctactgctccacacgcctca

SEQ ID NO: 24646 - DNA, 25 bp, Homo sapien
ggaaatctcgtaatcgcatccattg

SEQ ID NO: 24647 - DNA, 25 bp, Homo sapien
cgtaatcgcatccattgtctttttg

SEQ ID NO: 24648 - DNA, 25 bp, Homo sapien
actcgggaaatctcgtaatcgcatc

SEQ ID NO: 24649 - DNA, 25 bp, Homo sapien
ctttcactcgggaaatctcgtaatc

SEQ ID NO: 24650 - DNA, 25 bp, Homo sapien
tcctacactaaaagggctgcggccc

SEQ ID NO: 24651 - DNA, 25 bp, Homo sapien
tttcctacactaaaagggctgcggc

SEQ ID NO: 24652 - DNA, 25 bp, Homo sapien
tcggggtgagaggtttcctacacta

SEQ ID NO: 24653 - DNA, 25 bp, Homo sapien
cgcagccagcgtcccagcaaccgaa

SEQ ID NO: 24654 - DNA, 25 bp, Homo sapien
gatgcctcatctacacaggaatcgc

SEQ ID NO: 24655 - DNA, 25 bp, Homo sapien
acgcacggtcacttcccacgcgcaa

SEQ ID NO: 24656 - DNA, 25 bp, Homo sapien
ccctgagatgcctcatctacacagg

SEQ ID NO: 24657 - DNA, 25 bp, Homo sapien
aggagaaatcctccgtggcgaagca

SEQ ID NO: 24658 - DNA, 25 bp, Homo sapien
cgacagcacctttcccggtccggct

SEQ ID NO: 24659 - DNA, 25 bp, Homo sapien
cgtccaaccggcggtcctggacttg

SEQ ID NO: 24660 - DNA, 25 bp, Homo sapien
agccgatgaacccgctgcgggagcc

SEQ ID NO: 24661 - DNA, 25 bp, Homo sapien
tctgccacctcagccgatgaacccg

SEQ ID NO: 24662 - DNA, 25 bp, Homo sapien
tgcaggacacagatcaagtaccaca

SEQ ID NO: 24663 - DNA, 25 bp, Homo sapien
ggagaaagagacagacgtcacttcc

SEQ ID NO: 24664 - DNA, 25 bp, Homo sapien
ttctctgcaggacacagatcaagta

SEQ ID NO: 24665 - DNA, 25 bp, Homo sapien
agaagggttctctgcaggacacaga

SEQ ID NO: 24666 - DNA, 25 bp, Homo sapien
agatcaagtaccacagtcttagggg

SEQ ID NO: 24667 - DNA, 25 bp, Homo sapien
accacagtcttagggggagaccaga

SEQ ID NO: 24668 - DNA, 25 bp, Homo sapien
ggacacagatcaagtaccacagtct

SEQ ID NO: 24669 - DNA, 25 bp, Homo sapien
agggttctctgcaggacacagatca

SEQ ID NO: 24670 - DNA, 25 bp, Homo sapien
cccttccctgtgacttgaagagaag

SEQ ID NO: 24671 - DNA, 25 bp, Homo sapien
tccctgtgacttgaagagaagcttc

SEQ ID NO: 24672 - DNA, 25 bp, Homo sapien
agagaagcttcagggggcgtttatt

SEQ ID NO: 24673 - DNA, 25 bp, Homo sapien
ggggcgtttattcaatttgcgagga

SEQ ID NO: 24674 - DNA, 25 bp, Homo sapien
tattcaatttgcgaggagcccgcga

SEQ ID NO: 24675 - DNA, 25 bp, Homo sapien
cgcccgtttaggtcctgcgcaggag

SEQ ID NO: 24676 - DNA, 25 bp, Homo sapien
taacgttccgggtgagctagggctc

SEQ ID NO: 24677 - DNA, 25 bp, Homo sapien
accgcccgtttaggtcctgcgcagg

SEQ ID NO: 24678 - DNA, 25 bp, Homo sapien
ggagtcctaagccactaatttgtga

SEQ ID NO: 24679 - DNA, 25 bp, Homo sapien
acacagagggtcatgcggatgttgc

SEQ ID NO: 24680 - DNA, 25 bp, Homo sapien
ggtcatgcggatgttgctcctccaa

SEQ ID NO: 24681 - DNA, 25 bp, Homo sapien
gcggatgttgctcctccaaggattt

SEQ ID NO: 24682 - DNA, 25 bp, Homo sapien
gactaaaagctaaaaggatggattc

SEQ ID NO: 24683 - DNA, 25 bp, Homo sapien
gagcttttaaagtattcatgcattg

SEQ ID NO: 24684 - DNA, 25 bp, Homo sapien
ttcctggagtcctaagccactaatt

SEQ ID NO: 24685 - DNA, 25 bp, Homo sapien
taagccactaatttgtgacttatcc

SEQ ID NO: 24686 - DNA, 25 bp, Homo sapien
ggatgaaatccatcaccgtggtggc

SEQ ID NO: 24687 - DNA, 25 bp, Homo sapien
cctccgctttgtacaggatgcactc

SEQ ID NO: 24688 - DNA, 25 bp, Homo sapien
cctttatctttagagcgggcggctg

SEQ ID NO: 24689 - DNA, 25 bp, Homo sapien
cgggctgccaataaggcgtgattga

SEQ ID NO: 24690 - DNA, 25 bp, Homo sapien
gagcccgaggtttgcccttcagaag

SEQ ID NO: 24691 - DNA, 25 bp, Homo sapien
accggctcatgagcggggacaacac

SEQ ID NO: 24692 - DNA, 25 bp, Homo sapien
gttcggggccaaacaggcaccaaga

SEQ ID NO: 24693 - DNA, 25 bp, Homo sapien
ctggaagtcgctatagagagggtac

SEQ ID NO: 24694 - DNA, 25 bp, Homo sapien
ctgatcccagcctgtagggaaactg

SEQ ID NO: 24695 - DNA, 25 bp, Homo sapien
ataaagcttgaaatccgccgtcgcc

SEQ ID NO: 24696 - DNA, 25 bp, Homo sapien
ccattccaggagtaaataaagcttg

SEQ ID NO: 24697 - DNA, 25 bp, Homo sapien
caggaccattccaggagtaaataaa

SEQ ID NO: 24698 - DNA, 25 bp, Homo sapien
cttcgtcctgcaccgcacagggggg

SEQ ID NO: 24699 - DNA, 25 bp, Homo sapien
aggccagggttccttcgtcctgcac

SEQ ID NO: 24700 - DNA, 25 bp, Homo sapien
gatcccagcctgtagggaaactgag

SEQ ID NO: 24701 - DNA, 25 bp, Homo sapien
aaagcttgaaatccgccgtcgccac

SEQ ID NO: 24702 - DNA, 25 bp, Homo sapien
cttctcttcaagtcacagggaaggg

SEQ ID NO: 24703 - DNA, 25 bp, Homo sapien
ctcctgcgcaggacctaaacgggcg

SEQ ID NO: 24704 - DNA, 25 bp, Homo sapien
cctgcgcaggacctaaacgggcggt

SEQ ID NO: 24705 - DNA, 25 bp, Homo sapien
gagccctagctcacccggaacgtta

SEQ ID NO: 24706 - DNA, 25 bp, Homo sapien
ccggtgacagcgagaggaccaaaga

SEQ ID NO: 24707 - DNA, 25 bp, Homo sapien
tcgcgggctcctcgcaaattgaata

SEQ ID NO: 24708 - DNA, 25 bp, Homo sapien
gctcctcgcaaattgaataaacgcc

SEQ ID NO: 24709 - DNA, 25 bp, Homo sapien
gaagcttctcttcaagtcacaggga

SEQ ID NO: 24710 - DNA, 25 bp, Homo sapien
gcaacatccgcatgaccctctgtgt

SEQ ID NO: 24711 - DNA, 25 bp, Homo sapien
tcacaaattagtggcttaggactcc

SEQ ID NO: 24712 - DNA, 25 bp, Homo sapien
ttggaggagcaacatccgcatgacc

SEQ ID NO: 24713 - DNA, 25 bp, Homo sapien
aaatccttggaggagcaacatccgc

SEQ ID NO: 24714 - DNA, 25 bp, Homo sapien
gaatccatccttttagcttttagtc

SEQ ID NO: 24715 - DNA, 25 bp, Homo sapien
agggcgcacgcacgaaacttcctcc

SEQ ID NO: 24716 - DNA, 25 bp, Homo sapien
caatgcatgaatactttaaaagctc

SEQ ID NO: 24717 - DNA, 25 bp, Homo sapien
attagtggcttaggactccaggaag

SEQ ID NO: 24718 - DNA, 25 bp, Homo sapien
tctgtgtcctgcagagaacccttct

SEQ ID NO: 24719 - DNA, 25 bp, Homo sapien
cttgatctgtgtcctgcagagaacc

SEQ ID NO: 24720 - DNA, 25 bp, Homo sapien
aggaagtgacgtctgtctctttctc

SEQ ID NO: 24721 - DNA, 25 bp, Homo sapien
aagtgacgtctgtctctttctcctt

SEQ ID NO: 24722 - DNA, 25 bp, Homo sapien
ctcctgccattgtcctttggggagg

SEQ ID NO: 24723 - DNA, 25 bp, Homo sapien
ccctaagactgtggtacttgatctg

SEQ ID NO: 24724 - DNA, 25 bp, Homo sapien
tgtggtacttgatctgtgtcctgca

SEQ ID NO: 24725 - DNA, 25 bp, Homo sapien
agactgtggtacttgatctgtgtcc

SEQ ID NO: 24726 - DNA, 25 bp, Homo sapien
gctgcggcgggtgaaaagtcgcggg

SEQ ID NO: 24727 - DNA, 25 bp, Homo sapien
cgacaaaactcgcaacggcgagggg

SEQ ID NO: 24728 - DNA, 25 bp, Homo sapien
gcgacaaaactcgcaacggcgaggg

SEQ ID NO: 24729 - DNA, 25 bp, Homo sapien
ggcgacaaaactcgcaacggcgagg

SEQ ID NO: 24730 - DNA, 25 bp, Homo sapien
cggcgacaaaactcgcaacggcgag

SEQ ID NO: 24731 - DNA, 25 bp, Homo sapien
ctgcggcgggtgaaaagtcgcgggg

SEQ ID NO: 24732 - DNA, 25 bp, Homo sapien
cgcctggcatccctaggagtggaag

SEQ ID NO: 24733 - DNA, 25 bp, Homo sapien
cggccctggaagtcaaagatctgct

SEQ ID NO: 24734 - DNA, 25 bp, Homo sapien
tctggggatattgggtccagccttc

SEQ ID NO: 24735 - DNA, 25 bp, Homo sapien
gcgattctccatccctggatcggta

SEQ ID NO: 24736 - DNA, 25 bp, Homo sapien
agggcttctttgcagggacagtgca

SEQ ID NO: 24737 - DNA, 25 bp, Homo sapien
ctgatgaagtcaaagctgcctcctc

SEQ ID NO: 24738 - DNA, 25 bp, Homo sapien
tacccgaagcgcatagaggctgctg

SEQ ID NO: 24739 - DNA, 25 bp, Homo sapien
tttgctcccatagctggcgaacagg

SEQ ID NO: 24740 - DNA, 25 bp, Homo sapien
actctgcggcccagcccgaaatgct

SEQ ID NO: 24741 - DNA, 25 bp, Homo sapien
tgggatcgcgcacaaaccgactctg

SEQ ID NO: 24742 - DNA, 25 bp, Homo sapien
gtcagcaggtcatcagcgtggcccg

SEQ ID NO: 24743 - DNA, 25 bp, Homo sapien
tgtgcgtcagcaggtcatcagcgtg

SEQ ID NO: 24744 - DNA, 25 bp, Homo sapien
acctgtgtcagacctcttcgtggcg

SEQ ID NO: 24745 - DNA, 25 bp, Homo sapien
ctgtagttgggatcgcgcacaaacc

SEQ ID NO: 24746 - DNA, 25 bp, Homo sapien
atcgtgtctctacctgtgtcagacc

SEQ ID NO: 24747 - DNA, 25 bp, Homo sapien
gatcgcgcacaaaccgactctgcgg

SEQ ID NO: 24748 - DNA, 25 bp, Homo sapien
gcaatgagctcatctcctacaacca

SEQ ID NO: 24749 - DNA, 25 bp, Homo sapien
tgaacatcagcaatgagctcatctc

SEQ ID NO: 24750 - DNA, 25 bp, Homo sapien
gtcttccacaaggaaatcgcagctg

SEQ ID NO: 24751 - DNA, 25 bp, Homo sapien
caaggaaatcgcagctgcctacatc

SEQ ID NO: 24752 - DNA, 25 bp, Homo sapien
atcgcagctgcctacatccacatga

SEQ ID NO: 24753 - DNA, 25 bp, Homo sapien
gagctcatctcctacaaccaagaca

SEQ ID NO: 24754 - DNA, 25 bp, Homo sapien
gcagctgcctacatccacatgatgc

SEQ ID NO: 24755 - DNA, 25 bp, Homo sapien
tccacaaggaaatcgcagctgccta

SEQ ID NO: 24756 - DNA, 25 bp, Homo sapien
ctggctccgtactgcgggcgacagt

SEQ ID NO: 24757 - DNA, 25 bp, Homo sapien
ctcactaaaaccctggggctagtcg

SEQ ID NO: 24758 - DNA, 25 bp, Homo sapien
tcggacttctgctggctccgtactg

SEQ ID NO: 24759 - DNA, 25 bp, Homo sapien
agtcatctccgaagatctcagatcc

SEQ ID NO: 24760 - DNA, 25 bp, Homo sapien
tctcagatcccagtagtgcgggagc

SEQ ID NO: 24761 - DNA, 25 bp, Homo sapien
tagtgcgggagcactagccgcctcg

SEQ ID NO: 24762 - DNA, 25 bp, Homo sapien
tagtcggacctctcggtacagccca

SEQ ID NO: 24763 - DNA, 25 bp, Homo sapien
cgggcgacagtcatctccgaagatc

SEQ ID NO: 24764 - DNA, 25 bp, Homo sapien
ccactcgcgtggcaaaacttgcggg

SEQ ID NO: 24765 - DNA, 25 bp, Homo sapien
gcgcaggcgtagcagagacttaaaa

SEQ ID NO: 24766 - DNA, 25 bp, Homo sapien
gttcccaaaagcatcaggctcactt

SEQ ID NO: 24767 - DNA, 25 bp, Homo sapien
aaagtctgacttgcaggctcgggcc

SEQ ID NO: 24768 - DNA, 25 bp, Homo sapien
agctaccgggcgtttaggactccag

SEQ ID NO: 24769 - DNA, 25 bp, Homo sapien
aacgagtaacggaggacagagtgca

SEQ ID NO: 24770 - DNA, 25 bp, Homo sapien
ccgcaggggctgagaaaacgagtaa

SEQ ID NO: 24771 - DNA, 25 bp, Homo sapien
cagagacttaaaaggacacggccgc

SEQ ID NO: 24772 - DNA, 25 bp, Homo sapien
cactgtgcccagatcgccggcgaag

SEQ ID NO: 24773 - DNA, 25 bp, Homo sapien
cagcgtcgagcctgcttcgtttcaa

SEQ ID NO: 24774 - DNA, 25 bp, Homo sapien
ttcaatttcctccaggtccacaggc

SEQ ID NO: 24775 - DNA, 25 bp, Homo sapien
ggttctgagcgtgcagtcgccgcct

SEQ ID NO: 24776 - DNA, 25 bp, Homo sapien
tgaaacgagtttccagcgtcgagcc

SEQ ID NO: 24777 - DNA, 25 bp, Homo sapien
gcttcgtttcaaggtggacgccaca

SEQ ID NO: 24778 - DNA, 25 bp, Homo sapien
tggacgccacatgcaagccacgagc

SEQ ID NO: 24779 - DNA, 25 bp, Homo sapien
tgtcccagccacctcgccgcttcaa

SEQ ID NO: 24780 - DNA, 25 bp, Homo sapien
caggcccggaggagactcaagctac

SEQ ID NO: 24781 - DNA, 25 bp, Homo sapien
gtctctggcgaagggtcaccgcgtc

SEQ ID NO: 24782 - DNA, 25 bp, Homo sapien
tcaggcttttttgccaattgccaaa

SEQ ID NO: 24783 - DNA, 25 bp, Homo sapien
cggaggagactcaagctacgggtca

SEQ ID NO: 24784 - DNA, 25 bp, Homo sapien
tgcccgcgagccaagagccacgcta

SEQ ID NO: 24785 - DNA, 25 bp, Homo sapien
ggacgccttatgtcccttttcctgc

SEQ ID NO: 24786 - DNA, 25 bp, Homo sapien
gctttcccaccacggacgccttatg

SEQ ID NO: 24787 - DNA, 25 bp, Homo sapien
agctacgggtcaggcttttttgcca

SEQ ID NO: 24788 - DNA, 25 bp, Homo sapien
agtactctgcgaggcccaccaaggc

SEQ ID NO: 24789 - DNA, 25 bp, Homo sapien
caccgggtagccagaacaggcagga

SEQ ID NO: 24790 - DNA, 25 bp, Homo sapien
aggcgacgcacccagtactctgcga

SEQ ID NO: 24791 - DNA, 25 bp, Homo sapien
ccaccaaggccacgagtcccgagtc

SEQ ID NO: 24792 - DNA, 25 bp, Homo sapien
aaatgtgcctttgcgaagcggcagc

SEQ ID NO: 24793 - DNA, 25 bp, Homo sapien
catggagaaacagtcgctggtggcc

SEQ ID NO: 24794 - DNA, 25 bp, Homo sapien
ctgacctagaaatgtgcctttgcga

SEQ ID NO: 24795 - DNA, 25 bp, Homo sapien
gtcgcgcaccgggtagccagaacag

SEQ ID NO: 24796 - DNA, 25 bp, Homo sapien
cgagtcccgttctgttgagtaagcg

SEQ ID NO: 24797 - DNA, 25 bp, Homo sapien
ccagaaggacacgtaagggaaagca

SEQ ID NO: 24798 - DNA, 25 bp, Homo sapien
gggaaagcagctattcacttcggtc

SEQ ID NO: 24799 - DNA, 25 bp, Homo sapien
tcccactcgccggtaattaggtctc

SEQ ID NO: 24800 - DNA, 25 bp, Homo sapien
acttcggtcctgtccgcaagggatc

SEQ ID NO: 24801 - DNA, 25 bp, Homo sapien
gcaagggatccctttctgacgggaa

SEQ ID NO: 24802 - DNA, 25 bp, Homo sapien
aagaaaggtggcgagtcccgttctg

SEQ ID NO: 24803 - DNA, 25 bp, Homo sapien
attaggtctccggtcagcctcagct

SEQ ID NO: 24804 - DNA, 25 bp, Homo sapien
cccacgcgattcaggctcagggagt

SEQ ID NO: 24805 - DNA, 25 bp, Homo sapien
ccaagaactgcgagagctgtcacta

SEQ ID NO: 24806 - DNA, 25 bp, Homo sapien
gctgtcactagagcccaccgggcgt

SEQ ID NO: 24807 - DNA, 25 bp, Homo sapien
aacgttagatggacgcttgctctgc

SEQ ID NO: 24808 - DNA, 25 bp, Homo sapien
taccagagcgagagtcgactgttcc

SEQ ID NO: 24809 - DNA, 25 bp, Homo sapien
tggttcgagctcgttctatggaacg

SEQ ID NO: 24810 - DNA, 25 bp, Homo sapien
gtagcgcaagcagcgtagcgagtca

SEQ ID NO: 24811 - DNA, 25 bp, Homo sapien
gtggctccgcctaacgttagatgga

SEQ ID NO: 24812 - DNA, 25 bp, Homo sapien
taatgctcagcgaagggtttcaggt

SEQ ID NO: 24813 - DNA, 25 bp, Homo sapien
ttcctaatgctcagcgaagggtttc

SEQ ID NO: 24814 - DNA, 25 bp, Homo sapien
gcctggttcctaatgctcagcgaag

SEQ ID NO: 24815 - DNA, 25 bp, Homo sapien
cgatccaattcacggcgggcaaacc

SEQ ID NO: 24816 - DNA, 25 bp, Homo sapien
gtctcccgatccaattcacggcggg

SEQ ID NO: 24817 - DNA, 25 bp, Homo sapien
ctcgggaccttatccctggcgtccg

SEQ ID NO: 24818 - DNA, 25 bp, Homo sapien
ttccgggcggcagtagtgtggaccc

SEQ ID NO: 24819 - DNA, 25 bp, Homo sapien
tttgagcgccggagttccgggcggc

SEQ ID NO: 24820 - DNA, 25 bp, Homo sapien
cggcatctgttctcgcccgaagaag

SEQ ID NO: 24821 - DNA, 25 bp, Homo sapien
tgcggagcaacctttcagtggccac

SEQ ID NO: 24822 - DNA, 25 bp, Homo sapien
ctgcggagcaacctttcagtggcca

SEQ ID NO: 24823 - DNA, 25 bp, Homo sapien
cgctgcggagcaacctttcagtggc

SEQ ID NO: 24824 - DNA, 25 bp, Homo sapien
ggcatctgttctcgcccgaagaagc

SEQ ID NO: 24825 - DNA, 25 bp, Homo sapien
ccggcatctgttctcgcccgaagaa

SEQ ID NO: 24826 - DNA, 25 bp, Homo sapien
cagggggaagtgatgtctgtctctc

SEQ ID NO: 24827 - DNA, 25 bp, Homo sapien
atctgttctcgcccgaagaagctgg

SEQ ID NO: 24828 - DNA, 25 bp, Homo sapien
ttgcgctggtcacattggatacctg

SEQ ID NO: 24829 - DNA, 25 bp, Homo sapien
cgagccgcctgaggtcccaagggga

SEQ ID NO: 24830 - DNA, 25 bp, Homo sapien
tgcgctggtcacattggatacctgc

SEQ ID NO: 24831 - DNA, 25 bp, Homo sapien
gccgcctgaggtcccaaggggaagc

SEQ ID NO: 24832 - DNA, 25 bp, Homo sapien
agttgcgctggtcacattggatacc

SEQ ID NO: 24833 - DNA, 25 bp, Homo sapien
gagttgcgctggtcacattggatac

SEQ ID NO: 24834 - DNA, 25 bp, Homo sapien
tgagttgcgctggtcacattggata

SEQ ID NO: 24835 - DNA, 25 bp, Homo sapien
tcagaagcccccagaaactccgcgg

SEQ ID NO: 24836 - DNA, 25 bp, Homo sapien
cgggccgcgcttaactgtcccaggt

SEQ ID NO: 24837 - DNA, 25 bp, Homo sapien
gcgcttaactgtcccaggtcagtta

SEQ ID NO: 24838 - DNA, 25 bp, Homo sapien
aactgtcccaggtcagttaagcccg

SEQ ID NO: 24839 - DNA, 25 bp, Homo sapien
tcccaggtcagttaagcccgtggga

SEQ ID NO: 24840 - DNA, 25 bp, Homo sapien
ccaggtcagttaagcccgtgggagc

SEQ ID NO: 24841 - DNA, 25 bp, Homo sapien
ggagcccaggtcatggggcagccag

SEQ ID NO: 24842 - DNA, 25 bp, Homo sapien
cgacccagtgctcggttggcccggg

SEQ ID NO: 24843 - DNA, 25 bp, Homo sapien
ccgcgcttaactgtcccaggtcagt

SEQ ID NO: 24844 - DNA, 25 bp, Homo sapien
ggtctcactctcgtgggcaaacata

SEQ ID NO: 24845 - DNA, 25 bp, Homo sapien
ccggcactcacaagcaggggtagta

SEQ ID NO: 24846 - DNA, 25 bp, Homo sapien
tccaacccttggagttctagtcatc

SEQ ID NO: 24847 - DNA, 25 bp, Homo sapien
tcccagcaccgtcctaggaggtaca

SEQ ID NO: 24848 - DNA, 25 bp, Homo sapien
tcacccgggcgcacatctgaatcag

SEQ ID NO: 24849 - DNA, 25 bp, Homo sapien
ttcagatcccgcctgttacgtagcg

SEQ ID NO: 24850 - DNA, 25 bp, Homo sapien
tgcgtacctacgaggagcaaaccta

SEQ ID NO: 24851 - DNA, 25 bp, Homo sapien
acgtagcgatcctgtctcttgtaga

SEQ ID NO: 24852 - DNA, 25 bp, Homo sapien
ccgagcttcgctgcaggtcacagga

SEQ ID NO: 24853 - DNA, 25 bp, Homo sapien
accaggtgctgctactggcctccga

SEQ ID NO: 24854 - DNA, 25 bp, Homo sapien
ctcctggccagttgaatacccggtc

SEQ ID NO: 24855 - DNA, 25 bp, Homo sapien
gcgcctcgagaactcctggccagtt

SEQ ID NO: 24856 - DNA, 25 bp, Homo sapien
actgacccgggatgttgctggagcc

SEQ ID NO: 24857 - DNA, 25 bp, Homo sapien
agttcggactgacccgggatgttgc

SEQ ID NO: 24858 - DNA, 25 bp, Homo sapien
ccttggcgccttcggagttcggact

SEQ ID NO: 24859 - DNA, 25 bp, Homo sapien
actggcctccgagaagacaggccta

SEQ ID NO: 24860 - DNA, 25 bp, Homo sapien
cttgggcaccggagccttagccgag

SEQ ID NO: 24861 - DNA, 25 bp, Homo sapien
cagggacttttccttcctcggagag

SEQ ID NO: 24862 - DNA, 25 bp, Homo sapien
ccacacgcggtgtgtccctgccaca

SEQ ID NO: 24863 - DNA, 25 bp, Homo sapien
gccacagccacggagagctttgtcc

SEQ ID NO: 24864 - DNA, 25 bp, Homo sapien
caggaggcgtctgcaagcacgctcc

SEQ ID NO: 24865 - DNA, 25 bp, Homo sapien
tcccttcctttgcttgggcaccgga

SEQ ID NO: 24866 - DNA, 25 bp, Homo sapien
cgcgctgcagggacttttccttcct

SEQ ID NO: 24867 - DNA, 25 bp, Homo sapien
agcacgctcccttcctttgcttggg

SEQ ID NO: 24868 - DNA, 25 bp, Homo sapien
cgggacttgtaaacctggcaggtgt

SEQ ID NO: 24869 - DNA, 25 bp, Homo sapien
ccgccgaccagcgacagtctctcca

SEQ ID NO: 24870 - DNA, 25 bp, Homo sapien
agctctgcacgtcgcgtgtgggctc

SEQ ID NO: 24871 - DNA, 25 bp, Homo sapien
ctcctcccggaagcctggtgcgctc

SEQ ID NO: 24872 - DNA, 25 bp, Homo sapien
gcgacagtctctccacgcgctgccg

SEQ ID NO: 24873 - DNA, 25 bp, Homo sapien
ctcgctccgggacttgtaaacctgg

SEQ ID NO: 24874 - DNA, 25 bp, Homo sapien
ctccgggacttgtaaacctggcagg

SEQ ID NO: 24875 - DNA, 25 bp, Homo sapien
acttgtaaacctggcaggtgttcga

SEQ ID NO: 24876 - DNA, 25 bp, Homo sapien
ttcttggcttgtcgcaagagcagcc

SEQ ID NO: 24877 - DNA, 25 bp, Homo sapien
caagccagcgggcaagaaggctcca

SEQ ID NO: 24878 - DNA, 25 bp, Homo sapien
ctgcaggagcgagaaatgagctgta

SEQ ID NO: 24879 - DNA, 25 bp, Homo sapien
cagctggttccctcaccgtcaaaag

SEQ ID NO: 24880 - DNA, 25 bp, Homo sapien
tcgtgtcccattcgcccgagtcaag

SEQ ID NO: 24881 - DNA, 25 bp, Homo sapien
ccgccaaaacccagtgagaaattat

SEQ ID NO: 24882 - DNA, 25 bp, Homo sapien
aatcccaacgtcattgtttcctcgg

SEQ ID NO: 24883 - DNA, 25 bp, Homo sapien
actgtggccgcatgtgcatattgca

SEQ ID NO: 24884 - DNA, 25 bp, Homo sapien
tggatccggcatttttgcgcgaaaa

SEQ ID NO: 24885 - DNA, 25 bp, Homo sapien
tccggcatttttgcgcgaaaaaaga

SEQ ID NO: 24886 - DNA, 25 bp, Homo sapien
actaccgcaaaacgggctggttatg

SEQ ID NO: 24887 - DNA, 25 bp, Homo sapien
cttcttgggagcaggagcggatttc

SEQ ID NO: 24888 - DNA, 25 bp, Homo sapien
agcggatttcgctggatccggcatt

SEQ ID NO: 24889 - DNA, 25 bp, Homo sapien
taaagaagtaatccgaactaccgca

SEQ ID NO: 24890 - DNA, 25 bp, Homo sapien
atttcgctggatccggcatttttgc

SEQ ID NO: 24891 - DNA, 25 bp, Homo sapien
cgctggatccggcatttttgcgcga

SEQ ID NO: 24892 - DNA, 25 bp, Homo sapien
ctcttgatgaaaacggcagtggctc

SEQ ID NO: 24893 - DNA, 25 bp, Homo sapien
agccggtacagctgctcttgatgaa

SEQ ID NO: 24894 - DNA, 25 bp, Homo sapien
gcacatcagatggagagccggtaca

SEQ ID NO: 24895 - DNA, 25 bp, Homo sapien
tctgtaacgtcacccaccacgagtg

SEQ ID NO: 24896 - DNA, 25 bp, Homo sapien
ttgggttctgtaacgtcacccacca

SEQ ID NO: 24897 - DNA, 25 bp, Homo sapien
gccggccaactcacggctgggcttt

SEQ ID NO: 24898 - DNA, 25 bp, Homo sapien
tgcggctttctctactgccggccaa

SEQ ID NO: 24899 - DNA, 25 bp, Homo sapien
ctttagatcgaccacttaaaaatat

SEQ ID NO: 24900 - DNA, 25 bp, Homo sapien
ggccagaggtttcatttttaactga

SEQ ID NO: 24901 - DNA, 25 bp, Homo sapien
gcaggtgagttcttgcttttccaga

SEQ ID NO: 24902 - DNA, 25 bp, Homo sapien
acgtcgtgatccagaagtccagagc

SEQ ID NO: 24903 - DNA, 25 bp, Homo sapien
tcagaaggatatcgacgtcgtgatc

SEQ ID NO: 24904 - DNA, 25 bp, Homo sapien
taatggggatgtgttcaaggcaaga

SEQ ID NO: 24905 - DNA, 25 bp, Homo sapien
aattggaatccagcagcggcgagca

SEQ ID NO: 24906 - DNA, 25 bp, Homo sapien
gggcagtgcgtggtatttccagccc

SEQ ID NO: 24907 - DNA, 25 bp, Homo sapien
ggttcatttggcaacagctgctgca

SEQ ID NO: 24908 - DNA, 25 bp, Homo sapien
tacaggcaccagtgccgctgcgcgg

SEQ ID NO: 24909 - DNA, 25 bp, Homo sapien
agctcctcccaggtttccgttgtca

SEQ ID NO: 24910 - DNA, 25 bp, Homo sapien
tttccgttgtcaaggacgcgccgtc

SEQ ID NO: 24911 - DNA, 25 bp, Homo sapien
acgcgccgtcggttgttgtcaagat

SEQ ID NO: 24912 - DNA, 25 bp, Homo sapien
cccatctgctattgcccggcgaggt

SEQ ID NO: 24913 - DNA, 25 bp, Homo sapien
gggaactgggcactgaatcatcgga

SEQ ID NO: 24914 - DNA, 25 bp, Homo sapien
tccctagggatgcttgggttgccac

SEQ ID NO: 24915 - DNA, 25 bp, Homo sapien
atcatcggacaacctcgacagagcc

SEQ ID NO: 24916 - DNA, 25 bp, Homo sapien
cgtgacgcaagtgaccttgcgtgta

SEQ ID NO: 24917 - DNA, 25 bp, Homo sapien
accggagagtcgcagctgtgtgtta

SEQ ID NO: 24918 - DNA, 25 bp, Homo sapien
cgcagctgtgtgttagggctaggat

SEQ ID NO: 24919 - DNA, 25 bp, Homo sapien
tgtgtgttagggctaggatggctcc

SEQ ID NO: 24920 - DNA, 25 bp, Homo sapien
ggatgcgcgtgacgcaagtgacctt

SEQ ID NO: 24921 - DNA, 25 bp, Homo sapien
tgcgcgtgacgcaagtgaccttgcg

SEQ ID NO: 24922 - DNA, 25 bp, Homo sapien
gacgcaagtgaccttgcgtgtaaag

SEQ ID NO: 24923 - DNA, 25 bp, Homo sapien
atgcgcgtgacgcaagtgaccttgc

SEQ ID NO: 24924 - DNA, 25 bp, Homo sapien
cagagacaagcactgctaactccac

SEQ ID NO: 24925 - DNA, 25 bp, Homo sapien
aagctggaaaagaagcaggggagtt

SEQ ID NO: 24926 - DNA, 25 bp, Homo sapien
caggggagttgtgaaccagacatcc

SEQ ID NO: 24927 - DNA, 25 bp, Homo sapien
aggggagttgtgaaccagacatcca

SEQ ID NO: 24928 - DNA, 25 bp, Homo sapien
cactgggccatataggaagggcgca

SEQ ID NO: 24929 - DNA, 25 bp, Homo sapien
cctttgaagagaggtgagagtggaa

SEQ ID NO: 24930 - DNA, 25 bp, Homo sapien
actccactgggccatataggaaggg

SEQ ID NO: 24931 - DNA, 25 bp, Homo sapien
tccactgggccatataggaagggcg

SEQ ID NO: 24932 - DNA, 25 bp, Homo sapien
caggggatggttcacatgtggcaca

SEQ ID NO: 24933 - DNA, 25 bp, Homo sapien
ccttctctgctgactggggagaggc

SEQ ID NO: 24934 - DNA, 25 bp, Homo sapien
gtgctccacacagttcgtctcattg

SEQ ID NO: 24935 - DNA, 25 bp, Homo sapien
ctcagtttcctcgtgtgcagaaatc

SEQ ID NO: 24936 - DNA, 25 bp, Homo sapien
tgagataactgtgattccctgtgga

SEQ ID NO: 24937 - DNA, 25 bp, Homo sapien
agccggctggctgctccacatagac

SEQ ID NO: 24938 - DNA, 25 bp, Homo sapien
ccaggtcccagtgccaggttctgtg

SEQ ID NO: 24939 - DNA, 25 bp, Homo sapien
ggcgcgtctcatcagctgcaggact

SEQ ID NO: 24940 - DNA, 25 bp, Homo sapien
cgcgttcctggaagagcccggctgg

SEQ ID NO: 24941 - DNA, 25 bp, Homo sapien
acgcacggcaacaaacagcgcgggg

SEQ ID NO: 24942 - DNA, 25 bp, Homo sapien
gcggacgcacggcaacaaacagcgc

SEQ ID NO: 24943 - DNA, 25 bp, Homo sapien
ctgaggcggacgcacggcaacaaac

SEQ ID NO: 24944 - DNA, 25 bp, Homo sapien
ggagcgggtcacattcttggccagc

SEQ ID NO: 24945 - DNA, 25 bp, Homo sapien
aggccgcggccgtgatcggccgtga

SEQ ID NO: 24946 - DNA, 25 bp, Homo sapien
ccgagtcatggcagggcgggtccga

SEQ ID NO: 24947 - DNA, 25 bp, Homo sapien
ggtcacattcttggccagcgctagg

SEQ ID NO: 24948 - DNA, 25 bp, Homo sapien
tcttccgaaggcctaacgagcatgt

SEQ ID NO: 24949 - DNA, 25 bp, Homo sapien
ctccacgagggagtcctgagtactg

SEQ ID NO: 24950 - DNA, 25 bp, Homo sapien
agcgacactttcctgtgctctagga

SEQ ID NO: 24951 - DNA, 25 bp, Homo sapien
catgcagatgcggaaagctgctttc

SEQ ID NO: 24952 - DNA, 25 bp, Homo sapien
tagccactagacaaccatgcagatg

SEQ ID NO: 24953 - DNA, 25 bp, Homo sapien
tggcctctctgcacggctgtgtaca

SEQ ID NO: 24954 - DNA, 25 bp, Homo sapien
aacgagcatgttagctgcgaacgga

SEQ ID NO: 24955 - DNA, 25 bp, Homo sapien
tattcacagctcagcccgataggca

SEQ ID NO: 24956 - DNA, 25 bp, Homo sapien
agaccactgtgcacctgatggcccg

SEQ ID NO: 24957 - DNA, 25 bp, Homo sapien
ggacacggtctggttcctgcgctcc

SEQ ID NO: 24958 - DNA, 25 bp, Homo sapien
cctcgcgcagcaggtgaagcgtcct

SEQ ID NO: 24959 - DNA, 25 bp, Homo sapien
cggttccctggaaccactcaccagg

SEQ ID NO: 24960 - DNA, 25 bp, Homo sapien
gcccgaggctcttttccgcgcgccc

SEQ ID NO: 24961 - DNA, 25 bp, Homo sapien
gcgggacttccctctcacagttcac

SEQ ID NO: 24962 - DNA, 25 bp, Homo sapien
caggtgaagcgtcctgcttggcccg

SEQ ID NO: 24963 - DNA, 25 bp, Homo sapien
cactcaccaggcagcatcatcgcgc

SEQ ID NO: 24964 - DNA, 25 bp, Homo sapien
ctgggtccctagagacgtgtggccc

SEQ ID NO: 24965 - DNA, 25 bp, Homo sapien
gaagaggcccttggtcttcgcggct

SEQ ID NO: 24966 - DNA, 25 bp, Homo sapien
ctctaaggagatcaccagccggctc

SEQ ID NO: 24967 - DNA, 25 bp, Homo sapien
ccttccagtctctgagctctaagga

SEQ ID NO: 24968 - DNA, 25 bp, Homo sapien
tcttgcctcagaaaaccttccagtc

SEQ ID NO: 24969 - DNA, 25 bp, Homo sapien
ggtggctactacttcaggttcttgc

SEQ ID NO: 24970 - DNA, 25 bp, Homo sapien
cggcgccattctgagtgaaccctga

SEQ ID NO: 24971 - DNA, 25 bp, Homo sapien
atccacccagccgagagcacgatgg

SEQ ID NO: 24972 - DNA, 25 bp, Homo sapien
tccgctcgtcgggattaaatcctgc

SEQ ID NO: 24973 - DNA, 25 bp, Homo sapien
ggcggggacaattgagaacgcttcc

SEQ ID NO: 24974 - DNA, 25 bp, Homo sapien
cgcgctttcggttttcaatctggtc

SEQ ID NO: 24975 - DNA, 25 bp, Homo sapien
ggtgctcgccttgacagaagctgtc

SEQ ID NO: 24976 - DNA, 25 bp, Homo sapien
ttaagcggatctctggcctcattta

SEQ ID NO: 24977 - DNA, 25 bp, Homo sapien
gctcatctgaggagttggacacttg

SEQ ID NO: 24978 - DNA, 25 bp, Homo sapien
taactttggcagtggggcgacaatc

SEQ ID NO: 24979 - DNA, 25 bp, Homo sapien
gccgctccagctttgcacgtttcga

SEQ ID NO: 24980 - DNA, 25 bp, Homo sapien
agctcccgcgtggaacctcattctt

SEQ ID NO: 24981 - DNA, 25 bp, Homo sapien
acacttcagcgcgttgggtactgcc

SEQ ID NO: 24982 - DNA, 25 bp, Homo sapien
cccagttgctacttggcggatcgtt

SEQ ID NO: 24983 - DNA, 25 bp, Homo sapien
gactaggtctaagtgtccggccata

SEQ ID NO: 24984 - DNA, 25 bp, Homo sapien
cggccatagcctgcggaaaccacta

SEQ ID NO: 24985 - DNA, 25 bp, Homo sapien
tcccgtcagctccaggttcgctatt

SEQ ID NO: 24986 - DNA, 25 bp, Homo sapien
gtggccagcattaacaactctttta

SEQ ID NO: 24987 - DNA, 25 bp, Homo sapien
ggacgtcagcctcacttgccctttg

SEQ ID NO: 24988 - DNA, 25 bp, Homo sapien
tggccggacacttagacctagtctg

SEQ ID NO: 24989 - DNA, 25 bp, Homo sapien
tcagagccacccacgttttcaaata

SEQ ID NO: 24990 - DNA, 25 bp, Homo sapien
gtccagcgttcctcagtagtgaata

SEQ ID NO: 24991 - DNA, 25 bp, Homo sapien
cgccgtcttccatctggagcacgta

SEQ ID NO: 24992 - DNA, 25 bp, Homo sapien
aactgccttggctcttcgatgagtg

SEQ ID NO: 24993 - DNA, 25 bp, Homo sapien
cgggcagtacccaacgcgctgaagt

SEQ ID NO: 24994 - DNA, 25 bp, Homo sapien
cttccctagtggtttccgcaggcta

SEQ ID NO: 24995 - DNA, 25 bp, Homo sapien
tggcttcactgagctgacttaagtc

SEQ ID NO: 24996 - DNA, 25 bp, Homo sapien
gtcaagtgtccaactcctcagatga

SEQ ID NO: 24997 - DNA, 25 bp, Homo sapien
atgaggccagagatccgcttaacgc

SEQ ID NO: 24998 - DNA, 25 bp, Homo sapien
ccgctggagcccgatagacagcttc

SEQ ID NO: 24999 - DNA, 25 bp, Homo sapien
agcttctgtcaaggcgagcaccgtc

SEQ ID NO: 25000 - DNA, 25 bp, Homo sapien
tccggattctgtagtggctttggcc

SEQ ID NO: 25001 - DNA, 25 bp, Homo sapien
tccgttaacttcagatccgattgtc

SEQ ID NO: 25002 - DNA, 25 bp, Homo sapien
gagcggattcagagccgtgcttata

SEQ ID NO: 25003 - DNA, 25 bp, Homo sapien
agcgcgccagcgcaggatttaatcc

SEQ ID NO: 25004 - DNA, 25 bp, Homo sapien
cgatcttcagagagaggacgcccga

SEQ ID NO: 25005 - DNA, 25 bp, Homo sapien
tcttcagagagaggacgcccgagaa

SEQ ID NO: 25006 - DNA, 25 bp, Homo sapien
gatcttcagagagaggacgcccgag

SEQ ID NO: 25007 - DNA, 25 bp, Homo sapien
gatcttcatagagaggacgcccgag

SEQ ID NO: 25008 - DNA, 25 bp, Homo sapien
cagagagaggatgcccgagaagaca

SEQ ID NO: 25009 - DNA, 25 bp, Homo sapien
agatcttcatagagaggacgcccga

SEQ ID NO: 25010 - DNA, 25 bp, Homo sapien
agatcttcagagagaggatgcccga

SEQ ID NO: 25011 - DNA, 25 bp, Homo sapien
atcttcagagagaggacgcccgaga

SEQ ID NO: 25012 - DNA, 25 bp, Homo sapien
gccggttcaggcatggtaagacaca

SEQ ID NO: 25013 - DNA, 25 bp, Homo sapien
atccaggccgttctgttaccaaaga

SEQ ID NO: 25014 - DNA, 25 bp, Homo sapien
ctcttgacttgattggccggttctg

SEQ ID NO: 25015 - DNA, 25 bp, Homo sapien
tagggctccgaaagtcgttcatttc

SEQ ID NO: 25016 - DNA, 25 bp, Homo sapien
tgcggaccttgcgttttcagcaatg

SEQ ID NO: 25017 - DNA, 25 bp, Homo sapien
tgggcgggcctgattcttttataac

SEQ ID NO: 25018 - DNA, 25 bp, Homo sapien
tgcgctatttcgtgatcagcccttc

SEQ ID NO: 25019 - DNA, 25 bp, Homo sapien
gcgtacgtaacaacaccgactcttg

SEQ ID NO: 25020 - DNA, 25 bp, Homo sapien
ggactgcattttgctccggagcgtc

SEQ ID NO: 25021 - DNA, 25 bp, Homo sapien
cgcagttgcacatgccctacttttg

SEQ ID NO: 25022 - DNA, 25 bp, Homo sapien
cgggcctttctaatcttcgcttgtc

SEQ ID NO: 25023 - DNA, 25 bp, Homo sapien
ccacagctggaggtcgaattcacca

SEQ ID NO: 25024 - DNA, 25 bp, Homo sapien
acattgtgctctcaccaggcggatc

SEQ ID NO: 25025 - DNA, 25 bp, Homo sapien
ccgaggtgctagagcttcgcaacga

SEQ ID NO: 25026 - DNA, 25 bp, Homo sapien
tgagactcacttccgcgtggctgtg

SEQ ID NO: 25027 - DNA, 25 bp, Homo sapien
ttcggcccaaccacaagtacgcagt

SEQ ID NO: 25028 - DNA, 25 bp, Homo sapien
gcggttccgccttctgacctcagca

SEQ ID NO: 25029 - DNA, 25 bp, Homo sapien
ccgccgtctcccagcagcggttccg

SEQ ID NO: 25030 - DNA, 25 bp, Homo sapien
ccgctgctagttgtcttagcgagga

SEQ ID NO: 25031 - DNA, 25 bp, Homo sapien
cctcagcacgacttccacttccggg

SEQ ID NO: 25032 - DNA, 25 bp, Homo sapien
cggctgcagccatcttaggagcctc

SEQ ID NO: 25033 - DNA, 25 bp, Homo sapien
tcgcgtcctgaggtgccgctgctag

SEQ ID NO: 25034 - DNA, 25 bp, Homo sapien
gcagccatcttaggagcctccgaaa

SEQ ID NO: 25035 - DNA, 25 bp, Homo sapien
catcttaggagcctccgaaacttaa

SEQ ID NO: 25036 - DNA, 25 bp, Homo sapien
ttcaggatcggtggctttctgctgt

SEQ ID NO: 25037 - DNA, 25 bp, Homo sapien
agctggagccagaaaggactgatcg

SEQ ID NO: 25038 - DNA, 25 bp, Homo sapien
atcgggacgaagcaaggagcagtca

SEQ ID NO: 25039 - DNA, 25 bp, Homo sapien
agatggcttcgggtgaaacagattc

SEQ ID NO: 25040 - DNA, 25 bp, Homo sapien
gcagagtttgcgagtctgagaagcc

SEQ ID NO: 25041 - DNA, 25 bp, Homo sapien
gcagctgttgctccgcacgggatct

SEQ ID NO: 25042 - DNA, 25 bp, Homo sapien
gctttctgctgtccggccggaaaca

SEQ ID NO: 25043 - DNA, 25 bp, Homo sapien
gcctctcttcattcctcggcagtga

SEQ ID NO: 25044 - DNA, 25 bp, Homo sapien
ccgggcatcagatcgtgcacgtccg

SEQ ID NO: 25045 - DNA, 25 bp, Homo sapien
tccggcctccgtcaagggagttgga

SEQ ID NO: 25046 - DNA, 25 bp, Homo sapien
aaaggcaacgagctgtccggcctcc

SEQ ID NO: 25047 - DNA, 25 bp, Homo sapien
cgagtttctgtctcagtcgggcgca

SEQ ID NO: 25048 - DNA, 25 bp, Homo sapien
ttttggcgtttgaggcgagtttctg

SEQ ID NO: 25049 - DNA, 25 bp, Homo sapien
cgaaaagtttccctgcgctgccggc

SEQ ID NO: 25050 - DNA, 25 bp, Homo sapien
tgcaggaatgtagcaacttgcagcg

SEQ ID NO: 25051 - DNA, 25 bp, Homo sapien
aaaaagttctcaggcgccgcaggtc

SEQ ID NO: 25052 - DNA, 25 bp, Homo sapien
ttgtgccaggttcctcatttcgcga

SEQ ID NO: 25053 - DNA, 25 bp, Homo sapien
tgaacccgggaagacgaatctcgac

SEQ ID NO: 25054 - DNA, 25 bp, Homo sapien
cgcaaataccgcgtgtgatttatta

SEQ ID NO: 25055 - DNA, 25 bp, Homo sapien
tctcactgccatgcaagaaagcgtt

SEQ ID NO: 25056 - DNA, 25 bp, Homo sapien
tccgtcgttcctgcttccaagcaaa

SEQ ID NO: 25057 - DNA, 25 bp, Homo sapien
atttcgcgaggctccactctcttgg

SEQ ID NO: 25058 - DNA, 25 bp, Homo sapien
ctcaggcatcttcaggccgcaggtg

SEQ ID NO: 25059 - DNA, 25 bp, Homo sapien
gggcacgtagccacactccgtcgtt

SEQ ID NO: 25060 - DNA, 25 bp, Homo sapien
ggggcttcaacttggctgagtttcc

SEQ ID NO: 25061 - DNA, 25 bp, Homo sapien
gagcggtctccagccgcttcgaagc

SEQ ID NO: 25062 - DNA, 25 bp, Homo sapien
ccctccgtgagtcagaaacaaaggc

SEQ ID NO: 25063 - DNA, 25 bp, Homo sapien
gcggctccgcgattcgccctttatt

SEQ ID NO: 25064 - DNA, 25 bp, Homo sapien
ttctgaactcgcaacgtcagcggcc

SEQ ID NO: 25065 - DNA, 25 bp, Homo sapien
ggccttgagtgaaaccggagctaca

SEQ ID NO: 25066 - DNA, 25 bp, Homo sapien
acaattccgccaagcgggtgagtgc

SEQ ID NO: 25067 - DNA, 25 bp, Homo sapien
cccgctgggaatgatgaagaagaac

SEQ ID NO: 25068 - DNA, 25 bp, Homo sapien
tggcccaatccgagacggtttcgta

SEQ ID NO: 25069 - DNA, 25 bp, Homo sapien
gcatgcgcaggtctctgactttgac

SEQ ID NO: 25070 - DNA, 25 bp, Homo sapien
tgactttgaccgttttggcgggtgc

SEQ ID NO: 25071 - DNA, 25 bp, Homo sapien
gggtgcgcgccagccctagtttatc

SEQ ID NO: 25072 - DNA, 25 bp, Homo sapien
ttgcggcatttctggcccaatccga

SEQ ID NO: 25073 - DNA, 25 bp, Homo sapien
acggtttcgtagagcgccctgtaga

SEQ ID NO: 25074 - DNA, 25 bp, Homo sapien
ccctgtagagcaattcgggttgccc

SEQ ID NO: 25075 - DNA, 25 bp, Homo sapien
cacgtgactggggttgcggcatttc

SEQ ID NO: 25076 - DNA, 25 bp, Homo sapien
accgtctccagggatcaaattcaga

SEQ ID NO: 25077 - DNA, 25 bp, Homo sapien
cagtgagagcgcatcatttagtttc

SEQ ID NO: 25078 - DNA, 25 bp, Homo sapien
tttcggcgaacccatctttaaagca

SEQ ID NO: 25079 - DNA, 25 bp, Homo sapien
ccgtctctttaaggcgacagcagtg

SEQ ID NO: 25080 - DNA, 25 bp, Homo sapien
tcaaattcagagttgcggccacacg

SEQ ID NO: 25081 - DNA, 25 bp, Homo sapien
tgccacatatcgttacacggcgggg

SEQ ID NO: 25082 - DNA, 25 bp, Homo sapien
gccgcactgcagaaaagttggacta

SEQ ID NO: 25083 - DNA, 25 bp, Homo sapien
tggactaacttctcaggcgcctatg

SEQ ID NO: 25084 - DNA, 25 bp, Homo sapien
ccgaacgcgacgaaagtgcagccga

SEQ ID NO: 25085 - DNA, 25 bp, Homo sapien
gccacagtgatcaagaaaagcgcga

SEQ ID NO: 25086 - DNA, 25 bp, Homo sapien
cccggaaggccaatggagaatcagc

SEQ ID NO: 25087 - DNA, 25 bp, Homo sapien
gcgcttccgtcgctgtttcctttcg

SEQ ID NO: 25088 - DNA, 25 bp, Homo sapien
agacaccaattccagggttcggttg

SEQ ID NO: 25089 - DNA, 25 bp, Homo sapien
ccgggaatggaccagtcgagacacc

SEQ ID NO: 25090 - DNA, 25 bp, Homo sapien
cttccgaggccttgacttcgtcctg

SEQ ID NO: 25091 - DNA, 25 bp, Homo sapien
ccctgcgaccaggatgataacgcga

SEQ ID NO: 25092 - DNA, 25 bp, Homo sapien
catcctatttaaggccacgggctcc

SEQ ID NO: 25093 - DNA, 25 bp, Homo sapien
ctctggcgcatcaccatcctattta

SEQ ID NO: 25094 - DNA, 25 bp, Homo sapien
tgaacactcaaaccgcgcatctctg

SEQ ID NO: 25095 - DNA, 25 bp, Homo sapien
gccttcagtagcacaaccaatctct

SEQ ID NO: 25096 - DNA, 25 bp, Homo sapien
cagatgagttacttcccgagacgga

SEQ ID NO: 25097 - DNA, 25 bp, Homo sapien
tcactgacggtttccacgtgctgcg

SEQ ID NO: 25098 - DNA, 25 bp, Homo sapien
ctcacacacgttgcagacacaaatc

SEQ ID NO: 25099 - DNA, 25 bp, Homo sapien
gcaggagaatataccgtgtcacaca

SEQ ID NO: 25100 - DNA, 25 bp, Homo sapien
gtgaatcagccttccaagaaccgcg

SEQ ID NO: 25101 - DNA, 25 bp, Homo sapien
gtttgtctccctcaatctttggcga

SEQ ID NO: 25102 - DNA, 25 bp, Homo sapien
tcattctggatggaaaggcctgttt

SEQ ID NO: 25103 - DNA, 25 bp, Homo sapien
ctgcagcgtttcctctcattctgga

SEQ ID NO: 25104 - DNA, 25 bp, Homo sapien
gcagcatcctgtgccgcttctgtgt

SEQ ID NO: 25105 - DNA, 25 bp, Homo sapien
ctgccgctcttacgaaacactctta

SEQ ID NO: 25106 - DNA, 25 bp, Homo sapien
ccgtcctgtaaagccggggatggca

SEQ ID NO: 25107 - DNA, 25 bp, Homo sapien
gccgcttctgtgttccgcatttttc

SEQ ID NO: 25108 - DNA, 25 bp, Homo sapien
ggtaacgccctgctgccatctcttt

SEQ ID NO: 25109 - DNA, 25 bp, Homo sapien
atccttgtcgctcgtgtccttctca

SEQ ID NO: 25110 - DNA, 25 bp, Homo sapien
cgacgcgtctttgtggtaacgccct

SEQ ID NO: 25111 - DNA, 25 bp, Homo sapien
ttccaaatcctaaataagccgcgcg

SEQ ID NO: 25112 - DNA, 25 bp, Homo sapien
tctctatgcgaggatttggactggc

SEQ ID NO: 25113 - DNA, 25 bp, Homo sapien
cgattcacgtctactttctaggatg

SEQ ID NO: 25114 - DNA, 25 bp, Homo sapien
tgacttccatgtgctccatctcgcg

SEQ ID NO: 25115 - DNA, 25 bp, Homo sapien
cgcgtccctgagcatgttgaatttc

SEQ ID NO: 25116 - DNA, 25 bp, Homo sapien
cctccaagaaagtggcaaatacggc

SEQ ID NO: 25117 - DNA, 25 bp, Homo sapien
tggcaaatacggctgcgcgaattgg

SEQ ID NO: 25118 - DNA, 25 bp, Homo sapien
ccctccttggtcacgtgttgggaga

SEQ ID NO: 25119 - DNA, 25 bp, Homo sapien
ttctgcgacgcatgcgttcagcctc

SEQ ID NO: 25120 - DNA, 25 bp, Homo sapien
ccttggtcacgtgttgggagacagc

SEQ ID NO: 25121 - DNA, 25 bp, Homo sapien
ccgggcccacagagggtaattccag

SEQ ID NO: 25122 - DNA, 25 bp, Homo sapien
ggtaattccagtccgcgccactgtg

SEQ ID NO: 25123 - DNA, 25 bp, Homo sapien
tgcgttcagcctccaagaaagtggc

SEQ ID NO: 25124 - DNA, 25 bp, Homo sapien
cagaagagcccagcgcgtgcaccat

SEQ ID NO: 25125 - DNA, 25 bp, Homo sapien
tagtttcggcgtcaggcgttttgaa

SEQ ID NO: 25126 - DNA, 25 bp, Homo sapien
caggtcctgttttctgcgtaatttt

SEQ ID NO: 25127 - DNA, 25 bp, Homo sapien
tgttcccgtccgtacctccagaaga

SEQ ID NO: 25128 - DNA, 25 bp, Homo sapien
ctacggctttcacgcactcgcagtg

SEQ ID NO: 25129 - DNA, 25 bp, Homo sapien
agcgcttgtgcaaaccgggaagatg

SEQ ID NO: 25130 - DNA, 25 bp, Homo sapien
ggagtcctcgttggatcgaaaattc

SEQ ID NO: 25131 - DNA, 25 bp, Homo sapien
ccgtgattactgactggtttaaaca

SEQ ID NO: 25132 - DNA, 25 bp, Homo sapien
ctgcagagggcgttgcccgacttag

SEQ ID NO: 25133 - DNA, 25 bp, Homo sapien
gtggggcctctgcacgaacacctgc

SEQ ID NO: 25134 - DNA, 25 bp, Homo sapien
gaacacctgcctgtacttgggcccg

SEQ ID NO: 25135 - DNA, 25 bp, Homo sapien
acacctgcctgtacttgggcccgga

SEQ ID NO: 25136 - DNA, 25 bp, Homo sapien
ctgcctgtacttgggcccggagctt

SEQ ID NO: 25137 - DNA, 25 bp, Homo sapien
acttgggcccggagcttggatctct

SEQ ID NO: 25138 - DNA, 25 bp, Homo sapien
agtcatccccggcaatcaggaggca

SEQ ID NO: 25139 - DNA, 25 bp, Homo sapien
cggagcttggatctctgcccagaga

SEQ ID NO: 25140 - DNA, 25 bp, Homo sapien
tgtccgtcagcacgcgagccaatga

SEQ ID NO: 25141 - DNA, 25 bp, Homo sapien
cacctggcgggcgaatccgcaagcg

SEQ ID NO: 25142 - DNA, 25 bp, Homo sapien
cacgaagccttgtcacctggcgggc

SEQ ID NO: 25143 - DNA, 25 bp, Homo sapien
agtcctggcccacgaagccttgtca

SEQ ID NO: 25144 - DNA, 25 bp, Homo sapien
ctcgagagtgacactgcgcatgtgc

SEQ ID NO: 25145 - DNA, 25 bp, Homo sapien
cgccgcgctcgagtctggagctcga

SEQ ID NO: 25146 - DNA, 25 bp, Homo sapien
ggctcctcagatctttcgccggctg

SEQ ID NO: 25147 - DNA, 25 bp, Homo sapien
gtctggagctcgagagtgacactgc

SEQ ID NO: 25148 - DNA, 25 bp, Homo sapien
ccgggctgcttaagtccctagtctc

SEQ ID NO: 25149 - DNA, 25 bp, Homo sapien
cccactgcactcctgaacttggagg

SEQ ID NO: 25150 - DNA, 25 bp, Homo sapien
cctctctctaggagggtgctctcgg

SEQ ID NO: 25151 - DNA, 25 bp, Homo sapien
agtaaagttggaaaacagacccatg

SEQ ID NO: 25152 - DNA, 25 bp, Homo sapien
cctcctaagtcacatagtaaagttg

SEQ ID NO: 25153 - DNA, 25 bp, Homo sapien
agtctgatcccgtggaactctggcc

SEQ ID NO: 25154 - DNA, 25 bp, Homo sapien
agctccggtggcctcggacaatctt

SEQ ID NO: 25155 - DNA, 25 bp, Homo sapien
ggcttcagctcacgcagccgtcggg

SEQ ID NO: 25156 - DNA, 25 bp, Homo sapien
aacgagtgggacactctgcatgctc

SEQ ID NO: 25157 - DNA, 25 bp, Homo sapien
cgtactggaaacgagtgggacactc

SEQ ID NO: 25158 - DNA, 25 bp, Homo sapien
gcaccctccagcgtcaggtgcggat

SEQ ID NO: 25159 - DNA, 25 bp, Homo sapien
tgacactcccgcatcctggattgtg

SEQ ID NO: 25160 - DNA, 25 bp, Homo sapien
gtctccagctgcgtactggaaacga

SEQ ID NO: 25161 - DNA, 25 bp, Homo sapien
tgcatgctcagcgtcctgcgggaaa

SEQ ID NO: 25162 - DNA, 25 bp, Homo sapien
cccgcatcctggattgtggggccac

SEQ ID NO: 25163 - DNA, 25 bp, Homo sapien
gattgtggggccacgcccgaccctg

SEQ ID NO: 25164 - DNA, 25 bp, Homo sapien
gccgagtctctcctggaagccgggc

SEQ ID NO: 25165 - DNA, 25 bp, Homo sapien
tttctgagcacctgaaccctgtggg

SEQ ID NO: 25166 - DNA, 25 bp, Homo sapien
ggctgctgttttctgagcacctgaa

SEQ ID NO: 25167 - DNA, 25 bp, Homo sapien
agtgaactcagtggctgctgttttc

SEQ ID NO: 25168 - DNA, 25 bp, Homo sapien
ggcctgcggaaacagtgaactcagt

SEQ ID NO: 25169 - DNA, 25 bp, Homo sapien
aatacggggcctgcggaaacagtga

SEQ ID NO: 25170 - DNA, 25 bp, Homo sapien
cccagctgagcacggccgggaatac

SEQ ID NO: 25171 - DNA, 25 bp, Homo sapien
ccgctcgcgactccacaagcccagc

SEQ ID NO: 25172 - DNA, 25 bp, Homo sapien
gagcagctcctttatcacggtttta

SEQ ID NO: 25173 - DNA, 25 bp, Homo sapien
cctgcccattggctttgtgtccttg

SEQ ID NO: 25174 - DNA, 25 bp, Homo sapien
ctgctcccgaaggtaccgagagata

SEQ ID NO: 25175 - DNA, 25 bp, Homo sapien
tgacccgtccgtactggtgttatta

SEQ ID NO: 25176 - DNA, 25 bp, Homo sapien
ggggcttccatctcctcaagcggcg

SEQ ID NO: 25177 - DNA, 25 bp, Homo sapien
ccacagtagaggttgagtccgatta

SEQ ID NO: 25178 - DNA, 25 bp, Homo sapien
gaggctctgagtgccggttacgtaa

SEQ ID NO: 25179 - DNA, 25 bp, Homo sapien
gattaccgcgtttcttttgaggcca

SEQ ID NO: 25180 - DNA, 25 bp, Homo sapien
tcgccgtctaaaggtgggctctata

SEQ ID NO: 25181 - DNA, 25 bp, Homo sapien
tgctcagtcaaaatggcggcccttg

SEQ ID NO: 25182 - DNA, 25 bp, Homo sapien
ctcctgtcactagggttgctcagtc

SEQ ID NO: 25183 - DNA, 25 bp, Homo sapien
tccgcagggttctcttcttcttgtt

SEQ ID NO: 25184 - DNA, 25 bp, Homo sapien
agcctgagaccatggcgaccaatcc

SEQ ID NO: 25185 - DNA, 25 bp, Homo sapien
cccagcgtgacgcaaaaagtggcca

SEQ ID NO: 25186 - DNA, 25 bp, Homo sapien
gcgccaaagcagcatgtcgtgttga

SEQ ID NO: 25187 - DNA, 25 bp, Homo sapien
gtcgtgttgaagctcacccagcgtg

SEQ ID NO: 25188 - DNA, 25 bp, Homo sapien
atatagtaggcggagtcaacacacg

SEQ ID NO: 25189 - DNA, 25 bp, Homo sapien
aagatggcggcttcagcagccccca

SEQ ID NO: 25190 - DNA, 25 bp, Homo sapien
agtcgccgccatggccgcagatgcc

SEQ ID NO: 25191 - DNA, 25 bp, Homo sapien
tccgtctcctcaccggggttggcag

SEQ ID NO: 25192 - DNA, 25 bp, Homo sapien
atggccgcagatgccaccgccgccg

SEQ ID NO: 25193 - DNA, 25 bp, Homo sapien
tccgctaccgcggaatccaagatgg

SEQ ID NO: 25194 - DNA, 25 bp, Homo sapien
cgctaccgcggaatccaagatggcg

SEQ ID NO: 25195 - DNA, 25 bp, Homo sapien
cgcctatatagtaggcggagtcaac

SEQ ID NO: 25196 - DNA, 25 bp, Homo sapien
gctgcttagacaggaagctccaccc

SEQ ID NO: 25197 - DNA, 25 bp, Homo sapien
ccgggtgataactgagccgaatttc

SEQ ID NO: 25198 - DNA, 25 bp, Homo sapien
agcgccggctgttgtggcttttccc

SEQ ID NO: 25199 - DNA, 25 bp, Homo sapien
ggagtctctgagtctcccggagtca

SEQ ID NO: 25200 - DNA, 25 bp, Homo sapien
gcgcccgcttcagtggctgcttaga

SEQ ID NO: 25201 - DNA, 25 bp, Homo sapien
ggtggcctgaggcatctgactcttt

SEQ ID NO: 25202 - DNA, 25 bp, Homo sapien
ttctcaggcgttggctctcatggag

SEQ ID NO: 25203 - DNA, 25 bp, Homo sapien
aggcagagccgtgttctcaggcgtt

SEQ ID NO: 25204 - DNA, 25 bp, Homo sapien
cgcatgcgtagttaccttagttttc

SEQ ID NO: 25205 - DNA, 25 bp, Homo sapien
cttagttttcgtcgcctctgagggg

SEQ ID NO: 25206 - DNA, 25 bp, Homo sapien
cggctttggatttgaccccgtcagg

SEQ ID NO: 25207 - DNA, 25 bp, Homo sapien
ctcggtaatatactggccacgccta

SEQ ID NO: 25208 - DNA, 25 bp, Homo sapien
tcgcggtgaccggaacggcactaaa

SEQ ID NO: 25209 - DNA, 25 bp, Homo sapien
cgtcaggctaccgtcgcggtgaccg

SEQ ID NO: 25210 - DNA, 25 bp, Homo sapien
aaggctctgccttaacgcatgcgta

SEQ ID NO: 25211 - DNA, 25 bp, Homo sapien
gcggcggagactcggtaatatactg

SEQ ID NO: 25212 - DNA, 25 bp, Homo sapien
tgctccgtgtactccgtctgctcgg

SEQ ID NO: 25213 - DNA, 25 bp, Homo sapien
cgccagggtgggcacattcccactt

SEQ ID NO: 25214 - DNA, 25 bp, Homo sapien
tgcgctagagaaaccgccgacctgg

SEQ ID NO: 25215 - DNA, 25 bp, Homo sapien
cgagcccagtcgagctgagcccgag

SEQ ID NO: 25216 - DNA, 25 bp, Homo sapien
cgacacagacgcactggatgccgcg

SEQ ID NO: 25217 - DNA, 25 bp, Homo sapien
cgggaaagcttctccggctcagggc

SEQ ID NO: 25218 - DNA, 25 bp, Homo sapien
cctgttgcccgggaaagcttctccg

SEQ ID NO: 25219 - DNA, 25 bp, Homo sapien
acgcccgtcaccttgcgctagagaa

SEQ ID NO: 25220 - DNA, 25 bp, Homo sapien
tgcatgcgtcgtcggcctctgggca

SEQ ID NO: 25221 - DNA, 25 bp, Homo sapien
gcatttaaaagacagcgtgagactc

SEQ ID NO: 25222 - DNA, 25 bp, Homo sapien
aagacagcgtgagactcgcgccctc

SEQ ID NO: 25223 - DNA, 25 bp, Homo sapien
cctccggcacggaaaaggccaggcg

SEQ ID NO: 25224 - DNA, 25 bp, Homo sapien
cgacaggtgtcgcttgaaaagactg

SEQ ID NO: 25225 - DNA, 25 bp, Homo sapien
cttgaaaagactgggcttgtccttg

SEQ ID NO: 25226 - DNA, 25 bp, Homo sapien
ccctggtgtaagagatgtgccagcg

SEQ ID NO: 25227 - DNA, 25 bp, Homo sapien
ggcttgtccttgctggtgcatgcgt

SEQ ID NO: 25228 - DNA, 25 bp, Homo sapien
ggctgcattcgtcggggaaacctct

SEQ ID NO: 25229 - DNA, 25 bp, Homo sapien
tgactctggcctctagtccctgagt

SEQ ID NO: 25230 - DNA, 25 bp, Homo sapien
cgaacgactgatccctcagaaaaca

SEQ ID NO: 25231 - DNA, 25 bp, Homo sapien
gccggaaagacgtcccaggagcctc

SEQ ID NO: 25232 - DNA, 25 bp, Homo sapien
tccctcggttgctagggacattgcg

SEQ ID NO: 25233 - DNA, 25 bp, Homo sapien
cagaaaacaatccttccctcggttg

SEQ ID NO: 25234 - DNA, 25 bp, Homo sapien
acattgcggagttgcgggactacgt

SEQ ID NO: 25235 - DNA, 25 bp, Homo sapien
ttggcctcgccggaaagacgtccca

SEQ ID NO: 25236 - DNA, 25 bp, Homo sapien
ggtcctgctgctgaatctgggtccc

SEQ ID NO: 25237 - DNA, 25 bp, Homo sapien
agaatgatgccatggccgacgccga

SEQ ID NO: 25238 - DNA, 25 bp, Homo sapien
aatcctagaggacgagaatgatgcc

SEQ ID NO: 25239 - DNA, 25 bp, Homo sapien
cccggaagacaaggataatcctaga

SEQ ID NO: 25240 - DNA, 25 bp, Homo sapien
gacccagactccgaccgaaatgcag

SEQ ID NO: 25241 - DNA, 25 bp, Homo sapien
tcaaacgacccggtgggtctacagc

SEQ ID NO: 25242 - DNA, 25 bp, Homo sapien
atgcagcgggtcagtttacgctttg

SEQ ID NO: 25243 - DNA, 25 bp, Homo sapien
gctttagccggtcgtccgccattaa

SEQ ID NO: 25244 - DNA, 25 bp, Homo sapien
ctctggactgcggaggcactgcact

SEQ ID NO: 25245 - DNA, 25 bp, Homo sapien
ccatccagacgttcagctacagctg

SEQ ID NO: 25246 - DNA, 25 bp, Homo sapien
gagaactggagaatgcggacaccta

SEQ ID NO: 25247 - DNA, 25 bp, Homo sapien
ggagcgtggatgactacggccaccc

SEQ ID NO: 25248 - DNA, 25 bp, Homo sapien
cggacacctagatgaggccctggca

SEQ ID NO: 25249 - DNA, 25 bp, Homo sapien
cgccaggcatttcggggcaaaacga

SEQ ID NO: 25250 - DNA, 25 bp, Homo sapien
acgttccctttactcgccaggcatt

SEQ ID NO: 25251 - DNA, 25 bp, Homo sapien
ggccaggggaccaactgcacggcct

SEQ ID NO: 25252 - DNA, 25 bp, Homo sapien
tggcgccaacaccagacctaggatc

SEQ ID NO: 25253 - DNA, 25 bp, Homo sapien
ccctcagcagttcgccaggttcttg

SEQ ID NO: 25254 - DNA, 25 bp, Homo sapien
ccgtccttgacagggagtcttaact

SEQ ID NO: 25255 - DNA, 25 bp, Homo sapien
cgcgcaagatacgtaaccagcagtc

SEQ ID NO: 25256 - DNA, 25 bp, Homo sapien
ccgttaaatagtcctgcctagcatg

SEQ ID NO: 25257 - DNA, 25 bp, Homo sapien
agcatgcctcggtgacgcacttttc

SEQ ID NO: 25258 - DNA, 25 bp, Homo sapien
ggggtgcatcatctttctgttagaa

SEQ ID NO: 25259 - DNA, 25 bp, Homo sapien
ccagaaatcttactcgcggcgcctt

SEQ ID NO: 25260 - DNA, 25 bp, Homo sapien
cagtggctgcagacacggctgtatt

SEQ ID NO: 25261 - DNA, 25 bp, Homo sapien
ctcccactcttctgtcgaggacagg

SEQ ID NO: 25262 - DNA, 25 bp, Homo sapien
ccctgaaatgctggctcactgagga

SEQ ID NO: 25263 - DNA, 25 bp, Homo sapien
aaggcccgaggactctggacacagc

SEQ ID NO: 25264 - DNA, 25 bp, Homo sapien
agaggcacgtcccagacccagaagg

SEQ ID NO: 25265 - DNA, 25 bp, Homo sapien
cctacacagtaggagaggcacgtcc

SEQ ID NO: 25266 - DNA, 25 bp, Homo sapien
gcttcagggacaactggggcttctc

SEQ ID NO: 25267 - DNA, 25 bp, Homo sapien
aaacgtcctgaagagcgtccagctc

SEQ ID NO: 25268 - DNA, 25 bp, Homo sapien
cgctgagttcgcaatccgtggttgt

SEQ ID NO: 25269 - DNA, 25 bp, Homo sapien
tttgcacgagccaacccttcagagg

SEQ ID NO: 25270 - DNA, 25 bp, Homo sapien
agcccaattgaacgaggtgcccaga

SEQ ID NO: 25271 - DNA, 25 bp, Homo sapien
gcgactcgacgaaagcccaattgaa

SEQ ID NO: 25272 - DNA, 25 bp, Homo sapien
ggagcgcgcctcaaataatcccttt

SEQ ID NO: 25273 - DNA, 25 bp, Homo sapien
gccaggttttccacgctctctacgg

SEQ ID NO: 25274 - DNA, 25 bp, Homo sapien
ggtctcggagccctagtttccttgc

SEQ ID NO: 25275 - DNA, 25 bp, Homo sapien
cccttcagagggtgctcagattccg

SEQ ID NO: 25276 - DNA, 25 bp, Homo sapien
agccaccgtagggactgtcggccaa

SEQ ID NO: 25277 - DNA, 25 bp, Homo sapien
tctgggcgcaaggtcccagcagcca

SEQ ID NO: 25278 - DNA, 25 bp, Homo sapien
ttgggcgattaacaggccgtggtta

SEQ ID NO: 25279 - DNA, 25 bp, Homo sapien
ttttttgcttggctacccggagtga

SEQ ID NO: 25280 - DNA, 25 bp, Homo sapien
cgcatgcgcagtgctcggatttttt

SEQ ID NO: 25281 - DNA, 25 bp, Homo sapien
agcctcccgattggttttgctcctt

SEQ ID NO: 25282 - DNA, 25 bp, Homo sapien
gtgaccattagcagcctcccgattg

SEQ ID NO: 25283 - DNA, 25 bp, Homo sapien
aaccggattgaaagagagccaggcc

SEQ ID NO: 25284 - DNA, 25 bp, Homo sapien
caggctggcttctttctaagcgaca

SEQ ID NO: 25285 - DNA, 25 bp, Homo sapien
tcgcgacctaaaatggtgtccgttc

SEQ ID NO: 25286 - DNA, 25 bp, Homo sapien
acggcatcagtgacacgggtttagc

SEQ ID NO: 25287 - DNA, 25 bp, Homo sapien
caccacacagaagctgggttcctta

SEQ ID NO: 25288 - DNA, 25 bp, Homo sapien
tgggttccttacattcgcgaaagtg

SEQ ID NO: 25289 - DNA, 25 bp, Homo sapien
cagccaatggggagaggtatcttca

SEQ ID NO: 25290 - DNA, 25 bp, Homo sapien
agcggcagtatttagggccaaccca

SEQ ID NO: 25291 - DNA, 25 bp, Homo sapien
gggcgaaactcctggcctgttgtaa

SEQ ID NO: 25292 - DNA, 25 bp, Homo sapien
gtgagtcgctttctgtgcctcctcc

SEQ ID NO: 25293 - DNA, 25 bp, Homo sapien
tcgccacttgcacccagcctcggaa

SEQ ID NO: 25294 - DNA, 25 bp, Homo sapien
gaagcggaagctgactgtggacacc

SEQ ID NO: 25295 - DNA, 25 bp, Homo sapien
tggtggccccatgtttcgcaggttc

SEQ ID NO: 25296 - DNA, 25 bp, Homo sapien
aagttgaaagcagggaggaatgtac

SEQ ID NO: 25297 - DNA, 25 bp, Homo sapien
aggaatgtacgtgtgagtcgctttc

SEQ ID NO: 25298 - DNA, 25 bp, Homo sapien
acgtgtgagtcgctttctgtgcctc

SEQ ID NO: 25299 - DNA, 25 bp, Homo sapien
ccagcagaaggttgtgagcagccct

SEQ ID NO: 25300 - DNA, 25 bp, Homo sapien
cggggaagacgttctttctgactgc

SEQ ID NO: 25301 - DNA, 25 bp, Homo sapien
cgactcgaggccgtggttctgcctc

SEQ ID NO: 25302 - DNA, 25 bp, Homo sapien
tttcgccgttagaggcccgactcga

SEQ ID NO: 25303 - DNA, 25 bp, Homo sapien
cggtccaaccgcgtcagtcttttcg

SEQ ID NO: 25304 - DNA, 25 bp, Homo sapien
ttaacatttcgggaatggcgcggtc

SEQ ID NO: 25305 - DNA, 25 bp, Homo sapien
gacgatgcggagtttaagctcctta

SEQ ID NO: 25306 - DNA, 25 bp, Homo sapien
cctacttatcttggaggacgatgcg

SEQ ID NO: 25307 - DNA, 25 bp, Homo sapien
tctgactgcccttttcctacttatc

SEQ ID NO: 25308 - DNA, 25 bp, Homo sapien
gtgactcccgatgagcgtccagttg

SEQ ID NO: 25309 - DNA, 25 bp, Homo sapien
ccacttccctgatgtggcggcgaac

SEQ ID NO: 25310 - DNA, 25 bp, Homo sapien
acaccgagttgatacggatagtccc

SEQ ID NO: 25311 - DNA, 25 bp, Homo sapien
cgcactgcggtgagtgctgctcctt

SEQ ID NO: 25312 - DNA, 25 bp, Homo sapien
agccgcgcagcttccgtgtttgctg

SEQ ID NO: 25313 - DNA, 25 bp, Homo sapien
gtatctccttgtcggcgccgctgat

SEQ ID NO: 25314 - DNA, 25 bp, Homo sapien
acgtcatcgtgcgtcagagtgagcc

SEQ ID NO: 25315 - DNA, 25 bp, Homo sapien
tctttcccggaggttcatcgccgca

SEQ ID NO: 25316 - DNA, 25 bp, Homo sapien
aactcatgcgctgggcgtcagaaac

SEQ ID NO: 25317 - DNA, 25 bp, Homo sapien
ccctacgtcatctcccacaacagcc

SEQ ID NO: 25318 - DNA, 25 bp, Homo sapien
tctcccacaacagcccatcctgagg

SEQ ID NO: 25319 - DNA, 25 bp, Homo sapien
ttcaatccccggtttctgcaaagtg

SEQ ID NO: 25320 - DNA, 25 bp, Homo sapien
cccggtttctgcaaagtggagcggg

SEQ ID NO: 25321 - DNA, 25 bp, Homo sapien
ggaactcatgcgctgggcgtcagaa

SEQ ID NO: 25322 - DNA, 25 bp, Homo sapien
tgcgctgggcgtcagaaacccggca

SEQ ID NO: 25323 - DNA, 25 bp, Homo sapien
tagcggaactcatgcgctgggcgtc

SEQ ID NO: 25324 - DNA, 25 bp, Homo sapien
ctttacagaggtccaatcacgcgga

SEQ ID NO: 25325 - DNA, 25 bp, Homo sapien
ccgtgactaagatggaagcgttttt

SEQ ID NO: 25326 - DNA, 25 bp, Homo sapien
caggacagttttaccgcattccgtc

SEQ ID NO: 25327 - DNA, 25 bp, Homo sapien
ggatccggcgtctgcactttacaga

SEQ ID NO: 25328 - DNA, 25 bp, Homo sapien
tcacgcggacccagtaagttctcgg

SEQ ID NO: 25329 - DNA, 25 bp, Homo sapien
acggctccttggctcgtttccgcaa

SEQ ID NO: 25330 - DNA, 25 bp, Homo sapien
ttggcgcaagcgctttcattttttc

SEQ ID NO: 25331 - DNA, 25 bp, Homo sapien
cagacatgctgggatcctacggctc

SEQ ID NO: 25332 - DNA, 25 bp, Homo sapien
gaacgcctcgccgagcgaaaagata

SEQ ID NO: 25333 - DNA, 25 bp, Homo sapien
gagggatacggctcgtcacttccgc

SEQ ID NO: 25334 - DNA, 25 bp, Homo sapien
gaggtaaccgttgaaagctcgtctc

SEQ ID NO: 25335 - DNA, 25 bp, Homo sapien
tagtctgacccgaggaaggcgccgt

SEQ ID NO: 25336 - DNA, 25 bp, Homo sapien
gtcgccgccggtagtctgacccgag

SEQ ID NO: 25337 - DNA, 25 bp, Homo sapien
ggagagagaaggctcgctcgctcac

SEQ ID NO: 25338 - DNA, 25 bp, Homo sapien
tttcacggcctcccaattggtcgga

SEQ ID NO: 25339 - DNA, 25 bp, Homo sapien
tcgccgagcgaaaagataacggaac

SEQ ID NO: 25340 - DNA, 25 bp, Homo sapien
gggtgaagagcaccgaagtccagaa

SEQ ID NO: 25341 - DNA, 25 bp, Homo sapien
ggtgggattcgaggtctgaaccctc

SEQ ID NO: 25342 - DNA, 25 bp, Homo sapien
gtgaagagcaccgaagtccagaaaa

SEQ ID NO: 25343 - DNA, 25 bp, Homo sapien
tgcgctcctctgctggcgcccgcaa

SEQ ID NO: 25344 - DNA, 25 bp, Homo sapien
aaaagggcagtgtccgccctgcgct

SEQ ID NO: 25345 - DNA, 25 bp, Homo sapien
tccagaaaagggcagtgtccgccct

SEQ ID NO: 25346 - DNA, 25 bp, Homo sapien
gtgggattcgaggtctgaaccctcg

SEQ ID NO: 25347 - DNA, 25 bp, Homo sapien
aagagcaccgaagtccagaaaaggg

SEQ ID NO: 25348 - DNA, 25 bp, Homo sapien
agcccgtgggtccacgtgacctggc

SEQ ID NO: 25349 - DNA, 25 bp, Homo sapien
ttggccggcggtcactcgcgaccat

SEQ ID NO: 25350 - DNA, 25 bp, Homo sapien
ggtcactcgcgaccatccgcgacgc

SEQ ID NO: 25351 - DNA, 25 bp, Homo sapien
cagcccgtgggtccacgtgacctgg

SEQ ID NO: 25352 - DNA, 25 bp, Homo sapien
tccacgtgacctggcccgcccttcg

SEQ ID NO: 25353 - DNA, 25 bp, Homo sapien
ggtggagctccgcagcggagtaaca

SEQ ID NO: 25354 - DNA, 25 bp, Homo sapien
cagcggagtaacaggttggtgggag

SEQ ID NO: 25355 - DNA, 25 bp, Homo sapien
cccaaaatggcctccgcgcccctcg

SEQ ID NO: 25356 - DNA, 25 bp, Homo sapien
tcctcgcctatcgttagttctctgc

SEQ ID NO: 25357 - DNA, 25 bp, Homo sapien
ttttattcttttgcctgcgacgggc

SEQ ID NO: 25358 - DNA, 25 bp, Homo sapien
cgtgttggctgacatcacctggtgc

SEQ ID NO: 25359 - DNA, 25 bp, Homo sapien
tcgctgtcttctccgttttgtattc

SEQ ID NO: 25360 - DNA, 25 bp, Homo sapien
ggcggcggtaagaaaaagcgctctc

SEQ ID NO: 25361 - DNA, 25 bp, Homo sapien
gtgtaccctggtggacgtgcaccca

SEQ ID NO: 25362 - DNA, 25 bp, Homo sapien
ttctctgcgaaaccgcgaactgggg

SEQ ID NO: 25363 - DNA, 25 bp, Homo sapien
tccctgccctttggtaggacactgc

SEQ ID NO: 25364 - DNA, 25 bp, Homo sapien
ggccttgcttccgaactgcgtctta

SEQ ID NO: 25365 - DNA, 25 bp, Homo sapien
ctacggcttcaacgtgcggggccaa

SEQ ID NO: 25366 - DNA, 25 bp, Homo sapien
gtccgagtccggctacggcttcaac

SEQ ID NO: 25367 - DNA, 25 bp, Homo sapien
tcgtgcgcatcgtcaagtccgagtc

SEQ ID NO: 25368 - DNA, 25 bp, Homo sapien
acggggaagggattcatccctcagc

SEQ ID NO: 25369 - DNA, 25 bp, Homo sapien
acggtgcccgattgtccgcttttcg

SEQ ID NO: 25370 - DNA, 25 bp, Homo sapien
agcatcaacggggagctgtacgcgc

SEQ ID NO: 25371 - DNA, 25 bp, Homo sapien
ctgcgtcttataacctcggctcagg

SEQ ID NO: 25372 - DNA, 25 bp, Homo sapien
agcgtccaccaaagtgtagctgccc

SEQ ID NO: 25373 - DNA, 25 bp, Homo sapien
ttgacgaccgcagcaagatggagac

SEQ ID NO: 25374 - DNA, 25 bp, Homo sapien
cgaaaattcaaggtgggtgcgcccg

SEQ ID NO: 25375 - DNA, 25 bp, Homo sapien
cccagactgggaagagagccgccga

SEQ ID NO: 25376 - DNA, 25 bp, Homo sapien
ggagcctgttccctgataaagtggg

SEQ ID NO: 25377 - DNA, 25 bp, Homo sapien
cccggcggacctctaggcgtctgat

SEQ ID NO: 25378 - DNA, 25 bp, Homo sapien
taggcgtctgatcccagcacagagc

SEQ ID NO: 25379 - DNA, 25 bp, Homo sapien
agatggagacgctgccaggcttgct

SEQ ID NO: 25380 - DNA, 25 bp, Homo sapien
ccgccatgttcacaggcacagaatg

SEQ ID NO: 25381 - DNA, 25 bp, Homo sapien
tccaccagcttatagacgcgatgtc

SEQ ID NO: 25382 - DNA, 25 bp, Homo sapien
caggttttctttgggccgatgcttc

SEQ ID NO: 25383 - DNA, 25 bp, Homo sapien
cggtaagctagtctccacaaggaac

SEQ ID NO: 25384 - DNA, 25 bp, Homo sapien
tcccagtgcgcctccagaaacaata

SEQ ID NO: 25385 - DNA, 25 bp, Homo sapien
agactcagccctcacccgattttga

SEQ ID NO: 25386 - DNA, 25 bp, Homo sapien
ttcccttcatgtcgcggccgcagta

SEQ ID NO: 25387 - DNA, 25 bp, Homo sapien
caccgactgcgtcaggatgagctcc

SEQ ID NO: 25388 - DNA, 25 bp, Homo sapien
cccaggagctggagttcctacgcgt

SEQ ID NO: 25389 - DNA, 25 bp, Homo sapien
agctggagccgtagattccgtgcct

SEQ ID NO: 25390 - DNA, 25 bp, Homo sapien
ggctccctttcagatcgaagacctg

SEQ ID NO: 25391 - DNA, 25 bp, Homo sapien
gtctcgtgagcctgtgtcctagcag

SEQ ID NO: 25392 - DNA, 25 bp, Homo sapien
ccggaaaggccttggagcagaagcc

SEQ ID NO: 25393 - DNA, 25 bp, Homo sapien
gccaagcgtaacctgcggaaggaga

SEQ ID NO: 25394 - DNA, 25 bp, Homo sapien
gctccagggcacattgtcagataga

SEQ ID NO: 25395 - DNA, 25 bp, Homo sapien
gcgccaagtactcggcccaggtatg

SEQ ID NO: 25396 - DNA, 25 bp, Homo sapien
tttctgtaccagagcccaacttggg

SEQ ID NO: 25397 - DNA, 25 bp, Homo sapien
gccgagtcccattgttccgagggca

SEQ ID NO: 25398 - DNA, 25 bp, Homo sapien
ccaggcaatttcctcagcaggcggc

SEQ ID NO: 25399 - DNA, 25 bp, Homo sapien
agacacacgcggaactttctgtacc

SEQ ID NO: 25400 - DNA, 25 bp, Homo sapien
ggtgactggtccaaacctcagtttc

SEQ ID NO: 25401 - DNA, 25 bp, Homo sapien
ccgcgggcctaggtagacatatttt

SEQ ID NO: 25402 - DNA, 25 bp, Homo sapien
cttgcggtaactcaacaggttatgc

SEQ ID NO: 25403 - DNA, 25 bp, Homo sapien
cgaccgccgcatccaaaaagcgaga

SEQ ID NO: 25404 - DNA, 25 bp, Homo sapien
attcctttgcggaggcacggacaca

SEQ ID NO: 25405 - DNA, 25 bp, Homo sapien
gccgctgcccaattacccggatgga

SEQ ID NO: 25406 - DNA, 25 bp, Homo sapien
tggaatccaaagcaggcccaccctg

SEQ ID NO: 25407 - DNA, 25 bp, Homo sapien
tgagtggcaccgttcgcaaaaattg

SEQ ID NO: 25408 - DNA, 25 bp, Homo sapien
accgaggcatgagagcgttgaatca

SEQ ID NO: 25409 - DNA, 25 bp, Homo sapien
tcgcagaccacctctaggccaatta

SEQ ID NO: 25410 - DNA, 25 bp, Homo sapien
ttgttaactgagaccgcacctgctg

SEQ ID NO: 25411 - DNA, 25 bp, Homo sapien
agggctgcccatgaccctgtctttc

SEQ ID NO: 25412 - DNA, 25 bp, Homo sapien
aatcctcgttgaagatggggttggc

SEQ ID NO: 25413 - DNA, 25 bp, Homo sapien
atcccgtctcagatgggagtgctcg

SEQ ID NO: 25414 - DNA, 25 bp, Homo sapien
gccgagagggtccaaatcccgtctc

SEQ ID NO: 25415 - DNA, 25 bp, Homo sapien
ctttttccaagagccacatgcggtg

SEQ ID NO: 25416 - DNA, 25 bp, Homo sapien
gagaacaggccggaaggcgcccaac

SEQ ID NO: 25417 - DNA, 25 bp, Homo sapien
tatcggccgagctcgctttttctgg

SEQ ID NO: 25418 - DNA, 25 bp, Homo sapien
tgcacttgaccacgcggctctgctg

SEQ ID NO: 25419 - DNA, 25 bp, Homo sapien
cccggcctgatattcggtggagagc

SEQ ID NO: 25420 - DNA, 25 bp, Homo sapien
aagagcaccgtgttccgaccctctg

SEQ ID NO: 25421 - DNA, 25 bp, Homo sapien
aaggcagcattgattctccgccacc

SEQ ID NO: 25422 - DNA, 25 bp, Homo sapien
accctcagagcggtctccggaaggc

SEQ ID NO: 25423 - DNA, 25 bp, Homo sapien
gagcggtctccggaaggctccgcca

SEQ ID NO: 25424 - DNA, 25 bp, Homo sapien
gcggagccaccaagagcaccgtgtt

SEQ ID NO: 25425 - DNA, 25 bp, Homo sapien
ctgccctgggatccgagctagcgac

SEQ ID NO: 25426 - DNA, 25 bp, Homo sapien
accaccgagcacaaaggcagcattg

SEQ ID NO: 25427 - DNA, 25 bp, Homo sapien
ctgggatccgagctagcgaccctct

SEQ ID NO: 25428 - DNA, 25 bp, Homo sapien
atgacccagggcgtacgcagtgctc

SEQ ID NO: 25429 - DNA, 25 bp, Homo sapien
aaggctctgttaccgcaggcgtgtt

SEQ ID NO: 25430 - DNA, 25 bp, Homo sapien
ttgctctagccctggacggcgcact

SEQ ID NO: 25431 - DNA, 25 bp, Homo sapien
acaagagcgcgcgtgcgagttaacc

SEQ ID NO: 25432 - DNA, 25 bp, Homo sapien
gggcatcgctgttgagtctatcttc

SEQ ID NO: 25433 - DNA, 25 bp, Homo sapien
tctatcttctggttccggccttttc

SEQ ID NO: 25434 - DNA, 25 bp, Homo sapien
cttccggggcttctcaaaggcaaga

SEQ ID NO: 25435 - DNA, 25 bp, Homo sapien
aggctttgcggtcatccttcccaca

SEQ ID NO: 25436 - DNA, 25 bp, Homo sapien
gttcaggcgcaccaataccacggtc

SEQ ID NO: 25437 - DNA, 25 bp, Homo sapien
cccggagcactgagcagcggattcc

SEQ ID NO: 25438 - DNA, 25 bp, Homo sapien
cagaaacgcctgtttggccgacgga

SEQ ID NO: 25439 - DNA, 25 bp, Homo sapien
tacccgcgcctacttgggcggtaca

SEQ ID NO: 25440 - DNA, 25 bp, Homo sapien
tacagccgggagcaggctacgaaca

SEQ ID NO: 25441 - DNA, 25 bp, Homo sapien
gctacgaacatgcagacccggcctg

SEQ ID NO: 25442 - DNA, 25 bp, Homo sapien
cctgcgagcggaacccaccaagaaa

SEQ ID NO: 25443 - DNA, 25 bp, Homo sapien
gtgggagtaaagcaacgcaaacata

SEQ ID NO: 25444 - DNA, 25 bp, Homo sapien
cgctggcgcagaaccagaggtaacc

SEQ ID NO: 25445 - DNA, 25 bp, Homo sapien
cgacctcagaggcactatcagatta

SEQ ID NO: 25446 - DNA, 25 bp, Homo sapien
cacgtggagtcctatcgacctcaga

SEQ ID NO: 25447 - DNA, 25 bp, Homo sapien
attacttgctggatgaccctgcagg

SEQ ID NO: 25448 - DNA, 25 bp, Homo sapien
ctacgggtctaggaattacttgctg

SEQ ID NO: 25449 - DNA, 25 bp, Homo sapien
tgcggccacctacgggtctaggaat

SEQ ID NO: 25450 - DNA, 25 bp, Homo sapien
agaggtaaccggctctgcggccacc

SEQ ID NO: 25451 - DNA, 25 bp, Homo sapien
gcactatcagattagccctaggagg

SEQ ID NO: 25452 - DNA, 25 bp, Homo sapien
gcggcgacgggctaaagtttcagtc

SEQ ID NO: 25453 - DNA, 25 bp, Homo sapien
aacttgctcctaggcgtctctgggc

SEQ ID NO: 25454 - DNA, 25 bp, Homo sapien
tgccttaaacttgctcctaggcgtc

SEQ ID NO: 25455 - DNA, 25 bp, Homo sapien
aaatgtcccttttctggtgtacaga

SEQ ID NO: 25456 - DNA, 25 bp, Homo sapien
ccctggggctagacgaccaagttct

SEQ ID NO: 25457 - DNA, 25 bp, Homo sapien
ccgggtgcttactgaaactttgatt

SEQ ID NO: 25458 - DNA, 25 bp, Homo sapien
cgtctgccgggtgcttactgaaact

SEQ ID NO: 25459 - DNA, 25 bp, Homo sapien
cagtcccgttgggtcttggccgtct

SEQ ID NO: 25460 - DNA, 25 bp, Homo sapien
acggaattttctgtcacgctcttgg

SEQ ID NO: 25461 - DNA, 25 bp, Homo sapien
aggaattttctgtcacgctcttggc

SEQ ID NO: 25462 - DNA, 25 bp, Homo sapien
gcggaattttctgtcacgctcttgg

SEQ ID NO: 25463 - DNA, 25 bp, Homo sapien
ggaattttctgtcacgctcttggcg

SEQ ID NO: 25464 - DNA, 25 bp, Homo sapien
cggaattttctgtcacgctcttggc

SEQ ID NO: 25465 - DNA, 25 bp, Homo sapien
ttcctcctcgcggaattttctgtca

SEQ ID NO: 25466 - DNA, 25 bp, Homo sapien
gcggaattttctgtcgcgctcctgg

SEQ ID NO: 25467 - DNA, 25 bp, Homo sapien
agctgttcctcctcgcggaattttc

SEQ ID NO: 25468 - DNA, 25 bp, Homo sapien
tctctggttcctgactgcgcagttc

SEQ ID NO: 25469 - DNA, 25 bp, Homo sapien
cggagctgctcttcctctaggattt

SEQ ID NO: 25470 - DNA, 25 bp, Homo sapien
ctccaggaattttctgtcacgctct

SEQ ID NO: 25471 - DNA, 25 bp, Homo sapien
tgctccgtttcttggcgcagctgtt

SEQ ID NO: 25472 - DNA, 25 bp, Homo sapien
ctgcgcagttcctgttcgcggaatt

SEQ ID NO: 25473 - DNA, 25 bp, Homo sapien
ggaggaattttctctgccgttgctg

SEQ ID NO: 25474 - DNA, 25 bp, Homo sapien
ggcggcgcactttctgttcctctaa

SEQ ID NO: 25475 - DNA, 25 bp, Homo sapien
ctaggatttttctgtagcgttcttg

SEQ ID NO: 25476 - DNA, 25 bp, Homo sapien
cctgctcgcgtcttagttgttgctc

SEQ ID NO: 25477 - DNA, 25 bp, Homo sapien
tcgggatgcggctcttaatccgctc

SEQ ID NO: 25478 - DNA, 25 bp, Homo sapien
ggagaaaccgttgttcccgctgctg

SEQ ID NO: 25479 - DNA, 25 bp, Homo sapien
gggcctcgagtagactttgctttgc

SEQ ID NO: 25480 - DNA, 25 bp, Homo sapien
agactttgctttgccgtgcgtcggc

SEQ ID NO: 25481 - DNA, 25 bp, Homo sapien
ctagctgccactgccacttcgggat

SEQ ID NO: 25482 - DNA, 25 bp, Homo sapien
ctcctggagctgttgggcacgctcc

SEQ ID NO: 25483 - DNA, 25 bp, Homo sapien
gttgttgctcgctcctcaaccgctg

SEQ ID NO: 25484 - DNA, 25 bp, Homo sapien
actcctcagtttcgtgacctttgca

SEQ ID NO: 25485 - DNA, 25 bp, Homo sapien
cgccttcgcagttgctcttcgtctg

SEQ ID NO: 25486 - DNA, 25 bp, Homo sapien
gctcttcgtctggaaactcctcagt

SEQ ID NO: 25487 - DNA, 25 bp, Homo sapien
ctttgcaactctgcagctgctcttc

SEQ ID NO: 25488 - DNA, 25 bp, Homo sapien
ttcttgccattcttgcctttgccgc

SEQ ID NO: 25489 - DNA, 25 bp, Homo sapien
cggcgctgcctgtcgcgctgttcaa

SEQ ID NO: 25490 - DNA, 25 bp, Homo sapien
gcctttgctgctgtttctcctcgcg

SEQ ID NO: 25491 - DNA, 25 bp, Homo sapien
gctcttcccgttcttgccattcttg

SEQ ID NO: 25492 - DNA, 25 bp, Homo sapien
gtggccaacgtcacctgcgtgaaca

SEQ ID NO: 25493 - DNA, 25 bp, Homo sapien
tgcgtgggtgacaaccgtgtcgtcc

SEQ ID NO: 25494 - DNA, 25 bp, Homo sapien
gacaaccgtgtcgtcctgctggacc

SEQ ID NO: 25495 - DNA, 25 bp, Homo sapien
aaagcctgtggccaacgtcacctgc

SEQ ID NO: 25496 - DNA, 25 bp, Homo sapien
tgcgtgaacaagcacctgcccatca

SEQ ID NO: 25497 - DNA, 25 bp, Homo sapien
ctgcccatcaaagtgtcggacccga

SEQ ID NO: 25498 - DNA, 25 bp, Homo sapien
acttccactatgagtgcgagtgtga

SEQ ID NO: 25499 - DNA, 25 bp, Homo sapien
tcctgctggacccaaagcctgtggc

SEQ ID NO: 25500 - DNA, 25 bp, Homo sapien
tccctgttctgctcagttgggggtc

SEQ ID NO: 25501 - DNA, 25 bp, Homo sapien
aatcctgtttctggctccaggccag

SEQ ID NO: 25502 - DNA, 25 bp, Homo sapien
cagcgccggctccgaaaccttccca

SEQ ID NO: 25503 - DNA, 25 bp, Homo sapien
cctgggagcttcctgcagcgtgggg

SEQ ID NO: 25504 - DNA, 25 bp, Homo sapien
gcgcgcgtttcacgggtttcgccgc

SEQ ID NO: 25505 - DNA, 25 bp, Homo sapien
aagcgggaactgcagctcggccgag

SEQ ID NO: 25506 - DNA, 25 bp, Homo sapien
gcggtggcggaggaactacccagga

SEQ ID NO: 25507 - DNA, 25 bp, Homo sapien
gcgggttcgggtgcttttctctctg

SEQ ID NO: 25508 - DNA, 25 bp, Homo sapien
ctcagccggagcactggtgaacaca

SEQ ID NO: 25509 - DNA, 25 bp, Homo sapien
accaaagggtcccagcgcctagagg

SEQ ID NO: 25510 - DNA, 25 bp, Homo sapien
gggctgcggaaagctcctacaatac

SEQ ID NO: 25511 - DNA, 25 bp, Homo sapien
ttctctgttaggatcacggggactg

SEQ ID NO: 25512 - DNA, 25 bp, Homo sapien
gacatcagtggcctcccttggtaga

SEQ ID NO: 25513 - DNA, 25 bp, Homo sapien
cctcaggaatctggcctcagccgga

SEQ ID NO: 25514 - DNA, 25 bp, Homo sapien
cctccttgttctggtgtgatccgaa

SEQ ID NO: 25515 - DNA, 25 bp, Homo sapien
gccatcggcctaggtctttcgtatc

SEQ ID NO: 25516 - DNA, 25 bp, Homo sapien
catgctgaccatagcgggaagacga

SEQ ID NO: 25517 - DNA, 25 bp, Homo sapien
gggagccagacccatgctgaccata

SEQ ID NO: 25518 - DNA, 25 bp, Homo sapien
cccgaagactgacgggagccagacc

SEQ ID NO: 25519 - DNA, 25 bp, Homo sapien
ccttgtcggccgtggcccgaagact

SEQ ID NO: 25520 - DNA, 25 bp, Homo sapien
agatccagacccttgtcggccgtgg

SEQ ID NO: 25521 - DNA, 25 bp, Homo sapien
ccacggctggaagaacgacctgagc

SEQ ID NO: 25522 - DNA, 25 bp, Homo sapien
cgagcgagactcatatgggccacgg

SEQ ID NO: 25523 - DNA, 25 bp, Homo sapien
actcatatgggccacggctggaaga

SEQ ID NO: 25524 - DNA, 25 bp, Homo sapien
gctgggcctcggagtttgccccgta

SEQ ID NO: 25525 - DNA, 25 bp, Homo sapien
ctgctgcggcgactcaggctgctgc

SEQ ID NO: 25526 - DNA, 25 bp, Homo sapien
agctccaccagttgctgctgcttcc

SEQ ID NO: 25527 - DNA, 25 bp, Homo sapien
ccgacagcggagtagtggttgctgc

SEQ ID NO: 25528 - DNA, 25 bp, Homo sapien
ccagaggtcccagcgctccaacaac

SEQ ID NO: 25529 - DNA, 25 bp, Homo sapien
agcgctccaacaaccggagctcagg

SEQ ID NO: 25530 - DNA, 25 bp, Homo sapien
gcgctgcgctagagaaacccgccca

SEQ ID NO: 25531 - DNA, 25 bp, Homo sapien
ccaacaaccggagctcaggatgctg

SEQ ID NO: 25532 - DNA, 25 bp, Homo sapien
gcgcccagaaccatgcataagtcta

SEQ ID NO: 25533 - DNA, 25 bp, Homo sapien
ccagagtcaccactgcagcgatgtc

SEQ ID NO: 25534 - DNA, 25 bp, Homo sapien
cacggcgtcttgaccagtgtccaga

SEQ ID NO: 25535 - DNA, 25 bp, Homo sapien
ctgagctgaggccacacgtagagcc

SEQ ID NO: 25536 - DNA, 25 bp, Homo sapien
tgttgagattcctcccatcagacgc

SEQ ID NO: 25537 - DNA, 25 bp, Homo sapien
cgccgctctgaacccatatataaca

SEQ ID NO: 25538 - DNA, 25 bp, Homo sapien
ataagtctagaaccacgcccgcgtc

SEQ ID NO: 25539 - DNA, 25 bp, Homo sapien
ccaagtgccgaatcgagatttcctc

SEQ ID NO: 25540 - DNA, 25 bp, Homo sapien
tgctcagtttgctcttcgtgacacg

SEQ ID NO: 25541 - DNA, 25 bp, Homo sapien
ctgccagaccgtgaatgtgaccctc

SEQ ID NO: 25542 - DNA, 25 bp, Homo sapien
cttcgtgacacgtgactcggcaagg

SEQ ID NO: 25543 - DNA, 25 bp, Homo sapien
tgcgcagctcagtttgctcagtttg

SEQ ID NO: 25544 - DNA, 25 bp, Homo sapien
ccactgcacgcctggtgacgagtct

SEQ ID NO: 25545 - DNA, 25 bp, Homo sapien
gccgtggcttacacaacgcacattc

SEQ ID NO: 25546 - DNA, 25 bp, Homo sapien
actggccttatagcggtcggtgccc

SEQ ID NO: 25547 - DNA, 25 bp, Homo sapien
ctgtgtcgcagtccgactggcctta

SEQ ID NO: 25548 - DNA, 25 bp, Homo sapien
acggatcggccgactagacagccaa

SEQ ID NO: 25549 - DNA, 25 bp, Homo sapien
gccattttgttttggacaccgagca

SEQ ID NO: 25550 - DNA, 25 bp, Homo sapien
cactggcgtctgtttccttcggtga

SEQ ID NO: 25551 - DNA, 25 bp, Homo sapien
tgagctcgcatactaccgcttacgc

SEQ ID NO: 25552 - DNA, 25 bp, Homo sapien
agacgccattttagccggtcagaca

SEQ ID NO: 25553 - DNA, 25 bp, Homo sapien
ttgcagcgcaaccactactggaacg

SEQ ID NO: 25554 - DNA, 25 bp, Homo sapien
gcctgacgtaattgcgtagacgcca

SEQ ID NO: 25555 - DNA, 25 bp, Homo sapien
tgcgcaggcgtagctcaaatctttc

SEQ ID NO: 25556 - DNA, 25 bp, Homo sapien
tcttggtggagacagcatttcccgg

SEQ ID NO: 25557 - DNA, 25 bp, Homo sapien
actctcacgtacacgccgtcaggtg

SEQ ID NO: 25558 - DNA, 25 bp, Homo sapien
tgtgcagcagctcgactctcacgta

SEQ ID NO: 25559 - DNA, 25 bp, Homo sapien
accttttcgccgaagggctgctgga

SEQ ID NO: 25560 - DNA, 25 bp, Homo sapien
caggccgcgaccttttcgccgaagg

SEQ ID NO: 25561 - DNA, 25 bp, Homo sapien
ccctcgcggcaggtttcgggcttca

SEQ ID NO: 25562 - DNA, 25 bp, Homo sapien
gcccggttcgcgctagactccattt

SEQ ID NO: 25563 - DNA, 25 bp, Homo sapien
tcgggcttcaggacaattcgtgatg

SEQ ID NO: 25564 - DNA, 25 bp, Homo sapien
ccttcctctgagtagcagacaactg

SEQ ID NO: 25565 - DNA, 25 bp, Homo sapien
cttctttcggcccacgttcacaaag

SEQ ID NO: 25566 - DNA, 25 bp, Homo sapien
ccacttacctcatggcgccttaaaa

SEQ ID NO: 25567 - DNA, 25 bp, Homo sapien
acgaacaatggaggccgcaccaacc

SEQ ID NO: 25568 - DNA, 25 bp, Homo sapien
cagacaactgaagaggcgtcttgcc

SEQ ID NO: 25569 - DNA, 25 bp, Homo sapien
gtcttgccggcgtgtcccaataaaa

SEQ ID NO: 25570 - DNA, 25 bp, Homo sapien
caataaaacccggtgcgattggctc

SEQ ID NO: 25571 - DNA, 25 bp, Homo sapien
tggcgccttaaaacacgaacaatgg

SEQ ID NO: 25572 - DNA, 25 bp, Homo sapien
agactcttaacgtgggcggctcttc

SEQ ID NO: 25573 - DNA, 25 bp, Homo sapien
tccaccagtcacagcaagcaagagg

SEQ ID NO: 25574 - DNA, 25 bp, Homo sapien
aggtatcctcgtcgtctttctctga

SEQ ID NO: 25575 - DNA, 25 bp, Homo sapien
ttttcctccagttgtccagcaaagg

SEQ ID NO: 25576 - DNA, 25 bp, Homo sapien
gcctagctcgatcaaaggggcctca

SEQ ID NO: 25577 - DNA, 25 bp, Homo sapien
agactcgcggtgttcggcacctaca

SEQ ID NO: 25578 - DNA, 25 bp, Homo sapien
acactgcggttcgttctcaccggga

SEQ ID NO: 25579 - DNA, 25 bp, Homo sapien
ggcggctcttctagtctctccataa

SEQ ID NO: 25580 - DNA, 25 bp, Homo sapien
tggacctcaagtgggagcacaaccc

SEQ ID NO: 25581 - DNA, 25 bp, Homo sapien
ccttcccatagggacgcgcctgatg

SEQ ID NO: 25582 - DNA, 25 bp, Homo sapien
aacctgacggtagccgtggtactgc

SEQ ID NO: 25583 - DNA, 25 bp, Homo sapien
actcccagttgttcacactcgggtc

SEQ ID NO: 25584 - DNA, 25 bp, Homo sapien
ttccctccggatagccggagacttg

SEQ ID NO: 25585 - DNA, 25 bp, Homo sapien
tggtactgccgctggccaatacctc

SEQ ID NO: 25586 - DNA, 25 bp, Homo sapien
caaggacgagtatgcgctgaccacc

SEQ ID NO: 25587 - DNA, 25 bp, Homo sapien
ggcaggcgctcacgcacgctacaaa

SEQ ID NO: 25588 - DNA, 25 bp, Homo sapien
cgatgggaaaggatctttcacaggg

SEQ ID NO: 25589 - DNA, 25 bp, Homo sapien
caggcgagccgaggtcagcccacgg

SEQ ID NO: 25590 - DNA, 25 bp, Homo sapien
cggcactcagggactggttctggcc

SEQ ID NO: 25591 - DNA, 25 bp, Homo sapien
ggcagcaagtctgtccactcactga

SEQ ID NO: 25592 - DNA, 25 bp, Homo sapien
cgccctcagcgcagggacgctgctc

SEQ ID NO: 25593 - DNA, 25 bp, Homo sapien
gcaggcgatgggaaaggatctttca

SEQ ID NO: 25594 - DNA, 25 bp, Homo sapien
tgcccgggaatcagcgcccagtccc

SEQ ID NO: 25595 - DNA, 25 bp, Homo sapien
ctgctcggcggcagcaagtctgtcc

SEQ ID NO: 25596 - DNA, 25 bp, Homo sapien
ccctggcactgctggatgctgtgcg

SEQ ID NO: 25597 - DNA, 25 bp, Homo sapien
atgctgtgcgctccttccgaatccg

SEQ ID NO: 25598 - DNA, 25 bp, Homo sapien
cacaggtggagacaattggcgatgc

SEQ ID NO: 25599 - DNA, 25 bp, Homo sapien
tggcgatgcctacatggtggtgtca

SEQ ID NO: 25600 - DNA, 25 bp, Homo sapien
tacacgcctgcgaggtagcccgcat

SEQ ID NO: 25601 - DNA, 25 bp, Homo sapien
gccgcacagttgcagccgtcaagtc

SEQ ID NO: 25602 - DNA, 25 bp, Homo sapien
aggtagcccgcatggccctggcact

SEQ ID NO: 25603 - DNA, 25 bp, Homo sapien
tcgccactcccacaggtggagacaa

SEQ ID NO: 25604 - DNA, 25 bp, Homo sapien
cctcaacaccattggcagacggaga

SEQ ID NO: 25605 - DNA, 25 bp, Homo sapien
cactatggccgcttctgtgtggtgt

SEQ ID NO: 25606 - DNA, 25 bp, Homo sapien
ggaggctgacatcgcgcatgcgcct

SEQ ID NO: 25607 - DNA, 25 bp, Homo sapien
cgattgggcacgctagttgtccatc

SEQ ID NO: 25608 - DNA, 25 bp, Homo sapien
gttgtccatcagaccaggctctctt

SEQ ID NO: 25609 - DNA, 25 bp, Homo sapien
gagaaaaggccagtccgccgaggtc

SEQ ID NO: 25610 - DNA, 25 bp, Homo sapien
gagactcagcgccaccgcggaagca

SEQ ID NO: 25611 - DNA, 25 bp, Homo sapien
ggcgcgggcctagacgatttctccc

SEQ ID NO: 25612 - DNA, 25 bp, Homo sapien
cgctggcccagagtttctgtggctc

SEQ ID NO: 25613 - DNA, 25 bp, Homo sapien
gtctcagctagaacgagcggcccta

SEQ ID NO: 25614 - DNA, 25 bp, Homo sapien
gctggaaccagacggtgccgataga

SEQ ID NO: 25615 - DNA, 25 bp, Homo sapien
tgaagctacacctctggccgcagtt

SEQ ID NO: 25616 - DNA, 25 bp, Homo sapien
tgcgagctctgtgctgcaaaagggc

SEQ ID NO: 25617 - DNA, 25 bp, Homo sapien
tcgcggcgctttagctactcagagg

SEQ ID NO: 25618 - DNA, 25 bp, Homo sapien
ttcctacgtgcgctaggctgggact

SEQ ID NO: 25619 - DNA, 25 bp, Homo sapien
ctggagctccgaactgactaaggcg

SEQ ID NO: 25620 - DNA, 25 bp, Homo sapien
aaaaacccatctcgggcgctgctgg

SEQ ID NO: 25621 - DNA, 25 bp, Homo sapien
gacctcgctgcgcaagcgcaaatcg

SEQ ID NO: 25622 - DNA, 25 bp, Homo sapien
cgcgcgaacccacaagcggggagat

SEQ ID NO: 25623 - DNA, 25 bp, Homo sapien
gcgtcaggcgcatggagccaacata

SEQ ID NO: 25624 - DNA, 25 bp, Homo sapien
tggagccaacatactccctggcagc

SEQ ID NO: 25625 - DNA, 25 bp, Homo sapien
gtgcttcgcgcctacgtaaacccga

SEQ ID NO: 25626 - DNA, 25 bp, Homo sapien
tgcgcaagcgcaaatcggtgcccgc

SEQ ID NO: 25627 - DNA, 25 bp, Homo sapien
agggcggtgcttcgcgcctacgtaa

SEQ ID NO: 25628 - DNA, 25 bp, Homo sapien
gcgttaatgggtacctctgccagtc

SEQ ID NO: 25629 - DNA, 25 bp, Homo sapien
gatccagaccctgctgacgggacta

SEQ ID NO: 25630 - DNA, 25 bp, Homo sapien
gtgatgattggcgtgcttaaaaccc

SEQ ID NO: 25631 - DNA, 25 bp, Homo sapien
cacccttgaagaatgagtggccgga

SEQ ID NO: 25632 - DNA, 25 bp, Homo sapien
tctcggccatgccagtagaagacta

SEQ ID NO: 25633 - DNA, 25 bp, Homo sapien
cggcaccacacaaacaaggacgctg

SEQ ID NO: 25634 - DNA, 25 bp, Homo sapien
ggggtcaaaaaatcgcttcaggctg

SEQ ID NO: 25635 - DNA, 25 bp, Homo sapien
cgggtcttcgacagcccattaagtg

SEQ ID NO: 25636 - DNA, 25 bp, Homo sapien
cagtgcccgtgcctgtcgctctgat

SEQ ID NO: 25637 - DNA, 25 bp, Homo sapien
ccagcgggacagcacagcgatggca

SEQ ID NO: 25638 - DNA, 25 bp, Homo sapien
cttgggaacgcctcgtagaactgca

SEQ ID NO: 25639 - DNA, 25 bp, Homo sapien
gatagcctggcccttgggaacgcct

SEQ ID NO: 25640 - DNA, 25 bp, Homo sapien
gctctgatagcctggcccttgggaa

SEQ ID NO: 25641 - DNA, 25 bp, Homo sapien
cctgagacggagtagcggtaaagga

SEQ ID NO: 25642 - DNA, 25 bp, Homo sapien
ctgtcgctctgatagcctggccctt

SEQ ID NO: 25643 - DNA, 25 bp, Homo sapien
acagcgatggcacgccggctgcgca

SEQ ID NO: 25644 - DNA, 25 bp, Homo sapien
gtgaccctggcaagcgtctgcccaa

SEQ ID NO: 25645 - DNA, 25 bp, Homo sapien
tgcccaaagcccagccgcctgcagc

SEQ ID NO: 25646 - DNA, 25 bp, Homo sapien
tgcacccaggtagcttcccaccatc

SEQ ID NO: 25647 - DNA, 25 bp, Homo sapien
tggcaagcgtctgcccaaagcccag

SEQ ID NO: 25648 - DNA, 25 bp, Homo sapien
ccagacatggcgcacccgacttggg

SEQ ID NO: 25649 - DNA, 25 bp, Homo sapien
cagatgtgcagtgagggacagcagc

SEQ ID NO: 25650 - DNA, 25 bp, Homo sapien
caggagagaggaaccggaaccagat

SEQ ID NO: 25651 - DNA, 25 bp, Homo sapien
aggaaccggaaccagatgtgcagtg

SEQ ID NO: 25652 - DNA, 25 bp, Homo sapien
cgggtggagccgatgtccatcatca

SEQ ID NO: 25653 - DNA, 25 bp, Homo sapien
ggtctccgctccgtaactgctcagc

SEQ ID NO: 25654 - DNA, 25 bp, Homo sapien
ttctcactaaatttgcgcggattgg

SEQ ID NO: 25655 - DNA, 25 bp, Homo sapien
tggagccgatgtccatcatcacctc

SEQ ID NO: 25656 - DNA, 25 bp, Homo sapien
tgccaccctcccagtaccagccgcg

SEQ ID NO: 25657 - DNA, 25 bp, Homo sapien
cccagcctagccctgacctgttgcg

SEQ ID NO: 25658 - DNA, 25 bp, Homo sapien
taaatttgcgcggattggaagccga

SEQ ID NO: 25659 - DNA, 25 bp, Homo sapien
tctgcagcgcaatcttctcactaaa

SEQ ID NO: 25660 - DNA, 25 bp, Homo sapien
ttcaaggtcctctgcgaagcggagt

SEQ ID NO: 25661 - DNA, 25 bp, Homo sapien
gtccctacctaccaagtcctgagga

SEQ ID NO: 25662 - DNA, 25 bp, Homo sapien
cccgactttgagctccgaaacttca

SEQ ID NO: 25663 - DNA, 25 bp, Homo sapien
gatcatccacatggagcgactcctc

SEQ ID NO: 25664 - DNA, 25 bp, Homo sapien
atcgtggttttactgcagaaggaca

SEQ ID NO: 25665 - DNA, 25 bp, Homo sapien
aaccagcctcgtgtagacttcagtg

SEQ ID NO: 25666 - DNA, 25 bp, Homo sapien
tgaatgagcccggacggtccctacc

SEQ ID NO: 25667 - DNA, 25 bp, Homo sapien
gcgactcctcatcgaggaccactgt

SEQ ID NO: 25668 - DNA, 25 bp, Homo sapien
cgcttccggcctagagtcgggaatt

SEQ ID NO: 25669 - DNA, 25 bp, Homo sapien
cgtcagttaggagcaatcagagatc

SEQ ID NO: 25670 - DNA, 25 bp, Homo sapien
tgagcgagagcaagagcggatatta

SEQ ID NO: 25671 - DNA, 25 bp, Homo sapien
ggtctcactacatggtctccgcgcg

SEQ ID NO: 25672 - DNA, 25 bp, Homo sapien
cacctcgcgagggtctcactacatg

SEQ ID NO: 25673 - DNA, 25 bp, Homo sapien
aagaatgcgtgagctgggactcctg

SEQ ID NO: 25674 - DNA, 25 bp, Homo sapien
cggtgcctgaaagtccgggctccag

SEQ ID NO: 25675 - DNA, 25 bp, Homo sapien
agcggatattaggaaaaggacctcg

SEQ ID NO: 25676 - DNA, 25 bp, Homo sapien
gctgctgttctccattaacgccaca

SEQ ID NO: 25677 - DNA, 25 bp, Homo sapien
agcttcccggcgattcatattctgg

SEQ ID NO: 25678 - DNA, 25 bp, Homo sapien
aacctggctgctcagggtttcccgg

SEQ ID NO: 25679 - DNA, 25 bp, Homo sapien
cgcgcgaagacaaacctggctgctc

SEQ ID NO: 25680 - DNA, 25 bp, Homo sapien
aacgccacactgctcggcttgcgga

SEQ ID NO: 25681 - DNA, 25 bp, Homo sapien
agcgtgtgcgcacagctgctgttct

SEQ ID NO: 25682 - DNA, 25 bp, Homo sapien
tgtccctccgtgaatgagcagcgtg

SEQ ID NO: 25683 - DNA, 25 bp, Homo sapien
atcaccgctccactggggtcagcgg

SEQ ID NO: 25684 - DNA, 25 bp, Homo sapien
tagggcctcggccatacgtacatgg

SEQ ID NO: 25685 - DNA, 25 bp, Homo sapien
cacataaaccctggccgagcggctg

SEQ ID NO: 25686 - DNA, 25 bp, Homo sapien
tcccaggaatccagctataccagtg

SEQ ID NO: 25687 - DNA, 25 bp, Homo sapien
cagcccggtttctaggtgttcccag

SEQ ID NO: 25688 - DNA, 25 bp, Homo sapien
cagtgtttccaagcagcccggtttc

SEQ ID NO: 25689 - DNA, 25 bp, Homo sapien
gccgattcctgtcactgcagagatg

SEQ ID NO: 25690 - DNA, 25 bp, Homo sapien
ggggacacacgttctgcaacctggc

SEQ ID NO: 25691 - DNA, 25 bp, Homo sapien
gagtcggctcacaccgcaaggcaga

SEQ ID NO: 25692 - DNA, 25 bp, Homo sapien
cctgtcggaacagagggacctactc

SEQ ID NO: 25693 - DNA, 25 bp, Homo sapien
gcctattggagcagaggatctatca

SEQ ID NO: 25694 - DNA, 25 bp, Homo sapien
ccgttgcattgtggtcttggtagtc

SEQ ID NO: 25695 - DNA, 25 bp, Homo sapien
ttgcagaggctcgtccgaattctcg

SEQ ID NO: 25696 - DNA, 25 bp, Homo sapien
gggacaatacgtcgccctctcagga

SEQ ID NO: 25697 - DNA, 25 bp, Homo sapien
acccgaggattcaccgtcaagcttc

SEQ ID NO: 25698 - DNA, 25 bp, Homo sapien
gaaactgcgcgttctcgtccctgca

SEQ ID NO: 25699 - DNA, 25 bp, Homo sapien
agcgccaagtgtcgcacctgtcgga

SEQ ID NO: 25700 - DNA, 25 bp, Homo sapien
gacgacctacgcacacgagaacatg

SEQ ID NO: 25701 - DNA, 25 bp, Homo sapien
ctgtgagtgctttggtccaggtttc

SEQ ID NO: 25702 - DNA, 25 bp, Homo sapien
ttcggcggagatctcgctgttctgt

SEQ ID NO: 25703 - DNA, 25 bp, Homo sapien
cctcacgctgatttcggatcgtaga

SEQ ID NO: 25704 - DNA, 25 bp, Homo sapien
accctctgcacttcttaggacatta

SEQ ID NO: 25705 - DNA, 25 bp, Homo sapien
acattaactccagggaccgcagcgg

SEQ ID NO: 25706 - DNA, 25 bp, Homo sapien
ccacccgcatagacgggagcggaga

SEQ ID NO: 25707 - DNA, 25 bp, Homo sapien
tcggatcgtagagggtcctcattta

SEQ ID NO: 25708 - DNA, 25 bp, Homo sapien
agaacctggatcttgcgcttcaccg

SEQ ID NO: 25709 - DNA, 25 bp, Homo sapien
ggccttcagaggaccgtgctccacg

SEQ ID NO: 25710 - DNA, 25 bp, Homo sapien
gtgctccacggcaaaagggacctta

SEQ ID NO: 25711 - DNA, 25 bp, Homo sapien
ttaccatggtaactgggcggcgctt

SEQ ID NO: 25712 - DNA, 25 bp, Homo sapien
gcctgctacgccctgaaataccgga

SEQ ID NO: 25713 - DNA, 25 bp, Homo sapien
agggaccttattccgcttgccggat

SEQ ID NO: 25714 - DNA, 25 bp, Homo sapien
ctcaacttctcgctggaggcgctca

SEQ ID NO: 25715 - DNA, 25 bp, Homo sapien
agtggatcctcccagtcgccctgga

SEQ ID NO: 25716 - DNA, 25 bp, Homo sapien
ccttttagcgtcacgcgctgaggga

SEQ ID NO: 25717 - DNA, 25 bp, Homo sapien
gctcagacgcggaactacgacagta

SEQ ID NO: 25718 - DNA, 25 bp, Homo sapien
tgacacgtgactcaggcaggcaatg

SEQ ID NO: 25719 - DNA, 25 bp, Homo sapien
acccggcctgaaaacatggcggaca

SEQ ID NO: 25720 - DNA, 25 bp, Homo sapien
ggaagaccaagccagacccggcctg

SEQ ID NO: 25721 - DNA, 25 bp, Homo sapien
cctcgcgcagaattgttcgggttta

SEQ ID NO: 25722 - DNA, 25 bp, Homo sapien
cagttactgccggacgccatggcct

SEQ ID NO: 25723 - DNA, 25 bp, Homo sapien
gggaatcttatatcacgtgacaggg

SEQ ID NO: 25724 - DNA, 25 bp, Homo sapien
tgagcctctttgatctcttccgggg

SEQ ID NO: 25725 - DNA, 25 bp, Homo sapien
cccgtctgcgaatggaccactggag

SEQ ID NO: 25726 - DNA, 25 bp, Homo sapien
ttacgacagtgtcaggatcgcgggc

SEQ ID NO: 25727 - DNA, 25 bp, Homo sapien
gctcaatttctcacagggctgcgca

SEQ ID NO: 25728 - DNA, 25 bp, Homo sapien
aatcgcttttcgtactgagttggtc

SEQ ID NO: 25729 - DNA, 25 bp, Homo sapien
atccgggtgccatccagagtcaaac

SEQ ID NO: 25730 - DNA, 25 bp, Homo sapien
ggacgccctcaagccggtccatttg

SEQ ID NO: 25731 - DNA, 25 bp, Homo sapien
tcccagtacgggaatgagcctcttt

SEQ ID NO: 25732 - DNA, 25 bp, Homo sapien
gggccaagatttgggagctgcggcc

SEQ ID NO: 25733 - DNA, 25 bp, Homo sapien
gagcgggtgtagactggggagcacc

SEQ ID NO: 25734 - DNA, 25 bp, Homo sapien
cgagtgccaaggagaagctcgtgca

SEQ ID NO: 25735 - DNA, 25 bp, Homo sapien
gccaaggagaagctcgtgcagcctt

SEQ ID NO: 25736 - DNA, 25 bp, Homo sapien
gagaagctcgtgcagccttggccag

SEQ ID NO: 25737 - DNA, 25 bp, Homo sapien
agttgttgggcgagaggagtaaccg

SEQ ID NO: 25738 - DNA, 25 bp, Homo sapien
gggtctgcgtacaggatgggaggat

SEQ ID NO: 25739 - DNA, 25 bp, Homo sapien
agacccgcccagagagttgttgggc

SEQ ID NO: 25740 - DNA, 25 bp, Homo sapien
agctttcgcctacgcggcgcgctgg

SEQ ID NO: 25741 - DNA, 25 bp, Homo sapien
ctcaaaccgggatcatgacggtccc

SEQ ID NO: 25742 - DNA, 25 bp, Homo sapien
gggctcgcgcgcgagctttcgccta

SEQ ID NO: 25743 - DNA, 25 bp, Homo sapien
aggacatatagacggtctgccctcc

SEQ ID NO: 25744 - DNA, 25 bp, Homo sapien
aaccctgggcgtgctcggcgtgtcc

SEQ ID NO: 25745 - DNA, 25 bp, Homo sapien
cccgtcgatgccactaaggccaagg

SEQ ID NO: 25746 - DNA, 25 bp, Homo sapien
cgacaacgccggcagtccgctcacc

SEQ ID NO: 25747 - DNA, 25 bp, Homo sapien
tgccactaaggccaaggacatatag

SEQ ID NO: 25748 - DNA, 25 bp, Homo sapien
gtgtcccgacagctgcaaaagtttg

SEQ ID NO: 25749 - DNA, 25 bp, Homo sapien
gtttgcgcagattagagtgtagaca

SEQ ID NO: 25750 - DNA, 25 bp, Homo sapien
catttgggatcagcgactagagaca

SEQ ID NO: 25751 - DNA, 25 bp, Homo sapien
tcgctgtgctaatcgccgagctctc

SEQ ID NO: 25752 - DNA, 25 bp, Homo sapien
gcatgctgaactttccgagcgcgtg

SEQ ID NO: 25753 - DNA, 25 bp, Homo sapien
acttccttgtggtgctgagctgata

SEQ ID NO: 25754 - DNA, 25 bp, Homo sapien
tggtgacgggacaaacaacaggttg

SEQ ID NO: 25755 - DNA, 25 bp, Homo sapien
caaagctttgatggatgcgctctgc

SEQ ID NO: 25756 - DNA, 25 bp, Homo sapien
tgcgcttgctcccttggtccggagc

SEQ ID NO: 25757 - DNA, 25 bp, Homo sapien
cccggtgaagctgtgcgggaaccct

SEQ ID NO: 25758 - DNA, 25 bp, Homo sapien
cctcaaatgttttcctgcgttgcca

SEQ ID NO: 25759 - DNA, 25 bp, Homo sapien
gtccgccgctctgagtcatgtgcga

SEQ ID NO: 25760 - DNA, 25 bp, Homo sapien
tgggaagtcgcactgacactgagcc

SEQ ID NO: 25761 - DNA, 25 bp, Homo sapien
ctgccctgcgcagggtaagggcttc

SEQ ID NO: 25762 - DNA, 25 bp, Homo sapien
aaaccgccttggtcaccgcagtctg

SEQ ID NO: 25763 - DNA, 25 bp, Homo sapien
cgctccagcgcgagttcctcaaatg

SEQ ID NO: 25764 - DNA, 25 bp, Homo sapien
cagggacaacggtcgccagctcctg

SEQ ID NO: 25765 - DNA, 25 bp, Homo sapien
agcccagacacgcagaggcgccagg

SEQ ID NO: 25766 - DNA, 25 bp, Homo sapien
acacggcaggcgacaggcacgacgc

SEQ ID NO: 25767 - DNA, 25 bp, Homo sapien
caggagtgtcacgtgcgccgctcac

SEQ ID NO: 25768 - DNA, 25 bp, Homo sapien
tctgcagacgttatttttggcggta

SEQ ID NO: 25769 - DNA, 25 bp, Homo sapien
agctcctgcgctagttccgttactc

SEQ ID NO: 25770 - DNA, 25 bp, Homo sapien
cgttactcttcggtggcacacggtc

SEQ ID NO: 25771 - DNA, 25 bp, Homo sapien
tctactccactctttctgcagacgt

SEQ ID NO: 25772 - DNA, 25 bp, Homo sapien
ttgcagtggatgcggacaggatccc

SEQ ID NO: 25773 - DNA, 25 bp, Homo sapien
gcaggaactcgcagctcagctcgtc

SEQ ID NO: 25774 - DNA, 25 bp, Homo sapien
cacgcgagggggtcctcaccgtgat

SEQ ID NO: 25775 - DNA, 25 bp, Homo sapien
aggcgctggcaatgcggaagcgctc

SEQ ID NO: 25776 - DNA, 25 bp, Homo sapien
aatgcggaagcgctcgtggccgcgg

SEQ ID NO: 25777 - DNA, 25 bp, Homo sapien
tggactcgagcagcttcagctctcg

SEQ ID NO: 25778 - DNA, 25 bp, Homo sapien
aagatggactcgagcagcttcagct

SEQ ID NO: 25779 - DNA, 25 bp, Homo sapien
gtggaagatggactcgagcagcttc

SEQ ID NO: 25780 - DNA, 25 bp, Homo sapien
ctgaggcctgtgtcgtccccacaga

SEQ ID NO: 25781 - DNA, 25 bp, Homo sapien
tgttctgcagcgctggacgtctgag

SEQ ID NO: 25782 - DNA, 25 bp, Homo sapien
tggcatcggcctggcagtctcggcc

SEQ ID NO: 25783 - DNA, 25 bp, Homo sapien
tccctcctgactttcggaggcctgg

SEQ ID NO: 25784 - DNA, 25 bp, Homo sapien
gccaccaccgcgcagacacatcctg

SEQ ID NO: 25785 - DNA, 25 bp, Homo sapien
catctcctgccagttctgcctgagg

SEQ ID NO: 25786 - DNA, 25 bp, Homo sapien
cacagacgcgcgctgtggacacact

SEQ ID NO: 25787 - DNA, 25 bp, Homo sapien
ggctgccctctggaggccccagtaa

SEQ ID NO: 25788 - DNA, 25 bp, Homo sapien
gcgcctcagtgcgagtttgcgtatg

SEQ ID NO: 25789 - DNA, 25 bp, Homo sapien
cgagtttgcgtatgtcgtgcgtgct

SEQ ID NO: 25790 - DNA, 25 bp, Homo sapien
ttgcgtatgtcgtgcgtgcttgcgc

SEQ ID NO: 25791 - DNA, 25 bp, Homo sapien
ctctcacgtgactcggtgccgcgtg

SEQ ID NO: 25792 - DNA, 25 bp, Homo sapien
tcacgtgactcggtgccgcgtgctc

SEQ ID NO: 25793 - DNA, 25 bp, Homo sapien
ctcccaggggctacccgcgcaggac

SEQ ID NO: 25794 - DNA, 25 bp, Homo sapien
ccgcgcaggacgctgtttcctgccc

SEQ ID NO: 25795 - DNA, 25 bp, Homo sapien
cctcagtgcgagtttgcgtatgtcg

SEQ ID NO: 25796 - DNA, 25 bp, Homo sapien
tcaccgtcccaattgtattccctgg

SEQ ID NO: 25797 - DNA, 25 bp, Homo sapien
cgtcccaattgtattccctggaaga

SEQ ID NO: 25798 - DNA, 25 bp, Homo sapien
tgtattccctggaagagcagccgga

SEQ ID NO: 25799 - DNA, 25 bp, Homo sapien
agagcagccggaaaagcctccgcct

SEQ ID NO: 25800 - DNA, 25 bp, Homo sapien
ctccgcctgctcataccaggatagg

SEQ ID NO: 25801 - DNA, 25 bp, Homo sapien
ccaggataggcaagaagctggtttc

SEQ ID NO: 25802 - DNA, 25 bp, Homo sapien
aggcagcgagctatgcccgcggcat

SEQ ID NO: 25803 - DNA, 25 bp, Homo sapien
gctgctccttggcttcggcctcctc

SEQ ID NO: 25804 - DNA, 25 bp, Homo sapien
ggcgtgcgcttcatcgcagaccaca

SEQ ID NO: 25805 - DNA, 25 bp, Homo sapien
cgtggacatcacgtatgacttcatc

SEQ ID NO: 25806 - DNA, 25 bp, Homo sapien
gtggacctacgaccgcacagagatc

SEQ ID NO: 25807 - DNA, 25 bp, Homo sapien
cgacgactctacgtacgtggacatc

SEQ ID NO: 25808 - DNA, 25 bp, Homo sapien
tcatgcagcagccacgccatcattg

SEQ ID NO: 25809 - DNA, 25 bp, Homo sapien
atcgtcaccagcgtgtgcgtgctca

SEQ ID NO: 25810 - DNA, 25 bp, Homo sapien
cgctcgtcggcaagtacctcatgtt

SEQ ID NO: 25811 - DNA, 25 bp, Homo sapien
agcctggacgacttcacacctagtg

SEQ ID NO: 25812 - DNA, 25 bp, Homo sapien
gctacgcactgcaacacaaagcctg

SEQ ID NO: 25813 - DNA, 25 bp, Homo sapien
tggctccggttcaatttcgctttcg

SEQ ID NO: 25814 - DNA, 25 bp, Homo sapien
cgggcccaagatggctccggttcaa

SEQ ID NO: 25815 - DNA, 25 bp, Homo sapien
aggggcttgagcaaatcttgcgcca

SEQ ID NO: 25816 - DNA, 25 bp, Homo sapien
tcttgcgccacgcttggtttcaggc

SEQ ID NO: 25817 - DNA, 25 bp, Homo sapien
acaaagcctgtgaggttgtaaacga

SEQ ID NO: 25818 - DNA, 25 bp, Homo sapien
cgcttggtttcaggccggttacaag

SEQ ID NO: 25819 - DNA, 25 bp, Homo sapien
ttacctgccgcggattcattgcgcc

SEQ ID NO: 25820 - DNA, 25 bp, Homo sapien
caagggcctttggtacccagctgtt

SEQ ID NO: 25821 - DNA, 25 bp, Homo sapien
acagaggctcttaccgggtcttgca

SEQ ID NO: 25822 - DNA, 25 bp, Homo sapien
ggtcttgcacttcctcgggacacgg

SEQ ID NO: 25823 - DNA, 25 bp, Homo sapien
tagccttctctaccttcagtcggga

SEQ ID NO: 25824 - DNA, 25 bp, Homo sapien
tcagtcgggaatcaatggtctggtc

SEQ ID NO: 25825 - DNA, 25 bp, Homo sapien
cggtcctaacgcagtttgtggtaga

SEQ ID NO: 25826 - DNA, 25 bp, Homo sapien
tatctctgggataaagggccggtcc

SEQ ID NO: 25827 - DNA, 25 bp, Homo sapien
cccgcagtgagctttccacagtggc

SEQ ID NO: 25828 - DNA, 25 bp, Homo sapien
cccttcaagacggaacttgcattgc

SEQ ID NO: 25829 - DNA, 25 bp, Homo sapien
atcccactcgagacaggagccagga

SEQ ID NO: 25830 - DNA, 25 bp, Homo sapien
cgagaggaaacctgaacgctctgct

SEQ ID NO: 25831 - DNA, 25 bp, Homo sapien
cccgggaggctactgaagagccagt

SEQ ID NO: 25832 - DNA, 25 bp, Homo sapien
agtggcgcctgcctcgatcacacgt

SEQ ID NO: 25833 - DNA, 25 bp, Homo sapien
cgggtcggaagagagcccttcaaga

SEQ ID NO: 25834 - DNA, 25 bp, Homo sapien
cggctgaatacgagatcacagaacg

SEQ ID NO: 25835 - DNA, 25 bp, Homo sapien
atcacagaacgagaaagcggccgcg

SEQ ID NO: 25836 - DNA, 25 bp, Homo sapien
cccagccagctggacggtggagact

SEQ ID NO: 25837 - DNA, 25 bp, Homo sapien
gacagcgcccaccaagtgacacgga

SEQ ID NO: 25838 - DNA, 25 bp, Homo sapien
agctgtcaccgtctaccaacctgtg

SEQ ID NO: 25839 - DNA, 25 bp, Homo sapien
agcacaagctgtcaccgtctaccaa

SEQ ID NO: 25840 - DNA, 25 bp, Homo sapien
tgctcctgcgtctgcccagcacaag

SEQ ID NO: 25841 - DNA, 25 bp, Homo sapien
gacgtggctatttcctctgcagagc

SEQ ID NO: 25842 - DNA, 25 bp, Homo sapien
cccaccaagtgacacggaggacgga

SEQ ID NO: 25843 - DNA, 25 bp, Homo sapien
ccatggaggacgttctctggacgtg

SEQ ID NO: 25844 - DNA, 25 bp, Homo sapien
ggcagcgatgctccgggctggtgca

SEQ ID NO: 25845 - DNA, 25 bp, Homo sapien
agcgcatgtctcatccctgcgagca

SEQ ID NO: 25846 - DNA, 25 bp, Homo sapien
aggcaaagatagagcgcatgtctca

SEQ ID NO: 25847 - DNA, 25 bp, Homo sapien
gtgaggcaaagatagagcgcatgtc

SEQ ID NO: 25848 - DNA, 25 bp, Homo sapien
atgtgagaaagcaaggggcgagcgc

SEQ ID NO: 25849 - DNA, 25 bp, Homo sapien
atgtcggctgatgcgagctggagag

SEQ ID NO: 25850 - DNA, 25 bp, Homo sapien
actggggcgctccggtgagcaccca

SEQ ID NO: 25851 - DNA, 25 bp, Homo sapien
tttgtgtgtatgtgagaaagcaagg

SEQ ID NO: 25852 - DNA, 25 bp, Homo sapien
atcggtgaagagcttgctgtgcagc

SEQ ID NO: 25853 - DNA, 25 bp, Homo sapien
tggatggcgcacaccagcatctcca

SEQ ID NO: 25854 - DNA, 25 bp, Homo sapien
gaagaacttgtactcgccaggaatg

SEQ ID NO: 25855 - DNA, 25 bp, Homo sapien
gcgtgccgtccagaagaacttgtac

SEQ ID NO: 25856 - DNA, 25 bp, Homo sapien
catgactcgggcgatcaggtacagg

SEQ ID NO: 25857 - DNA, 25 bp, Homo sapien
ccaggctgatgtacaggatgcgctc

SEQ ID NO: 25858 - DNA, 25 bp, Homo sapien
gtcatccgcgccattgtcgatcacg

SEQ ID NO: 25859 - DNA, 25 bp, Homo sapien
atgcgctcgtaggtcatggctatcc

SEQ ID NO: 25860 - DNA, 25 bp, Homo sapien
ccggatttcctcttgccgctgaaca

SEQ ID NO: 25861 - DNA, 25 bp, Homo sapien
gtgccctcagctcatgtccaaacag

SEQ ID NO: 25862 - DNA, 25 bp, Homo sapien
agaaaggcggttccttcacagagca

SEQ ID NO: 25863 - DNA, 25 bp, Homo sapien
ggcctgcttaactgacacccgggga

SEQ ID NO: 25864 - DNA, 25 bp, Homo sapien
tgcgttatagtacatgtgccacagc

SEQ ID NO: 25865 - DNA, 25 bp, Homo sapien
gacgtcactaagatgtggcccttta

SEQ ID NO: 25866 - DNA, 25 bp, Homo sapien
agcccggcgagaaacctttgattgc

SEQ ID NO: 25867 - DNA, 25 bp, Homo sapien
ctcgcgatgcctgaagctgacactt

SEQ ID NO: 25868 - DNA, 25 bp, Homo sapien
accatcgcccagaaggggtgtcagg

SEQ ID NO: 25869 - DNA, 25 bp, Homo sapien
agtggaaagggtcgtctccgctagc

SEQ ID NO: 25870 - DNA, 25 bp, Homo sapien
taccacggcaccacgcgagtggaaa

SEQ ID NO: 25871 - DNA, 25 bp, Homo sapien
agggacgaggcttaccacggcacca

SEQ ID NO: 25872 - DNA, 25 bp, Homo sapien
ggacgagacgctacgcctgaaaaca

SEQ ID NO: 25873 - DNA, 25 bp, Homo sapien
agcaaggaccggacgagacgctacg

SEQ ID NO: 25874 - DNA, 25 bp, Homo sapien
ccacaaagtgcgacgacagggaagc

SEQ ID NO: 25875 - DNA, 25 bp, Homo sapien
cccgagctgcagcaaccacaaagtg

SEQ ID NO: 25876 - DNA, 25 bp, Homo sapien
cgaacttcagacttctgggcgggga

SEQ ID NO: 25877 - DNA, 25 bp, Homo sapien
ttttgacaggagttagccgaggatc

SEQ ID NO: 25878 - DNA, 25 bp, Homo sapien
aggggcggagcttcaacaaattcga

SEQ ID NO: 25879 - DNA, 25 bp, Homo sapien
ttcgaatcgttctttgaagagcagg

SEQ ID NO: 25880 - DNA, 25 bp, Homo sapien
tgaagagcagggttttgcccttttg

SEQ ID NO: 25881 - DNA, 25 bp, Homo sapien
cttttgggagataggccttttgaca

SEQ ID NO: 25882 - DNA, 25 bp, Homo sapien
cctaaggacgcgaacttcagacttc

SEQ ID NO: 25883 - DNA, 25 bp, Homo sapien
ctttctggacagtcagacgtggatt

SEQ ID NO: 25884 - DNA, 25 bp, Homo sapien
ccgagattaattggcgccgccggcg

SEQ ID NO: 25885 - DNA, 25 bp, Homo sapien
gccgtaacgagctgcgcatcgaccg

SEQ ID NO: 25886 - DNA, 25 bp, Homo sapien
cctccacggcaggtcagcgtcggaa

SEQ ID NO: 25887 - DNA, 25 bp, Homo sapien
gcgcagtaattaccgctgcagccgt

SEQ ID NO: 25888 - DNA, 25 bp, Homo sapien
ccgccgcccggattgcggctaatga

SEQ ID NO: 25889 - DNA, 25 bp, Homo sapien
atctgttcccggcacagacaaggcc

SEQ ID NO: 25890 - DNA, 25 bp, Homo sapien
ctggctggcgctcaaatgtagacgc

SEQ ID NO: 25891 - DNA, 25 bp, Homo sapien
cactgtgttcagctctaggttcggg

SEQ ID NO: 25892 - DNA, 25 bp, Homo sapien
ggcccgtgcggcttttagaagcaca

SEQ ID NO: 25893 - DNA, 25 bp, Homo sapien
ccagaatggcccattggccgaattg

SEQ ID NO: 25894 - DNA, 25 bp, Homo sapien
ctctggcggtgaccagaatggccca

SEQ ID NO: 25895 - DNA, 25 bp, Homo sapien
ggctaacaaggtgctgcgcccggct

SEQ ID NO: 25896 - DNA, 25 bp, Homo sapien
cctctgcaaggctaacaaggtgctg

SEQ ID NO: 25897 - DNA, 25 bp, Homo sapien
ggcggcaccacctctgcaaggctaa

SEQ ID NO: 25898 - DNA, 25 bp, Homo sapien
ttttagaagcacagacaggagatgg

SEQ ID NO: 25899 - DNA, 25 bp, Homo sapien
attggccgaattggccgccctgacg

SEQ ID NO: 25900 - DNA, 25 bp, Homo sapien
gaagcgtgagaactgccctccaata

SEQ ID NO: 25901 - DNA, 25 bp, Homo sapien
ccgctgagggcacaaggaattagta

SEQ ID NO: 25902 - DNA, 25 bp, Homo sapien
cttgaaagtagaggtgtcccgcctc

SEQ ID NO: 25903 - DNA, 25 bp, Homo sapien
cgcctcgagccaaacggaccaatag

SEQ ID NO: 25904 - DNA, 25 bp, Homo sapien
ctgaaggctagcaaaccgagcgatc

SEQ ID NO: 25905 - DNA, 25 bp, Homo sapien
tacgacgacgaggagtttgagtatc

SEQ ID NO: 25906 - DNA, 25 bp, Homo sapien
tgggaggcgctcgtaaaacaaagtg

SEQ ID NO: 25907 - DNA, 25 bp, Homo sapien
tgacccacgctcgttcttgagaagc

SEQ ID NO: 25908 - DNA, 25 bp, Homo sapien
acttctatgcttctacccttcggcg

SEQ ID NO: 25909 - DNA, 25 bp, Homo sapien
ccaggttctgcaagcatctaacttc

SEQ ID NO: 25910 - DNA, 25 bp, Homo sapien
ataggcgcggagttataaatagtgc

SEQ ID NO: 25911 - DNA, 25 bp, Homo sapien
ttcttaacacctgaaggcctcattc

SEQ ID NO: 25912 - DNA, 25 bp, Homo sapien
gcatgctgacgctccgcttgcagct

SEQ ID NO: 25913 - DNA, 25 bp, Homo sapien
tataaatagtgccacccgcaggtgt

SEQ ID NO: 25914 - DNA, 25 bp, Homo sapien
ggctccaacccagaggcccggaata

SEQ ID NO: 25915 - DNA, 25 bp, Homo sapien
atcccggcggcgattagcgctgcgc

SEQ ID NO: 25916 - DNA, 25 bp, Homo sapien
ttcatgtcaagctatccctcctcgg

SEQ ID NO: 25917 - DNA, 25 bp, Homo sapien
ttcacccgctacctttctcagttgg

SEQ ID NO: 25918 - DNA, 25 bp, Homo sapien
aacccggagcggattactcgagcca

SEQ ID NO: 25919 - DNA, 25 bp, Homo sapien
gccgcccattgtggtccaacaggtt

SEQ ID NO: 25920 - DNA, 25 bp, Homo sapien
ctccgcaggctcagtcagaaacatc

SEQ ID NO: 25921 - DNA, 25 bp, Homo sapien
gggtctctcagcgaattcatgtcaa

SEQ ID NO: 25922 - DNA, 25 bp, Homo sapien
ccctcctcggtggagactcagtttc

SEQ ID NO: 25923 - DNA, 25 bp, Homo sapien
tggccctaggtagccggatttgatt

SEQ ID NO: 25924 - DNA, 25 bp, Homo sapien
aactgaccgcggccttctgaccagg

SEQ ID NO: 25925 - DNA, 25 bp, Homo sapien
ttctgaccaggaccggagcagggcc

SEQ ID NO: 25926 - DNA, 25 bp, Homo sapien
ccttctgaccaggaccggagcaggg

SEQ ID NO: 25927 - DNA, 25 bp, Homo sapien
gcgagcaactgaccgcggccttctg

SEQ ID NO: 25928 - DNA, 25 bp, Homo sapien
cagcgagcggcgagcaactgaccgc

SEQ ID NO: 25929 - DNA, 25 bp, Homo sapien
gcggcgagcaactgaccgcggcctt

SEQ ID NO: 25930 - DNA, 25 bp, Homo sapien
agcagctccagccagcggacccgac

SEQ ID NO: 25931 - DNA, 25 bp, Homo sapien
gacgcgcttcttcccacactgtgag

SEQ ID NO: 25932 - DNA, 25 bp, Homo sapien
agacgcgcgtggcacttctcccgag

SEQ ID NO: 25933 - DNA, 25 bp, Homo sapien
gctacgtcgcagcccttggaccaaa

SEQ ID NO: 25934 - DNA, 25 bp, Homo sapien
cgtggcacttctcccgagcgtgcag

SEQ ID NO: 25935 - DNA, 25 bp, Homo sapien
tccagcatagaaccgctcacctgcg

SEQ ID NO: 25936 - DNA, 25 bp, Homo sapien
cgggaccctacccactgcgagggca

SEQ ID NO: 25937 - DNA, 25 bp, Homo sapien
agcgttgcgccaattgccgctgacc

SEQ ID NO: 25938 - DNA, 25 bp, Homo sapien
ccggcagcaagcgttgcgccaattg

SEQ ID NO: 25939 - DNA, 25 bp, Homo sapien
gaccaaacccggcagcaagcgttgc

SEQ ID NO: 25940 - DNA, 25 bp, Homo sapien
ttgtagaacctacagagtgcgcctg

SEQ ID NO: 25941 - DNA, 25 bp, Homo sapien
ccggtgctagctgacccacaggaaa

SEQ ID NO: 25942 - DNA, 25 bp, Homo sapien
cccacgtatcaaagggcggctgaga

SEQ ID NO: 25943 - DNA, 25 bp, Homo sapien
tcccaagtaagagagcgacgtgtcc

SEQ ID NO: 25944 - DNA, 25 bp, Homo sapien
ctattcggtttcttgcgcttccaga

SEQ ID NO: 25945 - DNA, 25 bp, Homo sapien
ctgaaccgacatagaacgaccgctc

SEQ ID NO: 25946 - DNA, 25 bp, Homo sapien
ggcgggtgactaggaagaattctcc

SEQ ID NO: 25947 - DNA, 25 bp, Homo sapien
tagtggggctcagcaacaacctctg

SEQ ID NO: 25948 - DNA, 25 bp, Homo sapien
ccatctggcggccatgctctgagtg

SEQ ID NO: 25949 - DNA, 25 bp, Homo sapien
agcgagctgtcttcacgctcctcat

SEQ ID NO: 25950 - DNA, 25 bp, Homo sapien
ccactggagcgagctgtcttcacgc

SEQ ID NO: 25951 - DNA, 25 bp, Homo sapien
ccatgctctgagtgggcgagcgccc

SEQ ID NO: 25952 - DNA, 25 bp, Homo sapien
gggaatgtcttgttcccgccgctcc

SEQ ID NO: 25953 - DNA, 25 bp, Homo sapien
gcagggaatgtcttgttcccgccgc

SEQ ID NO: 25954 - DNA, 25 bp, Homo sapien
ggtggcctgattggctcgcctgccc

SEQ ID NO: 25955 - DNA, 25 bp, Homo sapien
ggccactggagcgagctgtcttcac

SEQ ID NO: 25956 - DNA, 25 bp, Homo sapien
tactgctggtcgtgctgggacgaca

SEQ ID NO: 25957 - DNA, 25 bp, Homo sapien
ctcgcctgcagtcgggaaagcctgc

SEQ ID NO: 25958 - DNA, 25 bp, Homo sapien
tccgcctttagtgacagcaacgacg

SEQ ID NO: 25959 - DNA, 25 bp, Homo sapien
acgacactgcctacgcggggtgaag

SEQ ID NO: 25960 - DNA, 25 bp, Homo sapien
gtgaagaggcgtcctgctcgctctt

SEQ ID NO: 25961 - DNA, 25 bp, Homo sapien
taaaatgccctgtacgcttcacgtg

SEQ ID NO: 25962 - DNA, 25 bp, Homo sapien
ccgagtcctacgtgtgccggacgct

SEQ ID NO: 25963 - DNA, 25 bp, Homo sapien
tcccaaatataggtgagtcctccgc

SEQ ID NO: 25964 - DNA, 25 bp, Homo sapien
ttccgcttgcactgtccctagatgt

SEQ ID NO: 25965 - DNA, 25 bp, Homo sapien
tgtacctttctctcctcgactgtga

SEQ ID NO: 25966 - DNA, 25 bp, Homo sapien
tttgtctgcttctagaacccgggtc

SEQ ID NO: 25967 - DNA, 25 bp, Homo sapien
ttcggcgcaatctgtcaagctgttg

SEQ ID NO: 25968 - DNA, 25 bp, Homo sapien
ctagcgcgccacctaaggctcttta

SEQ ID NO: 25969 - DNA, 25 bp, Homo sapien
ttggacaggcttcatggatcctcgc

SEQ ID NO: 25970 - DNA, 25 bp, Homo sapien
cctcagtggaagctttggcgaacct

SEQ ID NO: 25971 - DNA, 25 bp, Homo sapien
aggtgctttgtacaggccgcaacca

SEQ ID NO: 25972 - DNA, 25 bp, Homo sapien
cgggccttacccacgagaagtcgag

SEQ ID NO: 25973 - DNA, 25 bp, Homo sapien
cccacgagaagtcgaggcgtgttcc

SEQ ID NO: 25974 - DNA, 25 bp, Homo sapien
cgccgctgataacgcatgtgcgaaa

SEQ ID NO: 25975 - DNA, 25 bp, Homo sapien
aactgtcgggcgctcccacttgaca

SEQ ID NO: 25976 - DNA, 25 bp, Homo sapien
atgcctcagcgaccacgggagccgg

SEQ ID NO: 25977 - DNA, 25 bp, Homo sapien
actttcctcatagcatgcgcgggcg

SEQ ID NO: 25978 - DNA, 25 bp, Homo sapien
ctgagtccactcatggggccgagac

SEQ ID NO: 25979 - DNA, 25 bp, Homo sapien
tccttttcgcagaaccaggcgggcg

SEQ ID NO: 25980 - DNA, 25 bp, Homo sapien
ttgttggacaccctgtttacctgcc

SEQ ID NO: 25981 - DNA, 25 bp, Homo sapien
cgccgctgcagatcaataaaccttc

SEQ ID NO: 25982 - DNA, 25 bp, Homo sapien
cgaggatttgacaagttcagggccc

SEQ ID NO: 25983 - DNA, 25 bp, Homo sapien
ccctactccctggtcttgttggaca

SEQ ID NO: 25984 - DNA, 25 bp, Homo sapien
ctccgcggacactccgggttaagtg

SEQ ID NO: 25985 - DNA, 25 bp, Homo sapien
ctccaaatggggtgtgtcggcattc

SEQ ID NO: 25986 - DNA, 25 bp, Homo sapien
tcggcattcgcctttctgcaagaga

SEQ ID NO: 25987 - DNA, 25 bp, Homo sapien
tctgtgtctcgctttcggcaggtct

SEQ ID NO: 25988 - DNA, 25 bp, Homo sapien
catgcggtgtactggaacagctcca

SEQ ID NO: 25989 - DNA, 25 bp, Homo sapien
cactctgtgggcgtctaggaaactc

SEQ ID NO: 25990 - DNA, 25 bp, Homo sapien
tgtctgaagaggctgttgggctata

SEQ ID NO: 25991 - DNA, 25 bp, Homo sapien
ctatagtaaggagcgctcgggccgt

SEQ ID NO: 25992 - DNA, 25 bp, Homo sapien
ctgtcccatagtcccaccagttggg

SEQ ID NO: 25993 - DNA, 25 bp, Homo sapien
agggatgacctgtttttggccatga

SEQ ID NO: 25994 - DNA, 25 bp, Homo sapien
cacctccctagaaggaaggcgaatg

SEQ ID NO: 25995 - DNA, 25 bp, Homo sapien
ttgtcttggttgtgtggataagccc

SEQ ID NO: 25996 - DNA, 25 bp, Homo sapien
cgctccgctctttgttgtttggggc

SEQ ID NO: 25997 - DNA, 25 bp, Homo sapien
cttccatttagtcccgtggaacagg

SEQ ID NO: 25998 - DNA, 25 bp, Homo sapien
cggcctcctttgacagacctgggga

SEQ ID NO: 25999 - DNA, 25 bp, Homo sapien
ccctagtcacgtgagctgggctcct

SEQ ID NO: 26000 - DNA, 25 bp, Homo sapien
cccataaatcgtgagagcgacgtgc

SEQ ID NO: 26001 - DNA, 25 bp, Homo sapien
ctcagcgttcttaggggaagccaga

SEQ ID NO: 26002 - DNA, 25 bp, Homo sapien
ccttggagcacctcagcgttcttag

SEQ ID NO: 26003 - DNA, 25 bp, Homo sapien
ggctgactttccagctctatctagc

SEQ ID NO: 26004 - DNA, 25 bp, Homo sapien
acatcaccctcagcgcggaggttgc

SEQ ID NO: 26005 - DNA, 25 bp, Homo sapien
cccgaagagacgacatcatttgaac

SEQ ID NO: 26006 - DNA, 25 bp, Homo sapien
ttgaacactgaacactccgactccg

SEQ ID NO: 26007 - DNA, 25 bp, Homo sapien
ggtcgtcctgggattgaaacaatcc

SEQ ID NO: 26008 - DNA, 25 bp, Homo sapien
acttaactcgaggacagtgcgagcc

SEQ ID NO: 26009 - DNA, 25 bp, Homo sapien
ctttctgctgaaataagacgttcca

SEQ ID NO: 26010 - DNA, 25 bp, Homo sapien
aatgtctcggcttttggctctcgca

SEQ ID NO: 26011 - DNA, 25 bp, Homo sapien
cctccgttctctcaggtggaaaaga

SEQ ID NO: 26012 - DNA, 25 bp, Homo sapien
ctgcgccgtttctgtggcaaccaaa

SEQ ID NO: 26013 - DNA, 25 bp, Homo sapien
atctggatatttactgcccgcacta

SEQ ID NO: 26014 - DNA, 25 bp, Homo sapien
tgtacatggtgagccgcaacggcta

SEQ ID NO: 26015 - DNA, 25 bp, Homo sapien
cggagaagttccagcgctacagcgc

SEQ ID NO: 26016 - DNA, 25 bp, Homo sapien
gcgccttctctctgggctacgagtt

SEQ ID NO: 26017 - DNA, 25 bp, Homo sapien
tctgaacgcgagagtctgagtgaca

SEQ ID NO: 26018 - DNA, 25 bp, Homo sapien
tgcgcctttgctaccctctggtggc

SEQ ID NO: 26019 - DNA, 25 bp, Homo sapien
ccgtgcaggtgaacgtgaacgacta

SEQ ID NO: 26020 - DNA, 25 bp, Homo sapien
acacacgcggctgtgatactactca

SEQ ID NO: 26021 - DNA, 25 bp, Homo sapien
acaaatgctttcatgctagcgcgcc

SEQ ID NO: 26022 - DNA, 25 bp, Homo sapien
agcgcgccatcacacgtatttcatg

SEQ ID NO: 26023 - DNA, 25 bp, Homo sapien
gtttgtcacccttcatgcccagatt

SEQ ID NO: 26024 - DNA, 25 bp, Homo sapien
ttcaagagcctgttcgcacggtgta

SEQ ID NO: 26025 - DNA, 25 bp, Homo sapien
cacggtgtacgcgtgtgttgttaca

SEQ ID NO: 26026 - DNA, 25 bp, Homo sapien
ctttattcccggcatctaggcgatg

SEQ ID NO: 26027 - DNA, 25 bp, Homo sapien
ccgagaggcaaattccagtgggttt

SEQ ID NO: 26028 - DNA, 25 bp, Homo sapien
catttacggagcatgcgtggtcttc

SEQ ID NO: 26029 - DNA, 25 bp, Homo sapien
gcggctttctggactcgctcattta

SEQ ID NO: 26030 - DNA, 25 bp, Homo sapien
cctgtgggaacacgagcgttgagac

SEQ ID NO: 26031 - DNA, 25 bp, Homo sapien
cgtctagatgatccaaggggtaggc

SEQ ID NO: 26032 - DNA, 25 bp, Homo sapien
gacacacccgcggagccctaggaag

SEQ ID NO: 26033 - DNA, 25 bp, Homo sapien
tggctcgtccggaaccgggatcaaa

SEQ ID NO: 26034 - DNA, 25 bp, Homo sapien
gcgcgggatccgactctagtcgtaa

SEQ ID NO: 26035 - DNA, 25 bp, Homo sapien
tggtcttcacccttggcatgttctc

SEQ ID NO: 26036 - DNA, 25 bp, Homo sapien
cagtgcgatcgattcagcccgagga

SEQ ID NO: 26037 - DNA, 25 bp, Homo sapien
aaacggttctgcttggtgccatcca

SEQ ID NO: 26038 - DNA, 25 bp, Homo sapien
agcgcattggccagttcgtctttgc

SEQ ID NO: 26039 - DNA, 25 bp, Homo sapien
taaggcagccatggtactacaggtc

SEQ ID NO: 26040 - DNA, 25 bp, Homo sapien
tttagagcctaggaagcagatcttg

SEQ ID NO: 26041 - DNA, 25 bp, Homo sapien
cacggcctttgtaaccgccttggag

SEQ ID NO: 26042 - DNA, 25 bp, Homo sapien
gaagcctcgcctacttgacgtcata

SEQ ID NO: 26043 - DNA, 25 bp, Homo sapien
cgaggtccgctttcagtgtatggtt

SEQ ID NO: 26044 - DNA, 25 bp, Homo sapien
tggtgtactcctggccagcgcctca

SEQ ID NO: 26045 - DNA, 25 bp, Homo sapien
ccggatgttggcgtccggaagtcct

SEQ ID NO: 26046 - DNA, 25 bp, Homo sapien
gcgtccggaagtcctccctggttca

SEQ ID NO: 26047 - DNA, 25 bp, Homo sapien
tggttcacgttccgcttccgcgcgg

SEQ ID NO: 26048 - DNA, 25 bp, Homo sapien
gagttgtagttcacatggcggcgcc

SEQ ID NO: 26049 - DNA, 25 bp, Homo sapien
cagcgcctcaatctaggcgggggta

SEQ ID NO: 26050 - DNA, 25 bp, Homo sapien
acatggcggcgcctggtgtactcct

SEQ ID NO: 26051 - DNA, 25 bp, Homo sapien
ggctgtgctccgcaaacggggagca

SEQ ID NO: 26052 - DNA, 25 bp, Homo sapien
tccggcaagctacgggcagatcagc

SEQ ID NO: 26053 - DNA, 25 bp, Homo sapien
ttcttcctctcagtgcctggacgca

SEQ ID NO: 26054 - DNA, 25 bp, Homo sapien
atgcgtcagcgcttaccgcggactt

SEQ ID NO: 26055 - DNA, 25 bp, Homo sapien
tggaacccaggacacgtcagctctg

SEQ ID NO: 26056 - DNA, 25 bp, Homo sapien
gaggtgcccgtacccaccactggag

SEQ ID NO: 26057 - DNA, 25 bp, Homo sapien
tcaggctttcctcgtacctggtgcg

SEQ ID NO: 26058 - DNA, 25 bp, Homo sapien
gccctcttgcgacagggaggaaata

SEQ ID NO: 26059 - DNA, 25 bp, Homo sapien
tgcggttagctatgcgcatgcgtca

SEQ ID NO: 26060 - DNA, 25 bp, Homo sapien
tcgcctggctatcgggaggaatcac

SEQ ID NO: 26061 - DNA, 25 bp, Homo sapien
gccaacctcgcctggctatcgggag

SEQ ID NO: 26062 - DNA, 25 bp, Homo sapien
gcaggatggagtgccaacctcgcct

SEQ ID NO: 26063 - DNA, 25 bp, Homo sapien
agcgagcaggatggagtgccaacct

SEQ ID NO: 26064 - DNA, 25 bp, Homo sapien
gcaggaggacgtatggagcgagcag

SEQ ID NO: 26065 - DNA, 25 bp, Homo sapien
ttggtaagaccgatggggaagtgaa

SEQ ID NO: 26066 - DNA, 25 bp, Homo sapien
tgattcccccgctagttcggagaag

SEQ ID NO: 26067 - DNA, 25 bp, Homo sapien
cgagtaggcggggctcttgattccc

SEQ ID NO: 26068 - DNA, 25 bp, Homo sapien
gcgtctggaggaaatggagctaagc

SEQ ID NO: 26069 - DNA, 25 bp, Homo sapien
gaaatggagctaagcgggtggggtc

SEQ ID NO: 26070 - DNA, 25 bp, Homo sapien
ggccgcgcaagctgaggggccgctc

SEQ ID NO: 26071 - DNA, 25 bp, Homo sapien
gaggagtaagggcagcgctgcctaa

SEQ ID NO: 26072 - DNA, 25 bp, Homo sapien
cagcgctgcctaagtgaggcagcga

SEQ ID NO: 26073 - DNA, 25 bp, Homo sapien
agagaagggtcactgccgtggccag

SEQ ID NO: 26074 - DNA, 25 bp, Homo sapien
gggaggaacgcacagcatggtggac

SEQ ID NO: 26075 - DNA, 25 bp, Homo sapien
agtggtcaccgggagccttgcgggg

SEQ ID NO: 26076 - DNA, 25 bp, Homo sapien
tggacacgttctgtgtgggccgtta

SEQ ID NO: 26077 - DNA, 25 bp, Homo sapien
acacgttctgtgtgggccgttatgt

SEQ ID NO: 26078 - DNA, 25 bp, Homo sapien
tctgtgtgggccgttatgtacttaa

SEQ ID NO: 26079 - DNA, 25 bp, Homo sapien
tgtgggccgttatgtacttaagagg

SEQ ID NO: 26080 - DNA, 25 bp, Homo sapien
ccgttatgtacttaagaggcagatc

SEQ ID NO: 26081 - DNA, 25 bp, Homo sapien
atgtacttaagaggcagatcgggcg

SEQ ID NO: 26082 - DNA, 25 bp, Homo sapien
caccgaggtatgtgggagaggacgt

SEQ ID NO: 26083 - DNA, 25 bp, Homo sapien
tcctgaggtatgtggaaggggcacc

SEQ ID NO: 26084 - DNA, 25 bp, Homo sapien
atcccggcggatctttgatagactg

SEQ ID NO: 26085 - DNA, 25 bp, Homo sapien
acggaagcagttccgcctgtattca

SEQ ID NO: 26086 - DNA, 25 bp, Homo sapien
cacgggattggagcgcatcagatca

SEQ ID NO: 26087 - DNA, 25 bp, Homo sapien
catcagatcagcaggcgagagacca

SEQ ID NO: 26088 - DNA, 25 bp, Homo sapien
tcgcaggccggagaaaacacgagta

SEQ ID NO: 26089 - DNA, 25 bp, Homo sapien
tgccaagcaacagccattcagttcg

SEQ ID NO: 26090 - DNA, 25 bp, Homo sapien
gacgcggtgcagtgttgttttttcc

SEQ ID NO: 26091 - DNA, 25 bp, Homo sapien
gcgccgcgcagtctgagtacttaaa

SEQ ID NO: 26092 - DNA, 25 bp, Homo sapien
taacgcgctgtggaaaacatgctgc

SEQ ID NO: 26093 - DNA, 25 bp, Homo sapien
cgcagttcagctgccagtcgggcca

SEQ ID NO: 26094 - DNA, 25 bp, Homo sapien
ccgctccaaacataacgcgctgtgg

SEQ ID NO: 26095 - DNA, 25 bp, Homo sapien
cagtcgggccagaagaagcctcgcc

SEQ ID NO: 26096 - DNA, 25 bp, Homo sapien
ccacttggacgaggcgccgtgacac

SEQ ID NO: 26097 - DNA, 25 bp, Homo sapien
ggccacgtgcagtttggcaagagcc

SEQ ID NO: 26098 - DNA, 25 bp, Homo sapien
cctggagcagtacaggccacgtgca

SEQ ID NO: 26099 - DNA, 25 bp, Homo sapien
ccctgaccgcaacgatcggaggggc

SEQ ID NO: 26100 - DNA, 25 bp, Homo sapien
actacgcatgcgtctcagcgctttc

SEQ ID NO: 26101 - DNA, 25 bp, Homo sapien
gtgccagacgcgagaactacgcatg

SEQ ID NO: 26102 - DNA, 25 bp, Homo sapien
ataatgcctaccgtcggcgaagaga

SEQ ID NO: 26103 - DNA, 25 bp, Homo sapien
tcacttggaaaagagacggtcactc

SEQ ID NO: 26104 - DNA, 25 bp, Homo sapien
gtcactcatccagaggcgggactca

SEQ ID NO: 26105 - DNA, 25 bp, Homo sapien
cactaggcgcggaagtcaagaagca

SEQ ID NO: 26106 - DNA, 25 bp, Homo sapien
tttgaagacggacaactctccctga

SEQ ID NO: 26107 - DNA, 25 bp, Homo sapien
ccgcgctccgtgaacgtttgtcaca

SEQ ID NO: 26108 - DNA, 25 bp, Homo sapien
gcactcatagatgaccatatgtgcc

SEQ ID NO: 26109 - DNA, 25 bp, Homo sapien
agggtccacgcatgctcacactctg

SEQ ID NO: 26110 - DNA, 25 bp, Homo sapien
atgctcacactctgcgctcatggat

SEQ ID NO: 26111 - DNA, 25 bp, Homo sapien
cgcgtgctcacagcactcatagatg

SEQ ID NO: 26112 - DNA, 25 bp, Homo sapien
cgtgctcacgctctacgctcatgga

SEQ ID NO: 26113 - DNA, 25 bp, Homo sapien
acgctcatggatggccacatgtgcc

SEQ ID NO: 26114 - DNA, 25 bp, Homo sapien
agggtccacgtgtgctcacctgcgc

SEQ ID NO: 26115 - DNA, 25 bp, Homo sapien
ctgaaaacggcgtcagcctccggga

SEQ ID NO: 26116 - DNA, 25 bp, Homo sapien
gaacgtagtccacggagcgcacgga

SEQ ID NO: 26117 - DNA, 25 bp, Homo sapien
aagagaacgtagtccacggagcgca

SEQ ID NO: 26118 - DNA, 25 bp, Homo sapien
gatggagcgaaagagaacgtagtcc

SEQ ID NO: 26119 - DNA, 25 bp, Homo sapien
agagcaggaataggagcgggcagcc

SEQ ID NO: 26120 - DNA, 25 bp, Homo sapien
ggccagccctccaaccggtggcagc

SEQ ID NO: 26121 - DNA, 25 bp, Homo sapien
agctatcgctgaagcgacgagtcgg

SEQ ID NO: 26122 - DNA, 25 bp, Homo sapien
ggaacctgagctatcgctgaagcga

SEQ ID NO: 26123 - DNA, 25 bp, Homo sapien
gtgagggaacctgagctatcgctga

SEQ ID NO: 26124 - DNA, 25 bp, Homo sapien
cgcgtattccttggcgttcccggca

SEQ ID NO: 26125 - DNA, 25 bp, Homo sapien
ctccctggcacttgggagcatctca

SEQ ID NO: 26126 - DNA, 25 bp, Homo sapien
gagcatctcagaggcgcccaaggcc

SEQ ID NO: 26127 - DNA, 25 bp, Homo sapien
cggctcatcgcatctccctagggaa

SEQ ID NO: 26128 - DNA, 25 bp, Homo sapien
ttgtagttcgggactgagaccctgt

SEQ ID NO: 26129 - DNA, 25 bp, Homo sapien
aggcagtcggataagcgctcctcca

SEQ ID NO: 26130 - DNA, 25 bp, Homo sapien
gatcctttgggcctccacttgagcc

SEQ ID NO: 26131 - DNA, 25 bp, Homo sapien
accctggctaggctgctagtgatcc

SEQ ID NO: 26132 - DNA, 25 bp, Homo sapien
cattttggcgcccatcctgctggag

SEQ ID NO: 26133 - DNA, 25 bp, Homo sapien
tcttccttcgagacatgctgccggc

SEQ ID NO: 26134 - DNA, 25 bp, Homo sapien
ggaccggcaagcgacaacgttaagc

SEQ ID NO: 26135 - DNA, 25 bp, Homo sapien
gcgggaatcacgtgtcgccatcata

SEQ ID NO: 26136 - DNA, 25 bp, Homo sapien
tcgcctgtcgccacgtttcaggagc

SEQ ID NO: 26137 - DNA, 25 bp, Homo sapien
tttcaggagcaacgaggacacttcg

SEQ ID NO: 26138 - DNA, 25 bp, Homo sapien
cactccagaggagacgctttcaggg

SEQ ID NO: 26139 - DNA, 25 bp, Homo sapien
agccaccttggggaaacctgacagt

SEQ ID NO: 26140 - DNA, 25 bp, Homo sapien
cggccttcctagtctcccgagatgg

SEQ ID NO: 26141 - DNA, 25 bp, Homo sapien
gccgactggcgcaagtcacctgaaa

SEQ ID NO: 26142 - DNA, 25 bp, Homo sapien
gctctgagccatgtttgcaactgcg

SEQ ID NO: 26143 - DNA, 25 bp, Homo sapien
gcggtagccctcagagtccacttca

SEQ ID NO: 26144 - DNA, 25 bp, Homo sapien
cttctctgtgcacggattggttcca

SEQ ID NO: 26145 - DNA, 25 bp, Homo sapien
ttgcgcctgcgtcttgtccaaaagc

SEQ ID NO: 26146 - DNA, 25 bp, Homo sapien
tgaccgcccaaaagaggccgactgg

SEQ ID NO: 26147 - DNA, 25 bp, Homo sapien
ggcctcgcgtaggaatccggccttc

SEQ ID NO: 26148 - DNA, 25 bp, Homo sapien
ggtaactgctgttctcccgctgata

SEQ ID NO: 26149 - DNA, 25 bp, Homo sapien
ataggaatgccgatagtctgtgtca

SEQ ID NO: 26150 - DNA, 25 bp, Homo sapien
gtctgtgtcatagtaggcatctccc

SEQ ID NO: 26151 - DNA, 25 bp, Homo sapien
cccgatcccggctataatcgttgcg

SEQ ID NO: 26152 - DNA, 25 bp, Homo sapien
aatcgttgcgtctgtagctgccaca

SEQ ID NO: 26153 - DNA, 25 bp, Homo sapien
agctgccacagtatcgccggtcata

SEQ ID NO: 26154 - DNA, 25 bp, Homo sapien
ggtcatacaccctccggtcggacga

SEQ ID NO: 26155 - DNA, 25 bp, Homo sapien
tcccgctgatattcataggaatgcc

SEQ ID NO: 26156 - DNA, 25 bp, Homo sapien
taagatctgcttggcgccgctcgca

SEQ ID NO: 26157 - DNA, 25 bp, Homo sapien
cgtcgcttcgtaggtctcaactctc

SEQ ID NO: 26158 - DNA, 25 bp, Homo sapien
ggtcgccatcttttcgcgcggccag

SEQ ID NO: 26159 - DNA, 25 bp, Homo sapien
cgccgtgagcgagcacgtacgcacg

SEQ ID NO: 26160 - DNA, 25 bp, Homo sapien
ccaccacgtgctcacgtagttggca

SEQ ID NO: 26161 - DNA, 25 bp, Homo sapien
tcacgtagttggcaggcatccgcct

SEQ ID NO: 26162 - DNA, 25 bp, Homo sapien
ggcatccgcctgtcagagcctcgga

SEQ ID NO: 26163 - DNA, 25 bp, Homo sapien
gcctgtcagagcctcggaggtactg

SEQ ID NO: 26164 - DNA, 25 bp, Homo sapien
cggagttcctccaggatcccggcgt

SEQ ID NO: 26165 - DNA, 25 bp, Homo sapien
gagggcagggtacatcaatcccacc

SEQ ID NO: 26166 - DNA, 25 bp, Homo sapien
cggcagccacaaagcagtggaaatc

SEQ ID NO: 26167 - DNA, 25 bp, Homo sapien
tgctccagcctacggtcaacaagtt

SEQ ID NO: 26168 - DNA, 25 bp, Homo sapien
cctccctggttctcagtggatgaaa

SEQ ID NO: 26169 - DNA, 25 bp, Homo sapien
tacctgatggccacagagggctcta

SEQ ID NO: 26170 - DNA, 25 bp, Homo sapien
ctcagtggatgaaaggccaacgcta

SEQ ID NO: 26171 - DNA, 25 bp, Homo sapien
ccaaatctgggcctgagcctaagag

SEQ ID NO: 26172 - DNA, 25 bp, Homo sapien
acgggctggcaaaaacgcgtggcca

SEQ ID NO: 26173 - DNA, 25 bp, Homo sapien
cttccgactctggaccctaaggagg

SEQ ID NO: 26174 - DNA, 25 bp, Homo sapien
cctgcggacatggaaagagccagct

SEQ ID NO: 26175 - DNA, 25 bp, Homo sapien
cccgcaagaggtcaggaaccatgtc

SEQ ID NO: 26176 - DNA, 25 bp, Homo sapien
cttcgcccggaagaggcacagatgg

SEQ ID NO: 26177 - DNA, 25 bp, Homo sapien
cgcaccgattttctggaccactagg

SEQ ID NO: 26178 - DNA, 25 bp, Homo sapien
gatgagcccgtcgtcaatgtagatg

SEQ ID NO: 26179 - DNA, 25 bp, Homo sapien
cggcacgacccggacaatattgggg

SEQ ID NO: 26180 - DNA, 25 bp, Homo sapien
caacaagcgggaccgagcaggaatc

SEQ ID NO: 26181 - DNA, 25 bp, Homo sapien
cgtcacagtgccacagtgcgccatg

SEQ ID NO: 26182 - DNA, 25 bp, Homo sapien
cgcaggatcgcgttatctgtccctc

SEQ ID NO: 26183 - DNA, 25 bp, Homo sapien
ccctcccgcgggcacattgggagtt

SEQ ID NO: 26184 - DNA, 25 bp, Homo sapien
gagcgggaactactcgacccacaga

SEQ ID NO: 26185 - DNA, 25 bp, Homo sapien
atcgcggagcggattctgcttttag

SEQ ID NO: 26186 - DNA, 25 bp, Homo sapien
ctgcttttaggagtacccgccaaca

SEQ ID NO: 26187 - DNA, 25 bp, Homo sapien
cttccattggtcgtccgtcacagtg

SEQ ID NO: 26188 - DNA, 25 bp, Homo sapien
acgccacgcccatgcgcgaaggggt

SEQ ID NO: 26189 - DNA, 25 bp, Homo sapien
agccgcggacaagcccaaggccgga

SEQ ID NO: 26190 - DNA, 25 bp, Homo sapien
cccatgggtgtagaccgatggacct

SEQ ID NO: 26191 - DNA, 25 bp, Homo sapien
gacaagggagcaggagaaatgaata

SEQ ID NO: 26192 - DNA, 25 bp, Homo sapien
cgaatgcggagagaatggacatacc

SEQ ID NO: 26193 - DNA, 25 bp, Homo sapien
tggacataccgctgttccgaggggc

SEQ ID NO: 26194 - DNA, 25 bp, Homo sapien
cagccagcagatgcggagttgacaa

SEQ ID NO: 26195 - DNA, 25 bp, Homo sapien
gggtctgagctacgccacgcccatg

SEQ ID NO: 26196 - DNA, 25 bp, Homo sapien
aagttgttgcctttcctgctccgtg

SEQ ID NO: 26197 - DNA, 25 bp, Homo sapien
cgagtccagtcccacgcgggatgaa

SEQ ID NO: 26198 - DNA, 25 bp, Homo sapien
cgctctttcccagaagtagcacctt

SEQ ID NO: 26199 - DNA, 25 bp, Homo sapien
tttaagccgactccaagcaagtttg

SEQ ID NO: 26200 - DNA, 25 bp, Homo sapien
ccagcgagtctgttgttaggggctt

SEQ ID NO: 26201 - DNA, 25 bp, Homo sapien
ttgggtcacaccctctgtggaattc

SEQ ID NO: 26202 - DNA, 25 bp, Homo sapien
ccgggagctcattggcactagaggt

SEQ ID NO: 26203 - DNA, 25 bp, Homo sapien
ctccgcccaggctacgtaagacgga

SEQ ID NO: 26204 - DNA, 25 bp, Homo sapien
tggaatcgaaccaagtggaccaccg

SEQ ID NO: 26205 - DNA, 25 bp, Homo sapien
acctgggcagtcgtccacactcaga

SEQ ID NO: 26206 - DNA, 25 bp, Homo sapien
acactcagaccgtgaggctcggctc

SEQ ID NO: 26207 - DNA, 25 bp, Homo sapien
gcctggagcactgtggaatcgaacc

SEQ ID NO: 26208 - DNA, 25 bp, Homo sapien
ggccacggagcatgcaagagacaca

SEQ ID NO: 26209 - DNA, 25 bp, Homo sapien
ccgtggaatgttcccgcacgtcttc

SEQ ID NO: 26210 - DNA, 25 bp, Homo sapien
ttgcagagcagcgacctgggcagtc

SEQ ID NO: 26211 - DNA, 25 bp, Homo sapien
catgcaagagacacaagtgggcggt

SEQ ID NO: 26212 - DNA, 25 bp, Homo sapien
gactccgtccgcgtagcgcgcacgc

SEQ ID NO: 26213 - DNA, 25 bp, Homo sapien
ctgagcctacttcgcagtagcagga

SEQ ID NO: 26214 - DNA, 25 bp, Homo sapien
gttgacctgagcctacttcgcagta

SEQ ID NO: 26215 - DNA, 25 bp, Homo sapien
tttcctgccggttgacctgagccta

SEQ ID NO: 26216 - DNA, 25 bp, Homo sapien
agcggatcgaggactgcctagcgcc

SEQ ID NO: 26217 - DNA, 25 bp, Homo sapien
aattgccagaatggcggaccgagcc

SEQ ID NO: 26218 - DNA, 25 bp, Homo sapien
cttcgcagtagcaggaccgctgctg

SEQ ID NO: 26219 - DNA, 25 bp, Homo sapien
actggaattgccagaatggcggacc

SEQ ID NO: 26220 - DNA, 25 bp, Homo sapien
acagggcatgcgcacatctgaggtc

SEQ ID NO: 26221 - DNA, 25 bp, Homo sapien
cacatctgaggtcgcttagggctcg

SEQ ID NO: 26222 - DNA, 25 bp, Homo sapien
ttgccatcgtaaagctaagaagccg

SEQ ID NO: 26223 - DNA, 25 bp, Homo sapien
agccgccatacttgttgccatcgta

SEQ ID NO: 26224 - DNA, 25 bp, Homo sapien
tttcaaatctaccactagcagccgc

SEQ ID NO: 26225 - DNA, 25 bp, Homo sapien
gctcttcgatactcttcgcactttc

SEQ ID NO: 26226 - DNA, 25 bp, Homo sapien
ggtctgttctttccgctcttcgata

SEQ ID NO: 26227 - DNA, 25 bp, Homo sapien
agcacggctccaccaacagggcatg

SEQ ID NO: 26228 - DNA, 25 bp, Homo sapien
caataagtagccgagaataacaccc

SEQ ID NO: 26229 - DNA, 25 bp, Homo sapien
ggccaataagtagccgagaataaca

SEQ ID NO: 26230 - DNA, 25 bp, Homo sapien
gcccctcacaggcaaccacagagaa

SEQ ID NO: 26231 - DNA, 25 bp, Homo sapien
gcgggccaataagtagccgagaata

SEQ ID NO: 26232 - DNA, 25 bp, Homo sapien
tttgcgggccaataagtagccgaga

SEQ ID NO: 26233 - DNA, 25 bp, Homo sapien
taagtagccgagaataacacccgcc

SEQ ID NO: 26234 - DNA, 25 bp, Homo sapien
agtagccgagaataacacccgccca

SEQ ID NO: 26235 - DNA, 25 bp, Homo sapien
tgtttgcgggccaataagtagccga

SEQ ID NO: 26236 - DNA, 25 bp, Homo sapien
ggcaaccacagagaagccggactgg

SEQ ID NO: 26237 - DNA, 25 bp, Homo sapien
gccgagcgaccgattccaaggagcc

SEQ ID NO: 26238 - DNA, 25 bp, Homo sapien
ggagcccttcgggatctacagtccc

SEQ ID NO: 26239 - DNA, 25 bp, Homo sapien
acattttgccggtttcgtgggcgcg

SEQ ID NO: 26240 - DNA, 25 bp, Homo sapien
ctcacactgcagttgggacattttg

SEQ ID NO: 26241 - DNA, 25 bp, Homo sapien
cgcctgccaagccaatcggctagga

SEQ ID NO: 26242 - DNA, 25 bp, Homo sapien
ccgacgtcctgtatcgtacgggccg

SEQ ID NO: 26243 - DNA, 25 bp, Homo sapien
ttctccaatgggaaaggatgtgttt

SEQ ID NO: 26244 - DNA, 25 bp, Homo sapien
gtggccggccgagtcccatgacaac

SEQ ID NO: 26245 - DNA, 25 bp, Homo sapien
gaccggcaaagcgagtctggcttgc

SEQ ID NO: 26246 - DNA, 25 bp, Homo sapien
aagcgagtctggcttgccgtttgac

SEQ ID NO: 26247 - DNA, 25 bp, Homo sapien
cggatgacccgacccttttttgcag

SEQ ID NO: 26248 - DNA, 25 bp, Homo sapien
tttgcagtctcaggacgggcgcttt

SEQ ID NO: 26249 - DNA, 25 bp, Homo sapien
ccaggcagcgtgtgtcggtcgccta

SEQ ID NO: 26250 - DNA, 25 bp, Homo sapien
gactccggccatgtagcgcgcacgt

SEQ ID NO: 26251 - DNA, 25 bp, Homo sapien
ccgacccttttttgcagtctcagga

SEQ ID NO: 26252 - DNA, 25 bp, Homo sapien
cgcctctcgcggcaaccacagagaa

SEQ ID NO: 26253 - DNA, 25 bp, Homo sapien
agtcgccagtataacacccgcccac

SEQ ID NO: 26254 - DNA, 25 bp, Homo sapien
ataagtcgccagtataacacccgcc

SEQ ID NO: 26255 - DNA, 25 bp, Homo sapien
ccaataagtcgccagtataacaccc

SEQ ID NO: 26256 - DNA, 25 bp, Homo sapien
ggaccaataagtcgccagtataaca

SEQ ID NO: 26257 - DNA, 25 bp, Homo sapien
tgcggaccaataagtcgccagtata

SEQ ID NO: 26258 - DNA, 25 bp, Homo sapien
tttgcggaccaataagtcgccagta

SEQ ID NO: 26259 - DNA, 25 bp, Homo sapien
gtgtttgcggaccaataagtcgcca

SEQ ID NO: 26260 - DNA, 25 bp, Homo sapien
gttttggaaccacagcgcgtcagtg

SEQ ID NO: 26261 - DNA, 25 bp, Homo sapien
cgcagctgacaactaggggccggac

SEQ ID NO: 26262 - DNA, 25 bp, Homo sapien
cggagcatcttaagagctgagcgca

SEQ ID NO: 26263 - DNA, 25 bp, Homo sapien
gactgcacctgcatccttagctcag

SEQ ID NO: 26264 - DNA, 25 bp, Homo sapien
tctcatcaggaccagtctgactgca

SEQ ID NO: 26265 - DNA, 25 bp, Homo sapien
aggcggagcctacctctcatcagga

SEQ ID NO: 26266 - DNA, 25 bp, Homo sapien
cgagggctgacttccgtaatctttc

SEQ ID NO: 26267 - DNA, 25 bp, Homo sapien
gcgcggcctcattctcgggaaaact

SEQ ID NO: 26268 - DNA, 25 bp, Homo sapien
aggccgctttgtgtaccgcagaaag

SEQ ID NO: 26269 - DNA, 25 bp, Homo sapien
catcgtaatggtggggtccctccga

SEQ ID NO: 26270 - DNA, 25 bp, Homo sapien
gtgatgtctatttctgggcctcctg

SEQ ID NO: 26271 - DNA, 25 bp, Homo sapien
ggggatgacgtgatgtctatttctg

SEQ ID NO: 26272 - DNA, 25 bp, Homo sapien
gatgctaccaaatggcgcttggcgc

SEQ ID NO: 26273 - DNA, 25 bp, Homo sapien
ggggtccctccgatgctaccaaatg

SEQ ID NO: 26274 - DNA, 25 bp, Homo sapien
taccgcagaaagcattacgtcattt

SEQ ID NO: 26275 - DNA, 25 bp, Homo sapien
tacgtcatttcagagcggctggtcc

SEQ ID NO: 26276 - DNA, 25 bp, Homo sapien
cctgaagccgtacccgccagctcca

SEQ ID NO: 26277 - DNA, 25 bp, Homo sapien
gcggttccggtgaaaatgtcgattc

SEQ ID NO: 26278 - DNA, 25 bp, Homo sapien
cagcctcttccggtcgtggggccga

SEQ ID NO: 26279 - DNA, 25 bp, Homo sapien
tacgcacagcctcttccggtcgtgg

SEQ ID NO: 26280 - DNA, 25 bp, Homo sapien
gttcttacgcacagcctcttccggt

SEQ ID NO: 26281 - DNA, 25 bp, Homo sapien
ggacatggcgaccgcttctactcaa

SEQ ID NO: 26282 - DNA, 25 bp, Homo sapien
aatgtcgattccgattggactctcg

SEQ ID NO: 26283 - DNA, 25 bp, Homo sapien
cagctccaggatgtgtcgcgctccc

SEQ ID NO: 26284 - DNA, 25 bp, Homo sapien
tcttcggcctcacgctccagcagtg

SEQ ID NO: 26285 - DNA, 25 bp, Homo sapien
cggccagctgccttcgagcctcttc

SEQ ID NO: 26286 - DNA, 25 bp, Homo sapien
ccgccgaggatccacaggtctgcgg

SEQ ID NO: 26287 - DNA, 25 bp, Homo sapien
ttcggttgcccgttcttcacctagc

SEQ ID NO: 26288 - DNA, 25 bp, Homo sapien
gctgcgccgccgaggatccacaggt

SEQ ID NO: 26289 - DNA, 25 bp, Homo sapien
ccgttcttcacctagccgccggcag

SEQ ID NO: 26290 - DNA, 25 bp, Homo sapien
caggctgccagcttcggttgcccgt

SEQ ID NO: 26291 - DNA, 25 bp, Homo sapien
cagtgcccgggcctgctcactctcc

SEQ ID NO: 26292 - DNA, 25 bp, Homo sapien
cccgcacgcgttggtctcggggaca

SEQ ID NO: 26293 - DNA, 25 bp, Homo sapien
gaacgaccaagccagcgattgggga

SEQ ID NO: 26294 - DNA, 25 bp, Homo sapien
cggagcaactttctttcaagcggcc

SEQ ID NO: 26295 - DNA, 25 bp, Homo sapien
ttcaagcggcctaaagcactcggtc

SEQ ID NO: 26296 - DNA, 25 bp, Homo sapien
tcccgccggcttggaggcgaccaag

SEQ ID NO: 26297 - DNA, 25 bp, Homo sapien
cgtgagggattcgatccgagacata

SEQ ID NO: 26298 - DNA, 25 bp, Homo sapien
ctcggggacaggaagtctgactccc

SEQ ID NO: 26299 - DNA, 25 bp, Homo sapien
tccgcccgattttggcgcccagaaa

SEQ ID NO: 26300 - DNA, 25 bp, Homo sapien
tcccgcctcttgcaaggttacacgt

SEQ ID NO: 26301 - DNA, 25 bp, Homo sapien
cctttccggagccacaaagacagga

SEQ ID NO: 26302 - DNA, 25 bp, Homo sapien
agagagcgtcagcatccgaaagacc

SEQ ID NO: 26303 - DNA, 25 bp, Homo sapien
tccggacttaccgttggcatcccaa

SEQ ID NO: 26304 - DNA, 25 bp, Homo sapien
agcactggccggaaaccgtggtgtt

SEQ ID NO: 26305 - DNA, 25 bp, Homo sapien
tgagatcccattcgtcctcgcctgt

SEQ ID NO: 26306 - DNA, 25 bp, Homo sapien
tcgcctgtcacatccctttcttggt

SEQ ID NO: 26307 - DNA, 25 bp, Homo sapien
ccgaaagaccggaaataagcactgg

SEQ ID NO: 26308 - DNA, 25 bp, Homo sapien
gacccagtcgccgtcgtacttgtca

SEQ ID NO: 26309 - DNA, 25 bp, Homo sapien
ggcctgctcgggacgcactcagctt

SEQ ID NO: 26310 - DNA, 25 bp, Homo sapien
ccaccctagatggtaggcctgctcg

SEQ ID NO: 26311 - DNA, 25 bp, Homo sapien
cgaggcaaaaataggcccgagcaga

SEQ ID NO: 26312 - DNA, 25 bp, Homo sapien
aggcactgcgggaccgaggcaaaaa

SEQ ID NO: 26313 - DNA, 25 bp, Homo sapien
tggcagtgactcagaccggctcctc

SEQ ID NO: 26314 - DNA, 25 bp, Homo sapien
acgcacggagtccactctcaacagg

SEQ ID NO: 26315 - DNA, 25 bp, Homo sapien
cgtcgtacttgtcaccgttcctggg

SEQ ID NO: 26316 - DNA, 25 bp, Homo sapien
gtgctcccagggaagcctctgcacg

SEQ ID NO: 26317 - DNA, 25 bp, Homo sapien
taccgccgccagagtccaggtgatt

SEQ ID NO: 26318 - DNA, 25 bp, Homo sapien
cgcgaggcatcacgcaagctgcgct

SEQ ID NO: 26319 - DNA, 25 bp, Homo sapien
cgggaatgaaagtgcactctgcctt

SEQ ID NO: 26320 - DNA, 25 bp, Homo sapien
ccggggtcacccaggacagtgattt

SEQ ID NO: 26321 - DNA, 25 bp, Homo sapien
tcccaattaacacccgagaggctgc

SEQ ID NO: 26322 - DNA, 25 bp, Homo sapien
tcgcctagcgacctaacgccgaggg

SEQ ID NO: 26323 - DNA, 25 bp, Homo sapien
agaggctgtttgcatctcggcccgg

SEQ ID NO: 26324 - DNA, 25 bp, Homo sapien
gcgtggcctttcagagccttggttt

SEQ ID NO: 26325 - DNA, 25 bp, Homo sapien
ttgaaagtaaccaaaggcgtgcctg

SEQ ID NO: 26326 - DNA, 25 bp, Homo sapien
cgcgaggccacaaagaactacgatt

SEQ ID NO: 26327 - DNA, 25 bp, Homo sapien
gttaaatgtccttccagcgctgctg

SEQ ID NO: 26328 - DNA, 25 bp, Homo sapien
gccaagcggacacgttgattccttt

SEQ ID NO: 26329 - DNA, 25 bp, Homo sapien
aaggactttctgtgtcgccgcttta

SEQ ID NO: 26330 - DNA, 25 bp, Homo sapien
gccgctttatctccgttccctgtga

SEQ ID NO: 26331 - DNA, 25 bp, Homo sapien
tcgcggcctgaatggtctattaaga

SEQ ID NO: 26332 - DNA, 25 bp, Homo sapien
ttgcccacgccatagcccggaaaga

SEQ ID NO: 26333 - DNA, 25 bp, Homo sapien
gcaccgcgatgtgcgtctcgatctc

SEQ ID NO: 26334 - DNA, 25 bp, Homo sapien
tactcgaggatcttgccagtgcgca

SEQ ID NO: 26335 - DNA, 25 bp, Homo sapien
tggggcctcaaagccagagtccact

SEQ ID NO: 26336 - DNA, 25 bp, Homo sapien
acgccgtagtacacatcctgcttgc

SEQ ID NO: 26337 - DNA, 25 bp, Homo sapien
gcagtcacttcgctctcaaagcaga

SEQ ID NO: 26338 - DNA, 25 bp, Homo sapien
gctccgctgctgagatgatttcccg

SEQ ID NO: 26339 - DNA, 25 bp, Homo sapien
cccgccaggaagtcgttttcattgt

SEQ ID NO: 26340 - DNA, 25 bp, Homo sapien
gcgcagctcggcctctttgtagaga

SEQ ID NO: 26341 - DNA, 25 bp, Homo sapien
tgaactttccgcgctagggacgagg

SEQ ID NO: 26342 - DNA, 25 bp, Homo sapien
agtccctctcagtggtcccggcgcc

SEQ ID NO: 26343 - DNA, 25 bp, Homo sapien
gcttaccttgcctgcccacgatctc

SEQ ID NO: 26344 - DNA, 25 bp, Homo sapien
aggtgggcacgggaacacactccgt

SEQ ID NO: 26345 - DNA, 25 bp, Homo sapien
cacactccgtggtgttgctgctgcc

SEQ ID NO: 26346 - DNA, 25 bp, Homo sapien
tggtgttgctgctgcccttcaggcg

SEQ ID NO: 26347 - DNA, 25 bp, Homo sapien
tgtagagagcgcagagcttggcgtc

SEQ ID NO: 26348 - DNA, 25 bp, Homo sapien
atgtggccttcggtctttcctcgca

SEQ ID NO: 26349 - DNA, 25 bp, Homo sapien
ttttaaatgaactggatggagcagc

SEQ ID NO: 26350 - DNA, 25 bp, Homo sapien
caaattccttgacccgaggaggata

SEQ ID NO: 26351 - DNA, 25 bp, Homo sapien
tgggatggaagtcgaggtccctaat

SEQ ID NO: 26352 - DNA, 25 bp, Homo sapien
tatgaagctggctaacgccgcgcgc

SEQ ID NO: 26353 - DNA, 25 bp, Homo sapien
gcccgcttttttatggaaatgagga

SEQ ID NO: 26354 - DNA, 25 bp, Homo sapien
ccagcgctcaaactcttttgtttta

SEQ ID NO: 26355 - DNA, 25 bp, Homo sapien
tatgcggaaacagagcgggtatgaa

SEQ ID NO: 26356 - DNA, 25 bp, Homo sapien
tgactcagtagccaaggagcgcgcc

SEQ ID NO: 26357 - DNA, 25 bp, Homo sapien
gggatgcccgcaagacccttgactc

SEQ ID NO: 26358 - DNA, 25 bp, Homo sapien
aggtgtccggcatcaaggccgccta

SEQ ID NO: 26359 - DNA, 25 bp, Homo sapien
tgcgccttcgcatcaccgagtctga

SEQ ID NO: 26360 - DNA, 25 bp, Homo sapien
gcgctcgctggaaacggagaacgca

SEQ ID NO: 26361 - DNA, 25 bp, Homo sapien
tctacatcgaccgtgtgcgctcgct

SEQ ID NO: 26362 - DNA, 25 bp, Homo sapien
ctcaatgatcgcttggcggtctaca

SEQ ID NO: 26363 - DNA, 25 bp, Homo sapien
gagcagtctctgtccttcgacccga

SEQ ID NO: 26364 - DNA, 25 bp, Homo sapien
cgcaaactggagtccactgagagcc

SEQ ID NO: 26365 - DNA, 25 bp, Homo sapien
cgaagcttcgagacctggaggactc

SEQ ID NO: 26366 - DNA, 25 bp, Homo sapien
gacgagtaccaggagcttctggaca

SEQ ID NO: 26367 - DNA, 25 bp, Homo sapien
cttctggacatcaagctggccctgg

SEQ ID NO: 26368 - DNA, 25 bp, Homo sapien
cacgcctaccgcaagctcttggagg

SEQ ID NO: 26369 - DNA, 25 bp, Homo sapien
tctggccggcaactggccttgacta

SEQ ID NO: 26370 - DNA, 25 bp, Homo sapien
gcgtcaccaaaaagcgcaaactgga

SEQ ID NO: 26371 - DNA, 25 bp, Homo sapien
tctcactcatcccagacacagggtg

SEQ ID NO: 26372 - DNA, 25 bp, Homo sapien
tcagttctcggaagtgcggcacatc

SEQ ID NO: 26373 - DNA, 25 bp, Homo sapien
tggctaccaggaggccgtcagttct

SEQ ID NO: 26374 - DNA, 25 bp, Homo sapien
tcactcctgggaggctcaaaggctc

SEQ ID NO: 26375 - DNA, 25 bp, Homo sapien
tgacagagtcctaatttccggttcc

SEQ ID NO: 26376 - DNA, 25 bp, Homo sapien
gcagtaccggtagcccagtcgagat

SEQ ID NO: 26377 - DNA, 25 bp, Homo sapien
ttcgctgggaacgacggatagactg

SEQ ID NO: 26378 - DNA, 25 bp, Homo sapien
gtggctactgcccaaatccaagatg

SEQ ID NO: 26379 - DNA, 25 bp, Homo sapien
ggcgccttaacgctgagggcataac

SEQ ID NO: 26380 - DNA, 25 bp, Homo sapien
cccggcactaccatttcgagggtga

SEQ ID NO: 26381 - DNA, 25 bp, Homo sapien
tgcttccaatcggaggcacccttcg

SEQ ID NO: 26382 - DNA, 25 bp, Homo sapien
cgagctttggcttgcgcgtattttt

SEQ ID NO: 26383 - DNA, 25 bp, Homo sapien
ccctgctcggtgacagacgttctac

SEQ ID NO: 26384 - DNA, 25 bp, Homo sapien
tgaagctcctcgacaccatggtgga

SEQ ID NO: 26385 - DNA, 25 bp, Homo sapien
gtcgtcttcggaatctgtgccaccc

SEQ ID NO: 26386 - DNA, 25 bp, Homo sapien
ggccgaagcaagtagcgccaatcta

SEQ ID NO: 26387 - DNA, 25 bp, Homo sapien
tgttggcaccgaagctcaaatcccg

SEQ ID NO: 26388 - DNA, 25 bp, Homo sapien
cgtgctcctgcttgagccgcctgct

SEQ ID NO: 26389 - DNA, 25 bp, Homo sapien
ttctcgtctccgctgggttgtccgc

SEQ ID NO: 26390 - DNA, 25 bp, Homo sapien
tgtcctctggcgacctgtcgctgga

SEQ ID NO: 26391 - DNA, 25 bp, Homo sapien
tctggcctaccggtgacccggctag

SEQ ID NO: 26392 - DNA, 25 bp, Homo sapien
gcgggcctgctgatctctcgcgcgt

SEQ ID NO: 26393 - DNA, 25 bp, Homo sapien
cgtgtcaggcgttctcgtctccgct

SEQ ID NO: 26394 - DNA, 25 bp, Homo sapien
ttggccagggccgatcgactcgctg

SEQ ID NO: 26395 - DNA, 25 bp, Homo sapien
cactggctccgtgccgtgcgtgtca

SEQ ID NO: 26396 - DNA, 25 bp, Homo sapien
ccaggagccgccacaggaagtacct

SEQ ID NO: 26397 - DNA, 25 bp, Homo sapien
agtggtacggctccgcacggaagcc

SEQ ID NO: 26398 - DNA, 25 bp, Homo sapien
accagcagcggccagtggtacggct

SEQ ID NO: 26399 - DNA, 25 bp, Homo sapien
cagcaggaagaccagcagcggccag

SEQ ID NO: 26400 - DNA, 25 bp, Homo sapien
cgccgtagtcgaggaagtagcagat

SEQ ID NO: 26401 - DNA, 25 bp, Homo sapien
ccagactgtagaggctgagcgcgcc

SEQ ID NO: 26402 - DNA, 25 bp, Homo sapien
ctgtccggctcacccagactgtaga

SEQ ID NO: 26403 - DNA, 25 bp, Homo sapien
ctctgagctcaaggccgcggcctgg

SEQ ID NO: 26404 - DNA, 25 bp, Homo sapien
ccgagggagacgcaccaagtgcttc

SEQ ID NO: 26405 - DNA, 25 bp, Homo sapien
tcgccacgatttcgaaacgggagcc

SEQ ID NO: 26406 - DNA, 25 bp, Homo sapien
agagagtgtgctccttgtccacgtg

SEQ ID NO: 26407 - DNA, 25 bp, Homo sapien
ctcaccaggtgaagagtttgccttt

SEQ ID NO: 26408 - DNA, 25 bp, Homo sapien
accatacctggtgtgcgtgttgagc

SEQ ID NO: 26409 - DNA, 25 bp, Homo sapien
ccgacgccaggtgaagcgcaccata

SEQ ID NO: 26410 - DNA, 25 bp, Homo sapien
aggtgggcactcctccttcacagca

SEQ ID NO: 26411 - DNA, 25 bp, Homo sapien
tttgccttttatcctgcgcagcagg

SEQ ID NO: 26412 - DNA, 25 bp, Homo sapien
ggcacctggacctctactttccgag

SEQ ID NO: 26413 - DNA, 25 bp, Homo sapien
ctactttccgaggtgagcatttggg

SEQ ID NO: 26414 - DNA, 25 bp, Homo sapien
agcggaagtgctcgctgcagcttcc

SEQ ID NO: 26415 - DNA, 25 bp, Homo sapien
ccgagggttctcttagcgaccagca

SEQ ID NO: 26416 - DNA, 25 bp, Homo sapien
ttccattggtctttgtcgcaagggg

SEQ ID NO: 26417 - DNA, 25 bp, Homo sapien
ccgcgcaatctctggagcgaagcta

SEQ ID NO: 26418 - DNA, 25 bp, Homo sapien
gcaacgcccgcttccattggtcttt

SEQ ID NO: 26419 - DNA, 25 bp, Homo sapien
gcgatcgcaccctgaatggagccca

SEQ ID NO: 26420 - DNA, 25 bp, Homo sapien
gctgtcgatgctgatgtggaacctc

SEQ ID NO: 26421 - DNA, 25 bp, Homo sapien
acgtttctgccactgctgtcgatgc

SEQ ID NO: 26422 - DNA, 25 bp, Homo sapien
ttcggctacggcctgacgtttctgc

SEQ ID NO: 26423 - DNA, 25 bp, Homo sapien
gagccggagcgcatgctcactgcca

SEQ ID NO: 26424 - DNA, 25 bp, Homo sapien
cttccgaggcttcggctacggcctg

SEQ ID NO: 26425 - DNA, 25 bp, Homo sapien
tctactacatgttcgtggtggagcc

SEQ ID NO: 26426 - DNA, 25 bp, Homo sapien
gctgatgtggaacctctactacatg

SEQ ID NO: 26427 - DNA, 25 bp, Homo sapien
agcgcatgctcactgccaccgagag

SEQ ID NO: 26428 - DNA, 25 bp, Homo sapien
tggcagttggccagcacaccactac

SEQ ID NO: 26429 - DNA, 25 bp, Homo sapien
gttaaactgtgtattgcgactcggc

SEQ ID NO: 26430 - DNA, 25 bp, Homo sapien
caccgcaggtgaggtcgttaaactg

SEQ ID NO: 26431 - DNA, 25 bp, Homo sapien
ccactacgcatgtgtgtcaactcta

SEQ ID NO: 26432 - DNA, 25 bp, Homo sapien
ccagacaagttagacagagagcgca

SEQ ID NO: 26433 - DNA, 25 bp, Homo sapien
cctacgcaagaacggccagacaagt

SEQ ID NO: 26434 - DNA, 25 bp, Homo sapien
attgcgactcggctcctatcggacc

SEQ ID NO: 26435 - DNA, 25 bp, Homo sapien
cggctttcggttaacaccgcaggtg

SEQ ID NO: 26436 - DNA, 25 bp, Homo sapien
cacagtaacgcggacaatgaatttt

SEQ ID NO: 26437 - DNA, 25 bp, Homo sapien
cgtaacagtgccaggatcagcgcca

SEQ ID NO: 26438 - DNA, 25 bp, Homo sapien
atcagcgccaggactgtgcgactcc

SEQ ID NO: 26439 - DNA, 25 bp, Homo sapien
gccgggaattgtctgccaaagcctg

SEQ ID NO: 26440 - DNA, 25 bp, Homo sapien
ctctttgctgtctttgtccgctaca

SEQ ID NO: 26441 - DNA, 25 bp, Homo sapien
ccaaggacctggcaccgtaacagtg

SEQ ID NO: 26442 - DNA, 25 bp, Homo sapien
tggcaccggagcaaccacagtaacg

SEQ ID NO: 26443 - DNA, 25 bp, Homo sapien
ttactttcgctacccaagtgagtgc

SEQ ID NO: 26444 - DNA, 25 bp, Homo sapien
gaaaggcctgagattccccgctatt

SEQ ID NO: 26445 - DNA, 25 bp, Homo sapien
ccaactcggggaggaattagacacg

SEQ ID NO: 26446 - DNA, 25 bp, Homo sapien
attagacacggcgtgagtgtcccaa

SEQ ID NO: 26447 - DNA, 25 bp, Homo sapien
acacggcgtgagtgtcccaagtgcg

SEQ ID NO: 26448 - DNA, 25 bp, Homo sapien
ccgctattgggattcacatcacgac

SEQ ID NO: 26449 - DNA, 25 bp, Homo sapien
cccgctattgggattcacatcacga

SEQ ID NO: 26450 - DNA, 25 bp, Homo sapien
agacacggcgtgagtgtcccaagtg

SEQ ID NO: 26451 - DNA, 25 bp, Homo sapien
caactcggggaggaattagacacgg

SEQ ID NO: 26452 - DNA, 25 bp, Homo sapien
cggccacgtcgccaactcagaaagg

SEQ ID NO: 26453 - DNA, 25 bp, Homo sapien
gagatccgggagagtacccatgaga

SEQ ID NO: 26454 - DNA, 25 bp, Homo sapien
tcctaataggaagcagggaaatccc

SEQ ID NO: 26455 - DNA, 25 bp, Homo sapien
gaaatcccggcgacccaaagagaga

SEQ ID NO: 26456 - DNA, 25 bp, Homo sapien
agatcgagggcgcatccgacagcca

SEQ ID NO: 26457 - DNA, 25 bp, Homo sapien
cacccagggttgtgaaaatggccgg

SEQ ID NO: 26458 - DNA, 25 bp, Homo sapien
gccggattcaagaggccgactaaaa

SEQ ID NO: 26459 - DNA, 25 bp, Homo sapien
ctcccaagcgagtctctcaaggaga

SEQ ID NO: 26460 - DNA, 25 bp, Homo sapien
ggcagcgattcggactcccgctttc

SEQ ID NO: 26461 - DNA, 25 bp, Homo sapien
gtcaagcggagcctcggtccagcct

SEQ ID NO: 26462 - DNA, 25 bp, Homo sapien
gactgcaggtctgggtcctctgtgt

SEQ ID NO: 26463 - DNA, 25 bp, Homo sapien
tcggactcccgctttcgacaaagtc

SEQ ID NO: 26464 - DNA, 25 bp, Homo sapien
ttcgacaaagtctcagctccgcagc

SEQ ID NO: 26465 - DNA, 25 bp, Homo sapien
aggcgaagaaacaacagggctagga

SEQ ID NO: 26466 - DNA, 25 bp, Homo sapien
acccacagagagtcgcgggagcccg

SEQ ID NO: 26467 - DNA, 25 bp, Homo sapien
ccctgcatgcgcagtgtctgggttc

SEQ ID NO: 26468 - DNA, 25 bp, Homo sapien
cgtggcggctgatgcacagtaaata

SEQ ID NO: 26469 - DNA, 25 bp, Homo sapien
cccttcgccttagatggagattttc

SEQ ID NO: 26470 - DNA, 25 bp, Homo sapien
ctgatgattccgtctgccactggca

SEQ ID NO: 26471 - DNA, 25 bp, Homo sapien
tggccgaacccattgtctcatttgc

SEQ ID NO: 26472 - DNA, 25 bp, Homo sapien
actatgtgatttctgccttcgggga

SEQ ID NO: 26473 - DNA, 25 bp, Homo sapien
ccgacagcgtcgtcaccagctttta

SEQ ID NO: 26474 - DNA, 25 bp, Homo sapien
gcggggaccgcactttatgagacca

SEQ ID NO: 26475 - DNA, 25 bp, Homo sapien
ttgagcgtcttctgtgtgccataca

SEQ ID NO: 26476 - DNA, 25 bp, Homo sapien
ctgttaaaatgtcagtcgctcccga

SEQ ID NO: 26477 - DNA, 25 bp, Homo sapien
tcgggctccaaaggtaactcctcca

SEQ ID NO: 26478 - DNA, 25 bp, Homo sapien
ccgcctcggctgttgttgatatttt

SEQ ID NO: 26479 - DNA, 25 bp, Homo sapien
aataataaatgaggccggcgtccgc

SEQ ID NO: 26480 - DNA, 25 bp, Homo sapien
tcacggcaaagagcgggtagccctc

SEQ ID NO: 26481 - DNA, 25 bp, Homo sapien
gtggcaggcgcattatttttctcta

SEQ ID NO: 26482 - DNA, 25 bp, Homo sapien
ggaattgcagcccactccacttgtc

SEQ ID NO: 26483 - DNA, 25 bp, Homo sapien
gccgacgtaggcacagctcagccta

SEQ ID NO: 26484 - DNA, 25 bp, Homo sapien
cccaggacagaaagtttgccgaata

SEQ ID NO: 26485 - DNA, 25 bp, Homo sapien
ttgtcatcgcaaactctagtcgccg

SEQ ID NO: 26486 - DNA, 25 bp, Homo sapien
ccagctgccattgacgtcacgcgtg

SEQ ID NO: 26487 - DNA, 25 bp, Homo sapien
ctttccgcggaaggacataattgtc

SEQ ID NO: 26488 - DNA, 25 bp, Homo sapien
ctagtcgccgccgacttcagctgta

SEQ ID NO: 26489 - DNA, 25 bp, Homo sapien
tcagctgtaccacgcctttttcttg

SEQ ID NO: 26490 - DNA, 25 bp, Homo sapien
ctgatcgctaacgagggagtggccc

SEQ ID NO: 26491 - DNA, 25 bp, Homo sapien
agccagggcaccgacggactatttc

SEQ ID NO: 26492 - DNA, 25 bp, Homo sapien
cgcacagtgagggtcggtccatcct

SEQ ID NO: 26493 - DNA, 25 bp, Homo sapien
tcgttcatttcagcacttcctgggg

SEQ ID NO: 26494 - DNA, 25 bp, Homo sapien
cgtttctccaaccaagggtcgctgg

SEQ ID NO: 26495 - DNA, 25 bp, Homo sapien
cgtctctttcggagccaggtaacca

SEQ ID NO: 26496 - DNA, 25 bp, Homo sapien
tgcgcgcgtgggaagctactttccc

SEQ ID NO: 26497 - DNA, 25 bp, Homo sapien
tgagctctgaacaagcctatccgga

SEQ ID NO: 26498 - DNA, 25 bp, Homo sapien
gtaagtcccaacacgaacagccagg

SEQ ID NO: 26499 - DNA, 25 bp, Homo sapien
accaggggacctcgttcatttcagc

SEQ ID NO: 26500 - DNA, 25 bp, Homo sapien
accgctgagaatcctgggatttgta

SEQ ID NO: 26501 - DNA, 25 bp, Homo sapien
cgctcacagttccactcgggcccac

SEQ ID NO: 26502 - DNA, 25 bp, Homo sapien
gggctgaggattcccgtcccactga

SEQ ID NO: 26503 - DNA, 25 bp, Homo sapien
cctcaggcttcacgcccgacacacg

SEQ ID NO: 26504 - DNA, 25 bp, Homo sapien
gcaccactgcgagacccttctctga

SEQ ID NO: 26505 - DNA, 25 bp, Homo sapien
tttgaatctcccgccgttgggccac

SEQ ID NO: 26506 - DNA, 25 bp, Homo sapien
gtcggcaccgccagacaggacactt

SEQ ID NO: 26507 - DNA, 25 bp, Homo sapien
cgtccacaccgctgagaatcctggg

SEQ ID NO: 26508 - DNA, 25 bp, Homo sapien
gcagatgcggcgctaaccttctctc

SEQ ID NO: 26509 - DNA, 25 bp, Homo sapien
ccttgtggctatggtctgtactttc

SEQ ID NO: 26510 - DNA, 25 bp, Homo sapien
caccgtcttgtgtgtgacgaggaca

SEQ ID NO: 26511 - DNA, 25 bp, Homo sapien
cgcaatcgctgttctgttacccgca

SEQ ID NO: 26512 - DNA, 25 bp, Homo sapien
ctggccgattctggtgatgtacttc

SEQ ID NO: 26513 - DNA, 25 bp, Homo sapien
caacgtcccggtgttctggccgatt

SEQ ID NO: 26514 - DNA, 25 bp, Homo sapien
ctgtatcacgatgaagaggcaaatc

SEQ ID NO: 26515 - DNA, 25 bp, Homo sapien
cccacttgaaggcatgcggctacca

SEQ ID NO: 26516 - DNA, 25 bp, Homo sapien
gcttccggaatccgcgcgtgctggc

SEQ ID NO: 26517 - DNA, 25 bp, Homo sapien
agtacctgaggtaggcacgggtctc

SEQ ID NO: 26518 - DNA, 25 bp, Homo sapien
ggccacctgcgcgacagagaacacg

SEQ ID NO: 26519 - DNA, 25 bp, Homo sapien
acctgcgcgacagagaacacgaggg

SEQ ID NO: 26520 - DNA, 25 bp, Homo sapien
cgtgccgcggatcaaaagccagacc

SEQ ID NO: 26521 - DNA, 25 bp, Homo sapien
ggcgcgcgctctgcgagctggatgt

SEQ ID NO: 26522 - DNA, 25 bp, Homo sapien
tggcgagcacggtggtgaagtacct

SEQ ID NO: 26523 - DNA, 25 bp, Homo sapien
actcagaggtcatggcgagcacggt

SEQ ID NO: 26524 - DNA, 25 bp, Homo sapien
tgtggtgtttccgtaccaacccagc

SEQ ID NO: 26525 - DNA, 25 bp, Homo sapien
tcaattactacgaggcgaagcaggc

SEQ ID NO: 26526 - DNA, 25 bp, Homo sapien
tggctcctgcctatgacgcctctta

SEQ ID NO: 26527 - DNA, 25 bp, Homo sapien
aggagtggacctcagcttgagatca

SEQ ID NO: 26528 - DNA, 25 bp, Homo sapien
aagctcgatccagcacctctgcggt

SEQ ID NO: 26529 - DNA, 25 bp, Homo sapien
aggccaagtgttcttcgtgcccggg

SEQ ID NO: 26530 - DNA, 25 bp, Homo sapien
ccattcctgtgtagcagcgggtccg

SEQ ID NO: 26531 - DNA, 25 bp, Homo sapien
gctgacgctgtctgaagcccacgcg

SEQ ID NO: 26532 - DNA, 25 bp, Homo sapien
gctgctcgcagtctgatcagcaacc

SEQ ID NO: 26533 - DNA, 25 bp, Homo sapien
gagatttccgaccttgtcccaggca

SEQ ID NO: 26534 - DNA, 25 bp, Homo sapien
ggtagcgttccggatcagtccttgc

SEQ ID NO: 26535 - DNA, 25 bp, Homo sapien
gatctacatgcttccagctctgcca

SEQ ID NO: 26536 - DNA, 25 bp, Homo sapien
ctgctgccatctctgatctacatgc

SEQ ID NO: 26537 - DNA, 25 bp, Homo sapien
aggcgacaaacttcgcagtgccgcg

SEQ ID NO: 26538 - DNA, 25 bp, Homo sapien
gatgtcctacttcgctcgtccttgc

SEQ ID NO: 26539 - DNA, 25 bp, Homo sapien
tcggcttctcatccgctgaacgatg

SEQ ID NO: 26540 - DNA, 25 bp, Homo sapien
cagcgttaagttccagccggctcca

SEQ ID NO: 26541 - DNA, 25 bp, Homo sapien
cgcgtcaaggtgaacgaggcctacc

SEQ ID NO: 26542 - DNA, 25 bp, Homo sapien
gaccgcgcttttcgcgtgcgcatcg

SEQ ID NO: 26543 - DNA, 25 bp, Homo sapien
cgcgggtcaagtggactttcctgtc

SEQ ID NO: 26544 - DNA, 25 bp, Homo sapien
gtccagcacggcatcgatgacagca

SEQ ID NO: 26545 - DNA, 25 bp, Homo sapien
tcaggtatctatcgctgtgaggtcc

SEQ ID NO: 26546 - DNA, 25 bp, Homo sapien
gtggcactgcctgcgtacccagcgt

SEQ ID NO: 26547 - DNA, 25 bp, Homo sapien
acccgttcacagaggaccgcgcttt

SEQ ID NO: 26548 - DNA, 25 bp, Homo sapien
cagtggatcggactcaacgacagga

SEQ ID NO: 26549 - DNA, 25 bp, Homo sapien
cgacttcttgtggtcggatggcgtc

SEQ ID NO: 26550 - DNA, 25 bp, Homo sapien
ccatcgaaggcgacttcttgtggtc

SEQ ID NO: 26551 - DNA, 25 bp, Homo sapien
cgacaggaccatcgaaggcgacttc

SEQ ID NO: 26552 - DNA, 25 bp, Homo sapien
ccgggagtaccagtggatcggactc

SEQ ID NO: 26553 - DNA, 25 bp, Homo sapien
aagggtttccaaggcagtcaccgca

SEQ ID NO: 26554 - DNA, 25 bp, Homo sapien
tcggactcaacgacaggaccatcga

SEQ ID NO: 26555 - DNA, 25 bp, Homo sapien
tgcgctcactgcacgccttcgtctc

SEQ ID NO: 26556 - DNA, 25 bp, Homo sapien
gcgccgattgagctcccacatctga

SEQ ID NO: 26557 - DNA, 25 bp, Homo sapien
agcgacgtctccatgtgtgccacgc

SEQ ID NO: 26558 - DNA, 25 bp, Homo sapien
gtagagcctctagctcgcgctccag

SEQ ID NO: 26559 - DNA, 25 bp, Homo sapien
agctcttcagccaggttgtcgcgcg

SEQ ID NO: 26560 - DNA, 25 bp, Homo sapien
ctgctcgtctgacccactgaggatg

SEQ ID NO: 26561 - DNA, 25 bp, Homo sapien
ctcgcagagcttttaggacggaaga

SEQ ID NO: 26562 - DNA, 25 bp, Homo sapien
aggctattcatactcccgccaggcg

SEQ ID NO: 26563 - DNA, 25 bp, Homo sapien
tgcttctcccgccagcgttggtcaa

SEQ ID NO: 26564 - DNA, 25 bp, Homo sapien
ggccctagctccattgaaccctgaa

SEQ ID NO: 26565 - DNA, 25 bp, Homo sapien
agtgggaccactccgtactcagaga

SEQ ID NO: 26566 - DNA, 25 bp, Homo sapien
gcattcaactccttggtgccggaca

SEQ ID NO: 26567 - DNA, 25 bp, Homo sapien
cggacgcaaagccagcacttgaatc

SEQ ID NO: 26568 - DNA, 25 bp, Homo sapien
gagatagccttctcctgcgctagta

SEQ ID NO: 26569 - DNA, 25 bp, Homo sapien
gctcccgcgcggacagcttttatac

SEQ ID NO: 26570 - DNA, 25 bp, Homo sapien
agatcttgagccgtagctggcccta

SEQ ID NO: 26571 - DNA, 25 bp, Homo sapien
gctggagcactggacactgtctttt

SEQ ID NO: 26572 - DNA, 25 bp, Homo sapien
tctcactgtgaaacgtcgcgacctg

SEQ ID NO: 26573 - DNA, 25 bp, Homo sapien
tggatccctgttcactgcgttctcg

SEQ ID NO: 26574 - DNA, 25 bp, Homo sapien
gcgtagtactgaccctggatccctg

SEQ ID NO: 26575 - DNA, 25 bp, Homo sapien
cgtcggagactggacccaaaactct

SEQ ID NO: 26576 - DNA, 25 bp, Homo sapien
tttgtggcgtcactgcactgttacc

SEQ ID NO: 26577 - DNA, 25 bp, Homo sapien
ctccggcttcacttccgtaagagga

SEQ ID NO: 26578 - DNA, 25 bp, Homo sapien
agcccacctggataagcatacttcg

SEQ ID NO: 26579 - DNA, 25 bp, Homo sapien
gccctacgtgtctctgacgctgaca

SEQ ID NO: 26580 - DNA, 25 bp, Homo sapien
ggcccttccctctcgaaagtgcaaa

SEQ ID NO: 26581 - DNA, 25 bp, Homo sapien
agttcgcggcagcaaacctgcttcc

SEQ ID NO: 26582 - DNA, 25 bp, Homo sapien
ccgcagccgcaggaatatgctggaa

SEQ ID NO: 26583 - DNA, 25 bp, Homo sapien
tggatctaccagttccgcctcatcg

SEQ ID NO: 26584 - DNA, 25 bp, Homo sapien
gcctcatcgtgatcggggactccac

SEQ ID NO: 26585 - DNA, 25 bp, Homo sapien
ccgggcaagaggatcaagctacagc

SEQ ID NO: 26586 - DNA, 25 bp, Homo sapien
agtgcaaacactccattctcgcttc

SEQ ID NO: 26587 - DNA, 25 bp, Homo sapien
ctcacttctttctttggcgcccatt

SEQ ID NO: 26588 - DNA, 25 bp, Homo sapien
tcgggaatcgaaaggcaagctggtt

SEQ ID NO: 26589 - DNA, 25 bp, Homo sapien
accggaacacaccatgaagcatgtc

SEQ ID NO: 26590 - DNA, 25 bp, Homo sapien
cgcggcacttcggattttcagcaca

SEQ ID NO: 26591 - DNA, 25 bp, Homo sapien
acgcccgtcgactttctgggagttg

SEQ ID NO: 26592 - DNA, 25 bp, Homo sapien
aacggaagctcaaccacgaatctta

SEQ ID NO: 26593 - DNA, 25 bp, Homo sapien
acgaatcttacctctcagcatgctg

SEQ ID NO: 26594 - DNA, 25 bp, Homo sapien
cattcccgcgcatgctctgcgtgga

SEQ ID NO: 26595 - DNA, 25 bp, Homo sapien
tgtagtccgccgctagaaagctgga

SEQ ID NO: 26596 - DNA, 25 bp, Homo sapien
tgttatgcaacccaagcccgcaggg

SEQ ID NO: 26597 - DNA, 25 bp, Homo sapien
cgcgctcgtgcagttgtttgtgttt

SEQ ID NO: 26598 - DNA, 25 bp, Homo sapien
cggtttgatgcgtgcagcttcttga

SEQ ID NO: 26599 - DNA, 25 bp, Homo sapien
cccagcgcagttaagtgtggacgtc

SEQ ID NO: 26600 - DNA, 25 bp, Homo sapien
tgtggacgtctgtacacggtttccg

SEQ ID NO: 26601 - DNA, 25 bp, Homo sapien
cgacagagaaagagccggagaccta

SEQ ID NO: 26602 - DNA, 25 bp, Homo sapien
gtgcccttcccggtgttatgcaacc

SEQ ID NO: 26603 - DNA, 25 bp, Homo sapien
tccaccattatataaccggcgggtg

SEQ ID NO: 26604 - DNA, 25 bp, Homo sapien
caccgtggatgtaaaaccaggcaac

SEQ ID NO: 26605 - DNA, 25 bp, Homo sapien
cagcgaggagggcacatgtatccgc

SEQ ID NO: 26606 - DNA, 25 bp, Homo sapien
atgcagtgtcaccagcacgccacgg

SEQ ID NO: 26607 - DNA, 25 bp, Homo sapien
ccttgtccagcaggtagggcaggac

SEQ ID NO: 26608 - DNA, 25 bp, Homo sapien
cgcctgctacttacgtacgtgatcc

SEQ ID NO: 26609 - DNA, 25 bp, Homo sapien
caggcaacatgtagccgctggaggc

SEQ ID NO: 26610 - DNA, 25 bp, Homo sapien
agcctcttggccaggtggtagaaga

SEQ ID NO: 26611 - DNA, 25 bp, Homo sapien
tctgaggacgaagaccgcccgcagc

SEQ ID NO: 26612 - DNA, 25 bp, Homo sapien
ggctcctacatctgggcccgcttta

SEQ ID NO: 26613 - DNA, 25 bp, Homo sapien
gcgctgagatccctgcggcaaagaa

SEQ ID NO: 26614 - DNA, 25 bp, Homo sapien
gcttgtagtcacctcggaattgtta

SEQ ID NO: 26615 - DNA, 25 bp, Homo sapien
ggtacgccttgttcggtggaaatca

SEQ ID NO: 26616 - DNA, 25 bp, Homo sapien
atcagccgtagccatgagtttctgc

SEQ ID NO: 26617 - DNA, 25 bp, Homo sapien
ccggtctcaagtaggcctcatctgc

SEQ ID NO: 26618 - DNA, 25 bp, Homo sapien
gccatgtcgctggttgcttacgcca

SEQ ID NO: 26619 - DNA, 25 bp, Homo sapien
aaatgctctcctgtccgtctcagtg

SEQ ID NO: 26620 - DNA, 25 bp, Homo sapien
ccctcacctgtaagtcagcacgaag

SEQ ID NO: 26621 - DNA, 25 bp, Homo sapien
ggctcctcacgggatcagacccaag

SEQ ID NO: 26622 - DNA, 25 bp, Homo sapien
cgagaccctgggctctctggtcagg

SEQ ID NO: 26623 - DNA, 25 bp, Homo sapien
gaatgagctaagagcccggctcctc

SEQ ID NO: 26624 - DNA, 25 bp, Homo sapien
cagcccggggaatgagctaagagcc

SEQ ID NO: 26625 - DNA, 25 bp, Homo sapien
ggtcaccagcgagaggcgtgatccc

SEQ ID NO: 26626 - DNA, 25 bp, Homo sapien
tagggatcagactatctcccgctcc

SEQ ID NO: 26627 - DNA, 25 bp, Homo sapien
ggcgccgttagggatcagactatct

SEQ ID NO: 26628 - DNA, 25 bp, Homo sapien
ctcttcgcacatggggatggtgatc

SEQ ID NO: 26629 - DNA, 25 bp, Homo sapien
tgatcgcgttgtgtagaaagttttc

SEQ ID NO: 26630 - DNA, 25 bp, Homo sapien
cttcttctggaacgaggcctcttgc

SEQ ID NO: 26631 - DNA, 25 bp, Homo sapien
gctcttgttgatggacgtcaccttc

SEQ ID NO: 26632 - DNA, 25 bp, Homo sapien
atccggtattccgtgaagtggcgca

SEQ ID NO: 26633 - DNA, 25 bp, Homo sapien
ccgcagcgggaagacactagtaaga

SEQ ID NO: 26634 - DNA, 25 bp, Homo sapien
agtagccctatcaggcctgtccgga

SEQ ID NO: 26635 - DNA, 25 bp, Homo sapien
tgtcctcctggatctcgaaatccga

SEQ ID NO: 26636 - DNA, 25 bp, Homo sapien
ccattcccagtgagacctctgagga

SEQ ID NO: 26637 - DNA, 25 bp, Homo sapien
ctgtggtcccgaagaaattggcctc

SEQ ID NO: 26638 - DNA, 25 bp, Homo sapien
ccggcactcacgactccttgtagta

SEQ ID NO: 26639 - DNA, 25 bp, Homo sapien
cttgtagtacacgatgaagctgagc

SEQ ID NO: 26640 - DNA, 25 bp, Homo sapien
tccgtcacgttggacacgaagcgca

SEQ ID NO: 26641 - DNA, 25 bp, Homo sapien
gttgatctcagccttgttctgccga

SEQ ID NO: 26642 - DNA, 25 bp, Homo sapien
tccagtcggtagatgtgttccaagc

SEQ ID NO: 26643 - DNA, 25 bp, Homo sapien
gaagtagatcttgcccacgggaatg

SEQ ID NO: 26644 - DNA, 25 bp, Homo sapien
tgagcctctaggaggtcgtccttcc

SEQ ID NO: 26645 - DNA, 25 bp, Homo sapien
cctagagttcggagaatgttctacc

SEQ ID NO: 26646 - DNA, 25 bp, Homo sapien
cgtccgaggagctaagagaagatct

SEQ ID NO: 26647 - DNA, 25 bp, Homo sapien
aaatcgatgctcttgtcagggaggc

SEQ ID NO: 26648 - DNA, 25 bp, Homo sapien
aggcgatcgatgtcagccctgccct

SEQ ID NO: 26649 - DNA, 25 bp, Homo sapien
cccaggttctgcgattgatcctttg

SEQ ID NO: 26650 - DNA, 25 bp, Homo sapien
aggatgacctggacagcaacctttc

SEQ ID NO: 26651 - DNA, 25 bp, Homo sapien
tgcctccgtctggtcaccttcttga

SEQ ID NO: 26652 - DNA, 25 bp, Homo sapien
cctcctcgactggagtctgaggccc

SEQ ID NO: 26653 - DNA, 25 bp, Homo sapien
cgcagagtcggcctctgtgatccca

SEQ ID NO: 26654 - DNA, 25 bp, Homo sapien
gtgatcccacccagaatacagtttt

SEQ ID NO: 26655 - DNA, 25 bp, Homo sapien
gatcccacccagaatacagttttcc

SEQ ID NO: 26656 - DNA, 25 bp, Homo sapien
cggctcctgtttccttgtcaaaact

SEQ ID NO: 26657 - DNA, 25 bp, Homo sapien
cccagacccaggagtgtagaaaaga

SEQ ID NO: 26658 - DNA, 25 bp, Homo sapien
tccttgtcaaaacttcctgccttgg

SEQ ID NO: 26659 - DNA, 25 bp, Homo sapien
cccaggagtgtagaaaagagggact

SEQ ID NO: 26660 - DNA, 25 bp, Homo sapien
gcggcctctgtgaccgattcactgg

SEQ ID NO: 26661 - DNA, 25 bp, Homo sapien
gttttcagaatagcgcggagcctcc

SEQ ID NO: 26662 - DNA, 25 bp, Homo sapien
gcatgtctgtgcgaacacggcttca

SEQ ID NO: 26663 - DNA, 25 bp, Homo sapien
cgacggcttctacggtctcagctgc

SEQ ID NO: 26664 - DNA, 25 bp, Homo sapien
cgcgggacatgtggtcaaaggatca

SEQ ID NO: 26665 - DNA, 25 bp, Homo sapien
gctcactcagctaggtgcccaggtg

SEQ ID NO: 26666 - DNA, 25 bp, Homo sapien
gtgcgaatcccactgaccacgcgga

SEQ ID NO: 26667 - DNA, 25 bp, Homo sapien
ggaggtcttcctggccgaagtcacc

SEQ ID NO: 26668 - DNA, 25 bp, Homo sapien
cgtcgtctcgcgagagtccaagtta

SEQ ID NO: 26669 - DNA, 25 bp, Homo sapien
tgcggggcctaagccgagctaaatt

SEQ ID NO: 26670 - DNA, 25 bp, Homo sapien
agctaaattcgttgcaggtggccgc

SEQ ID NO: 26671 - DNA, 25 bp, Homo sapien
gcgggtgcaaccacaaaggctaatc

SEQ ID NO: 26672 - DNA, 25 bp, Homo sapien
ggagtcgatgcttcctcttccaagt

SEQ ID NO: 26673 - DNA, 25 bp, Homo sapien
aggtaagaccctcactccagcttgg

SEQ ID NO: 26674 - DNA, 25 bp, Homo sapien
gcattcgccgttccggtcttcctga

SEQ ID NO: 26675 - DNA, 25 bp, Homo sapien
tcttccaagtcaggtcggctcccgt

SEQ ID NO: 26676 - DNA, 25 bp, Homo sapien
gaggagcccaaaagccctggtacgc

SEQ ID NO: 26677 - DNA, 25 bp, Homo sapien
tagagtgcgttcttaccttcctgcc

SEQ ID NO: 26678 - DNA, 25 bp, Homo sapien
agacgctgcggacaacaccagcatg

SEQ ID NO: 26679 - DNA, 25 bp, Homo sapien
caccagcatgtcgagcgagcagagc

SEQ ID NO: 26680 - DNA, 25 bp, Homo sapien
ccagaagtcttctggcgcggtgacc

SEQ ID NO: 26681 - DNA, 25 bp, Homo sapien
agagcgcgcggccaaagagaagcca

SEQ ID NO: 26682 - DNA, 25 bp, Homo sapien
gagaagccagcgaccgttctgcctc

SEQ ID NO: 26683 - DNA, 25 bp, Homo sapien
tccctggacgcggaacagagatccc

SEQ ID NO: 26684 - DNA, 25 bp, Homo sapien
tgccttccagacgatccgcggctgt

SEQ ID NO: 26685 - DNA, 25 bp, Homo sapien
ccttaggtgagtgacagtggagctc

SEQ ID NO: 26686 - DNA, 25 bp, Homo sapien
cccgtttcctatcaagtgttttcag

SEQ ID NO: 26687 - DNA, 25 bp, Homo sapien
tccgcctctttgtcggaaaaggcca

SEQ ID NO: 26688 - DNA, 25 bp, Homo sapien
gggtcctcgagaccgacttcgccga

SEQ ID NO: 26689 - DNA, 25 bp, Homo sapien
cccgcagaggagtaccagtgctccg

SEQ ID NO: 26690 - DNA, 25 bp, Homo sapien
cagcgtccgtacttccaagcgtttg

SEQ ID NO: 26691 - DNA, 25 bp, Homo sapien
caaaaatatccgtctgaggagggcc

SEQ ID NO: 26692 - DNA, 25 bp, Homo sapien
cccaggattgcgcacttgtctctgc

SEQ ID NO: 26693 - DNA, 25 bp, Homo sapien
gccgacgcctcctgctggaaaaagg

SEQ ID NO: 26694 - DNA, 25 bp, Homo sapien
ggacgccctgtaccttttccagcga

SEQ ID NO: 26695 - DNA, 25 bp, Homo sapien
tctctgcggaacaataacatcgacg

SEQ ID NO: 26696 - DNA, 25 bp, Homo sapien
tgggtttcaaccacatcggtgacga

SEQ ID NO: 26697 - DNA, 25 bp, Homo sapien
cgcatccaggacaagggcgccctga

SEQ ID NO: 26698 - DNA, 25 bp, Homo sapien
agggagccgaccctgactacccagg

SEQ ID NO: 26699 - DNA, 25 bp, Homo sapien
agcgctcaagtctcccatattccgg

SEQ ID NO: 26700 - DNA, 25 bp, Homo sapien
aactgatgacggcacgacgtggctc

SEQ ID NO: 26701 - DNA, 25 bp, Homo sapien
cacatccctgaatggccgcagggca

SEQ ID NO: 26702 - DNA, 25 bp, Homo sapien
ggcgaccgtgaccacacacggcaga

SEQ ID NO: 26703 - DNA, 25 bp, Homo sapien
gcagacctctgcgtcaaggtgctgg

SEQ ID NO: 26704 - DNA, 25 bp, Homo sapien
agacggaggctttcgcttgggtctt

SEQ ID NO: 26705 - DNA, 25 bp, Homo sapien
gcccagacgggcgagaactgatgac

SEQ ID NO: 26706 - DNA, 25 bp, Homo sapien
ttgctgcgacctcggggtcctacgc

SEQ ID NO: 26707 - DNA, 25 bp, Homo sapien
caggcccatttacggctggggagac

SEQ ID NO: 26708 - DNA, 25 bp, Homo sapien
gctcccttattattcgttcggatta

SEQ ID NO: 26709 - DNA, 25 bp, Homo sapien
tgggtttttcttccacaccagactc

SEQ ID NO: 26710 - DNA, 25 bp, Homo sapien
ctcctggaaaatccgatcgcctgtc

SEQ ID NO: 26711 - DNA, 25 bp, Homo sapien
ctcgcctaatctcgcaggcaggagc

SEQ ID NO: 26712 - DNA, 25 bp, Homo sapien
tagcgggttcccatctcagccggat

SEQ ID NO: 26713 - DNA, 25 bp, Homo sapien
cttttattgacttctgctcgggagc

SEQ ID NO: 26714 - DNA, 25 bp, Homo sapien
ccagaaagacggctcccttattatt

SEQ ID NO: 26715 - DNA, 25 bp, Homo sapien
tgctcgggagccgacctttgtttcc

SEQ ID NO: 26716 - DNA, 25 bp, Homo sapien
cgccgtgaggcagaacggactttgc

SEQ ID NO: 26717 - DNA, 25 bp, Homo sapien
agtgaggcatgcacagtctggcgct

SEQ ID NO: 26718 - DNA, 25 bp, Homo sapien
cacagtctggcgctgcgggtttccc

SEQ ID NO: 26719 - DNA, 25 bp, Homo sapien
tcccttaaccgtggcctcagggctg

SEQ ID NO: 26720 - DNA, 25 bp, Homo sapien
ttctcctttcagcagacgccgactt

SEQ ID NO: 26721 - DNA, 25 bp, Homo sapien
gggtgctgagctgctatacgcttcc

SEQ ID NO: 26722 - DNA, 25 bp, Homo sapien
cccgaagagtgaggcatgcacagtc

SEQ ID NO: 26723 - DNA, 25 bp, Homo sapien
tgggccagggtcctccagacgccga

SEQ ID NO: 26724 - DNA, 25 bp, Homo sapien
tgaccgccgagctaggtgctcccgg

SEQ ID NO: 26725 - DNA, 25 bp, Homo sapien
caggatccaccctgcgtctgggtga

SEQ ID NO: 26726 - DNA, 25 bp, Homo sapien
tgaggttgcgtctccaggatccacc

SEQ ID NO: 26727 - DNA, 25 bp, Homo sapien
agattcagctcgtcagggcacctga

SEQ ID NO: 26728 - DNA, 25 bp, Homo sapien
gcctcctgagctggagattcagctc

SEQ ID NO: 26729 - DNA, 25 bp, Homo sapien
agagtaccggcaggcaccaatcgcc

SEQ ID NO: 26730 - DNA, 25 bp, Homo sapien
gggctgtgccgcacttgtgcacaga

SEQ ID NO: 26731 - DNA, 25 bp, Homo sapien
cgcacttgtgcacagagtaccggca

SEQ ID NO: 26732 - DNA, 25 bp, Homo sapien
ttgggtcacacctgccgagcatccg

SEQ ID NO: 26733 - DNA, 25 bp, Homo sapien
cacacagggcctcagtccgccggca

SEQ ID NO: 26734 - DNA, 25 bp, Homo sapien
tgaaggcatctcctccgcgagactc

SEQ ID NO: 26735 - DNA, 25 bp, Homo sapien
ctttgtggctctagtttattttcca

SEQ ID NO: 26736 - DNA, 25 bp, Homo sapien
ttaatgaaatgggagactgagtccc

SEQ ID NO: 26737 - DNA, 25 bp, Homo sapien
ccaggctgccgttgggtcacacctg

SEQ ID NO: 26738 - DNA, 25 bp, Homo sapien
gacgccggagttctgaaggcatctc

SEQ ID NO: 26739 - DNA, 25 bp, Homo sapien
tgggagactgagtccctgccgctgc

SEQ ID NO: 26740 - DNA, 25 bp, Homo sapien
gagaaccgagcaatggggccgcgag

SEQ ID NO: 26741 - DNA, 25 bp, Homo sapien
ttgccgttgatttgcccaagttgtt

SEQ ID NO: 26742 - DNA, 25 bp, Homo sapien
aatgagtttgccgttgatttgccca

SEQ ID NO: 26743 - DNA, 25 bp, Homo sapien
tccggacgcctgagtccagcctaag

SEQ ID NO: 26744 - DNA, 25 bp, Homo sapien
gggagaatgagtttgccgttgattt

SEQ ID NO: 26745 - DNA, 25 bp, Homo sapien
aacgctttctcttgagcttctggca

SEQ ID NO: 26746 - DNA, 25 bp, Homo sapien
gggaaccgaacgctttctcttgagc

SEQ ID NO: 26747 - DNA, 25 bp, Homo sapien
ccgaccctcgccctctgaggccggg

SEQ ID NO: 26748 - DNA, 25 bp, Homo sapien
cacgcctggcttattatgcacgagg

SEQ ID NO: 26749 - DNA, 25 bp, Homo sapien
ttatgcacgaggcaggcaatttgcc

SEQ ID NO: 26750 - DNA, 25 bp, Homo sapien
cgaggcaggcaatttgccttcctcc

SEQ ID NO: 26751 - DNA, 25 bp, Homo sapien
ccatctcggagacaagaaggtagtt

SEQ ID NO: 26752 - DNA, 25 bp, Homo sapien
aaggtagtttgttctctgtaatggc

SEQ ID NO: 26753 - DNA, 25 bp, Homo sapien
tgttctctgtaatggcttctgctgg

SEQ ID NO: 26754 - DNA, 25 bp, Homo sapien
ctgtaatggcttctgctggagtgcg

SEQ ID NO: 26755 - DNA, 25 bp, Homo sapien
tggcttattatgcacgaggcaggca

SEQ ID NO: 26756 - DNA, 25 bp, Homo sapien
agcgcctgccgtggtcataagtcag

SEQ ID NO: 26757 - DNA, 25 bp, Homo sapien
cacagtgctccagcggctcaacggg

SEQ ID NO: 26758 - DNA, 25 bp, Homo sapien
cgtggagtacaacatcttcgaggga

SEQ ID NO: 26759 - DNA, 25 bp, Homo sapien
ccgtggtcataagtcagggccgagt

SEQ ID NO: 26760 - DNA, 25 bp, Homo sapien
acattcccggactttgtctacaaga

SEQ ID NO: 26761 - DNA, 25 bp, Homo sapien
tgtctacaagaggatcaaagctcgc

SEQ ID NO: 26762 - DNA, 25 bp, Homo sapien
atcaaagctcgcaacagggtagggc

SEQ ID NO: 26763 - DNA, 25 bp, Homo sapien
ggaggcactggaccctcgggcctct

SEQ ID NO: 26764 - DNA, 25 bp, Homo sapien
cgacccgcacctgttgatgatgagc

SEQ ID NO: 26765 - DNA, 25 bp, Homo sapien
tgccgctccacgtgcttgcagtaga

SEQ ID NO: 26766 - DNA, 25 bp, Homo sapien
agggctttcctgcaagagacgtggc

SEQ ID NO: 26767 - DNA, 25 bp, Homo sapien
ggacacggcgtctgtactccacagt

SEQ ID NO: 26768 - DNA, 25 bp, Homo sapien
agcccgtgaatctctcggacactga

SEQ ID NO: 26769 - DNA, 25 bp, Homo sapien
aaaggggccacttgacgatgtagtc

SEQ ID NO: 26770 - DNA, 25 bp, Homo sapien
gcttggcggttttgttgctgatcca

SEQ ID NO: 26771 - DNA, 25 bp, Homo sapien
cgatgtagtcgaaagagaaggcctc

SEQ ID NO: 26772 - DNA, 25 bp, Homo sapien
gatactcagccctctgcgaccatgg

SEQ ID NO: 26773 - DNA, 25 bp, Homo sapien
tctacgcctgtggagccgatactca

SEQ ID NO: 26774 - DNA, 25 bp, Homo sapien
gtgctccgataacacccagggactc

SEQ ID NO: 26775 - DNA, 25 bp, Homo sapien
ccagggactcgcctatttttacagc

SEQ ID NO: 26776 - DNA, 25 bp, Homo sapien
acagcgcgtttctacttccaaggtc

SEQ ID NO: 26777 - DNA, 25 bp, Homo sapien
cttccaaggtctcggcgtaatcatc

SEQ ID NO: 26778 - DNA, 25 bp, Homo sapien
tcacgcgacgggttctggtccaaaa

SEQ ID NO: 26779 - DNA, 25 bp, Homo sapien
cgccgccgactgagaggcgactatt

SEQ ID NO: 26780 - DNA, 25 bp, Homo sapien
ctaagaccgttagctggtgggaatc

SEQ ID NO: 26781 - DNA, 25 bp, Homo sapien
cgaggaaattggctaagaccgttag

SEQ ID NO: 26782 - DNA, 25 bp, Homo sapien
tcccggccgaggaaattggctaaga

SEQ ID NO: 26783 - DNA, 25 bp, Homo sapien
ctccaaatcatttcccggccgagga

SEQ ID NO: 26784 - DNA, 25 bp, Homo sapien
cgccggcgttccaagttggaggcca

SEQ ID NO: 26785 - DNA, 25 bp, Homo sapien
gggaagtgcgcatgtgctccaaatc

SEQ ID NO: 26786 - DNA, 25 bp, Homo sapien
gtgcgcatgtgctccaaatcatttc

SEQ ID NO: 26787 - DNA, 25 bp, Homo sapien
ggaatcggaagagaatgggtcactc

SEQ ID NO: 26788 - DNA, 25 bp, Homo sapien
tggtctagttccctcagaaccgtcc

SEQ ID NO: 26789 - DNA, 25 bp, Homo sapien
acatcttaaactcccagaggtgccg

SEQ ID NO: 26790 - DNA, 25 bp, Homo sapien
cccaggctagtctcattggtctagt

SEQ ID NO: 26791 - DNA, 25 bp, Homo sapien
caggctagtctcattggtctagttc

SEQ ID NO: 26792 - DNA, 25 bp, Homo sapien
ccgacatcttaaactcccagaggtg

SEQ ID NO: 26793 - DNA, 25 bp, Homo sapien
ctcattggtctagttccctcagaac

SEQ ID NO: 26794 - DNA, 25 bp, Homo sapien
gttccctcagaaccgtcctcatcgg

SEQ ID NO: 26795 - DNA, 25 bp, Homo sapien
agtctcattggtctagttccctcag

SEQ ID NO: 26796 - DNA, 25 bp, Homo sapien
accagggacgtgaaggaattcgcca

SEQ ID NO: 26797 - DNA, 25 bp, Homo sapien
cgccggttgtgaaacctactgaagt

SEQ ID NO: 26798 - DNA, 25 bp, Homo sapien
gacctctttgcagctcgcacagcta

SEQ ID NO: 26799 - DNA, 25 bp, Homo sapien
ctggcgcgatctaggtagaaaactc

SEQ ID NO: 26800 - DNA, 25 bp, Homo sapien
cggcacagagttcgctggcatcagc

SEQ ID NO: 26801 - DNA, 25 bp, Homo sapien
cagatctcgtccttcgccaatagca

SEQ ID NO: 26802 - DNA, 25 bp, Homo sapien
cgcacagctggagcaacgactcgga

SEQ ID NO: 26803 - DNA, 25 bp, Homo sapien
tgggagacgctgcagcatatatttc

SEQ ID NO: 26804 - DNA, 25 bp, Homo sapien
accaaatggtttgctccgagcgccc

SEQ ID NO: 26805 - DNA, 25 bp, Homo sapien
tttcggtcaacatcgtagtccaccc

SEQ ID NO: 26806 - DNA, 25 bp, Homo sapien
ccctttcggtcaacatcgtagtcca

SEQ ID NO: 26807 - DNA, 25 bp, Homo sapien
ggtttgctccgagcgccctatttaa

SEQ ID NO: 26808 - DNA, 25 bp, Homo sapien
tccacctccaaccaaatggtttgct

SEQ ID NO: 26809 - DNA, 25 bp, Homo sapien
tggaaggcaccacgaaggcaaggag

SEQ ID NO: 26810 - DNA, 25 bp, Homo sapien
ggcgccctttcggtcaacatcgtag

SEQ ID NO: 26811 - DNA, 25 bp, Homo sapien
aacctctcccaggacggtgagtgag

SEQ ID NO: 26812 - DNA, 25 bp, Homo sapien
aatacggcggtcctatcctgggatg

SEQ ID NO: 26813 - DNA, 25 bp, Homo sapien
ggagcgaccatctgcccgaaacagc

SEQ ID NO: 26814 - DNA, 25 bp, Homo sapien
cactggcgaagtggagcgaccatct

SEQ ID NO: 26815 - DNA, 25 bp, Homo sapien
gaatctagatcagaaccactggcga

SEQ ID NO: 26816 - DNA, 25 bp, Homo sapien
gtggcagcgtcagcccgtctgctct

SEQ ID NO: 26817 - DNA, 25 bp, Homo sapien
ttcctgagggcgacttgaatacggc

SEQ ID NO: 26818 - DNA, 25 bp, Homo sapien
gttgcctcactcattggggcttcga

SEQ ID NO: 26819 - DNA, 25 bp, Homo sapien
cccaaagggaatcgaatctagatca

SEQ ID NO: 26820 - DNA, 25 bp, Homo sapien
aagcccggacacgtagcagctctgg

SEQ ID NO: 26821 - DNA, 25 bp, Homo sapien
gctgggacgactggcgaagttcacc

SEQ ID NO: 26822 - DNA, 25 bp, Homo sapien
ctctgggctctgctcagcagcggat

SEQ ID NO: 26823 - DNA, 25 bp, Homo sapien
cagcagcggatgagctcactgaatt

SEQ ID NO: 26824 - DNA, 25 bp, Homo sapien
gagctcactgaattttgcgcacttg

SEQ ID NO: 26825 - DNA, 25 bp, Homo sapien
ttgcgcacttgattggctacttcgg

SEQ ID NO: 26826 - DNA, 25 bp, Homo sapien
tggcgaagttcacccgggactccaa

SEQ ID NO: 26827 - DNA, 25 bp, Homo sapien
tgaaaagattcgcaaggccggtttc

SEQ ID NO: 26828 - DNA, 25 bp, Homo sapien
aggcgccagtgacgcaatgactgca

SEQ ID NO: 26829 - DNA, 25 bp, Homo sapien
cctgggataacttaactgggctcgg

SEQ ID NO: 26830 - DNA, 25 bp, Homo sapien
atcgaccgcttcgtgcagatcgtgg

SEQ ID NO: 26831 - DNA, 25 bp, Homo sapien
tcgctcagagactgggttccgcgtt

SEQ ID NO: 26832 - DNA, 25 bp, Homo sapien
tgatgatccagccaatcaccgcgtg

SEQ ID NO: 26833 - DNA, 25 bp, Homo sapien
ccttcttagctgagtgggttgaacc

SEQ ID NO: 26834 - DNA, 25 bp, Homo sapien
cgggttgttccatccgcagcaaaca

SEQ ID NO: 26835 - DNA, 25 bp, Homo sapien
atgactgcaacatgccgccagggtg

SEQ ID NO: 26836 - DNA, 25 bp, Homo sapien
aacgcggacagccacttcggactca

SEQ ID NO: 26837 - DNA, 25 bp, Homo sapien
ggggctcttggcaacctcttgtctc

SEQ ID NO: 26838 - DNA, 25 bp, Homo sapien
ggcgtcctctctgtggaaaacaaca

SEQ ID NO: 26839 - DNA, 25 bp, Homo sapien
tccgcgctcttgaccttgacgtaga

SEQ ID NO: 26840 - DNA, 25 bp, Homo sapien
gcgctcacaccaagaggccgttctt

SEQ ID NO: 26841 - DNA, 25 bp, Homo sapien
gctaacactgctgcctcagagctca

SEQ ID NO: 26842 - DNA, 25 bp, Homo sapien
ggcctcgacctactgtcctttgtga

SEQ ID NO: 26843 - DNA, 25 bp, Homo sapien
ggactcacgtctcaatgtttcttta

SEQ ID NO: 26844 - DNA, 25 bp, Homo sapien
ctctgaaggattgacccgccctggc

SEQ ID NO: 26845 - DNA, 25 bp, Homo sapien
ttaggaaccggagcccgtcgctcca

SEQ ID NO: 26846 - DNA, 25 bp, Homo sapien
cccaaccgcggctctgaaggattga

SEQ ID NO: 26847 - DNA, 25 bp, Homo sapien
cagttgccttgtgctggtggcttag

SEQ ID NO: 26848 - DNA, 25 bp, Homo sapien
acctccagcgggcagttgccttgtg

SEQ ID NO: 26849 - DNA, 25 bp, Homo sapien
ttggcaaccactagcccgcgttctt

SEQ ID NO: 26850 - DNA, 25 bp, Homo sapien
ccaaggccctagtgttgacgcgtta

SEQ ID NO: 26851 - DNA, 25 bp, Homo sapien
tgacgcgttaccttggcaaccacta

SEQ ID NO: 26852 - DNA, 25 bp, Homo sapien
cccgagctcgctggagcaagttcaa

SEQ ID NO: 26853 - DNA, 25 bp, Homo sapien
tggagcttcacagaaggtcaccgtg

SEQ ID NO: 26854 - DNA, 25 bp, Homo sapien
ctcacacgtgctcctggaaccagga

SEQ ID NO: 26855 - DNA, 25 bp, Homo sapien
cctgtctatgcatgggctaacctcg

SEQ ID NO: 26856 - DNA, 25 bp, Homo sapien
gtccaacaatgtcgggtcagggctt

SEQ ID NO: 26857 - DNA, 25 bp, Homo sapien
aagtagtcaccggacccttgcctgg

SEQ ID NO: 26858 - DNA, 25 bp, Homo sapien
agagcggcgcactgactcaaggcaa

SEQ ID NO: 26859 - DNA, 25 bp, Homo sapien
cctgggccgttacaacagatgagtc

SEQ ID NO: 26860 - DNA, 25 bp, Homo sapien
cgcaaacgctaagtcgctggccatt

SEQ ID NO: 26861 - DNA, 25 bp, Homo sapien
ggcttctgcgctgggaaattcagtc

SEQ ID NO: 26862 - DNA, 25 bp, Homo sapien
accgccgcggttgatactactttga

SEQ ID NO: 26863 - DNA, 25 bp, Homo sapien
tcgccttcggaactgtcgtcacttc

SEQ ID NO: 26864 - DNA, 25 bp, Homo sapien
gcagccaatcgcttccgccagagaa

SEQ ID NO: 26865 - DNA, 25 bp, Homo sapien
gcggcactgaactcgcggcaatttg

SEQ ID NO: 26866 - DNA, 25 bp, Homo sapien
ggctacgtccgagggtaacaacatg

SEQ ID NO: 26867 - DNA, 25 bp, Homo sapien
ctttgaccttccgagtgcagtggta

SEQ ID NO: 26868 - DNA, 25 bp, Homo sapien
aggatgctcacaaggacggccactc

SEQ ID NO: 26869 - DNA, 25 bp, Homo sapien
agccggccaggatgctcacaaggac

SEQ ID NO: 26870 - DNA, 25 bp, Homo sapien
aggacggccactcccagaaagcaga

SEQ ID NO: 26871 - DNA, 25 bp, Homo sapien
cgcgaagggtagacctccagaccta

SEQ ID NO: 26872 - DNA, 25 bp, Homo sapien
tccagacctaggcaggggtccacga

SEQ ID NO: 26873 - DNA, 25 bp, Homo sapien
cggaactcgtagagaacatcctgcg

SEQ ID NO: 26874 - DNA, 25 bp, Homo sapien
ggtcgctgacgaagctgcccgcgaa

SEQ ID NO: 26875 - DNA, 25 bp, Homo sapien
tcacgccaggtgctcaccggaagtg

SEQ ID NO: 26876 - DNA, 25 bp, Homo sapien
ccttgccaggctactggtacgccgt

SEQ ID NO: 26877 - DNA, 25 bp, Homo sapien
cggccaattggagccgccagaggca

SEQ ID NO: 26878 - DNA, 25 bp, Homo sapien
aagagctcggctgcacgtgggctca

SEQ ID NO: 26879 - DNA, 25 bp, Homo sapien
tcgtggacctctgcacagccaagcg

SEQ ID NO: 26880 - DNA, 25 bp, Homo sapien
cacagccaagcgtggaaaggccggt

SEQ ID NO: 26881 - DNA, 25 bp, Homo sapien
cgtcgccctggagaccgccaatccc

SEQ ID NO: 26882 - DNA, 25 bp, Homo sapien
cactctcgccgctacacaatagggg

SEQ ID NO: 26883 - DNA, 25 bp, Homo sapien
aggctactggtacgccgtccttctt

SEQ ID NO: 26884 - DNA, 25 bp, Homo sapien
gagcccatgatctgaccgtgcgaca

SEQ ID NO: 26885 - DNA, 25 bp, Homo sapien
tctttgtaagtgacagcccgccgcc

SEQ ID NO: 26886 - DNA, 25 bp, Homo sapien
ccggcactggcttgaggattttatg

SEQ ID NO: 26887 - DNA, 25 bp, Homo sapien
agacctggtagtcgatgtccgtata

SEQ ID NO: 26888 - DNA, 25 bp, Homo sapien
tatacctcacgtgcagggtccggtc

SEQ ID NO: 26889 - DNA, 25 bp, Homo sapien
cttcggttctttgcagcaggtggcc

SEQ ID NO: 26890 - DNA, 25 bp, Homo sapien
tccggtcctggaagacgccatagaa

SEQ ID NO: 26891 - DNA, 25 bp, Homo sapien
tggagccaccttcaagttcaggagc

SEQ ID NO: 26892 - DNA, 25 bp, Homo sapien
gtcctgtcagcgatgggttacgaga

SEQ ID NO: 26893 - DNA, 25 bp, Homo sapien
ataaggccggaaccctcagcgaagt

SEQ ID NO: 26894 - DNA, 25 bp, Homo sapien
ctgcagcggctttctctgtaaggaa

SEQ ID NO: 26895 - DNA, 25 bp, Homo sapien
gtgttgttcaccgtctcctaagtcc

SEQ ID NO: 26896 - DNA, 25 bp, Homo sapien
ttgggcacaattcccgtgttgttca

SEQ ID NO: 26897 - DNA, 25 bp, Homo sapien
cacaggactgtatctttgggcacaa

SEQ ID NO: 26898 - DNA, 25 bp, Homo sapien
aatgaattcaggaccggcccagtgg

SEQ ID NO: 26899 - DNA, 25 bp, Homo sapien
tatgcgaaacgataggagctgagct

SEQ ID NO: 26900 - DNA, 25 bp, Homo sapien
gcaacgtgcgcgagacataccgcta

SEQ ID NO: 26901 - DNA, 25 bp, Homo sapien
gagatcgtcgttatcctcgagggca

SEQ ID NO: 26902 - DNA, 25 bp, Homo sapien
ctggttatcagccacgagatcgacg

SEQ ID NO: 26903 - DNA, 25 bp, Homo sapien
gggcgacttgcgctcctcacacata

SEQ ID NO: 26904 - DNA, 25 bp, Homo sapien
tgttcgtcaagatctcgcagcccaa

SEQ ID NO: 26905 - DNA, 25 bp, Homo sapien
gggctccatggtgaacgccttcatg

SEQ ID NO: 26906 - DNA, 25 bp, Homo sapien
agtggcgcctcagcctgttgttctt

SEQ ID NO: 26907 - DNA, 25 bp, Homo sapien
gtgcgtcaacaacctcaacggcttc

SEQ ID NO: 26908 - DNA, 25 bp, Homo sapien
tccctacaggagcaggcagaggtgc

SEQ ID NO: 26909 - DNA, 25 bp, Homo sapien
agcactgtcctcgtgacacccgtga

SEQ ID NO: 26910 - DNA, 25 bp, Homo sapien
acacccgtgacaaggaggcggccag

SEQ ID NO: 26911 - DNA, 25 bp, Homo sapien
agcagcagatgctccctacaggagc

SEQ ID NO: 26912 - DNA, 25 bp, Homo sapien
cacctccaggatgaaaggcagcacc

SEQ ID NO: 26913 - DNA, 25 bp, Homo sapien
cgtcagggcacggatgcagtgcatt

SEQ ID NO: 26914 - DNA, 25 bp, Homo sapien
cagtgcattcgcagcgggtagaagc

SEQ ID NO: 26915 - DNA, 25 bp, Homo sapien
aagtcgccggacaactcagcacaga

SEQ ID NO: 26916 - DNA, 25 bp, Homo sapien
aacctgccggtctccggctgggacg

SEQ ID NO: 26917 - DNA, 25 bp, Homo sapien
aactgctcaggaacctgccggtctc

SEQ ID NO: 26918 - DNA, 25 bp, Homo sapien
ccactgccgcaggaactgctcagga

SEQ ID NO: 26919 - DNA, 25 bp, Homo sapien
taattaggttggactgtgccagccc

SEQ ID NO: 26920 - DNA, 25 bp, Homo sapien
tgcctaattaggttggactgtgcca

SEQ ID NO: 26921 - DNA, 25 bp, Homo sapien
ccgacgtggcgttgttgcctaatta

SEQ ID NO: 26922 - DNA, 25 bp, Homo sapien
tggcctcgcctaggcttgcggcagc

SEQ ID NO: 26923 - DNA, 25 bp, Homo sapien
tgctgtggggcccacgccaacggct

SEQ ID NO: 26924 - DNA, 25 bp, Homo sapien
agctgaactggagctgccgaatccc

SEQ ID NO: 26925 - DNA, 25 bp, Homo sapien
agggcgcccatcctgcgcggccagc

SEQ ID NO: 26926 - DNA, 25 bp, Homo sapien
ggacagccacaaagcgcagctggac

SEQ ID NO: 26927 - DNA, 25 bp, Homo sapien
gccacaaagcgcagctggacgccga

SEQ ID NO: 26928 - DNA, 25 bp, Homo sapien
tggcttacctagcattagcagcagc

SEQ ID NO: 26929 - DNA, 25 bp, Homo sapien
ccgagcgagctgaactggagctgcc

SEQ ID NO: 26930 - DNA, 25 bp, Homo sapien
cgagctgaactggagctgccgaatc

SEQ ID NO: 26931 - DNA, 25 bp, Homo sapien
ggggcctggcttacctagcattagc

SEQ ID NO: 26932 - DNA, 25 bp, Homo sapien
cgctgcttaggaaccggggactcag

SEQ ID NO: 26933 - DNA, 25 bp, Homo sapien
gattaggatgcagcctgcttcccgc

SEQ ID NO: 26934 - DNA, 25 bp, Homo sapien
gcctgtggattaggatgcagcctgc

SEQ ID NO: 26935 - DNA, 25 bp, Homo sapien
cacgctgaacggcagtttgggagtc

SEQ ID NO: 26936 - DNA, 25 bp, Homo sapien
gcccgttccacgctgaacggcagtt

SEQ ID NO: 26937 - DNA, 25 bp, Homo sapien
cactttgtgtcaggcctcacggggt

SEQ ID NO: 26938 - DNA, 25 bp, Homo sapien
acgagtccactttgtgtcaggcctc

SEQ ID NO: 26939 - DNA, 25 bp, Homo sapien
tctaggcttggaggggcaacgatct

SEQ ID NO: 26940 - DNA, 25 bp, Homo sapien
tgggtcacccaacgaagcaaggcgt

SEQ ID NO: 26941 - DNA, 25 bp, Homo sapien
cgctaagagcttgggatacgggtca

SEQ ID NO: 26942 - DNA, 25 bp, Homo sapien
tcttgggtcatccttctgctagcgg

SEQ ID NO: 26943 - DNA, 25 bp, Homo sapien
cccgtttgcgacgatgtgctcgaga

SEQ ID NO: 26944 - DNA, 25 bp, Homo sapien
agcaaggcgtccctgtgaactgtgc

SEQ ID NO: 26945 - DNA, 25 bp, Homo sapien
aataggagcgcacacatgggtcacc

SEQ ID NO: 26946 - DNA, 25 bp, Homo sapien
ggcgagccgtgtccctcaatctaag

SEQ ID NO: 26947 - DNA, 25 bp, Homo sapien
gggcaaccagtactcccagcgatga

SEQ ID NO: 26948 - DNA, 25 bp, Homo sapien
cggaagggcccttcaagttcattca

SEQ ID NO: 26949 - DNA, 25 bp, Homo sapien
gatccgtcggcttgatgactcacca

SEQ ID NO: 26950 - DNA, 25 bp, Homo sapien
atcagtccctgcacattaaatgcgg

SEQ ID NO: 26951 - DNA, 25 bp, Homo sapien
cgcctgcaggtagaaatagcggacc

SEQ ID NO: 26952 - DNA, 25 bp, Homo sapien
gggcgccgtccattcgcaacatcag

SEQ ID NO: 26953 - DNA, 25 bp, Homo sapien
ggaacgcgagccagtgccgcaatca

SEQ ID NO: 26954 - DNA, 25 bp, Homo sapien
tgtgactcacggcacactccttgta

SEQ ID NO: 26955 - DNA, 25 bp, Homo sapien
tcgtggtgatttttgcccgctttga

SEQ ID NO: 26956 - DNA, 25 bp, Homo sapien
gtctccttcgccttctgtctttctg

SEQ ID NO: 26957 - DNA, 25 bp, Homo sapien
tctctaaggggaactctcggatcgg

SEQ ID NO: 26958 - DNA, 25 bp, Homo sapien
gcgctcttggtctcgaatttggtta

SEQ ID NO: 26959 - DNA, 25 bp, Homo sapien
ttccgctcagcagagaggcaagatg

SEQ ID NO: 26960 - DNA, 25 bp, Homo sapien
cacgaacttccggtctcttaggctc

SEQ ID NO: 26961 - DNA, 25 bp, Homo sapien
ccgtgagctccgttctctaagggga

SEQ ID NO: 26962 - DNA, 25 bp, Homo sapien
ccggaagcgcctggaaacacgaact

SEQ ID NO: 26963 - DNA, 25 bp, Homo sapien
tcaggtctccgactccgatgtctta

SEQ ID NO: 26964 - DNA, 25 bp, Homo sapien
agagcctggccggaaagacctgcag

SEQ ID NO: 26965 - DNA, 25 bp, Homo sapien
gagctgcgcaagctgctgcctacgc

SEQ ID NO: 26966 - DNA, 25 bp, Homo sapien
cctggccggaaagacctgcagcatc

SEQ ID NO: 26967 - DNA, 25 bp, Homo sapien
agacctgcagcatctgagccgcgag

SEQ ID NO: 26968 - DNA, 25 bp, Homo sapien
gacctgcagcatctgagccgcgagg

SEQ ID NO: 26969 - DNA, 25 bp, Homo sapien
ccgcacggcccacgccacgcgagaa

SEQ ID NO: 26970 - DNA, 25 bp, Homo sapien
cacgcgagaacgcatccgcgtggaa

SEQ ID NO: 26971 - DNA, 25 bp, Homo sapien
gccgagctgcgcaagctgctgccta

SEQ ID NO: 26972 - DNA, 25 bp, Homo sapien
ccaccgcggattcccaggatcgggg

SEQ ID NO: 26973 - DNA, 25 bp, Homo sapien
gattccttgatccttggtcccgcca

SEQ ID NO: 26974 - DNA, 25 bp, Homo sapien
ccttggtcccgccatgggagcctga

SEQ ID NO: 26975 - DNA, 25 bp, Homo sapien
cagggggtgaccagactcaagaacc

SEQ ID NO: 26976 - DNA, 25 bp, Homo sapien
cgctgcctgtccaggagcgccgagt

SEQ ID NO: 26977 - DNA, 25 bp, Homo sapien
gacccggagcgctgcggatacaaag

SEQ ID NO: 26978 - DNA, 25 bp, Homo sapien
tgattcctgatccttgattccttga

SEQ ID NO: 26979 - DNA, 25 bp, Homo sapien
gccggctcccgatctgattcctgat

SEQ ID NO: 26980 - DNA, 25 bp, Homo sapien
tggacgcccttcttttcgtgcacta

SEQ ID NO: 26981 - DNA, 25 bp, Homo sapien
tccagcctcagttcacgctcaaggt

SEQ ID NO: 26982 - DNA, 25 bp, Homo sapien
tgccctgcttatggtgctggttttc

SEQ ID NO: 26983 - DNA, 25 bp, Homo sapien
gtggtctcctactggctcttctatg

SEQ ID NO: 26984 - DNA, 25 bp, Homo sapien
tcgtgcactacctggccgtggtcct

SEQ ID NO: 26985 - DNA, 25 bp, Homo sapien
gctcttctatggtgtgcgcatcctg

SEQ ID NO: 26986 - DNA, 25 bp, Homo sapien
ggttttcctgctcgtggtctcctac

SEQ ID NO: 26987 - DNA, 25 bp, Homo sapien
cgcatcctggatgctcgggagcgca

SEQ ID NO: 26988 - DNA, 25 bp, Homo sapien
tgccactggagaccgctccgccatc

SEQ ID NO: 26989 - DNA, 25 bp, Homo sapien
tctgtgaagagccgctgacgcccgc

SEQ ID NO: 26990 - DNA, 25 bp, Homo sapien
ggagccgccaacttggagactcctg

SEQ ID NO: 26991 - DNA, 25 bp, Homo sapien
caccggagccgccaacttggagact

SEQ ID NO: 26992 - DNA, 25 bp, Homo sapien
tcccatggcacgtcgggaacaccgg

SEQ ID NO: 26993 - DNA, 25 bp, Homo sapien
tgggcgttaggcgtgtcccacccac

SEQ ID NO: 26994 - DNA, 25 bp, Homo sapien
cccgaggctgctagacgtgggcgtt

SEQ ID NO: 26995 - DNA, 25 bp, Homo sapien
ctcaccgccgcgcagcagagctgga

SEQ ID NO: 26996 - DNA, 25 bp, Homo sapien
gggaacagacacagctccgcgacta

SEQ ID NO: 26997 - DNA, 25 bp, Homo sapien
tccgattggtgtaaggaaccgctgc

SEQ ID NO: 26998 - DNA, 25 bp, Homo sapien
tgctcttcagaacgagtcacctcgg

SEQ ID NO: 26999 - DNA, 25 bp, Homo sapien
tcagattggcccaggagactgtcgc

SEQ ID NO: 27000 - DNA, 25 bp, Homo sapien
gtcaggagacgaattccgcaccttc

SEQ ID NO: 27001 - DNA, 25 bp, Homo sapien
ccctgattggttggtgttcccgaag

SEQ ID NO: 27002 - DNA, 25 bp, Homo sapien
agtttcctctcgacttgcgcctttg

SEQ ID NO: 27003 - DNA, 25 bp, Homo sapien
tgggaacttacacaacaggatcgcc

SEQ ID NO: 27004 - DNA, 25 bp, Homo sapien
gatccggaagcaagggcaccgcctc

SEQ ID NO: 27005 - DNA, 25 bp, Homo sapien
ctcgcgagagcgcacgtcgaagagc

SEQ ID NO: 27006 - DNA, 25 bp, Homo sapien
tgaacggagttcaggaagcgagacc

SEQ ID NO: 27007 - DNA, 25 bp, Homo sapien
gcctaggagtcacggccgccatggc

SEQ ID NO: 27008 - DNA, 25 bp, Homo sapien
cctcccggtagggtgtgcacgaaga

SEQ ID NO: 27009 - DNA, 25 bp, Homo sapien
tcaacccagaggaccaagagaaccg

SEQ ID NO: 27010 - DNA, 25 bp, Homo sapien
ccagagctgagaccggatccggaag

SEQ ID NO: 27011 - DNA, 25 bp, Homo sapien
gtgcgcgtagcaaccgcgagtctcc

SEQ ID NO: 27012 - DNA, 25 bp, Homo sapien
atcctctctccatgtctgtcgctgg

SEQ ID NO: 27013 - DNA, 25 bp, Homo sapien
tcctctctccatgtctgtcgctggc

SEQ ID NO: 27014 - DNA, 25 bp, Homo sapien
cttgcattgctgcgaccagggatcc

SEQ ID NO: 27015 - DNA, 25 bp, Homo sapien
cggggatcttgcattgctgcgacca

SEQ ID NO: 27016 - DNA, 25 bp, Homo sapien
gatcctctctccatgtctgtcgctg

SEQ ID NO: 27017 - DNA, 25 bp, Homo sapien
ttgcattgctgcgaccagggatcct

SEQ ID NO: 27018 - DNA, 25 bp, Homo sapien
ccggggatcttgcattgctgcgacc

SEQ ID NO: 27019 - DNA, 25 bp, Homo sapien
ccgcccggggatcttgcattgctgc

SEQ ID NO: 27020 - DNA, 25 bp, Homo sapien
tagcgctagttcctgggcgccttcg

SEQ ID NO: 27021 - DNA, 25 bp, Homo sapien
tgaagcccgtatttggagtgcagta

SEQ ID NO: 27022 - DNA, 25 bp, Homo sapien
cctcggtagaagcagggcagttttg

SEQ ID NO: 27023 - DNA, 25 bp, Homo sapien
tccgcctgcactgcgttgcgcagga

SEQ ID NO: 27024 - DNA, 25 bp, Homo sapien
agcaccacagttaccacgtctgagg

SEQ ID NO: 27025 - DNA, 25 bp, Homo sapien
ttgcgcaggagcactgagccgtcca

SEQ ID NO: 27026 - DNA, 25 bp, Homo sapien
gcagttttgcgtcctggcccagcac

SEQ ID NO: 27027 - DNA, 25 bp, Homo sapien
tcgtaagccgggctcacatgaagcc

SEQ ID NO: 27028 - DNA, 25 bp, Homo sapien
acggttctatctcgtaggtggtctc

SEQ ID NO: 27029 - DNA, 25 bp, Homo sapien
gagggcggtatccacactcagcgac

SEQ ID NO: 27030 - DNA, 25 bp, Homo sapien
tgtctccacggtaactgctgctttg

SEQ ID NO: 27031 - DNA, 25 bp, Homo sapien
gctgctttgcgaccttcggtttgca

SEQ ID NO: 27032 - DNA, 25 bp, Homo sapien
ttccattcatgcaccgaactgcggg

SEQ ID NO: 27033 - DNA, 25 bp, Homo sapien
gcccagcagcgatacggtggttttc

SEQ ID NO: 27034 - DNA, 25 bp, Homo sapien
acgcgcttttggctagagctttcca

SEQ ID NO: 27035 - DNA, 25 bp, Homo sapien
cggttcccgatagccacccaggtgt

SEQ ID NO: 27036 - DNA, 25 bp, Homo sapien
agccaggattcctctccagatcgcg

SEQ ID NO: 27037 - DNA, 25 bp, Homo sapien
cgtgcttcgctgactgcccgcattg

SEQ ID NO: 27038 - DNA, 25 bp, Homo sapien
aagctctgtcggacccgtgcgagca

SEQ ID NO: 27039 - DNA, 25 bp, Homo sapien
ccgccgcatttcattgcctgaaacg

SEQ ID NO: 27040 - DNA, 25 bp, Homo sapien
gtggagagggtaccaactaagcatc

SEQ ID NO: 27041 - DNA, 25 bp, Homo sapien
cccaaagtccttcagggagcaactc

SEQ ID NO: 27042 - DNA, 25 bp, Homo sapien
agcaactccgcgcagttttctcttc

SEQ ID NO: 27043 - DNA, 25 bp, Homo sapien
gcctctggtgccgagggaaaactgc

SEQ ID NO: 27044 - DNA, 25 bp, Homo sapien
tggctatatcttcatgtaggaccta

SEQ ID NO: 27045 - DNA, 25 bp, Homo sapien
acttgtgtaacagagatgctgcctc

SEQ ID NO: 27046 - DNA, 25 bp, Homo sapien
cctgcggtgctttaacttgtgtaac

SEQ ID NO: 27047 - DNA, 25 bp, Homo sapien
atgtaggacctactccctatcccgt

SEQ ID NO: 27048 - DNA, 25 bp, Homo sapien
ccctgcgaatggttttggctatatc

SEQ ID NO: 27049 - DNA, 25 bp, Homo sapien
cggatcggaccctgcgaatggtttt

SEQ ID NO: 27050 - DNA, 25 bp, Homo sapien
gtcacgtccggcctgcgagttaccg

SEQ ID NO: 27051 - DNA, 25 bp, Homo sapien
ggccgcggtgaatcccacctgcggt

SEQ ID NO: 27052 - DNA, 25 bp, Homo sapien
gtggctgcatcctgaacggcgcctc

SEQ ID NO: 27053 - DNA, 25 bp, Homo sapien
tcacggcgccgcatccgggctccag

SEQ ID NO: 27054 - DNA, 25 bp, Homo sapien
ccacctctcagcgtcccgtcacctc

SEQ ID NO: 27055 - DNA, 25 bp, Homo sapien
ccgtcacctccctctcttgaggttc

SEQ ID NO: 27056 - DNA, 25 bp, Homo sapien
gttctcaggctggacgtcgccaccg

SEQ ID NO: 27057 - DNA, 25 bp, Homo sapien
atgttggatccatccgcgccgctct

SEQ ID NO: 27058 - DNA, 25 bp, Homo sapien
ccgggcctgcctcacggcgccgcat

SEQ ID NO: 27059 - DNA, 25 bp, Homo sapien
tgccctctcccgcagttgccatctc

SEQ ID NO: 27060 - DNA, 25 bp, Homo sapien
ccggaggctcttgcgcgccgaattt

SEQ ID NO: 27061 - DNA, 25 bp, Homo sapien
ggggtcagaccacgcgagcagccac

SEQ ID NO: 27062 - DNA, 25 bp, Homo sapien
cagaccacgcgagcagccacacccg

SEQ ID NO: 27063 - DNA, 25 bp, Homo sapien
gtttcaccgtcgcacatggcggcag

SEQ ID NO: 27064 - DNA, 25 bp, Homo sapien
ttcaccgtcgcacatggcggcagca

SEQ ID NO: 27065 - DNA, 25 bp, Homo sapien
acatggcggcagcacgcggtgagct

SEQ ID NO: 27066 - DNA, 25 bp, Homo sapien
ctggcaacgtcggtctcaggcgtag

SEQ ID NO: 27067 - DNA, 25 bp, Homo sapien
ttgcgcgccgaatttcacccgcggc

SEQ ID NO: 27068 - DNA, 25 bp, Homo sapien
ttgagaaccagcgaccctaaacttg

SEQ ID NO: 27069 - DNA, 25 bp, Homo sapien
ggctaaagctgcagccgggcccacg

SEQ ID NO: 27070 - DNA, 25 bp, Homo sapien
cgcagagggaagactgctccagacc

SEQ ID NO: 27071 - DNA, 25 bp, Homo sapien
tgctccagacccgagaggacactct

SEQ ID NO: 27072 - DNA, 25 bp, Homo sapien
aggacactctccacaaaggcgcgtg

SEQ ID NO: 27073 - DNA, 25 bp, Homo sapien
atacgccgccggattccgtagccaa

SEQ ID NO: 27074 - DNA, 25 bp, Homo sapien
agccaatcagcggtctcggcctttc

SEQ ID NO: 27075 - DNA, 25 bp, Homo sapien
tggctgcgtttccatggtgtcgatc

SEQ ID NO: 27076 - DNA, 25 bp, Homo sapien
ccgcctctgccagttcaatgtttta

SEQ ID NO: 27077 - DNA, 25 bp, Homo sapien
ggcgctaacacggttaacctccagc

SEQ ID NO: 27078 - DNA, 25 bp, Homo sapien
cggatttgaagcacttgttggccta

SEQ ID NO: 27079 - DNA, 25 bp, Homo sapien
cagagcacctcagaactcaggcgta

SEQ ID NO: 27080 - DNA, 25 bp, Homo sapien
cggtcttaggacctcgatctccttc

SEQ ID NO: 27081 - DNA, 25 bp, Homo sapien
ccctacctattgtgggtgagtcctg

SEQ ID NO: 27082 - DNA, 25 bp, Homo sapien
agcccatccgtgcacacttagtttc

SEQ ID NO: 27083 - DNA, 25 bp, Homo sapien
tccaagtcccgccaatccagatgta

SEQ ID NO: 27084 - DNA, 25 bp, Homo sapien
caggcgttacccaaaacttctcact

SEQ ID NO: 27085 - DNA, 25 bp, Homo sapien
cacctggaacgcgttgtaggcgacc

SEQ ID NO: 27086 - DNA, 25 bp, Homo sapien
ctggtcttttgctgcctgtcgtcac

SEQ ID NO: 27087 - DNA, 25 bp, Homo sapien
cccagcgcacatacctggtcttttg

SEQ ID NO: 27088 - DNA, 25 bp, Homo sapien
tgtcgacgcattcccagcgcacata

SEQ ID NO: 27089 - DNA, 25 bp, Homo sapien
tttatcccaggcctccgtgtcgacg

SEQ ID NO: 27090 - DNA, 25 bp, Homo sapien
actctctcgaatgcccaaaccttta

SEQ ID NO: 27091 - DNA, 25 bp, Homo sapien
aacagccgggcaggcatcgctgccg

SEQ ID NO: 27092 - DNA, 25 bp, Homo sapien
ccctcagtaaagatgaccgcggtca

SEQ ID NO: 27093 - DNA, 25 bp, Homo sapien
ccagcttccaagagggcggcttcac

SEQ ID NO: 27094 - DNA, 25 bp, Homo sapien
aagcgccgcgcgtttccaagatacg

SEQ ID NO: 27095 - DNA, 25 bp, Homo sapien
ctcggcgagagagcacgaagtatct

SEQ ID NO: 27096 - DNA, 25 bp, Homo sapien
cttgctcgctcctagaaaagccagc

SEQ ID NO: 27097 - DNA, 25 bp, Homo sapien
gaccgcggtcactgttatctaaacg

SEQ ID NO: 27098 - DNA, 25 bp, Homo sapien
caggacccggatgttgtcagttcga

SEQ ID NO: 27099 - DNA, 25 bp, Homo sapien
ttcgacggtaaacgaccctgccagc

SEQ ID NO: 27100 - DNA, 25 bp, Homo sapien
ggtaccgagctgagtataaaaggtg

SEQ ID NO: 27101 - DNA, 25 bp, Homo sapien
tctccctactgtggacggcgctttt

SEQ ID NO: 27102 - DNA, 25 bp, Homo sapien
cggggtgctttcagtctccctactg

SEQ ID NO: 27103 - DNA, 25 bp, Homo sapien
cacctcggggcgctgggaaacgatt

SEQ ID NO: 27104 - DNA, 25 bp, Homo sapien
cggagccgcgaagaaccctccaggg

SEQ ID NO: 27105 - DNA, 25 bp, Homo sapien
cagagcccggcaactttcagctgtc

SEQ ID NO: 27106 - DNA, 25 bp, Homo sapien
ggctccgagaatcccgggtgccagc

SEQ ID NO: 27107 - DNA, 25 bp, Homo sapien
ggtaattggaatcggctgtagagtc

SEQ ID NO: 27108 - DNA, 25 bp, Homo sapien
gctgtgaccgtgctgagaatgaccc

SEQ ID NO: 27109 - DNA, 25 bp, Homo sapien
aacgcccagcctggagatgggaagc

SEQ ID NO: 27110 - DNA, 25 bp, Homo sapien
ctttgcggagaaagtactttggctg

SEQ ID NO: 27111 - DNA, 25 bp, Homo sapien
ggcacgagtgacagcgcgctcctcg

SEQ ID NO: 27112 - DNA, 25 bp, Homo sapien
gaagcacagtaggtgccgctcctgc

SEQ ID NO: 27113 - DNA, 25 bp, Homo sapien
agccgcctgggcttcagactcggga

SEQ ID NO: 27114 - DNA, 25 bp, Homo sapien
gtcttgagctctccggatggcctca

SEQ ID NO: 27115 - DNA, 25 bp, Homo sapien
aaggccgcaggagcatctttgcgga

SEQ ID NO: 27116 - DNA, 25 bp, Homo sapien
ctgtttgggagtgcgatacaaaatg

SEQ ID NO: 27117 - DNA, 25 bp, Homo sapien
agccagcggcgtttctgccgaaatc

SEQ ID NO: 27118 - DNA, 25 bp, Homo sapien
agactgcagattttgagccagcggc

SEQ ID NO: 27119 - DNA, 25 bp, Homo sapien
tgtacgcaggtggaacgtagactgc

SEQ ID NO: 27120 - DNA, 25 bp, Homo sapien
caagtccgccgtttgctgtttggga

SEQ ID NO: 27121 - DNA, 25 bp, Homo sapien
actgcgaagtccttaaggaagaatc

SEQ ID NO: 27122 - DNA, 25 bp, Homo sapien
ggggaacgcaacagactgcgaagtc

SEQ ID NO: 27123 - DNA, 25 bp, Homo sapien
tcctggcaaattccggtagaagtcg

SEQ ID NO: 27124 - DNA, 25 bp, Homo sapien
tttcctgacgtcattggcgcgtgcc

SEQ ID NO: 27125 - DNA, 25 bp, Homo sapien
agcgcgagagtatcagccgcctcat

SEQ ID NO: 27126 - DNA, 25 bp, Homo sapien
cggtgcggagcttcaatcgctggaa

SEQ ID NO: 27127 - DNA, 25 bp, Homo sapien
gccgcctcatgcagaactatgaaaa

SEQ ID NO: 27128 - DNA, 25 bp, Homo sapien
ccgcaatgggcaaaacggccaactc

SEQ ID NO: 27129 - DNA, 25 bp, Homo sapien
ttgtcccatgctggttccgtgagtc

SEQ ID NO: 27130 - DNA, 25 bp, Homo sapien
catgcgcctctgtgcgtttgtccca

SEQ ID NO: 27131 - DNA, 25 bp, Homo sapien
ccagcaggagccaattcgccaatca

SEQ ID NO: 27132 - DNA, 25 bp, Homo sapien
ataactgtttatcctgtgcctgggc

SEQ ID NO: 27133 - DNA, 25 bp, Homo sapien
tgcgctgttgctgaggtgacttcag

SEQ ID NO: 27134 - DNA, 25 bp, Homo sapien
cggccctccggagatctgaactggc

SEQ ID NO: 27135 - DNA, 25 bp, Homo sapien
ccctcacgttttgctgataactgtt

SEQ ID NO: 27136 - DNA, 25 bp, Homo sapien
aagcgctcggggatcctagagaccc

SEQ ID NO: 27137 - DNA, 25 bp, Homo sapien
actgacttcgtatcgaggggccctc

SEQ ID NO: 27138 - DNA, 25 bp, Homo sapien
cggaacccaagatggctgcgctgtt

SEQ ID NO: 27139 - DNA, 25 bp, Homo sapien
gcttcggggtcactgacttcgtatc

SEQ ID NO: 27140 - DNA, 25 bp, Homo sapien
atgcaggtcaatgggaacgccactc

SEQ ID NO: 27141 - DNA, 25 bp, Homo sapien
cggtcttgactcattgctgacggga

SEQ ID NO: 27142 - DNA, 25 bp, Homo sapien
ctgtcgggaactgagagcacccttt

SEQ ID NO: 27143 - DNA, 25 bp, Homo sapien
ttcaaccgacgtattgccagtaccg

SEQ ID NO: 27144 - DNA, 25 bp, Homo sapien
aggctaacgggacagctgtttctcc

SEQ ID NO: 27145 - DNA, 25 bp, Homo sapien
ccgggacgtcaacacgaggctaacg

SEQ ID NO: 27146 - DNA, 25 bp, Homo sapien
gctgacgggaaagctccggacctct

SEQ ID NO: 27147 - DNA, 25 bp, Homo sapien
ggcacagtcttttcgtcctcctggg

SEQ ID NO: 27148 - DNA, 25 bp, Homo sapien
ttcccagtgtgtccgaagttccttc

SEQ ID NO: 27149 - DNA, 25 bp, Homo sapien
tcactgcgatctgggcgaattctta

SEQ ID NO: 27150 - DNA, 25 bp, Homo sapien
cccgaatgctcgtcgtggagttttc

SEQ ID NO: 27151 - DNA, 25 bp, Homo sapien
ttcctgatcctgtcgggtccctaag

SEQ ID NO: 27152 - DNA, 25 bp, Homo sapien
ggactaggccctgaactacaacttg

SEQ ID NO: 27153 - DNA, 25 bp, Homo sapien
agcgcactcttggatctgtatacag

SEQ ID NO: 27154 - DNA, 25 bp, Homo sapien
ccgcgacacggtgcctgatgatatc

SEQ ID NO: 27155 - DNA, 25 bp, Homo sapien
tatcaaaaggtctcacggctccgga

SEQ ID NO: 27156 - DNA, 25 bp, Homo sapien
cacctgctggtgacacaagtgagaa

SEQ ID NO: 27157 - DNA, 25 bp, Homo sapien
gcaggcgagtccaaacccggaaaga

SEQ ID NO: 27158 - DNA, 25 bp, Homo sapien
agacagcccaagaggaatcacgagc

SEQ ID NO: 27159 - DNA, 25 bp, Homo sapien
atcacgagcggaagccctagatccc

SEQ ID NO: 27160 - DNA, 25 bp, Homo sapien
cacggacctggtctgcgtttctgag

SEQ ID NO: 27161 - DNA, 25 bp, Homo sapien
caaaaactctgggtctgtgccgggg

SEQ ID NO: 27162 - DNA, 25 bp, Homo sapien
agcaaggcccgccacagcaaatctg

SEQ ID NO: 27163 - DNA, 25 bp, Homo sapien
agaggcacgccatccaacatcctgt

SEQ ID NO: 27164 - DNA, 25 bp, Homo sapien
aggcggcggcccaaaaagcacggct

SEQ ID NO: 27165 - DNA, 25 bp, Homo sapien
ctatactaacgaggacgacggcgac

SEQ ID NO: 27166 - DNA, 25 bp, Homo sapien
ccgccacacgccacccgtcacctgc

SEQ ID NO: 27167 - DNA, 25 bp, Homo sapien
aaagcaccctgcgatcccgctggga

SEQ ID NO: 27168 - DNA, 25 bp, Homo sapien
tgtctccaacgcggggatcgcgccg

SEQ ID NO: 27169 - DNA, 25 bp, Homo sapien
cgggcgaaacagtcaggccgctgct

SEQ ID NO: 27170 - DNA, 25 bp, Homo sapien
acagtcaggccgctgctcctaggac

SEQ ID NO: 27171 - DNA, 25 bp, Homo sapien
caggccgctgctcctaggacgcggt

SEQ ID NO: 27172 - DNA, 25 bp, Homo sapien
cgtgtgtcgcagaaagcctcttccg

SEQ ID NO: 27173 - DNA, 25 bp, Homo sapien
cccgtgtgtcgcagaaagcctcttc

SEQ ID NO: 27174 - DNA, 25 bp, Homo sapien
acaaccactttgagccggcagctcg

SEQ ID NO: 27175 - DNA, 25 bp, Homo sapien
actttgagccggcagctcgttgggc

SEQ ID NO: 27176 - DNA, 25 bp, Homo sapien
ccgcggacgagaagaaaagacagga

SEQ ID NO: 27177 - DNA, 25 bp, Homo sapien
acgagaagaaaagacaggaggccaa

SEQ ID NO: 27178 - DNA, 25 bp, Homo sapien
cagaaggccaaagggccaggcaggc

SEQ ID NO: 27179 - DNA, 25 bp, Homo sapien
tgccgctaccaagccgcggacgaga

SEQ ID NO: 27180 - DNA, 25 bp, Homo sapien
cactcctgacaagccgaccttttgg

SEQ ID NO: 27181 - DNA, 25 bp, Homo sapien
gggcaacgcccatggcaaccctgga

SEQ ID NO: 27182 - DNA, 25 bp, Homo sapien
ttgaagcaagcctccaaaacgccgc

SEQ ID NO: 27183 - DNA, 25 bp, Homo sapien
taccaattgcccttcggacagacgc

SEQ ID NO: 27184 - DNA, 25 bp, Homo sapien
tccaacttctgaccgctgagcagca

SEQ ID NO: 27185 - DNA, 25 bp, Homo sapien
agcgactcgctcgtggagccgcaca

SEQ ID NO: 27186 - DNA, 25 bp, Homo sapien
agaggcacgccatccaacatcctgt

SEQ ID NO: 27187 - DNA, 25 bp, Homo sapien
gttgcgcaccgaacccagacaggcg

SEQ ID NO: 27188 - DNA, 25 bp, Homo sapien
gtggcctccagcatccgacaagaag

SEQ ID NO: 27189 - DNA, 25 bp, Homo sapien
acaacaccgtgttcgatgccaagcg

SEQ ID NO: 27190 - DNA, 25 bp, Homo sapien
cagcccgtgaagcacgcagtgatca

SEQ ID NO: 27191 - DNA, 25 bp, Homo sapien
cactgctggagatacccacctggga

SEQ ID NO: 27192 - DNA, 25 bp, Homo sapien
tcggttctctccattgacgctggtg

SEQ ID NO: 27193 - DNA, 25 bp, Homo sapien
gggcaccttcgatgtgtcggttctc

SEQ ID NO: 27194 - DNA, 25 bp, Homo sapien
cgtgcccgcctatttcaatgactcg

SEQ ID NO: 27195 - DNA, 25 bp, Homo sapien
accggctcgtgaaccacttcatgga

SEQ ID NO: 27196 - DNA, 25 bp, Homo sapien
agccggtggcttctgcgttcaccgc

SEQ ID NO: 27197 - DNA, 25 bp, Homo sapien
aggtagaccctgtgtcggcccgtct

SEQ ID NO: 27198 - DNA, 25 bp, Homo sapien
ggatcctccgcaccaatcactgttg

SEQ ID NO: 27199 - DNA, 25 bp, Homo sapien
actgttgctgaatccgacacccggc

SEQ ID NO: 27200 - DNA, 25 bp, Homo sapien
cggagtctcgaacagctgcggagct

SEQ ID NO: 27201 - DNA, 25 bp, Homo sapien
gcgatgctcaactgcggctttctct

SEQ ID NO: 27202 - DNA, 25 bp, Homo sapien
ttctctctcggctgtgagccggctc

SEQ ID NO: 27203 - DNA, 25 bp, Homo sapien
ggtcgagccatgtcaaggtagaccc

SEQ ID NO: 27204 - DNA, 25 bp, Homo sapien
tcctttgccgtgaagcagcgcttga

SEQ ID NO: 27205 - DNA, 25 bp, Homo sapien
agcgactccctagcgtcctgcaagg

SEQ ID NO: 27206 - DNA, 25 bp, Homo sapien
tgacatgaagcgtctggcctggtcc

SEQ ID NO: 27207 - DNA, 25 bp, Homo sapien
gctgccacttggagggtttctctta

SEQ ID NO: 27208 - DNA, 25 bp, Homo sapien
tccggaaacgcagtccgtggctgca

SEQ ID NO: 27209 - DNA, 25 bp, Homo sapien
aggcgcagcgtctcctattctaggc

SEQ ID NO: 27210 - DNA, 25 bp, Homo sapien
ctgcagttcgcgttttacaagtaca

SEQ ID NO: 27211 - DNA, 25 bp, Homo sapien
gccctctccgtagagctgttccggg

SEQ ID NO: 27212 - DNA, 25 bp, Homo sapien
gcctcttcgtgccagcgctggacaa

SEQ ID NO: 27213 - DNA, 25 bp, Homo sapien
ggtcgaggatctatggcgcctcttc

SEQ ID NO: 27214 - DNA, 25 bp, Homo sapien
tcacggccgtgctaacagtggactc

SEQ ID NO: 27215 - DNA, 25 bp, Homo sapien
gtgcagccaggattgtatttcggtg

SEQ ID NO: 27216 - DNA, 25 bp, Homo sapien
tctagccggagtctactcgatggta

SEQ ID NO: 27217 - DNA, 25 bp, Homo sapien
gtcccaggggaaggatgttctagcc

SEQ ID NO: 27218 - DNA, 25 bp, Homo sapien
ccctcagcgataagtccagattcct

SEQ ID NO: 27219 - DNA, 25 bp, Homo sapien
agacggacctactcagccatctgga

SEQ ID NO: 27220 - DNA, 25 bp, Homo sapien
agaaggcgccattgtataccacgtg

SEQ ID NO: 27221 - DNA, 25 bp, Homo sapien
ggccattctcgtccacagcaaagtc

SEQ ID NO: 27222 - DNA, 25 bp, Homo sapien
agatgttggcattccgctggttgta

SEQ ID NO: 27223 - DNA, 25 bp, Homo sapien
gacaatgacctcctggctgaagccc

SEQ ID NO: 27224 - DNA, 25 bp, Homo sapien
tggtctccttctgtgtgctcaggtc

SEQ ID NO: 27225 - DNA, 25 bp, Homo sapien
agcagttgccgtagaaattcctccg

SEQ ID NO: 27226 - DNA, 25 bp, Homo sapien
gctggttgtagctatccacggcata

SEQ ID NO: 27227 - DNA, 25 bp, Homo sapien
tcgtaggccacgtcatgcagcatgg

SEQ ID NO: 27228 - DNA, 25 bp, Homo sapien
tgcaggtggtgactcagttgtcacc

SEQ ID NO: 27229 - DNA, 25 bp, Homo sapien
agttgtcaccgtcactgtcaccgct

SEQ ID NO: 27230 - DNA, 25 bp, Homo sapien
gctggctcctacctgacctcatggc

SEQ ID NO: 27231 - DNA, 25 bp, Homo sapien
tggcgctctagccacgcgctctggg

SEQ ID NO: 27232 - DNA, 25 bp, Homo sapien
ctctggggctcgtcaaaaagactta

SEQ ID NO: 27233 - DNA, 25 bp, Homo sapien
ggctcgtcaaaaagacttaaattgc

SEQ ID NO: 27234 - DNA, 25 bp, Homo sapien
cttgctctcagctgtgccttaaaaa

SEQ ID NO: 27235 - DNA, 25 bp, Homo sapien
ctcagctgtgccttaaaaagctgca

SEQ ID NO: 27236 - DNA, 25 bp, Homo sapien
ctggggtccgctgaccgaaaataca

SEQ ID NO: 27237 - DNA, 25 bp, Homo sapien
gggcagcggccgagattctaactaa

SEQ ID NO: 27238 - DNA, 25 bp, Homo sapien
cggctgcgtgtctgttgcaattata

SEQ ID NO: 27239 - DNA, 25 bp, Homo sapien
ctgagtaatctgcacctccgcggtg

SEQ ID NO: 27240 - DNA, 25 bp, Homo sapien
tagggacttcaaccaaagcggctgc

SEQ ID NO: 27241 - DNA, 25 bp, Homo sapien
tggtggttgatctttcccgacagca

SEQ ID NO: 27242 - DNA, 25 bp, Homo sapien
aggctgccttatctgctgagtaatc

SEQ ID NO: 27243 - DNA, 25 bp, Homo sapien
cccatcctgtcgagtggcatgagca

SEQ ID NO: 27244 - DNA, 25 bp, Homo sapien
agggctttactttcttctcatctga

SEQ ID NO: 27245 - DNA, 25 bp, Homo sapien
ccctgtgaggacaatgctggacacc

SEQ ID NO: 27246 - DNA, 25 bp, Homo sapien
ccggaaccacaatcagagcgaagta

SEQ ID NO: 27247 - DNA, 25 bp, Homo sapien
gtgtcctcgctagagcccgaaagtg

SEQ ID NO: 27248 - DNA, 25 bp, Homo sapien
gagactctgggcatctccttcccga

SEQ ID NO: 27249 - DNA, 25 bp, Homo sapien
ttcttggcgagaagagcgactttcc

SEQ ID NO: 27250 - DNA, 25 bp, Homo sapien
atcgtcctttagcacacctggggca

SEQ ID NO: 27251 - DNA, 25 bp, Homo sapien
gtggctgctgagagcaccttctaaa

SEQ ID NO: 27252 - DNA, 25 bp, Homo sapien
ccggcaggaattgcgcgaccacagc

SEQ ID NO: 27253 - DNA, 25 bp, Homo sapien
ccgcgggtaaccatgcctagcaaaa

SEQ ID NO: 27254 - DNA, 25 bp, Homo sapien
tgcctagcaaaaccaagtacaacct

SEQ ID NO: 27255 - DNA, 25 bp, Homo sapien
acgatgggcacgacctgcggatccc

SEQ ID NO: 27256 - DNA, 25 bp, Homo sapien
tcgctggcggctgatccagcgtctc

SEQ ID NO: 27257 - DNA, 25 bp, Homo sapien
ctcctagccggcaggaattgcgcga

SEQ ID NO: 27258 - DNA, 25 bp, Homo sapien
gtcccgggcggtgcgttccactgct

SEQ ID NO: 27259 - DNA, 25 bp, Homo sapien
agtacaaccttgtggacgatgggca

SEQ ID NO: 27260 - DNA, 25 bp, Homo sapien
atcgcctcggagtacgagtccaaca

SEQ ID NO: 27261 - DNA, 25 bp, Homo sapien
ccgcgcctgctgaatgtcctgcaga

SEQ ID NO: 27262 - DNA, 25 bp, Homo sapien
agttccgagagtcaggcatcgcctc

SEQ ID NO: 27263 - DNA, 25 bp, Homo sapien
ggcggtctggagctcatcaagttcc

SEQ ID NO: 27264 - DNA, 25 bp, Homo sapien
tttcgctttcttccgcccgaggaca

SEQ ID NO: 27265 - DNA, 25 bp, Homo sapien
agctggagtgctttcgctttcttcc

SEQ ID NO: 27266 - DNA, 25 bp, Homo sapien
taagccagaggacctgcattcgccg

SEQ ID NO: 27267 - DNA, 25 bp, Homo sapien
cgacggcctggatgatgagatcgcc

SEQ ID NO: 27268 - DNA, 25 bp, Homo sapien
cggtgtcatggctgcttgaagtccc

SEQ ID NO: 27269 - DNA, 25 bp, Homo sapien
tcaggcgtcgcgtcagctcccgtgt

SEQ ID NO: 27270 - DNA, 25 bp, Homo sapien
ttaacccacaccgatggcgggatcc

SEQ ID NO: 27271 - DNA, 25 bp, Homo sapien
tacagagccgtctgggtagcggctc

SEQ ID NO: 27272 - DNA, 25 bp, Homo sapien
ccgccgagtatggtttccgcaaaga

SEQ ID NO: 27273 - DNA, 25 bp, Homo sapien
atcgggttcgctgctgcggcaaccc

SEQ ID NO: 27274 - DNA, 25 bp, Homo sapien
ctcaagcagttcttgccgccaggaa

SEQ ID NO: 27275 - DNA, 25 bp, Homo sapien
actcgggtgcaccacggcttccggt

SEQ ID NO: 27276 - DNA, 25 bp, Homo sapien
ttcccattgggccagagaatgagtg

SEQ ID NO: 27277 - DNA, 25 bp, Homo sapien
agccgactgcgctccagaactattc

SEQ ID NO: 27278 - DNA, 25 bp, Homo sapien
cttcaccctcagttagtgcgcagga

SEQ ID NO: 27279 - DNA, 25 bp, Homo sapien
tcccagtacaacctagggacgtcag

SEQ ID NO: 27280 - DNA, 25 bp, Homo sapien
ctgggccgactaagagcctcgggct

SEQ ID NO: 27281 - DNA, 25 bp, Homo sapien
tcagacgtggacacgcgtcgcacga

SEQ ID NO: 27282 - DNA, 25 bp, Homo sapien
cgccctgaaagtttctccgcaggaa

SEQ ID NO: 27283 - DNA, 25 bp, Homo sapien
atgagggtatatattcggagcgagc

SEQ ID NO: 27284 - DNA, 25 bp, Homo sapien
ccgctgagccctaggaagcagtgac

SEQ ID NO: 27285 - DNA, 25 bp, Homo sapien
agattggagggatcagctcagactc

SEQ ID NO: 27286 - DNA, 25 bp, Homo sapien
gcaggggtctgcgaccctccacgaa

SEQ ID NO: 27287 - DNA, 25 bp, Homo sapien
tttgcttcactgcttggaagtgtga

SEQ ID NO: 27288 - DNA, 25 bp, Homo sapien
tgaggcggcccgaaatcgtaggact

SEQ ID NO: 27289 - DNA, 25 bp, Homo sapien
cgtggccgtactctgattggtgacg

SEQ ID NO: 27290 - DNA, 25 bp, Homo sapien
gctcagactcgatgacgcaacggga

SEQ ID NO: 27291 - DNA, 25 bp, Homo sapien
ccctaggaagcagtgacagacacct

SEQ ID NO: 27292 - DNA, 25 bp, Homo sapien
ttacggagtgagcaggtgaacgcct

SEQ ID NO: 27293 - DNA, 25 bp, Homo sapien
tgggtggggaactcacaactctgac

SEQ ID NO: 27294 - DNA, 25 bp, Homo sapien
gtgcttatcacgctgatgatgagga

SEQ ID NO: 27295 - DNA, 25 bp, Homo sapien
gcgtgctcggttttcgtgcttatca

SEQ ID NO: 27296 - DNA, 25 bp, Homo sapien
tctctgttgcttgcgtgctcggttt

SEQ ID NO: 27297 - DNA, 25 bp, Homo sapien
gaaataaactgggaaactgctgtgg

SEQ ID NO: 27298 - DNA, 25 bp, Homo sapien
ccgctgggtcagtctcggatagaaa

SEQ ID NO: 27299 - DNA, 25 bp, Homo sapien
tccctgggtgctccggtgcggtact

SEQ ID NO: 27300 - DNA, 25 bp, Homo sapien
cgcagagatgggctagacgctcaac

SEQ ID NO: 27301 - DNA, 25 bp, Homo sapien
ttctccatcccaaggcgcgggcagg

SEQ ID NO: 27302 - DNA, 25 bp, Homo sapien
aggaagcctgcagacagacgccttc

SEQ ID NO: 27303 - DNA, 25 bp, Homo sapien
tttgactttgcttgtagctgctccc

SEQ ID NO: 27304 - DNA, 25 bp, Homo sapien
acggttgacgtttgctgatttttga

SEQ ID NO: 27305 - DNA, 25 bp, Homo sapien
ggcgtctcttgagcccaaccggcat

SEQ ID NO: 27306 - DNA, 25 bp, Homo sapien
acgctctaaacgctggcggaagtca

SEQ ID NO: 27307 - DNA, 25 bp, Homo sapien
acttccagtaggaggcggcaagttt

SEQ ID NO: 27308 - DNA, 25 bp, Homo sapien
tctttgccctcgttggctactgcgg

SEQ ID NO: 27309 - DNA, 25 bp, Homo sapien
ggaagtgtccctgtctttgccctcg

SEQ ID NO: 27310 - DNA, 25 bp, Homo sapien
acatgggagcgacagcgaggcgtca

SEQ ID NO: 27311 - DNA, 25 bp, Homo sapien
acggaattcctgaggcgtactggga

SEQ ID NO: 27312 - DNA, 25 bp, Homo sapien
ttcacggaattcctgaggcgtactg

SEQ ID NO: 27313 - DNA, 25 bp, Homo sapien
cagcggtgcttcacggaattcctga

SEQ ID NO: 27314 - DNA, 25 bp, Homo sapien
cgcacagcggtgcttcacggaattc

SEQ ID NO: 27315 - DNA, 25 bp, Homo sapien
tgccctcgttggctactgcggggca

SEQ ID NO: 27316 - DNA, 25 bp, Homo sapien
cgccgtgttcccctctgttgtgtgc

SEQ ID NO: 27317 - DNA, 25 bp, Homo sapien
tgagagctgcgcagggcggtctggc

SEQ ID NO: 27318 - DNA, 25 bp, Homo sapien
gggaatcgcggagcgcggcagctcc

SEQ ID NO: 27319 - DNA, 25 bp, Homo sapien
tccctggcgtatgcaggtcgccggc

SEQ ID NO: 27320 - DNA, 25 bp, Homo sapien
gctccacctgagagctgcgcagggc

SEQ ID NO: 27321 - DNA, 25 bp, Homo sapien
ctccctggcgtatgcaggtcgccgg

SEQ ID NO: 27322 - DNA, 25 bp, Homo sapien
gcgtatgcaggtcgccggcgcagcc

SEQ ID NO: 27323 - DNA, 25 bp, Homo sapien
ttcccctctgttgtgtgcgccgcgt

SEQ ID NO: 27324 - DNA, 25 bp, Homo sapien
agtcaccgagctccggtcgctcagg

SEQ ID NO: 27325 - DNA, 25 bp, Homo sapien
ttggggctgtgagttgtgcaaccca

SEQ ID NO: 27326 - DNA, 25 bp, Homo sapien
agcgacctcgccgtgtgatctccag

SEQ ID NO: 27327 - DNA, 25 bp, Homo sapien
ccttggctcagggtttcctgtttca

SEQ ID NO: 27328 - DNA, 25 bp, Homo sapien
tcctgtttcagttctcggcgttctc

SEQ ID NO: 27329 - DNA, 25 bp, Homo sapien
tggtttgccaacctcggctccagag

SEQ ID NO: 27330 - DNA, 25 bp, Homo sapien
ttgagcaacagattcgagtgcgcgc

SEQ ID NO: 27331 - DNA, 25 bp, Homo sapien
ctccagggcatgtagtgatggctgc

SEQ ID NO: 27332 - DNA, 25 bp, Homo sapien
gctcagccaagaccaaggtaagggg

SEQ ID NO: 27333 - DNA, 25 bp, Homo sapien
ccgtgccggtaactgggattggcac

SEQ ID NO: 27334 - DNA, 25 bp, Homo sapien
gtgggctcagccaagaccaaggtaa

SEQ ID NO: 27335 - DNA, 25 bp, Homo sapien
cccaggtgggctcagccaagaccaa

SEQ ID NO: 27336 - DNA, 25 bp, Homo sapien
gtaactgggattggcacccgccggc

SEQ ID NO: 27337 - DNA, 25 bp, Homo sapien
ttctggcctctcagcggagccagct

SEQ ID NO: 27338 - DNA, 25 bp, Homo sapien
gttcactggtgacccgcccaggacc

SEQ ID NO: 27339 - DNA, 25 bp, Homo sapien
acccgccggccatggaagagcctgg

SEQ ID NO: 27340 - DNA, 25 bp, Homo sapien
atgcgcgcagcatagaggacgcttg

SEQ ID NO: 27341 - DNA, 25 bp, Homo sapien
agtggtcagccgcagcggtctgctc

SEQ ID NO: 27342 - DNA, 25 bp, Homo sapien
tgttttcatcatttcccttgcctgg

SEQ ID NO: 27343 - DNA, 25 bp, Homo sapien
gcgcggaccgcgaagccaagtgtcc

SEQ ID NO: 27344 - DNA, 25 bp, Homo sapien
ttcaccgcagggctgatgcgcgcag

SEQ ID NO: 27345 - DNA, 25 bp, Homo sapien
tctgttgacttcaccgcagggctga

SEQ ID NO: 27346 - DNA, 25 bp, Homo sapien
cctcgcaaatctgttgacttcaccg

SEQ ID NO: 27347 - DNA, 25 bp, Homo sapien
cccaagcggggcttgctgtgttttc

SEQ ID NO: 27348 - DNA, 25 bp, Homo sapien
aggggtcaatatgcggtgtcactgc

SEQ ID NO: 27349 - DNA, 25 bp, Homo sapien
atgcggtgtcactgctttccctctc

SEQ ID NO: 27350 - DNA, 25 bp, Homo sapien
ccctccaaagcctaattggctgtga

SEQ ID NO: 27351 - DNA, 25 bp, Homo sapien
agcgcaaagcgctgtcacgactcgg

SEQ ID NO: 27352 - DNA, 25 bp, Homo sapien
actcggtggccgaggtgattaatta

SEQ ID NO: 27353 - DNA, 25 bp, Homo sapien
aaagcgctgtcacgactcggtggcc

SEQ ID NO: 27354 - DNA, 25 bp, Homo sapien
ctaattggctgtgacacgcgggcca

SEQ ID NO: 27355 - DNA, 25 bp, Homo sapien
cccgtgccagcaggggtcaatatgc

SEQ ID NO: 27356 - DNA, 25 bp, Homo sapien
ggggactctccctttcagcacaagc

SEQ ID NO: 27357 - DNA, 25 bp, Homo sapien
gcctggcaggggtgtaattcaaact

SEQ ID NO: 27358 - DNA, 25 bp, Homo sapien
ctcttgcatttctaaggggcctttg

SEQ ID NO: 27359 - DNA, 25 bp, Homo sapien
ttctcataaaactgccgtccgtgtg

SEQ ID NO: 27360 - DNA, 25 bp, Homo sapien
cgccgggctctttatctgcattttc

SEQ ID NO: 27361 - DNA, 25 bp, Homo sapien
cggcttgtttactcaggattgggca

SEQ ID NO: 27362 - DNA, 25 bp, Homo sapien
ttttaattaactctgcggcgcggcg

SEQ ID NO: 27363 - DNA, 25 bp, Homo sapien
ttgccaaggtaacgggtgattccca

SEQ ID NO: 27364 - DNA, 25 bp, Homo sapien
ggacaaagtcctcgacgcacactga

SEQ ID NO: 27365 - DNA, 25 bp, Homo sapien
acacgactgcgctgaagggaagttc

SEQ ID NO: 27366 - DNA, 25 bp, Homo sapien
ccaccttcccgtgaggggcaatgta

SEQ ID NO: 27367 - DNA, 25 bp, Homo sapien
aggacagccattgcgcgcacttctg

SEQ ID NO: 27368 - DNA, 25 bp, Homo sapien
ccaagctcgagggattccaaggcta

SEQ ID NO: 27369 - DNA, 25 bp, Homo sapien
gctgcggggtcaatacagtctcacc

SEQ ID NO: 27370 - DNA, 25 bp, Homo sapien
gcagagccatttccgagcccaaact

SEQ ID NO: 27371 - DNA, 25 bp, Homo sapien
gctgtgcgcttagctccgaatggca

SEQ ID NO: 27372 - DNA, 25 bp, Homo sapien
cgagatagatcccaattttacaatt

SEQ ID NO: 27373 - DNA, 25 bp, Homo sapien
ttaggagaagcagcgagatagatcc

SEQ ID NO: 27374 - DNA, 25 bp, Homo sapien
gccgagcggaggacacagagtaaaa

SEQ ID NO: 27375 - DNA, 25 bp, Homo sapien
agcagcgagatagatcccaatttta

SEQ ID NO: 27376 - DNA, 25 bp, Homo sapien
gacacagagtaaaaagcgacgcccg

SEQ ID NO: 27377 - DNA, 25 bp, Homo sapien
gcgacgcccgctgtatacataaatc

SEQ ID NO: 27378 - DNA, 25 bp, Homo sapien
cgcccgctgtatacataaatccgca

SEQ ID NO: 27379 - DNA, 25 bp, Homo sapien
tgtatacataaatccgcacccgctg

SEQ ID NO: 27380 - DNA, 25 bp, Homo sapien
gcgaactgctctggctgatctgatt

SEQ ID NO: 27381 - DNA, 25 bp, Homo sapien
gcagccaccgcactcctgggaaaga

SEQ ID NO: 27382 - DNA, 25 bp, Homo sapien
acacgttatgtacttaggcctccgc

SEQ ID NO: 27383 - DNA, 25 bp, Homo sapien
tctgcagaagcaaaagagtcgcctc

SEQ ID NO: 27384 - DNA, 25 bp, Homo sapien
gcccggctcactcttggatgcattt

SEQ ID NO: 27385 - DNA, 25 bp, Homo sapien
cacgggcagccttacttacctggta

SEQ ID NO: 27386 - DNA, 25 bp, Homo sapien
acttacctggtaggcgagctctctc

SEQ ID NO: 27387 - DNA, 25 bp, Homo sapien
atctttaggccgtccagcatgttcg

SEQ ID NO: 27388 - DNA, 25 bp, Homo sapien
gagagtctgcccaatgagttccgcc

SEQ ID NO: 27389 - DNA, 25 bp, Homo sapien
agcgactgcacttcccaagcgcgga

SEQ ID NO: 27390 - DNA, 25 bp, Homo sapien
agccatcggggatataccatctctc

SEQ ID NO: 27391 - DNA, 25 bp, Homo sapien
ctcctcgtcgatctggaaggctttc

SEQ ID NO: 27392 - DNA, 25 bp, Homo sapien
tctgaaggaactggggtttgtgtcc

SEQ ID NO: 27393 - DNA, 25 bp, Homo sapien
agcccagagcttcaacggttgctgt

SEQ ID NO: 27394 - DNA, 25 bp, Homo sapien
gcccagagcagcagtcaaagtccct

SEQ ID NO: 27395 - DNA, 25 bp, Homo sapien
caaagtccctgcgtgagcgactgca

SEQ ID NO: 27396 - DNA, 25 bp, Homo sapien
gctccagctgttcgaaggtgatcca

SEQ ID NO: 27397 - DNA, 25 bp, Homo sapien
ccgtatctgcaggtctcacccaaga

SEQ ID NO: 27398 - DNA, 25 bp, Homo sapien
ggtgttcacatcaaaggtctgggtc

SEQ ID NO: 27399 - DNA, 25 bp, Homo sapien
tcggcgccagctctcggcaaaacta

SEQ ID NO: 27400 - DNA, 25 bp, Homo sapien
tcacttcgggagtgtagcaacctgg

SEQ ID NO: 27401 - DNA, 25 bp, Homo sapien
cgcgcctcagggacacatcgattga

SEQ ID NO: 27402 - DNA, 25 bp, Homo sapien
actgttctgcaaacccaatccggga

SEQ ID NO: 27403 - DNA, 25 bp, Homo sapien
ccagtggccctgagttggcaactta

SEQ ID NO: 27404 - DNA, 25 bp, Homo sapien
agaaacatgagtggcggacgcagct

SEQ ID NO: 27405 - DNA, 25 bp, Homo sapien
gccaggcctgctcggagaaacatga

SEQ ID NO: 27406 - DNA, 25 bp, Homo sapien
cacgacgaaggtgccagtgctcatg

SEQ ID NO: 27407 - DNA, 25 bp, Homo sapien
cgcggtaattgagcggctgcgacac

SEQ ID NO: 27408 - DNA, 25 bp, Homo sapien
ctcgaaagctttctcggtaccggag

SEQ ID NO: 27409 - DNA, 25 bp, Homo sapien
ttaccggttgctggctcgaaagctt

SEQ ID NO: 27410 - DNA, 25 bp, Homo sapien
cccggctcgttgcagttaccggttg

SEQ ID NO: 27411 - DNA, 25 bp, Homo sapien
ctggccgggaaatccgcgcatccgg

SEQ ID NO: 27412 - DNA, 25 bp, Homo sapien
cgccaccttagcgtctccggaggaa

SEQ ID NO: 27413 - DNA, 25 bp, Homo sapien
caccgcagacagctccgcaatatgg

SEQ ID NO: 27414 - DNA, 25 bp, Homo sapien
cccagggaaatagggcgaatgcgcc

SEQ ID NO: 27415 - DNA, 25 bp, Homo sapien
gagcgctgggctccagctaaacctg

SEQ ID NO: 27416 - DNA, 25 bp, Homo sapien
ccgacaccggcgctgaaggcagact

SEQ ID NO: 27417 - DNA, 25 bp, Homo sapien
acgcacgctctctagtaatttaaca

SEQ ID NO: 27418 - DNA, 25 bp, Homo sapien
tttcaaacaacccttgggaccatgc

SEQ ID NO: 27419 - DNA, 25 bp, Homo sapien
acctacgctgaatatctggattttc

SEQ ID NO: 27420 - DNA, 25 bp, Homo sapien
gggaaagcgctctacagccaggaaa

SEQ ID NO: 27421 - DNA, 25 bp, Homo sapien
tttgcccggtagattttactgactg

SEQ ID NO: 27422 - DNA, 25 bp, Homo sapien
ctcccggggactgatcaaacgtctg

SEQ ID NO: 27423 - DNA, 25 bp, Homo sapien
gcatagcaccggaaaggctcgtatc

SEQ ID NO: 27424 - DNA, 25 bp, Homo sapien
gagcagagccgtgcacacagagata

SEQ ID NO: 27425 - DNA, 25 bp, Homo sapien
tgtccgcgaacatagtgctcatctc

SEQ ID NO: 27426 - DNA, 25 bp, Homo sapien
ctctgacagcccgaagatcgcactt

SEQ ID NO: 27427 - DNA, 25 bp, Homo sapien
cacgagagtctagaggaaaccaacc

SEQ ID NO: 27428 - DNA, 25 bp, Homo sapien
ttctactacctggacgagcaccgct

SEQ ID NO: 27429 - DNA, 25 bp, Homo sapien
gctgacggccgtgtttctcccgtga

SEQ ID NO: 27430 - DNA, 25 bp, Homo sapien
tgtttctcccgtgaggagtggccgt

SEQ ID NO: 27431 - DNA, 25 bp, Homo sapien
tctctcctgcgaggagtggctgtgc

SEQ ID NO: 27432 - DNA, 25 bp, Homo sapien
gctgacagccgtgtctctcccgtgt

SEQ ID NO: 27433 - DNA, 25 bp, Homo sapien
cgctggaggccctcacgcaagaacg

SEQ ID NO: 27434 - DNA, 25 bp, Homo sapien
gcctggtccgcttctactacctgga

SEQ ID NO: 27435 - DNA, 25 bp, Homo sapien
tctctcccgtgtccagtggagcggt

SEQ ID NO: 27436 - DNA, 25 bp, Homo sapien
atgtaaaccggaccagccgctgcgg

SEQ ID NO: 27437 - DNA, 25 bp, Homo sapien
aggtcgggctcacacctttcgcaga

SEQ ID NO: 27438 - DNA, 25 bp, Homo sapien
tcacacctttcgcagagacctcggg

SEQ ID NO: 27439 - DNA, 25 bp, Homo sapien
gcccggattggagcagcagcatcac

SEQ ID NO: 27440 - DNA, 25 bp, Homo sapien
attgttttgcaactccagtgtcggg

SEQ ID NO: 27441 - DNA, 25 bp, Homo sapien
aggaaggctcttggctccttcggga

SEQ ID NO: 27442 - DNA, 25 bp, Homo sapien
tgacctctgcctgggatgtaaaccg

SEQ ID NO: 27443 - DNA, 25 bp, Homo sapien
gagcccttccttataggcgtcagcg

SEQ ID NO: 27444 - DNA, 25 bp, Homo sapien
cagacatgtggaaacgtcacgcgca

SEQ ID NO: 27445 - DNA, 25 bp, Homo sapien
gatgtgccgaccatgcagagccgct

SEQ ID NO: 27446 - DNA, 25 bp, Homo sapien
agagccgctgttccagcctgggact

SEQ ID NO: 27447 - DNA, 25 bp, Homo sapien
gcgcatgcgaccaagtagcacaatg

SEQ ID NO: 27448 - DNA, 25 bp, Homo sapien
aagcattttcgggaccatgaggtcc

SEQ ID NO: 27449 - DNA, 25 bp, Homo sapien
tccttggaggagatttgagcgagca

SEQ ID NO: 27450 - DNA, 25 bp, Homo sapien
cgagcaagggccagcacgagctctc

SEQ ID NO: 27451 - DNA, 25 bp, Homo sapien
gctcaggccaccgagcagacatgtg

SEQ ID NO: 27452 - DNA, 25 bp, Homo sapien
caggtgatgctttggatacagccca

SEQ ID NO: 27453 - DNA, 25 bp, Homo sapien
tacaccacgatgttctcgcgccgga

SEQ ID NO: 27454 - DNA, 25 bp, Homo sapien
gccctgtcactgaaacaaaagcgta

SEQ ID NO: 27455 - DNA, 25 bp, Homo sapien
ggcgagtcgcttacatgcccaggtc

SEQ ID NO: 27456 - DNA, 25 bp, Homo sapien
ccaggtcgctgtaggtgttgaagaa

SEQ ID NO: 27457 - DNA, 25 bp, Homo sapien
gaactccatctgattgcacgcctga

SEQ ID NO: 27458 - DNA, 25 bp, Homo sapien
gatggtggcgcacacatcgtacacc

SEQ ID NO: 27459 - DNA, 25 bp, Homo sapien
ttctcctcgcgtttctgggaagtca

SEQ ID NO: 27460 - DNA, 25 bp, Homo sapien
cggttaaaatcaatctgggctcttc

SEQ ID NO: 27461 - DNA, 25 bp, Homo sapien
gccgcgttcgcctatcttttttgga

SEQ ID NO: 27462 - DNA, 25 bp, Homo sapien
atctgaagcctagacccatccatgc

SEQ ID NO: 27463 - DNA, 25 bp, Homo sapien
acccgctggtgactgcaaatgagca

SEQ ID NO: 27464 - DNA, 25 bp, Homo sapien
gcccacgctacgctcggttaaaatc

SEQ ID NO: 27465 - DNA, 25 bp, Homo sapien
cacatggaactgtgcgcccacgcta

SEQ ID NO: 27466 - DNA, 25 bp, Homo sapien
gaacgcctggagagctcgtccaagc

SEQ ID NO: 27467 - DNA, 25 bp, Homo sapien
tcgtccaagcaagtgcaacccgctg

SEQ ID NO: 27468 - DNA, 25 bp, Homo sapien
gggcagctcttactgtttcacgttg

SEQ ID NO: 27469 - DNA, 25 bp, Homo sapien
cgcctcggctgcaacgttgctgaca

SEQ ID NO: 27470 - DNA, 25 bp, Homo sapien
cccaatctctcagaagtcgtttgtt

SEQ ID NO: 27471 - DNA, 25 bp, Homo sapien
ccagggcagacagtcccgagcaacg

SEQ ID NO: 27472 - DNA, 25 bp, Homo sapien
gtcgccattgctccgcgtgtctcag

SEQ ID NO: 27473 - DNA, 25 bp, Homo sapien
agctcgctcacaaaggtcgccattg

SEQ ID NO: 27474 - DNA, 25 bp, Homo sapien
cagggcctcgcttaagttcttcttg

SEQ ID NO: 27475 - DNA, 25 bp, Homo sapien
gagtcacgtgatccgcttcaccttg

SEQ ID NO: 27476 - DNA, 25 bp, Homo sapien
agcaccgcttgccttcgctagagga

SEQ ID NO: 27477 - DNA, 25 bp, Homo sapien
tcggtcttggcctcgttgacttatg

SEQ ID NO: 27478 - DNA, 25 bp, Homo sapien
cgagcgaaatgtctctgcagcagca

SEQ ID NO: 27479 - DNA, 25 bp, Homo sapien
cggcacggtgctgctcttagcacta

SEQ ID NO: 27480 - DNA, 25 bp, Homo sapien
tgtggtcacccaactctaggcgctc

SEQ ID NO: 27481 - DNA, 25 bp, Homo sapien
aggaaggactctccctgtggtcacc

SEQ ID NO: 27482 - DNA, 25 bp, Homo sapien
gtgcgtcctaggttctctcaggttc

SEQ ID NO: 27483 - DNA, 25 bp, Homo sapien
ttatgttgactctcaagggccgcca

SEQ ID NO: 27484 - DNA, 25 bp, Homo sapien
tccaaggagtcgtcctggtagaagc

SEQ ID NO: 27485 - DNA, 25 bp, Homo sapien
ctgcccaggtacgagtggtcgtatt

SEQ ID NO: 27486 - DNA, 25 bp, Homo sapien
cagtctcacggttttcttggcgggc

SEQ ID NO: 27487 - DNA, 25 bp, Homo sapien
agttcttccgcgacagcatctccga

SEQ ID NO: 27488 - DNA, 25 bp, Homo sapien
gctgaccgtagtactcctccaagga

SEQ ID NO: 27489 - DNA, 25 bp, Homo sapien
gcatctccgacttggagcgcggctg

SEQ ID NO: 27490 - DNA, 25 bp, Homo sapien
tcttcttctccgagttgctgtggta

SEQ ID NO: 27491 - DNA, 25 bp, Homo sapien
aaggccgccagctcgtccatggaaa

SEQ ID NO: 27492 - DNA, 25 bp, Homo sapien
tgcgcgctaattgaaggccgagttt

SEQ ID NO: 27493 - DNA, 25 bp, Homo sapien
gcgggtccacccgactacaatgcag

SEQ ID NO: 27494 - DNA, 25 bp, Homo sapien
cgactacaatgcagcgcgcggctga

SEQ ID NO: 27495 - DNA, 25 bp, Homo sapien
ttctcttaacacagggcagtgaacg

SEQ ID NO: 27496 - DNA, 25 bp, Homo sapien
gaaggggaaatagcgcctgcaagac

SEQ ID NO: 27497 - DNA, 25 bp, Homo sapien
ctgcaagaccgcatttgttctctta

SEQ ID NO: 27498 - DNA, 25 bp, Homo sapien
ctcccacagtgatgagcaacaagtg

SEQ ID NO: 27499 - DNA, 25 bp, Homo sapien
ggccgagtttcctcccacagtgatg

SEQ ID NO: 27500 - DNA, 25 bp, Homo sapien
tcacgggaatcttgttgggacagca

SEQ ID NO: 27501 - DNA, 25 bp, Homo sapien
gggaacatgtcctggatggctttca

SEQ ID NO: 27502 - DNA, 25 bp, Homo sapien
catcgaggcagaggctctatggctc

SEQ ID NO: 27503 - DNA, 25 bp, Homo sapien
gatggcggcatccttgttccctcgc

SEQ ID NO: 27504 - DNA, 25 bp, Homo sapien
tttcaggtcctcctcgctacagcgg

SEQ ID NO: 27505 - DNA, 25 bp, Homo sapien
acacgggtgctctttcacgggaatc

SEQ ID NO: 27506 - DNA, 25 bp, Homo sapien
gctgagacctcccagcacgagatgg

SEQ ID NO: 27507 - DNA, 25 bp, Homo sapien
ggagcggatcacctcctggtccatg

SEQ ID NO: 27508 - DNA, 25 bp, Homo sapien
gcccaaaggtcagcgtggagtgatt

SEQ ID NO: 27509 - DNA, 25 bp, Homo sapien
gccacagccaacctgaacggggaga

SEQ ID NO: 27510 - DNA, 25 bp, Homo sapien
ggggagcgaccatcgcggcttctcc

SEQ ID NO: 27511 - DNA, 25 bp, Homo sapien
cagccaacctgaacggggagagagt

SEQ ID NO: 27512 - DNA, 25 bp, Homo sapien
cgcgactgccaaagtttctcggtca

SEQ ID NO: 27513 - DNA, 25 bp, Homo sapien
gctgccgcgactgccaaagtttctc

SEQ ID NO: 27514 - DNA, 25 bp, Homo sapien
gctcggcggcgcatccgcatgccca

SEQ ID NO: 27515 - DNA, 25 bp, Homo sapien
actcgagcaggggagcctgtgtctg

SEQ ID NO: 27516 - DNA, 25 bp, Homo sapien
ggccagccggaatgcttactatttc

SEQ ID NO: 27517 - DNA, 25 bp, Homo sapien
gcttactatttcttcgtgcaggaga

SEQ ID NO: 27518 - DNA, 25 bp, Homo sapien
ccaggaagtttgaccgcgctgccat

SEQ ID NO: 27519 - DNA, 25 bp, Homo sapien
tgctttgttctgtctgaggccagga

SEQ ID NO: 27520 - DNA, 25 bp, Homo sapien
cgcaggcgcctacctctgttactta

SEQ ID NO: 27521 - DNA, 25 bp, Homo sapien
tcttccagtctcaggctgtttgttc

SEQ ID NO: 27522 - DNA, 25 bp, Homo sapien
cggcacgagccggaatcttccagtc

SEQ ID NO: 27523 - DNA, 25 bp, Homo sapien
atcagagcacttggcacctgcgacg

SEQ ID NO: 27524 - DNA, 25 bp, Homo sapien
tgcgctacctcatggccggcatcag

SEQ ID NO: 27525 - DNA, 25 bp, Homo sapien
ctccatcgactccatccaggaggtg

SEQ ID NO: 27526 - DNA, 25 bp, Homo sapien
ggaggtcttccagcgctaccctgac

SEQ ID NO: 27527 - DNA, 25 bp, Homo sapien
agcgctaccctgacggcagcttcga

SEQ ID NO: 27528 - DNA, 25 bp, Homo sapien
tgctgcttcagcatctaccacggca

SEQ ID NO: 27529 - DNA, 25 bp, Homo sapien
agtcgctggacctggtctccaccag

SEQ ID NO: 27530 - DNA, 25 bp, Homo sapien
gggtcactggcctgcgctacctcat

SEQ ID NO: 27531 - DNA, 25 bp, Homo sapien
catcagcgacgaggacagcctggct

SEQ ID NO: 27532 - DNA, 25 bp, Homo sapien
agcgggtacgctcgcaatagctcca

SEQ ID NO: 27533 - DNA, 25 bp, Homo sapien
atagctccaggcgtgtggacacggc

SEQ ID NO: 27534 - DNA, 25 bp, Homo sapien
cccagaatgtggaacgcatcccaga

SEQ ID NO: 27535 - DNA, 25 bp, Homo sapien
atcccagaagcgatagccagccttg

SEQ ID NO: 27536 - DNA, 25 bp, Homo sapien
gcgagggctcagcaggaagtttcct

SEQ ID NO: 27537 - DNA, 25 bp, Homo sapien
ttccctgcagcatacccaaggcggg

SEQ ID NO: 27538 - DNA, 25 bp, Homo sapien
cgtttgaccaacgtgggattgaatg

SEQ ID NO: 27539 - DNA, 25 bp, Homo sapien
cgtaaggagtgtgtcccacctcgct

SEQ ID NO: 27540 - DNA, 25 bp, Homo sapien
tttacatattcatagctgctgggcc

SEQ ID NO: 27541 - DNA, 25 bp, Homo sapien
aatctggttctgagctagagggagc

SEQ ID NO: 27542 - DNA, 25 bp, Homo sapien
tgcgcagagccgagacgaaaaatga

SEQ ID NO: 27543 - DNA, 25 bp, Homo sapien
gattgagggcgctgctttagctacc

SEQ ID NO: 27544 - DNA, 25 bp, Homo sapien
tttagctaccgaagggccacagcgc

SEQ ID NO: 27545 - DNA, 25 bp, Homo sapien
cccgcgacttagcataatttattag

SEQ ID NO: 27546 - DNA, 25 bp, Homo sapien
tcaagatgagagttcagccgcggcg

SEQ ID NO: 27547 - DNA, 25 bp, Homo sapien
cgcccgggatactatataatctggt

SEQ ID NO: 27548 - DNA, 25 bp, Homo sapien
caggacccgctggagtttattcttc

SEQ ID NO: 27549 - DNA, 25 bp, Homo sapien
cgcgtgcgcagaggtataaggttct

SEQ ID NO: 27550 - DNA, 25 bp, Homo sapien
gtgcattcatcacgctggcccagga

SEQ ID NO: 27551 - DNA, 25 bp, Homo sapien
ttctgagcccagttgtcctttttcc

SEQ ID NO: 27552 - DNA, 25 bp, Homo sapien
tccgctccttggcaactaacaatgc

SEQ ID NO: 27553 - DNA, 25 bp, Homo sapien
cgctcctgctgaactgcaacacaga

SEQ ID NO: 27554 - DNA, 25 bp, Homo sapien
tacgttatagagctggttctggccc

SEQ ID NO: 27555 - DNA, 25 bp, Homo sapien
cggcgaggctgacttacgttataga

SEQ ID NO: 27556 - DNA, 25 bp, Homo sapien
gaaacccgtgcatccatcggctagc

SEQ ID NO: 27557 - DNA, 25 bp, Homo sapien
ccgagggtctggtttttagatatca

SEQ ID NO: 27558 - DNA, 25 bp, Homo sapien
ttatcgcgcgtgatctcccatctga

SEQ ID NO: 27559 - DNA, 25 bp, Homo sapien
cagctggctcctcgctcgaggtttc

SEQ ID NO: 27560 - DNA, 25 bp, Homo sapien
tttaaagagacgagcttcagcctgc

SEQ ID NO: 27561 - DNA, 25 bp, Homo sapien
ccgatacgctataggtgaatatttc

SEQ ID NO: 27562 - DNA, 25 bp, Homo sapien
gctgcccactgcaccgagtttttcg

SEQ ID NO: 27563 - DNA, 25 bp, Homo sapien
ttagatatcaaaggagcccgacacc

SEQ ID NO: 27564 - DNA, 25 bp, Homo sapien
cccagtcggagacgtgcgtcacgaa

SEQ ID NO: 27565 - DNA, 25 bp, Homo sapien
acgagcagcgccaacagcgtcgacg

SEQ ID NO: 27566 - DNA, 25 bp, Homo sapien
acgtgcgtcacgaagcgggccacgc

SEQ ID NO: 27567 - DNA, 25 bp, Homo sapien
cctgcgcggcagagaagcaacagcc

SEQ ID NO: 27568 - DNA, 25 bp, Homo sapien
aagcaacagccgttcgagccacgct

SEQ ID NO: 27569 - DNA, 25 bp, Homo sapien
ctcacctgcaggttgctcacggaga

SEQ ID NO: 27570 - DNA, 25 bp, Homo sapien
ctcaggtagaaatagggcacgccgc

SEQ ID NO: 27571 - DNA, 25 bp, Homo sapien
caacagcgtcgacgccagcagggcg

SEQ ID NO: 27572 - DNA, 25 bp, Homo sapien
gcaaatgcctgctgttccgacgcct

SEQ ID NO: 27573 - DNA, 25 bp, Homo sapien
tgccaactagaagggcaaatgcctg

SEQ ID NO: 27574 - DNA, 25 bp, Homo sapien
ctccttgaccaactccgaaggatcg

SEQ ID NO: 27575 - DNA, 25 bp, Homo sapien
cgccgcagcccgaaactggccacgg

SEQ ID NO: 27576 - DNA, 25 bp, Homo sapien
ctgaaggacatggaggtaaaggacc

SEQ ID NO: 27577 - DNA, 25 bp, Homo sapien
cgcagagtcggcacctgaaggacat

SEQ ID NO: 27578 - DNA, 25 bp, Homo sapien
cggctcatcgctgctgccaactaga

SEQ ID NO: 27579 - DNA, 25 bp, Homo sapien
tggagcacgcggctcatcgctgctg

SEQ ID NO: 27580 - DNA, 25 bp, Homo sapien
gcgcccgccaacactgcgagtggaa

SEQ ID NO: 27581 - DNA, 25 bp, Homo sapien
cgcgtgcgaacgtggaggccacgcc

SEQ ID NO: 27582 - DNA, 25 bp, Homo sapien
gcgagcccgtaagccggaaggcggc

SEQ ID NO: 27583 - DNA, 25 bp, Homo sapien
cgccaacactgcgagtggaacagcc

SEQ ID NO: 27584 - DNA, 25 bp, Homo sapien
ccagctctgcgtgcactgacgggct

SEQ ID NO: 27585 - DNA, 25 bp, Homo sapien
ccgtcttcattcaccgacccactcg

SEQ ID NO: 27586 - DNA, 25 bp, Homo sapien
caacactgcgagtggaacagccggg

SEQ ID NO: 27587 - DNA, 25 bp, Homo sapien
ttcaccgacccactcgcggagcgag

SEQ ID NO: 27588 - DNA, 25 bp, Homo sapien
ccctgctcctccacgctgtggggca

SEQ ID NO: 27589 - DNA, 25 bp, Homo sapien
cgtggttgctcggaacacgaggtga

SEQ ID NO: 27590 - DNA, 25 bp, Homo sapien
cacgcagtataagggtcgcaggtcg

SEQ ID NO: 27591 - DNA, 25 bp, Homo sapien
tcagaggacacgcagtataagggtc

SEQ ID NO: 27592 - DNA, 25 bp, Homo sapien
gggaatcagaggacacgcagtataa

SEQ ID NO: 27593 - DNA, 25 bp, Homo sapien
acccgaggcttagggaatcagagga

SEQ ID NO: 27594 - DNA, 25 bp, Homo sapien
cggacccgaggcttagggaatcaga

SEQ ID NO: 27595 - DNA, 25 bp, Homo sapien
gcagtaagcgctccggacccgaggc

SEQ ID NO: 27596 - DNA, 25 bp, Homo sapien
gatccagcggcctgctgaggaaccg

SEQ ID NO: 27597 - DNA, 25 bp, Homo sapien
ccaatgtctttataggtcacccgga

SEQ ID NO: 27598 - DNA, 25 bp, Homo sapien
taggtcacccggaaggcacgcggaa

SEQ ID NO: 27599 - DNA, 25 bp, Homo sapien
cacgcggaacctcggcgcggtgctt

SEQ ID NO: 27600 - DNA, 25 bp, Homo sapien
cggtgcttccagcagggtctctccg

SEQ ID NO: 27601 - DNA, 25 bp, Homo sapien
ctttggagtctctcgcggcctcaaa

SEQ ID NO: 27602 - DNA, 25 bp, Homo sapien
cgcgctctgcttgccaatgtcttta

SEQ ID NO: 27603 - DNA, 25 bp, Homo sapien
ctcttctggggtgctctcgcggctc

SEQ ID NO: 27604 - DNA, 25 bp, Homo sapien
gagtttaaaccacgccataggcagc

SEQ ID NO: 27605 - DNA, 25 bp, Homo sapien
tgagctcccgatggccctgtacacg

SEQ ID NO: 27606 - DNA, 25 bp, Homo sapien
aagaactgagctcccgatggccctg

SEQ ID NO: 27607 - DNA, 25 bp, Homo sapien
ccacgccataggcagccaagaactg

SEQ ID NO: 27608 - DNA, 25 bp, Homo sapien
ggatgagtttaaaccacgccatagg

SEQ ID NO: 27609 - DNA, 25 bp, Homo sapien
cactgtcgtggatgagtttaaacca

SEQ ID NO: 27610 - DNA, 25 bp, Homo sapien
gggcactgtcgtggatgagtttaaa

SEQ ID NO: 27611 - DNA, 25 bp, Homo sapien
gcagccaagaactgagctcccgatg

SEQ ID NO: 27612 - DNA, 25 bp, Homo sapien
ctctccaatcgcgtccttaaaaggg

SEQ ID NO: 27613 - DNA, 25 bp, Homo sapien
tgactctggatcgtctaggccctcc

SEQ ID NO: 27614 - DNA, 25 bp, Homo sapien
ctctcctcgtggtgactctggatcg

SEQ ID NO: 27615 - DNA, 25 bp, Homo sapien
agtgctttaccttgctccttcccgg

SEQ ID NO: 27616 - DNA, 25 bp, Homo sapien
tctttcctggatcctggagtgcgga

SEQ ID NO: 27617 - DNA, 25 bp, Homo sapien
cgcttgggctctgtaagtgatgcca

SEQ ID NO: 27618 - DNA, 25 bp, Homo sapien
caagccgagccaacctcagcgggga

SEQ ID NO: 27619 - DNA, 25 bp, Homo sapien
acggatgatggacagcctgactctc

SEQ ID NO: 27620 - DNA, 25 bp, Homo sapien
tttggctatggttgtcctgacatca

SEQ ID NO: 27621 - DNA, 25 bp, Homo sapien
agcctctttcgttactcatccttga

SEQ ID NO: 27622 - DNA, 25 bp, Homo sapien
gactcccagttctacgtttcaaagc

SEQ ID NO: 27623 - DNA, 25 bp, Homo sapien
gtttccttttggaccatgactcagc

SEQ ID NO: 27624 - DNA, 25 bp, Homo sapien
tgactcagctttttggatcccttaa

SEQ ID NO: 27625 - DNA, 25 bp, Homo sapien
cgactgccctccaggtgatttttat

SEQ ID NO: 27626 - DNA, 25 bp, Homo sapien
gcccactaaagtctgagcagcattg

SEQ ID NO: 27627 - DNA, 25 bp, Homo sapien
cattggcctaggacacagctgttta

SEQ ID NO: 27628 - DNA, 25 bp, Homo sapien
cccttccatggggactttattgctg

SEQ ID NO: 27629 - DNA, 25 bp, Homo sapien
ggcaaagtcctcaatccttagggct

SEQ ID NO: 27630 - DNA, 25 bp, Homo sapien
ttagggctcaaggatttcaagcatc

SEQ ID NO: 27631 - DNA, 25 bp, Homo sapien
ctttattgctgccatgggattccca

SEQ ID NO: 27632 - DNA, 25 bp, Homo sapien
accttgggtttctgctgggatgccc

SEQ ID NO: 27633 - DNA, 25 bp, Homo sapien
ccagcccagagtgtgttgttgaccc

SEQ ID NO: 27634 - DNA, 25 bp, Homo sapien
actcccgtatgggtgatgttggctt

SEQ ID NO: 27635 - DNA, 25 bp, Homo sapien
cttccgtgtgggtagtgttaactgc

SEQ ID NO: 27636 - DNA, 25 bp, Homo sapien
tgccctcgaggccatgttggagaag

SEQ ID NO: 27637 - DNA, 25 bp, Homo sapien
ccgaatgcattcttccagggtgagg

SEQ ID NO: 27638 - DNA, 25 bp, Homo sapien
atctggttagagtggcccgaatgca

SEQ ID NO: 27639 - DNA, 25 bp, Homo sapien
cgtcttttatccctagcgacttaag

SEQ ID NO: 27640 - DNA, 25 bp, Homo sapien
cgtgagcgagagactacagaattga

SEQ ID NO: 27641 - DNA, 25 bp, Homo sapien
ttgggccttcagtgcctaaagatga

SEQ ID NO: 27642 - DNA, 25 bp, Homo sapien
ctttgattaagcaggcccgtagtta

SEQ ID NO: 27643 - DNA, 25 bp, Homo sapien
gcgctggttctactgccctttcact

SEQ ID NO: 27644 - DNA, 25 bp, Homo sapien
cactgttgtccaaagtgttctgata

SEQ ID NO: 27645 - DNA, 25 bp, Homo sapien
tgaatttacgcaccgagagcagagc

SEQ ID NO: 27646 - DNA, 25 bp, Homo sapien
gttacccattcgtgtttctctgtga

SEQ ID NO: 27647 - DNA, 25 bp, Homo sapien
caatgccattttctgttgttaccca

SEQ ID NO: 27648 - DNA, 25 bp, Homo sapien
gctgattcccactgttccaatgcca

SEQ ID NO: 27649 - DNA, 25 bp, Homo sapien
tcccaacgcttcctgtgcaaaattg

SEQ ID NO: 27650 - DNA, 25 bp, Homo sapien
tgttctgatactctacaatgtggtc

SEQ ID NO: 27651 - DNA, 25 bp, Homo sapien
ttgtcccaacttcagggagactaca

SEQ ID NO: 27652 - DNA, 25 bp, Homo sapien
cgccgagggctggtcgagttctccc

SEQ ID NO: 27653 - DNA, 25 bp, Homo sapien
gacagccctgacctccgagaggggc

SEQ ID NO: 27654 - DNA, 25 bp, Homo sapien
aatggggtgggcctctcagaagccc

SEQ ID NO: 27655 - DNA, 25 bp, Homo sapien
atccagcggactgtttaggggcttc

SEQ ID NO: 27656 - DNA, 25 bp, Homo sapien
gcatcggcagagtcccgggcacgca

SEQ ID NO: 27657 - DNA, 25 bp, Homo sapien
acaccctttgccctgagcgggacgt

SEQ ID NO: 27658 - DNA, 25 bp, Homo sapien
tcctcacggattccagccgaggggc

SEQ ID NO: 27659 - DNA, 25 bp, Homo sapien
atctccctcccgcagatctgagggg

SEQ ID NO: 27660 - DNA, 25 bp, Homo sapien
gacactttcagattcttcccgcagg

SEQ ID NO: 27661 - DNA, 25 bp, Homo sapien
ctttcattcatccagccgacgggca

SEQ ID NO: 27662 - DNA, 25 bp, Homo sapien
gcctttgctgctcacctttcattca

SEQ ID NO: 27663 - DNA, 25 bp, Homo sapien
gtcccgccgtggacgatcctggtat

SEQ ID NO: 27664 - DNA, 25 bp, Homo sapien
tgggacgtcgccttttccatgtctc

SEQ ID NO: 27665 - DNA, 25 bp, Homo sapien
tgtggtgcctaactcaggccttccc

SEQ ID NO: 27666 - DNA, 25 bp, Homo sapien
ctcctgaaaacctttgtggtgccta

SEQ ID NO: 27667 - DNA, 25 bp, Homo sapien
acgatcctggtatcgcctttgctgc

SEQ ID NO: 27668 - DNA, 25 bp, Homo sapien
aggcgctgctttcgtcaactgtcaa

SEQ ID NO: 27669 - DNA, 25 bp, Homo sapien
gtgggtcacgcaacaagagcaacta

SEQ ID NO: 27670 - DNA, 25 bp, Homo sapien
agcttattccttgtggcctctgcgg

SEQ ID NO: 27671 - DNA, 25 bp, Homo sapien
gccatgatgatccacggcttccaga

SEQ ID NO: 27672 - DNA, 25 bp, Homo sapien
gacggcgtccaagacccacatcatg

SEQ ID NO: 27673 - DNA, 25 bp, Homo sapien
ctccggaccggacctttgattgaca

SEQ ID NO: 27674 - DNA, 25 bp, Homo sapien
ggtgcgttcctaaccacaccttctg

SEQ ID NO: 27675 - DNA, 25 bp, Homo sapien
cgagatgacgtcacccaacgagttc

SEQ ID NO: 27676 - DNA, 25 bp, Homo sapien
agccgtcaacttagcgagcgcaaca

SEQ ID NO: 27677 - DNA, 25 bp, Homo sapien
tgctcggcattcgttgactggatca

SEQ ID NO: 27678 - DNA, 25 bp, Homo sapien
cccgttccggtttgaaactgctctg

SEQ ID NO: 27679 - DNA, 25 bp, Homo sapien
tccgcgaagaggtctggcactacac

SEQ ID NO: 27680 - DNA, 25 bp, Homo sapien
aactgctctggacgccgaattagtg

SEQ ID NO: 27681 - DNA, 25 bp, Homo sapien
gtctttgtgtctccggagccttgca

SEQ ID NO: 27682 - DNA, 25 bp, Homo sapien
ccgaattagtgtttggcagcgcctg

SEQ ID NO: 27683 - DNA, 25 bp, Homo sapien
actgggccgcaatggacaagctgaa

SEQ ID NO: 27684 - DNA, 25 bp, Homo sapien
tgatgtcctccaccggcttccggag

SEQ ID NO: 27685 - DNA, 25 bp, Homo sapien
aggaagtagcgcttgatggacctgc

SEQ ID NO: 27686 - DNA, 25 bp, Homo sapien
tcgccctggtccatgaggaagtagc

SEQ ID NO: 27687 - DNA, 25 bp, Homo sapien
ctcctccgcgaggtccatgaagtgc

SEQ ID NO: 27688 - DNA, 25 bp, Homo sapien
actgcaggaaaacccgagacccgcg

SEQ ID NO: 27689 - DNA, 25 bp, Homo sapien
cccaccttgaggtcgtccttgaagg

SEQ ID NO: 27690 - DNA, 25 bp, Homo sapien
cccggtagccaagtgaaggaaacag

SEQ ID NO: 27691 - DNA, 25 bp, Homo sapien
agtgcacgaagaagtcgccctggtc

SEQ ID NO: 27692 - DNA, 25 bp, Homo sapien
gtcgctcgaggagagactaaggctc

SEQ ID NO: 27693 - DNA, 25 bp, Homo sapien
acatcgccggccctgactttggggc

SEQ ID NO: 27694 - DNA, 25 bp, Homo sapien
ctacacgatcatgtccgcgggctgc

SEQ ID NO: 27695 - DNA, 25 bp, Homo sapien
cgagccgagacactcctgtcaggga

SEQ ID NO: 27696 - DNA, 25 bp, Homo sapien
gctcagcgtcctcaccttcttggtg

SEQ ID NO: 27697 - DNA, 25 bp, Homo sapien
gagcctcgagcgtcaaattcccgcg

SEQ ID NO: 27698 - DNA, 25 bp, Homo sapien
tgttctgggactctcattaggggcc

SEQ ID NO: 27699 - DNA, 25 bp, Homo sapien
tatatgttagcacaccggccaccgg

SEQ ID NO: 27700 - DNA, 25 bp, Homo sapien
cgccatcgccatggcccgcgggaaa

SEQ ID NO: 27701 - DNA, 25 bp, Homo sapien
tagggcgggcgcagccaattcctcg

SEQ ID NO: 27702 - DNA, 25 bp, Homo sapien
ccaggaggggtggacccacagccca

SEQ ID NO: 27703 - DNA, 25 bp, Homo sapien
gagcgctcggcggaccaaagaaagc

SEQ ID NO: 27704 - DNA, 25 bp, Homo sapien
ggaccaaagaaagcccgcgagcggc

SEQ ID NO: 27705 - DNA, 25 bp, Homo sapien
ggctgcgcgcccaccaataggtgcg

SEQ ID NO: 27706 - DNA, 25 bp, Homo sapien
cccaccaataggtgcggggctcgga

SEQ ID NO: 27707 - DNA, 25 bp, Homo sapien
aattcctcggctcctggcgggagtg

SEQ ID NO: 27708 - DNA, 25 bp, Homo sapien
acccatcccggtgcttgcgaagggc

SEQ ID NO: 27709 - DNA, 25 bp, Homo sapien
acgttatagagactcgcgaagtgcc

SEQ ID NO: 27710 - DNA, 25 bp, Homo sapien
gggacgactaaggaatccacgcatc

SEQ ID NO: 27711 - DNA, 25 bp, Homo sapien
gctgaggtttctaaggggacgacta

SEQ ID NO: 27712 - DNA, 25 bp, Homo sapien
ctgcgcaggcgcatgcaatatcctc

SEQ ID NO: 27713 - DNA, 25 bp, Homo sapien
actacgagagcgacaaaaatctgcg

SEQ ID NO: 27714 - DNA, 25 bp, Homo sapien
catccgggcctctctaactacgaga

SEQ ID NO: 27715 - DNA, 25 bp, Homo sapien
catggcaacagcgtgcctctgcgtc

SEQ ID NO: 27716 - DNA, 25 bp, Homo sapien
ctccgctggaagaaacgcgctgttc

SEQ ID NO: 27717 - DNA, 25 bp, Homo sapien
tccgctcatctgttgggaatgcgtc

SEQ ID NO: 27718 - DNA, 25 bp, Homo sapien
actccactccaaaagcggcggcttg

SEQ ID NO: 27719 - DNA, 25 bp, Homo sapien
gctcttccattggtcgtgggtcaca

SEQ ID NO: 27720 - DNA, 25 bp, Homo sapien
acgccgggaatacttgcctgctctt

SEQ ID NO: 27721 - DNA, 25 bp, Homo sapien
gtcgctgcctgatcgcccagtttaa

SEQ ID NO: 27722 - DNA, 25 bp, Homo sapien
cgcgagtgacgccttctccctgtaa

SEQ ID NO: 27723 - DNA, 25 bp, Homo sapien
cgcggtcggcaagaaccagcattcg

SEQ ID NO: 27724 - DNA, 25 bp, Homo sapien
ccctggaagaattaagtagctggcc

SEQ ID NO: 27725 - DNA, 25 bp, Homo sapien
cctgggatcgcgcttctgaaaaagc

SEQ ID NO: 27726 - DNA, 25 bp, Homo sapien
tagctggccagaggagctatgccgc

SEQ ID NO: 27727 - DNA, 25 bp, Homo sapien
ctcctgtttgacgaaagtatgtctc

SEQ ID NO: 27728 - DNA, 25 bp, Homo sapien
ccgccctcctctctatggttttgga

SEQ ID NO: 27729 - DNA, 25 bp, Homo sapien
gtcgagtcctccaggggctagagaa

SEQ ID NO: 27730 - DNA, 25 bp, Homo sapien
tccggacctaaatcgcgcaccagtg

SEQ ID NO: 27731 - DNA, 25 bp, Homo sapien
gtctggtttgaagctctcctgtttg

SEQ ID NO: 27732 - DNA, 25 bp, Homo sapien
agaagagccctgtgcgagtgcggcc

SEQ ID NO: 27733 - DNA, 25 bp, Homo sapien
agcccccgaggtaaggcgccagctg

SEQ ID NO: 27734 - DNA, 25 bp, Homo sapien
gtcctgggtacacgggacacaggct

SEQ ID NO: 27735 - DNA, 25 bp, Homo sapien
agctggtcctgggtacacgggacac

SEQ ID NO: 27736 - DNA, 25 bp, Homo sapien
ttagccagcggatcctgcggcgcac

SEQ ID NO: 27737 - DNA, 25 bp, Homo sapien
gggatggccgccacatgcatgaagt

SEQ ID NO: 27738 - DNA, 25 bp, Homo sapien
ggccgccacatgcatgaagtgtgtg

SEQ ID NO: 27739 - DNA, 25 bp, Homo sapien
gatcctgcgccggcgtgaacaccgg

SEQ ID NO: 27740 - DNA, 25 bp, Homo sapien
agtgacccgcccagccgagcaccct

SEQ ID NO: 27741 - DNA, 25 bp, Homo sapien
cggggtcactgaagggccgaggcgc

SEQ ID NO: 27742 - DNA, 25 bp, Homo sapien
aggcgccgctctcgcttcgctggcc

SEQ ID NO: 27743 - DNA, 25 bp, Homo sapien
ttccacacctccctgcgaggaccga

SEQ ID NO: 27744 - DNA, 25 bp, Homo sapien
acctccctgcgaggaccgactccgc

SEQ ID NO: 27745 - DNA, 25 bp, Homo sapien
gccgagcaccctcgccctgcttgcc

SEQ ID NO: 27746 - DNA, 25 bp, Homo sapien
cccgcgaagcgcagattacagggcg

SEQ ID NO: 27747 - DNA, 25 bp, Homo sapien
gccgcccgcgaagcgcagattacag

SEQ ID NO: 27748 - DNA, 25 bp, Homo sapien
gcgcttgctctgcacctcttgtatg

SEQ ID NO: 27749 - DNA, 25 bp, Homo sapien
tccgtgtataaggagtggctccgta

SEQ ID NO: 27750 - DNA, 25 bp, Homo sapien
gtgcagttttgagcgtccgtgtata

SEQ ID NO: 27751 - DNA, 25 bp, Homo sapien
ctcttgtatgcgcaggctcagtctg

SEQ ID NO: 27752 - DNA, 25 bp, Homo sapien
ggacggtggccaaagtaccctcaca

SEQ ID NO: 27753 - DNA, 25 bp, Homo sapien
gttaccacggtgaagcctccagctc

SEQ ID NO: 27754 - DNA, 25 bp, Homo sapien
cctcagagtttgacgcaccggggag

SEQ ID NO: 27755 - DNA, 25 bp, Homo sapien
cacccagaggcgatgacagtcctga

SEQ ID NO: 27756 - DNA, 25 bp, Homo sapien
ggatggaaacctctctgcgctatta

SEQ ID NO: 27757 - DNA, 25 bp, Homo sapien
ctgcgctattagactgcgtccagta

SEQ ID NO: 27758 - DNA, 25 bp, Homo sapien
tgcgtccagtacagcagatggcacg

SEQ ID NO: 27759 - DNA, 25 bp, Homo sapien
tcggaggcagctgagttggaaatcc

SEQ ID NO: 27760 - DNA, 25 bp, Homo sapien
cctggctcagaagcgcacagatgtt

SEQ ID NO: 27761 - DNA, 25 bp, Homo sapien
ttactgcttagagccggtaccgctg

SEQ ID NO: 27762 - DNA, 25 bp, Homo sapien
atcgaactggatgccggatggaaac

SEQ ID NO: 27763 - DNA, 25 bp, Homo sapien
gaaaaacggcccacatcgaactgga

SEQ ID NO: 27764 - DNA, 25 bp, Homo sapien
tcagtcacctgctagacctggagga

SEQ ID NO: 27765 - DNA, 25 bp, Homo sapien
agagccagcgctgtttgggaaagca

SEQ ID NO: 27766 - DNA, 25 bp, Homo sapien
cggcggactctctttacttcggcta

SEQ ID NO: 27767 - DNA, 25 bp, Homo sapien
tccgcggccagaaagacaaggtcct

SEQ ID NO: 27768 - DNA, 25 bp, Homo sapien
ccctgcaggcgaaaaagaacttctc

SEQ ID NO: 27769 - DNA, 25 bp, Homo sapien
atgacctccagctacgggcacgttc

SEQ ID NO: 27770 - DNA, 25 bp, Homo sapien
cgcccacagcgtttggtgttgattc

SEQ ID NO: 27771 - DNA, 25 bp, Homo sapien
accaggagaggtgatggcagacttc

SEQ ID NO: 27772 - DNA, 25 bp, Homo sapien
tgcggagatttgacctacgtactta

SEQ ID NO: 27773 - DNA, 25 bp, Homo sapien
cgaaagtgctttggcggtttgtcca

SEQ ID NO: 27774 - DNA, 25 bp, Homo sapien
tgtccatccgcagcttcggcttttc

SEQ ID NO: 27775 - DNA, 25 bp, Homo sapien
cggagaccctcgaagtgcgcaaact

SEQ ID NO: 27776 - DNA, 25 bp, Homo sapien
tgcgcaaacttgacactcaccctga

SEQ ID NO: 27777 - DNA, 25 bp, Homo sapien
ttggttaccatcatctctgtgtctg

SEQ ID NO: 27778 - DNA, 25 bp, Homo sapien
gccctgcgaggggattacgcatgtt

SEQ ID NO: 27779 - DNA, 25 bp, Homo sapien
ccctcggaaagctgcgaaagtgctt

SEQ ID NO: 27780 - DNA, 25 bp, Homo sapien
tggcactatctccaggcgtccaggc

SEQ ID NO: 27781 - DNA, 25 bp, Homo sapien
aacctactcactgcggcttttcggg

SEQ ID NO: 27782 - DNA, 25 bp, Homo sapien
gctcggcttggcctaacagccagtc

SEQ ID NO: 27783 - DNA, 25 bp, Homo sapien
gcgcgattcctggacgcacactgca

SEQ ID NO: 27784 - DNA, 25 bp, Homo sapien
ctaactcctggaacccggcttgagg

SEQ ID NO: 27785 - DNA, 25 bp, Homo sapien
cgggctaggaagagcgcaatctcct

SEQ ID NO: 27786 - DNA, 25 bp, Homo sapien
cacggcttttcctgcatagaacaga

SEQ ID NO: 27787 - DNA, 25 bp, Homo sapien
gtatccactgttgtgtcctgagaca

SEQ ID NO: 27788 - DNA, 25 bp, Homo sapien
ctgccgtctggaccgtggctctgct

SEQ ID NO: 27789 - DNA, 25 bp, Homo sapien
aaggttgtcgatgtcggtgtccacc

SEQ ID NO: 27790 - DNA, 25 bp, Homo sapien
gttgtcaatgtaggcgtccacccgg

SEQ ID NO: 27791 - DNA, 25 bp, Homo sapien
catgatgttgtcaatgtaggcgtcc

SEQ ID NO: 27792 - DNA, 25 bp, Homo sapien
tgtccacccggccatggtcatgatg

SEQ ID NO: 27793 - DNA, 25 bp, Homo sapien
ccgccataaggttgtcgatgtcggt

SEQ ID NO: 27794 - DNA, 25 bp, Homo sapien
cgcgatgttggcgaaggttttcccg

SEQ ID NO: 27795 - DNA, 25 bp, Homo sapien
cccggccatggtcatgatgttgtca

SEQ ID NO: 27796 - DNA, 25 bp, Homo sapien
ctggttgtccacgttccggtcgtga

SEQ ID NO: 27797 - DNA, 25 bp, Homo sapien
ccgtccctctggctgactacgttga

SEQ ID NO: 27798 - DNA, 25 bp, Homo sapien
gcagctcgaggacctgcttcgggtt

SEQ ID NO: 27799 - DNA, 25 bp, Homo sapien
tgctttaggggaggaacaaccactg

SEQ ID NO: 27800 - DNA, 25 bp, Homo sapien
tccagggcacggagataatcgagga

SEQ ID NO: 27801 - DNA, 25 bp, Homo sapien
cgccgagccctattcacctaaaaga

SEQ ID NO: 27802 - DNA, 25 bp, Homo sapien
agagcccgaacccacacgcagttta

SEQ ID NO: 27803 - DNA, 25 bp, Homo sapien
ctccaaatttatgctgtgctttagg

SEQ ID NO: 27804 - DNA, 25 bp, Homo sapien
ttaagccggctccaagacaaagcgg

SEQ ID NO: 27805 - DNA, 25 bp, Homo sapien
cacgatcggagtcagtgattaagcc

SEQ ID NO: 27806 - DNA, 25 bp, Homo sapien
gttatgggctcggaaatctagttcg

SEQ ID NO: 27807 - DNA, 25 bp, Homo sapien
agcgtgtgtgagattcagtggtcca

SEQ ID NO: 27808 - DNA, 25 bp, Homo sapien
ggccgacgaatcacgaggcttcgca

SEQ ID NO: 27809 - DNA, 25 bp, Homo sapien
aaagcgtttaggtgtctgcgacgga

SEQ ID NO: 27810 - DNA, 25 bp, Homo sapien
tgacctagttctcacagaggcccgg

SEQ ID NO: 27811 - DNA, 25 bp, Homo sapien
gcttcgcacccggatatggttatgg

SEQ ID NO: 27812 - DNA, 25 bp, Homo sapien
gctacaccctccacgtggtggacag

SEQ ID NO: 27813 - DNA, 25 bp, Homo sapien
accatcgcgggacaatcattttgcg

SEQ ID NO: 27814 - DNA, 25 bp, Homo sapien
ctgtgaaaccatcgcgggacaatca

SEQ ID NO: 27815 - DNA, 25 bp, Homo sapien
ccacgtggtggacagccccactgtg

SEQ ID NO: 27816 - DNA, 25 bp, Homo sapien
agtgtgtctctggacttgtgcgatg

SEQ ID NO: 27817 - DNA, 25 bp, Homo sapien
agcagtatgcctggctgtgcagcca

SEQ ID NO: 27818 - DNA, 25 bp, Homo sapien
tgcaggagcgacagcagtatgcctg

SEQ ID NO: 27819 - DNA, 25 bp, Homo sapien
ccactgtgaaaccatcgcgggacaa

SEQ ID NO: 27820 - DNA, 25 bp, Homo sapien
tccctgtcctccagtcggggagtcg

SEQ ID NO: 27821 - DNA, 25 bp, Homo sapien
gatcccgctggtgaaccgtctgcag

SEQ ID NO: 27822 - DNA, 25 bp, Homo sapien
accgtctgcaggacgcgttttcggc

SEQ ID NO: 27823 - DNA, 25 bp, Homo sapien
tcgttagctgtcagagccaagcggc

SEQ ID NO: 27824 - DNA, 25 bp, Homo sapien
tcgagaacttcgtgggcaggtaagc

SEQ ID NO: 27825 - DNA, 25 bp, Homo sapien
cctgcctgcctttcatcgtgcgata

SEQ ID NO: 27826 - DNA, 25 bp, Homo sapien
tcgtgcgatacaaagccatttcctc

SEQ ID NO: 27827 - DNA, 25 bp, Homo sapien
actccctgtcaggtcgtagaggcga

SEQ ID NO: 27828 - DNA, 25 bp, Homo sapien
tagaagggtgtctccttagcctgga

SEQ ID NO: 27829 - DNA, 25 bp, Homo sapien
tgcctccgtagttaggaactgagag

SEQ ID NO: 27830 - DNA, 25 bp, Homo sapien
cgctgcctccgtagttaggaactga

SEQ ID NO: 27831 - DNA, 25 bp, Homo sapien
cacgctgcctccgtagttaggaact

SEQ ID NO: 27832 - DNA, 25 bp, Homo sapien
ggagggacatacacggagcccgccc

SEQ ID NO: 27833 - DNA, 25 bp, Homo sapien
cccactagaagggtgtctccttagc

SEQ ID NO: 27834 - DNA, 25 bp, Homo sapien
cttcgctgctttgggctgaagcacc

SEQ ID NO: 27835 - DNA, 25 bp, Homo sapien
ccctgaccaagctttcctttctgcc

SEQ ID NO: 27836 - DNA, 25 bp, Homo sapien
acccgagagttcctagggttgcgca

SEQ ID NO: 27837 - DNA, 25 bp, Homo sapien
aatctccttagcgagggcacccttc

SEQ ID NO: 27838 - DNA, 25 bp, Homo sapien
gggtccgccgcaatctccttagcga

SEQ ID NO: 27839 - DNA, 25 bp, Homo sapien
tgtggccaagcacttccgggtccgc

SEQ ID NO: 27840 - DNA, 25 bp, Homo sapien
ggctgcgactgtggccaagcacttc

SEQ ID NO: 27841 - DNA, 25 bp, Homo sapien
ttctggcaccccatttggctttttg

SEQ ID NO: 27842 - DNA, 25 bp, Homo sapien
agggtgcgccttcactcttctggca

SEQ ID NO: 27843 - DNA, 25 bp, Homo sapien
gttggagggtctgcgacgcccaaaa

SEQ ID NO: 27844 - DNA, 25 bp, Homo sapien
cggtccactgtaaggggaaatgctg

SEQ ID NO: 27845 - DNA, 25 bp, Homo sapien
gaaatgctgaggatcactgggctcc

SEQ ID NO: 27846 - DNA, 25 bp, Homo sapien
ggcgaaagcatctgctcctgcgctt

SEQ ID NO: 27847 - DNA, 25 bp, Homo sapien
tcctgcgctttgtggtctcctgcct

SEQ ID NO: 27848 - DNA, 25 bp, Homo sapien
ggcttctccgcctgcgacgtcgaag

SEQ ID NO: 27849 - DNA, 25 bp, Homo sapien
aggagccgctcagccagcgccatag

SEQ ID NO: 27850 - DNA, 25 bp, Homo sapien
tatcggtcacattctcgcgctcctg

SEQ ID NO: 27851 - DNA, 25 bp, Homo sapien
atagcccttaggactatcggtcaca

SEQ ID NO: 27852 - DNA, 25 bp, Homo sapien
tctgggagactcgtaagtggccacc

SEQ ID NO: 27853 - DNA, 25 bp, Homo sapien
actttgaggccaataccaccgtcgg

SEQ ID NO: 27854 - DNA, 25 bp, Homo sapien
gtacgccctgcagagtcaaacctgg

SEQ ID NO: 27855 - DNA, 25 bp, Homo sapien
tggcgcatcctcaagcttccagggg

SEQ ID NO: 27856 - DNA, 25 bp, Homo sapien
cctatagtgtctgaaggatgccacc

SEQ ID NO: 27857 - DNA, 25 bp, Homo sapien
caggcgattctccaccttggggctc

SEQ ID NO: 27858 - DNA, 25 bp, Homo sapien
gttctgcgggttctggaaactcacc

SEQ ID NO: 27859 - DNA, 25 bp, Homo sapien
accaaccggttgcttgctgtcccag

SEQ ID NO: 27860 - DNA, 25 bp, Homo sapien
ggcctcctcggttaccatagcaacg

SEQ ID NO: 27861 - DNA, 25 bp, Homo sapien
agagtttgctcttcggcctgaattc

SEQ ID NO: 27862 - DNA, 25 bp, Homo sapien
gcctgaattccctagggaccttctg

SEQ ID NO: 27863 - DNA, 25 bp, Homo sapien
ggaccttctgcgatcccttgcggct

SEQ ID NO: 27864 - DNA, 25 bp, Homo sapien
ccggtgcgcaaagctctggacagaa

SEQ ID NO: 27865 - DNA, 25 bp, Homo sapien
aggacgctgagattgaagcccactc

SEQ ID NO: 27866 - DNA, 25 bp, Homo sapien
cctggagggaagatgtccgtctacc

SEQ ID NO: 27867 - DNA, 25 bp, Homo sapien
ggcaacggacacttcagggcaccag

SEQ ID NO: 27868 - DNA, 25 bp, Homo sapien
taactccactgccatcaaaacaagg

SEQ ID NO: 27869 - DNA, 25 bp, Homo sapien
cccagctacgcgtgttgtgcgctgc

SEQ ID NO: 27870 - DNA, 25 bp, Homo sapien
gctcggtttgtaggcagtgtcatta

SEQ ID NO: 27871 - DNA, 25 bp, Homo sapien
ctgtggtggttacaatcactaactc

SEQ ID NO: 27872 - DNA, 25 bp, Homo sapien
gcagcccgcagccttcgagagaaga

SEQ ID NO: 27873 - DNA, 25 bp, Homo sapien
tcgagagaagatgcctgagaagcgc

SEQ ID NO: 27874 - DNA, 25 bp, Homo sapien
cgcccgctgcaagtgcgaggaaacc

SEQ ID NO: 27875 - DNA, 25 bp, Homo sapien
gtcattagctgattgtactgtggtg

SEQ ID NO: 27876 - DNA, 25 bp, Homo sapien
gccagtcaccttagagcaggggaca

SEQ ID NO: 27877 - DNA, 25 bp, Homo sapien
ctcgcttcgcagatatgtggtccca

SEQ ID NO: 27878 - DNA, 25 bp, Homo sapien
ttcctgcgggaacgatttaagaata

SEQ ID NO: 27879 - DNA, 25 bp, Homo sapien
ccttggcggattatgtgggttcctg

SEQ ID NO: 27880 - DNA, 25 bp, Homo sapien
tcagagccggtaagtgagccagtca

SEQ ID NO: 27881 - DNA, 25 bp, Homo sapien
ggctgctgcagagaagaaagtgtca

SEQ ID NO: 27882 - DNA, 25 bp, Homo sapien
taggactacttcctgcttctggata

SEQ ID NO: 27883 - DNA, 25 bp, Homo sapien
aatagctctacgagcggcatcctgc

SEQ ID NO: 27884 - DNA, 25 bp, Homo sapien
aggccgagccacttaaccactatcg

SEQ ID NO: 27885 - DNA, 25 bp, Homo sapien
gtcgctctctcgtcgtcacttttgg

SEQ ID NO: 27886 - DNA, 25 bp, Homo sapien
tccttcccggtaatcttgggcacta

SEQ ID NO: 27887 - DNA, 25 bp, Homo sapien
gcggcacctcaccactgattcgttg

SEQ ID NO: 27888 - DNA, 25 bp, Homo sapien
ttccaatcgtgctcggttgctcctc

SEQ ID NO: 27889 - DNA, 25 bp, Homo sapien
cgcctcgccgattccgtatcagtga

SEQ ID NO: 27890 - DNA, 25 bp, Homo sapien
cgcgctctgggagaattttggcttt

SEQ ID NO: 27891 - DNA, 25 bp, Homo sapien
tcctcagttttcctaccggtgcgaa

SEQ ID NO: 27892 - DNA, 25 bp, Homo sapien
agtgatttccttccggcacgtcgcc

SEQ ID NO: 27893 - DNA, 25 bp, Homo sapien
tcaatcttcctctcatccagtatca

SEQ ID NO: 27894 - DNA, 25 bp, Homo sapien
ttgtgggcagagacatgaccgtcca

SEQ ID NO: 27895 - DNA, 25 bp, Homo sapien
gcggtgtaaggctgagtgatttcct

SEQ ID NO: 27896 - DNA, 25 bp, Homo sapien
taggtgctgctccttgactggactc

SEQ ID NO: 27897 - DNA, 25 bp, Homo sapien
tggggcgctcagctactttccttca

SEQ ID NO: 27898 - DNA, 25 bp, Homo sapien
ctagttctcacctgagcgctggctc

SEQ ID NO: 27899 - DNA, 25 bp, Homo sapien
tgaccgtccacgtgatgccgtgctc

SEQ ID NO: 27900 - DNA, 25 bp, Homo sapien
gccctgagcagatgaaccggtccct

SEQ ID NO: 27901 - DNA, 25 bp, Homo sapien
gaccgaaagtctcacacgccctgag

SEQ ID NO: 27902 - DNA, 25 bp, Homo sapien
cccaggccctgggagtaccacagga

SEQ ID NO: 27903 - DNA, 25 bp, Homo sapien
accacaggagccaggtagccctttc

SEQ ID NO: 27904 - DNA, 25 bp, Homo sapien
tgaggcctaaaggacgccggccact

SEQ ID NO: 27905 - DNA, 25 bp, Homo sapien
agctgcctattgttcccgactgagg

SEQ ID NO: 27906 - DNA, 25 bp, Homo sapien
ccgaggccaccgttgactctgattc

SEQ ID NO: 27907 - DNA, 25 bp, Homo sapien
gagcaaagctctgagtcaccggcca

SEQ ID NO: 27908 - DNA, 25 bp, Homo sapien
gcgtccctgctctaacagctctggt

SEQ ID NO: 27909 - DNA, 25 bp, Homo sapien
tttcttacccacacgcaggcttctg

SEQ ID NO: 27910 - DNA, 25 bp, Homo sapien
ggctgctgctggattcgcagtccca

SEQ ID NO: 27911 - DNA, 25 bp, Homo sapien
tcctgacattgctgcctcggcggct

SEQ ID NO: 27912 - DNA, 25 bp, Homo sapien
ccaggtggccgctcctcgcggatag

SEQ ID NO: 27913 - DNA, 25 bp, Homo sapien
cagctctggttctgtcaggacctca

SEQ ID NO: 27914 - DNA, 25 bp, Homo sapien
aggcttctgtactcgaccatttctc

SEQ ID NO: 27915 - DNA, 25 bp, Homo sapien
cagagtgggcgcctccgacatcagg

SEQ ID NO: 27916 - DNA, 25 bp, Homo sapien
taaccttacacaacatggcggcctg

SEQ ID NO: 27917 - DNA, 25 bp, Homo sapien
tcggaactgttagaccgcggtgacg

SEQ ID NO: 27918 - DNA, 25 bp, Homo sapien
gcggacgaaagcaggtgactctcta

SEQ ID NO: 27919 - DNA, 25 bp, Homo sapien
tctcgtttgaaagtaaccaggctgc

SEQ ID NO: 27920 - DNA, 25 bp, Homo sapien
ggcccagcgcggtcaaattataata

SEQ ID NO: 27921 - DNA, 25 bp, Homo sapien
cagggcggagagcaagacattactc

SEQ ID NO: 27922 - DNA, 25 bp, Homo sapien
gacattactcttctcggattgccgg

SEQ ID NO: 27923 - DNA, 25 bp, Homo sapien
gtcaacttccgacttggactccgaa

SEQ ID NO: 27924 - DNA, 25 bp, Homo sapien
tggggtacctctgcacactggaggc

SEQ ID NO: 27925 - DNA, 25 bp, Homo sapien
tacgactctggccatggggaacagc

SEQ ID NO: 27926 - DNA, 25 bp, Homo sapien
gtatggccgcctggtccacagcaat

SEQ ID NO: 27927 - DNA, 25 bp, Homo sapien
cctcgctgaagggaaacaggtgagc

SEQ ID NO: 27928 - DNA, 25 bp, Homo sapien
agggacccagacttgccgacctgta

SEQ ID NO: 27929 - DNA, 25 bp, Homo sapien
tgccggcaggtagtgtcacttgaga

SEQ ID NO: 27930 - DNA, 25 bp, Homo sapien
cctcagatgagcagcgagccagccg

SEQ ID NO: 27931 - DNA, 25 bp, Homo sapien
ctcatccggccgaaagtctgagcgg

SEQ ID NO: 27932 - DNA, 25 bp, Homo sapien
caataaaaagcagggagtccagtgg

SEQ ID NO: 27933 - DNA, 25 bp, Homo sapien
acgccagactgcaacggcggggctc

SEQ ID NO: 27934 - DNA, 25 bp, Homo sapien
tatggttctccgaccgcaacgccgg

SEQ ID NO: 27935 - DNA, 25 bp, Homo sapien
tgccatgacaccaacccgaagcgtg

SEQ ID NO: 27936 - DNA, 25 bp, Homo sapien
ccttggatacagacacccaccggga

SEQ ID NO: 27937 - DNA, 25 bp, Homo sapien
gcctgcgggtcacgcaggagtcaca

SEQ ID NO: 27938 - DNA, 25 bp, Homo sapien
gtggagaattttcggactcggattc

SEQ ID NO: 27939 - DNA, 25 bp, Homo sapien
cccgtgtctccgcttgtggagaatt

SEQ ID NO: 27940 - DNA, 25 bp, Homo sapien
gacctgcagtggcttaattccgcta

SEQ ID NO: 27941 - DNA, 25 bp, Homo sapien
ccacctgtctgaagaagaatccatc

SEQ ID NO: 27942 - DNA, 25 bp, Homo sapien
gcctgtttgccatccacggagactg

SEQ ID NO: 27943 - DNA, 25 bp, Homo sapien
gtggctttgtacagtccatctgcaa

SEQ ID NO: 27944 - DNA, 25 bp, Homo sapien
ccgctagctatgatgggacctcaga

SEQ ID NO: 27945 - DNA, 25 bp, Homo sapien
acctggctaccgtggagtcctacga

SEQ ID NO: 27946 - DNA, 25 bp, Homo sapien
gccgccttgcatggactcctgtact

SEQ ID NO: 27947 - DNA, 25 bp, Homo sapien
catcgaggccctgaagttccacctg

SEQ ID NO: 27948 - DNA, 25 bp, Homo sapien
gtgtactccgatgccacgggcagtg

SEQ ID NO: 27949 - DNA, 25 bp, Homo sapien
ccagctcctgccgtgtactccgatg

SEQ ID NO: 27950 - DNA, 25 bp, Homo sapien
ccgtgtactccgatgccacgggcag

SEQ ID NO: 27951 - DNA, 25 bp, Homo sapien
gtactccgatgccacgggcagtgac

SEQ ID NO: 27952 - DNA, 25 bp, Homo sapien
tactccgatgccacgggcagtgacc

SEQ ID NO: 27953 - DNA, 25 bp, Homo sapien
cgtgtactccgatgccacgggcagt

SEQ ID NO: 27954 - DNA, 25 bp, Homo sapien
ctgccgtgtactccgatgccacggg

SEQ ID NO: 27955 - DNA, 25 bp, Homo sapien
gccgtgtactccgatgccacgggca

SEQ ID NO: 27956 - DNA, 25 bp, Homo sapien
ggactggtcctcaccgagcactaca

SEQ ID NO: 27957 - DNA, 25 bp, Homo sapien
gctgaaactttattgacactgccga

SEQ ID NO: 27958 - DNA, 25 bp, Homo sapien
atgacaaatctgaaggcgccgcgtt

SEQ ID NO: 27959 - DNA, 25 bp, Homo sapien
cggagctctcgcgatatttcacgga

SEQ ID NO: 27960 - DNA, 25 bp, Homo sapien
gtccgctacaaactacaaaccgctg

SEQ ID NO: 27961 - DNA, 25 bp, Homo sapien
aaggccgccatgttgtccgctacaa

SEQ ID NO: 27962 - DNA, 25 bp, Homo sapien
ggacccgtgggttatgagattcagc

SEQ ID NO: 27963 - DNA, 25 bp, Homo sapien
tttcacggaacttgggcaaatgaca

SEQ ID NO: 27964 - DNA, 25 bp, Homo sapien
acttcatgtcggaggactgcagcga

SEQ ID NO: 27965 - DNA, 25 bp, Homo sapien
cctgtgccatgagccctacgtgggt

SEQ ID NO: 27966 - DNA, 25 bp, Homo sapien
tacgtgggtgccgactgcggctacc

SEQ ID NO: 27967 - DNA, 25 bp, Homo sapien
gtgccagtgccacgaagacttcatg

SEQ ID NO: 27968 - DNA, 25 bp, Homo sapien
ggactgcagcgagaagcgctgtccc

SEQ ID NO: 27969 - DNA, 25 bp, Homo sapien
gccacggcttctgtgacacgggcga

SEQ ID NO: 27970 - DNA, 25 bp, Homo sapien
ctactgcgaggagggcttcacaggc

SEQ ID NO: 27971 - DNA, 25 bp, Homo sapien
ccctgagaactgcagcggacacggc

SEQ ID NO: 27972 - DNA, 25 bp, Homo sapien
cccgggattactggtatttgctggc

SEQ ID NO: 27973 - DNA, 25 bp, Homo sapien
ccctagcgaatctcagctggtgctg

SEQ ID NO: 27974 - DNA, 25 bp, Homo sapien
ttgctggctcctcggaacaagatgc

SEQ ID NO: 27975 - DNA, 25 bp, Homo sapien
tggcggatcccaacacctacctagg

SEQ ID NO: 27976 - DNA, 25 bp, Homo sapien
gaagcgtcctcagttgccatggaaa

SEQ ID NO: 27977 - DNA, 25 bp, Homo sapien
ccagcgaagaacctagcggccgaaa

SEQ ID NO: 27978 - DNA, 25 bp, Homo sapien
cggccgaaaagagtcccaggaaatg

SEQ ID NO: 27979 - DNA, 25 bp, Homo sapien
acttggctaagcagttctggatctc

SEQ ID NO: 27980 - DNA, 25 bp, Homo sapien
acttcctgaatctggctcgccgttc

SEQ ID NO: 27981 - DNA, 25 bp, Homo sapien
tgatgtcacaggcacaacttcctga

SEQ ID NO: 27982 - DNA, 25 bp, Homo sapien
ttgaggtttcgctccaactctgtcc

SEQ ID NO: 27983 - DNA, 25 bp, Homo sapien
cctggcatagttgaggtttcgctcc

SEQ ID NO: 27984 - DNA, 25 bp, Homo sapien
ccgacgcctggcatagttgaggttt

SEQ ID NO: 27985 - DNA, 25 bp, Homo sapien
ttcctacgggccgacgcctggcata

SEQ ID NO: 27986 - DNA, 25 bp, Homo sapien
cagcgccctctgtgttccctgcctt

SEQ ID NO: 27987 - DNA, 25 bp, Homo sapien
ggaacacgcctccttcaggacacag

SEQ ID NO: 27988 - DNA, 25 bp, Homo sapien
gcagaccattagagcattacgagga

SEQ ID NO: 27989 - DNA, 25 bp, Homo sapien
tggcggagacatcgcagcaacgcta

SEQ ID NO: 27990 - DNA, 25 bp, Homo sapien
gtcatggcgacggaagcagaccatt

SEQ ID NO: 27991 - DNA, 25 bp, Homo sapien
tctgctcacacctcaggcagtcgga

SEQ ID NO: 27992 - DNA, 25 bp, Homo sapien
gacggagtaattcgcagatgccacc

SEQ ID NO: 27993 - DNA, 25 bp, Homo sapien
ttatgcggacctggctaactccaga

SEQ ID NO: 27994 - DNA, 25 bp, Homo sapien
tttgcccaccgcgaagagcagtggc

SEQ ID NO: 27995 - DNA, 25 bp, Homo sapien
ctgagaggcacacacgcgccttctg

SEQ ID NO: 27996 - DNA, 25 bp, Homo sapien
taaagacgaggaggcggaagtcacc

SEQ ID NO: 27997 - DNA, 25 bp, Homo sapien
tagaaggcactaccgctgtcgaggc

SEQ ID NO: 27998 - DNA, 25 bp, Homo sapien
ccaagcggagaatatcggcgcaagc

SEQ ID NO: 27999 - DNA, 25 bp, Homo sapien
tagcgggcggaaactctcgaaaagc

SEQ ID NO: 28000 - DNA, 25 bp, Homo sapien
agccgctttcgttccagaaaacgtg

SEQ ID NO: 28001 - DNA, 25 bp, Homo sapien
tttaaggcagccacacaacagcgtc

SEQ ID NO: 28002 - DNA, 25 bp, Homo sapien
ggcggctaccagacatcgtgactcc

SEQ ID NO: 28003 - DNA, 25 bp, Homo sapien
agggcaggccgtcttaatacagtga

SEQ ID NO: 28004 - DNA, 25 bp, Homo sapien
tgtgcatgatgctcaggtcgttctc

SEQ ID NO: 28005 - DNA, 25 bp, Homo sapien
atttctcccgggaagtcgttgcgca

SEQ ID NO: 28006 - DNA, 25 bp, Homo sapien
gtgttctccaggtcgtccaccacga

SEQ ID NO: 28007 - DNA, 25 bp, Homo sapien
ccagcacgaagtagggcagctccgt

SEQ ID NO: 28008 - DNA, 25 bp, Homo sapien
gcagtgccgacaccgtgatgctttt

SEQ ID NO: 28009 - DNA, 25 bp, Homo sapien
gcagagcccggctaaagccatcttg

SEQ ID NO: 28010 - DNA, 25 bp, Homo sapien
tcgttgcgcaccgagaagaggagct

SEQ ID NO: 28011 - DNA, 25 bp, Homo sapien
gatgcttttgagcttgcactccagc

SEQ ID NO: 28012 - DNA, 25 bp, Homo sapien
ctgcagctctgggatgcaatccgcc

SEQ ID NO: 28013 - DNA, 25 bp, Homo sapien
ctgagctcggaggatcccattagga

SEQ ID NO: 28014 - DNA, 25 bp, Homo sapien
ctcggaggatcccattaggacttgc

SEQ ID NO: 28015 - DNA, 25 bp, Homo sapien
gctctgggatgcaatccgcctgcct

SEQ ID NO: 28016 - DNA, 25 bp, Homo sapien
tcccattaggacttgcccggggatg

SEQ ID NO: 28017 - DNA, 25 bp, Homo sapien
gggatgtgcacctgccgtgcgctcc

SEQ ID NO: 28018 - DNA, 25 bp, Homo sapien
gctccgaggtcagtggcaggtctgc

SEQ ID NO: 28019 - DNA, 25 bp, Homo sapien
cgcctgcctcgcaagctgctcgccg

SEQ ID NO: 28020 - DNA, 25 bp, Homo sapien
ctttcggatttgagccgcgagggac

SEQ ID NO: 28021 - DNA, 25 bp, Homo sapien
cggaagcctcgggtcactagagacc

SEQ ID NO: 28022 - DNA, 25 bp, Homo sapien
ccctagaggcgaaaagctgtgttac

SEQ ID NO: 28023 - DNA, 25 bp, Homo sapien
tctgtaagtacactccggcaagctc

SEQ ID NO: 28024 - DNA, 25 bp, Homo sapien
ctttctgaaatctccgacctttcgg

SEQ ID NO: 28025 - DNA, 25 bp, Homo sapien
tccggcaagctcgaaagggacagca

SEQ ID NO: 28026 - DNA, 25 bp, Homo sapien
tgcacacgcctcttctttctgaaat

SEQ ID NO: 28027 - DNA, 25 bp, Homo sapien
ccgacctttcggatttgagccgcga

SEQ ID NO: 28028 - DNA, 25 bp, Homo sapien
cacaaaacaagggaagggtcagtcg

SEQ ID NO: 28029 - DNA, 25 bp, Homo sapien
ggggccacctcttcaatggtcaggg

SEQ ID NO: 28030 - DNA, 25 bp, Homo sapien
tcttcaatggtcaggggcttcttca

SEQ ID NO: 28031 - DNA, 25 bp, Homo sapien
ttcttcagctctgcgcaaatcgcag

SEQ ID NO: 28032 - DNA, 25 bp, Homo sapien
gaggcactgcctgcagagcacggcc

SEQ ID NO: 28033 - DNA, 25 bp, Homo sapien
ggctctcctgcaacacaaaacaagg

SEQ ID NO: 28034 - DNA, 25 bp, Homo sapien
tcggggttgcacctgcagacccacg

SEQ ID NO: 28035 - DNA, 25 bp, Homo sapien
tgcgcaaatcgcagcgcggtagtgc

SEQ ID NO: 28036 - DNA, 25 bp, Homo sapien
tgcttcagcctatcaccctgggatg

SEQ ID NO: 28037 - DNA, 25 bp, Homo sapien
gacctggacgcggttgtcccagtca

SEQ ID NO: 28038 - DNA, 25 bp, Homo sapien
ttcggtgtccgacttttcctgcctg

SEQ ID NO: 28039 - DNA, 25 bp, Homo sapien
cccggcttcgttactcgagtgcaca

SEQ ID NO: 28040 - DNA, 25 bp, Homo sapien
ggctctcggccctcgattgcttcag

SEQ ID NO: 28041 - DNA, 25 bp, Homo sapien
tcctcaggctgagggaacgggcact

SEQ ID NO: 28042 - DNA, 25 bp, Homo sapien
ccagagcctggtctgaccgcgagag

SEQ ID NO: 28043 - DNA, 25 bp, Homo sapien
gggcaccatggagctctctccgtcg

SEQ ID NO: 28044 - DNA, 25 bp, Homo sapien
gcactcgttgcctacaaggtctaga

SEQ ID NO: 28045 - DNA, 25 bp, Homo sapien
ctatttggtgcgtgcccacggtgct

SEQ ID NO: 28046 - DNA, 25 bp, Homo sapien
aaactctatttggtgcgtgcccacg

SEQ ID NO: 28047 - DNA, 25 bp, Homo sapien
gcagatggctccggcctcttttaaa

SEQ ID NO: 28048 - DNA, 25 bp, Homo sapien
ctccgaaataaaacatcgcagatgg

SEQ ID NO: 28049 - DNA, 25 bp, Homo sapien
ccctgctccgaaataaaacatcgca

SEQ ID NO: 28050 - DNA, 25 bp, Homo sapien
caaggtctagaagcagcgcagggaa

SEQ ID NO: 28051 - DNA, 25 bp, Homo sapien
ggcggctggcactcgttgcctacaa

SEQ ID NO: 28052 - DNA, 25 bp, Homo sapien
tgctggtccctagggccagagagaa

SEQ ID NO: 28053 - DNA, 25 bp, Homo sapien
gaagagtcgcagttacttcctgggg

SEQ ID NO: 28054 - DNA, 25 bp, Homo sapien
cggaggccagaagagtcgcagttac

SEQ ID NO: 28055 - DNA, 25 bp, Homo sapien
gcatcctgggtccttccgcgggaac

SEQ ID NO: 28056 - DNA, 25 bp, Homo sapien
ctcccaaagccgagggcaagaagga

SEQ ID NO: 28057 - DNA, 25 bp, Homo sapien
ccctctgagtgagccgcgctgctga

SEQ ID NO: 28058 - DNA, 25 bp, Homo sapien
agagaagacttctgtggggtccgct

SEQ ID NO: 28059 - DNA, 25 bp, Homo sapien
ggaagacgcactctgggcagtgacc

SEQ ID NO: 28060 - DNA, 25 bp, Homo sapien
agcccgttcccagtccagagttatg

SEQ ID NO: 28061 - DNA, 25 bp, Homo sapien
tcgttatcagattgcctaggggccc

SEQ ID NO: 28062 - DNA, 25 bp, Homo sapien
acgcatcgaatcagtccttgggacc

SEQ ID NO: 28063 - DNA, 25 bp, Homo sapien
taggggcccgactgaagtattcctc

SEQ ID NO: 28064 - DNA, 25 bp, Homo sapien
ccacgtatgggactagaaggccgtc

SEQ ID NO: 28065 - DNA, 25 bp, Homo sapien
gtcctggaacgctcgaagcccgttc

SEQ ID NO: 28066 - DNA, 25 bp, Homo sapien
tgcacccgcacagctggcgaacttg

SEQ ID NO: 28067 - DNA, 25 bp, Homo sapien
cagcccttcggagtctcttgcgttc

SEQ ID NO: 28068 - DNA, 25 bp, Homo sapien
cagagcttcgcatatcctggcggga

SEQ ID NO: 28069 - DNA, 25 bp, Homo sapien
aaaaggcttttcacggagcaggctc

SEQ ID NO: 28070 - DNA, 25 bp, Homo sapien
tccgagactccgactggtcacagtc

SEQ ID NO: 28071 - DNA, 25 bp, Homo sapien
cgtcattcttggtcgcctgtgtgtc

SEQ ID NO: 28072 - DNA, 25 bp, Homo sapien
cgagtgctcccgactaatgtttaac

SEQ ID NO: 28073 - DNA, 25 bp, Homo sapien
ctcggcttcctcttgctttacagta

SEQ ID NO: 28074 - DNA, 25 bp, Homo sapien
gtcaccgtcttcatcagcactcttg

SEQ ID NO: 28075 - DNA, 25 bp, Homo sapien
tgagacttgactcactcccggcaga

SEQ ID NO: 28076 - DNA, 25 bp, Homo sapien
ttcgggtcgacgagtgctactctag

SEQ ID NO: 28077 - DNA, 25 bp, Homo sapien
ggaagcgcgaggttaagaccctgac

SEQ ID NO: 28078 - DNA, 25 bp, Homo sapien
gttaagaccctgacggctgcagctc

SEQ ID NO: 28079 - DNA, 25 bp, Homo sapien
cggggtggttccagctcactctcct

SEQ ID NO: 28080 - DNA, 25 bp, Homo sapien
ggcatcgtctttccgtcctctgagg

SEQ ID NO: 28081 - DNA, 25 bp, Homo sapien
tccttcaggtgagcccgatcccgga

SEQ ID NO: 28082 - DNA, 25 bp, Homo sapien
cgggcaccgatcaccggcggcagtt

SEQ ID NO: 28083 - DNA, 25 bp, Homo sapien
ggcgcctcagtcttccttcaggtga

SEQ ID NO: 28084 - DNA, 25 bp, Homo sapien
aggcgctacgctaggacggtaccaa

SEQ ID NO: 28085 - DNA, 25 bp, Homo sapien
ggcacaacttaacgaatgctgtgtt

SEQ ID NO: 28086 - DNA, 25 bp, Homo sapien
gcgctcgcagaagggcacaacttaa

SEQ ID NO: 28087 - DNA, 25 bp, Homo sapien
cggtgcctctcttgtgttccccgga

SEQ ID NO: 28088 - DNA, 25 bp, Homo sapien
gtccttctagtgaccgtctctcgtc

SEQ ID NO: 28089 - DNA, 25 bp, Homo sapien
gccagaggtccttctagtgaccgtc

SEQ ID NO: 28090 - DNA, 25 bp, Homo sapien
aatgctgtgttagccctcagtgggc

SEQ ID NO: 28091 - DNA, 25 bp, Homo sapien
cgctaggacggtaccaacagccggg

SEQ ID NO: 28092 - DNA, 25 bp, Homo sapien
tcaagcccgcctaggaagtgcggtc

SEQ ID NO: 28093 - DNA, 25 bp, Homo sapien
tggacgctcttcagctgccaggtgt

SEQ ID NO: 28094 - DNA, 25 bp, Homo sapien
ggtgccctctccaagcggtactgga

SEQ ID NO: 28095 - DNA, 25 bp, Homo sapien
cccaccctggcgttattcgaaggtg

SEQ ID NO: 28096 - DNA, 25 bp, Homo sapien
tcgaaggtgttgctcttgacagctc

SEQ ID NO: 28097 - DNA, 25 bp, Homo sapien
ttgacagctctagggaacgtccgct

SEQ ID NO: 28098 - DNA, 25 bp, Homo sapien
cgtggcgccagctttggctcttttt

SEQ ID NO: 28099 - DNA, 25 bp, Homo sapien
tgatccctgcgctttccagattctc

SEQ ID NO: 28100 - DNA, 25 bp, Homo sapien
ccaccgctgcttgaggtctttcgtc

SEQ ID NO: 28101 - DNA, 25 bp, Homo sapien
ccatgctgggtgaagatattgaagc

SEQ ID NO: 28102 - DNA, 25 bp, Homo sapien
cctccacctgtcaaatgagtgagtc

SEQ ID NO: 28103 - DNA, 25 bp, Homo sapien
atattgaagccggtctctgtggtgc

SEQ ID NO: 28104 - DNA, 25 bp, Homo sapien
tgcctccaggcgactcacagattct

SEQ ID NO: 28105 - DNA, 25 bp, Homo sapien
catctttaaaccaccgagcgctggg

SEQ ID NO: 28106 - DNA, 25 bp, Homo sapien
gaaagcgtgggacagagcgtctccc

SEQ ID NO: 28107 - DNA, 25 bp, Homo sapien
actggaccagatggcagcggattcc

SEQ ID NO: 28108 - DNA, 25 bp, Homo sapien
gcacgctggtttggtgttccgcaaa

SEQ ID NO: 28109 - DNA, 25 bp, Homo sapien
ccaataggatgctcagccggaggtg

SEQ ID NO: 28110 - DNA, 25 bp, Homo sapien
ctgtccggcgctttagcttagcagg

SEQ ID NO: 28111 - DNA, 25 bp, Homo sapien
cacgggcagccttttaaaccctgca

SEQ ID NO: 28112 - DNA, 25 bp, Homo sapien
tttagcttagcaggcgacgttgcgg

SEQ ID NO: 28113 - DNA, 25 bp, Homo sapien
agagcttcccggagtcgaccttcct

SEQ ID NO: 28114 - DNA, 25 bp, Homo sapien
ctggggaccaccaataggatgctca

SEQ ID NO: 28115 - DNA, 25 bp, Homo sapien
cctcaggtaacggtggtgctcccgc

SEQ ID NO: 28116 - DNA, 25 bp, Homo sapien
gattgtcttagctgtctccctcctc

SEQ ID NO: 28117 - DNA, 25 bp, Homo sapien
gctactgaacctatgctgtgactta

SEQ ID NO: 28118 - DNA, 25 bp, Homo sapien
ccaagagggtgtagggattgtctta

SEQ ID NO: 28119 - DNA, 25 bp, Homo sapien
gggccctgggtttctatgacgacaa

SEQ ID NO: 28120 - DNA, 25 bp, Homo sapien
tttaaaccaagaagcagtgcgaggc

SEQ ID NO: 28121 - DNA, 25 bp, Homo sapien
cgaggcctgcccaactcgcgagttt

SEQ ID NO: 28122 - DNA, 25 bp, Homo sapien
ggattccgtgacaacggcgggatta

SEQ ID NO: 28123 - DNA, 25 bp, Homo sapien
tatgacgacaaacaggcgttccagc

SEQ ID NO: 28124 - DNA, 25 bp, Homo sapien
cctcttgttctccttgtgcggagtc

SEQ ID NO: 28125 - DNA, 25 bp, Homo sapien
gagctgtggactgcgcccgccgact

SEQ ID NO: 28126 - DNA, 25 bp, Homo sapien
cccgacagctgtgtcttggtggagc

SEQ ID NO: 28127 - DNA, 25 bp, Homo sapien
tgttctccttgtgcggagtcctgcc

SEQ ID NO: 28128 - DNA, 25 bp, Homo sapien
atccacgtccaccaccgtggcggcg

SEQ ID NO: 28129 - DNA, 25 bp, Homo sapien
ccggagcctcggacctcatccacgt

SEQ ID NO: 28130 - DNA, 25 bp, Homo sapien
gcgccaccacctcggtgccctcctc

SEQ ID NO: 28131 - DNA, 25 bp, Homo sapien
agcgcagtccctgtggagtcgctgc

SEQ ID NO: 28132 - DNA, 25 bp, Homo sapien
cctagggctggaaagaggctgcctc

SEQ ID NO: 28133 - DNA, 25 bp, Homo sapien
cggctgccagggcttttaatgtctg

SEQ ID NO: 28134 - DNA, 25 bp, Homo sapien
ctgcctcgcaggaaggcgctctagc

SEQ ID NO: 28135 - DNA, 25 bp, Homo sapien
ggaaggcgctctagcgagcctcctc

SEQ ID NO: 28136 - DNA, 25 bp, Homo sapien
gtgttgacttgagacgccggcccgc

SEQ ID NO: 28137 - DNA, 25 bp, Homo sapien
ccgcttgtccctgccatgaattgag

SEQ ID NO: 28138 - DNA, 25 bp, Homo sapien
tgccatgaattgagaccgcgggcca

SEQ ID NO: 28139 - DNA, 25 bp, Homo sapien
gctcggagctcagcgctcagcggct

SEQ ID NO: 28140 - DNA, 25 bp, Homo sapien
tgccgcgtcacagcagtaccatata

SEQ ID NO: 28141 - DNA, 25 bp, Homo sapien
tccctgtggtggtaaaaacacattc

SEQ ID NO: 28142 - DNA, 25 bp, Homo sapien
ggccagccacgcgttcttgatgacg

SEQ ID NO: 28143 - DNA, 25 bp, Homo sapien
ctgacaagtgacaagcagaagagtc

SEQ ID NO: 28144 - DNA, 25 bp, Homo sapien
cggctgggacctcgtacttgaagat

SEQ ID NO: 28145 - DNA, 25 bp, Homo sapien
cttgatgacggccagcttgaggctc

SEQ ID NO: 28146 - DNA, 25 bp, Homo sapien
tcgtacttgaagatgacgctgaaga

SEQ ID NO: 28147 - DNA, 25 bp, Homo sapien
tgggtcacacgcatctgtgcggctg

SEQ ID NO: 28148 - DNA, 25 bp, Homo sapien
ggcggcaccggatcaccaagacgga

SEQ ID NO: 28149 - DNA, 25 bp, Homo sapien
gtggccacccggaatttcgcccaga

SEQ ID NO: 28150 - DNA, 25 bp, Homo sapien
cggacccgagtgtcgtccgactgga

SEQ ID NO: 28151 - DNA, 25 bp, Homo sapien
agggcaacttcgctgtggtgaagct

SEQ ID NO: 28152 - DNA, 25 bp, Homo sapien
ttctacgacatcgagggcacgctgg

SEQ ID NO: 28153 - DNA, 25 bp, Homo sapien
tcctgtccgccgtgtctagcagcgg

SEQ ID NO: 28154 - DNA, 25 bp, Homo sapien
catggtgaccaatccaggctcgggc

SEQ ID NO: 28155 - DNA, 25 bp, Homo sapien
ctggaaacgcaaccagccggggctt

SEQ ID NO: 28156 - DNA, 25 bp, Homo sapien
gtagcttaatcaacgcaggtggaga

SEQ ID NO: 28157 - DNA, 25 bp, Homo sapien
aggggcagagttcttgacacctgta

SEQ ID NO: 28158 - DNA, 25 bp, Homo sapien
cgggcgaagattggtggtaccttca

SEQ ID NO: 28159 - DNA, 25 bp, Homo sapien
gcggcattgcgttggccttagttcc

SEQ ID NO: 28160 - DNA, 25 bp, Homo sapien
gttggagtccaacacccgacaggaa

SEQ ID NO: 28161 - DNA, 25 bp, Homo sapien
ggagcggctaatcctgcccaaccgt

SEQ ID NO: 28162 - DNA, 25 bp, Homo sapien
tcttcccaccgcgtcggaggacgta

SEQ ID NO: 28163 - DNA, 25 bp, Homo sapien
ttcctagtcctggttcccgaggagc

SEQ ID NO: 28164 - DNA, 25 bp, Homo sapien
aataaagagggcgaagtgccttcgc

SEQ ID NO: 28165 - DNA, 25 bp, Homo sapien
tgccggcaactgtgggcagccttga

SEQ ID NO: 28166 - DNA, 25 bp, Homo sapien
cagtgagtccggattcgtgccggca

SEQ ID NO: 28167 - DNA, 25 bp, Homo sapien
gtgtctgcagcgacccgcttctctg

SEQ ID NO: 28168 - DNA, 25 bp, Homo sapien
aggcgctctactcagcgtgtctgca

SEQ ID NO: 28169 - DNA, 25 bp, Homo sapien
gcgtactttcgagggcgcctcaaca

SEQ ID NO: 28170 - DNA, 25 bp, Homo sapien
atgtgtctggccaccgcgtactttc

SEQ ID NO: 28171 - DNA, 25 bp, Homo sapien
ggcgaccgcactccgattccagagg

SEQ ID NO: 28172 - DNA, 25 bp, Homo sapien
atgacaaacactttccgccggaagg

SEQ ID NO: 28173 - DNA, 25 bp, Homo sapien
gcggcccgaatgtcgtccagggtcc

SEQ ID NO: 28174 - DNA, 25 bp, Homo sapien
gtggaatcctgggactagtagtctc

SEQ ID NO: 28175 - DNA, 25 bp, Homo sapien
tctactgccaggtcgtctgacccag

SEQ ID NO: 28176 - DNA, 25 bp, Homo sapien
tgccaggtcgtctgacccagcgaca

SEQ ID NO: 28177 - DNA, 25 bp, Homo sapien
gacccagcgacaggcgcggtaaatg

SEQ ID NO: 28178 - DNA, 25 bp, Homo sapien
ggcgcggtaaatgcgcgaccaaacc

SEQ ID NO: 28179 - DNA, 25 bp, Homo sapien
gggactagtagtctccgtgccctgc

SEQ ID NO: 28180 - DNA, 25 bp, Homo sapien
cttcgcgatcgactaaagctacgtc

SEQ ID NO: 28181 - DNA, 25 bp, Homo sapien
ctacgtcaacaactatggcgggcga

SEQ ID NO: 28182 - DNA, 25 bp, Homo sapien
gatgcgcctgcgtacagaactcctc

SEQ ID NO: 28183 - DNA, 25 bp, Homo sapien
ggctagaagagttccggtccgattc

SEQ ID NO: 28184 - DNA, 25 bp, Homo sapien
atgcccgcctgggtactaagtactg

SEQ ID NO: 28185 - DNA, 25 bp, Homo sapien
tactaccttcggtctaggcagcgga

SEQ ID NO: 28186 - DNA, 25 bp, Homo sapien
gggactctcattcctctgaaggtga

SEQ ID NO: 28187 - DNA, 25 bp, Homo sapien
tagggtccataaagccatcttcgcg

SEQ ID NO: 28188 - DNA, 25 bp, Homo sapien
cctccgtgtcagttgttgggctgta

SEQ ID NO: 28189 - DNA, 25 bp, Homo sapien
cgacactctcaggtgagctcctgta

SEQ ID NO: 28190 - DNA, 25 bp, Homo sapien
ccagacctgcgccagagagaactgc

SEQ ID NO: 28191 - DNA, 25 bp, Homo sapien
ctgtggcactgtctcgggacagttc

SEQ ID NO: 28192 - DNA, 25 bp, Homo sapien
ccctaaccgaaggttggcatgcctg

SEQ ID NO: 28193 - DNA, 25 bp, Homo sapien
ggagtctcgctcagcctcaactgtc

SEQ ID NO: 28194 - DNA, 25 bp, Homo sapien
cttcgcggttctgctccttgtttta

SEQ ID NO: 28195 - DNA, 25 bp, Homo sapien
ttcgacgcaccaaacatggcttctt

SEQ ID NO: 28196 - DNA, 25 bp, Homo sapien
ggaccgcgaaaggatggctcaccac

SEQ ID NO: 28197 - DNA, 25 bp, Homo sapien
ctggccgaagacgtcaaaggtgaga

SEQ ID NO: 28198 - DNA, 25 bp, Homo sapien
gccgaaatccgggtcgtctattcca

SEQ ID NO: 28199 - DNA, 25 bp, Homo sapien
gggacccgactcatccggtgcttgc

SEQ ID NO: 28200 - DNA, 25 bp, Homo sapien
gcgggcgctccattcctttaccgga

SEQ ID NO: 28201 - DNA, 25 bp, Homo sapien
aggccaaacaacctccgcgaggcta

SEQ ID NO: 28202 - DNA, 25 bp, Homo sapien
cggactcctcttccgttggatacgg

SEQ ID NO: 28203 - DNA, 25 bp, Homo sapien
ggtcggcgctctattcgccttccga

SEQ ID NO: 28204 - DNA, 25 bp, Homo sapien
tcgcgcccgttttcggagcttatta

SEQ ID NO: 28205 - DNA, 25 bp, Homo sapien
acctaggcggctgaggatgtcaatt

SEQ ID NO: 28206 - DNA, 25 bp, Homo sapien
tccgcagcttagtggaccttgacga

SEQ ID NO: 28207 - DNA, 25 bp, Homo sapien
tttaaccctgggaaagcgatgctcc

SEQ ID NO: 28208 - DNA, 25 bp, Homo sapien
ttatctcaggtagcccagaggtccg

SEQ ID NO: 28209 - DNA, 25 bp, Homo sapien
ctgcaatagaggttcctgcgccttg

SEQ ID NO: 28210 - DNA, 25 bp, Homo sapien
ccggggaacagacgatgaattcttt

SEQ ID NO: 28211 - DNA, 25 bp, Homo sapien
ggcagggacttttccagcaaggata

SEQ ID NO: 28212 - DNA, 25 bp, Homo sapien
cggcaggccatcagcagaatttata

SEQ ID NO: 28213 - DNA, 25 bp, Homo sapien
agcgttgggccttctgttgtatttc

SEQ ID NO: 28214 - DNA, 25 bp, Homo sapien
ctcgcgttgaggagaatttgtttta

SEQ ID NO: 28215 - DNA, 25 bp, Homo sapien
aagcgtttctctacctgtccatgca

SEQ ID NO: 28216 - DNA, 25 bp, Homo sapien
gtccatgcatctcgtaaatacagta

SEQ ID NO: 28217 - DNA, 25 bp, Homo sapien
agaatttatacccagggcgcgagcc

SEQ ID NO: 28218 - DNA, 25 bp, Homo sapien
gatggttcaaagcacccgcggtggc

SEQ ID NO: 28219 - DNA, 25 bp, Homo sapien
ccctaccctgcggaactggaggcaa

SEQ ID NO: 28220 - DNA, 25 bp, Homo sapien
gcccagggaggcaatgtctaatcta

SEQ ID NO: 28221 - DNA, 25 bp, Homo sapien
gccggcaatcagttccacgtctgtg

SEQ ID NO: 28222 - DNA, 25 bp, Homo sapien
gcaccgagtccttaagctgcttgta

SEQ ID NO: 28223 - DNA, 25 bp, Homo sapien
ggtacccagtacgtctgtgctttca

SEQ ID NO: 28224 - DNA, 25 bp, Homo sapien
gccttccgggacagtaggctcttaa

SEQ ID NO: 28225 - DNA, 25 bp, Homo sapien
tcagggagtcgctttgctaaaatgc

SEQ ID NO: 28226 - DNA, 25 bp, Homo sapien
gtagcctcccttgcagcacatctgg

SEQ ID NO: 28227 - DNA, 25 bp, Homo sapien
gctctgacggcctttcttgtgatga

SEQ ID NO: 28228 - DNA, 25 bp, Homo sapien
tgaagccatgtctccttgctcgctc

SEQ ID NO: 28229 - DNA, 25 bp, Homo sapien
tcctccttggattgggtgtaaggcc

SEQ ID NO: 28230 - DNA, 25 bp, Homo sapien
cccgcgggcaggaatgatgaagcca

SEQ ID NO: 28231 - DNA, 25 bp, Homo sapien
gtcccgtcttactgtgtgactgatg

SEQ ID NO: 28232 - DNA, 25 bp, Homo sapien
cgcgttgggctctgtgttgaataat

SEQ ID NO: 28233 - DNA, 25 bp, Homo sapien
gaaattagcagtcccgagctccgga

SEQ ID NO: 28234 - DNA, 25 bp, Homo sapien
gtgtttcgctctccacaccttcgga

SEQ ID NO: 28235 - DNA, 25 bp, Homo sapien
cacttctactccctgggcgtgcaga

SEQ ID NO: 28236 - DNA, 25 bp, Homo sapien
ggagtcttaagaagcgtacccaagc

SEQ ID NO: 28237 - DNA, 25 bp, Homo sapien
gctgctctgaagagacctcggcggc

SEQ ID NO: 28238 - DNA, 25 bp, Homo sapien
ccgcctgtagctgctggacccgagt

SEQ ID NO: 28239 - DNA, 25 bp, Homo sapien
caggatgaagttcgccgagcacctc

SEQ ID NO: 28240 - DNA, 25 bp, Homo sapien
ggaggaagcaatacatccagtatga

SEQ ID NO: 28241 - DNA, 25 bp, Homo sapien
tccagtatgaggtaccggcacggct

SEQ ID NO: 28242 - DNA, 25 bp, Homo sapien
tgcccgggcagactttgacccgctg

SEQ ID NO: 28243 - DNA, 25 bp, Homo sapien
taccatggcgatgacgtccagaggg

SEQ ID NO: 28244 - DNA, 25 bp, Homo sapien
gggtttccctcacgcctctggagag

SEQ ID NO: 28245 - DNA, 25 bp, Homo sapien
ctggagagcgggaaccaacgacctt

SEQ ID NO: 28246 - DNA, 25 bp, Homo sapien
acggacagctgatgccacttccttc

SEQ ID NO: 28247 - DNA, 25 bp, Homo sapien
cggcaaagccgtgaacggacagctg

SEQ ID NO: 28248 - DNA, 25 bp, Homo sapien
cacaaaaggcattcctcagcttcca

SEQ ID NO: 28249 - DNA, 25 bp, Homo sapien
cttgtccacacaaaaggcattcctc

SEQ ID NO: 28250 - DNA, 25 bp, Homo sapien
cttgacctcggaggaaacggctcta

SEQ ID NO: 28251 - DNA, 25 bp, Homo sapien
gaaacggctctacggagcgatggac

SEQ ID NO: 28252 - DNA, 25 bp, Homo sapien
ccgcgatcgggtatagcgaatcatc

SEQ ID NO: 28253 - DNA, 25 bp, Homo sapien
tgatgcgcccgccatgttctttctc

SEQ ID NO: 28254 - DNA, 25 bp, Homo sapien
gctcgtcgattaaaaccgcgatcgg

SEQ ID NO: 28255 - DNA, 25 bp, Homo sapien
tcttcattgcggagctcgtcgatta

SEQ ID NO: 28256 - DNA, 25 bp, Homo sapien
gtccagtacctgcacgtcttcattg

SEQ ID NO: 28257 - DNA, 25 bp, Homo sapien
cttcaagtttctgctacgagtccga

SEQ ID NO: 28258 - DNA, 25 bp, Homo sapien
agcaaggttactagagaggtacccg

SEQ ID NO: 28259 - DNA, 25 bp, Homo sapien
cgccacgctggtttagccgaagttg

SEQ ID NO: 28260 - DNA, 25 bp, Homo sapien
ctgtgccacggacgtcctcaggagc

SEQ ID NO: 28261 - DNA, 25 bp, Homo sapien
agggcacactgcacttactttggag

SEQ ID NO: 28262 - DNA, 25 bp, Homo sapien
cacttactttggagtagggatccgg

SEQ ID NO: 28263 - DNA, 25 bp, Homo sapien
ggatccgggaagttgaactcgttca

SEQ ID NO: 28264 - DNA, 25 bp, Homo sapien
gcacggtcagggtcccataggcgct

SEQ ID NO: 28265 - DNA, 25 bp, Homo sapien
cagagacaggacacgcggtgccagc

SEQ ID NO: 28266 - DNA, 25 bp, Homo sapien
gcccggcagtgcaaacgctgcttga

SEQ ID NO: 28267 - DNA, 25 bp, Homo sapien
aactcgttcagacagtgctccctgg

SEQ ID NO: 28268 - DNA, 25 bp, Homo sapien
gacctcgccgactacatcaacgggg

SEQ ID NO: 28269 - DNA, 25 bp, Homo sapien
tgctgagcaccgtgttgcaggccgc

SEQ ID NO: 28270 - DNA, 25 bp, Homo sapien
gggcacacgagcgattcctccagcg

SEQ ID NO: 28271 - DNA, 25 bp, Homo sapien
aagccgagttccgtcacctggagcg

SEQ ID NO: 28272 - DNA, 25 bp, Homo sapien
ctttgaggatgagtccgcccgcgaa

SEQ ID NO: 28273 - DNA, 25 bp, Homo sapien
gccgtcgcacgtgcgctttgaggat

SEQ ID NO: 28274 - DNA, 25 bp, Homo sapien
gcaggggacattccacaggcttgtg

SEQ ID NO: 28275 - DNA, 25 bp, Homo sapien
agcgattcctccagcggagagtcca

SEQ ID NO: 28276 - DNA, 25 bp, Homo sapien
cggcgagagatatccgcagctggca

SEQ ID NO: 28277 - DNA, 25 bp, Homo sapien
tcaggccactagaggcaacctcgca

SEQ ID NO: 28278 - DNA, 25 bp, Homo sapien
actagaggcaacctcgcagcgactc

SEQ ID NO: 28279 - DNA, 25 bp, Homo sapien
gtcgccagggccttcgtgccaaggc

SEQ ID NO: 28280 - DNA, 25 bp, Homo sapien
ctgggctcaccctgcctttgagaaa

SEQ ID NO: 28281 - DNA, 25 bp, Homo sapien
tgcctttgagaaacgcacggctggg

SEQ ID NO: 28282 - DNA, 25 bp, Homo sapien
gggcctactggtgcaccgcacggtc

SEQ ID NO: 28283 - DNA, 25 bp, Homo sapien
accaggaggcgactgtgccctcagc

SEQ ID NO: 28284 - DNA, 25 bp, Homo sapien
ctcagacgcctctgggcttgttgtg

SEQ ID NO: 28285 - DNA, 25 bp, Homo sapien
actcaatggacaatggagctcaccc

SEQ ID NO: 28286 - DNA, 25 bp, Homo sapien
ctacaaagctcaggagggccatttc

SEQ ID NO: 28287 - DNA, 25 bp, Homo sapien
ttttcctgcccagatgctgttttcg

SEQ ID NO: 28288 - DNA, 25 bp, Homo sapien
cgctccttcgaagcaagatcccatg

SEQ ID NO: 28289 - DNA, 25 bp, Homo sapien
cccatgctcgactagacggccagtg

SEQ ID NO: 28290 - DNA, 25 bp, Homo sapien
gcggacaagcgctccaaactcaatg

SEQ ID NO: 28291 - DNA, 25 bp, Homo sapien
tgtggtctcgccagtctgcggacaa

SEQ ID NO: 28292 - DNA, 25 bp, Homo sapien
acgaacgccgcctgaaacacgactt

SEQ ID NO: 28293 - DNA, 25 bp, Homo sapien
ggccaatcacgaacgccgcctgaaa

SEQ ID NO: 28294 - DNA, 25 bp, Homo sapien
ctcccgaagcgtcggagggcctgac

SEQ ID NO: 28295 - DNA, 25 bp, Homo sapien
cactggccgaatcccggactcgggc

SEQ ID NO: 28296 - DNA, 25 bp, Homo sapien
ctcgctcagcaccactggccgaatc

SEQ ID NO: 28297 - DNA, 25 bp, Homo sapien
cgcctgaaacacgacttccgcaccc

SEQ ID NO: 28298 - DNA, 25 bp, Homo sapien
gtccagcactcgctcagcaccactg

SEQ ID NO: 28299 - DNA, 25 bp, Homo sapien
gacggccgctggtccagcactcgct

SEQ ID NO: 28300 - DNA, 25 bp, Homo sapien
agcgctcggccgacactcacccttt

SEQ ID NO: 28301 - DNA, 25 bp, Homo sapien
gtcctccatggacatggcgtcccgg

SEQ ID NO: 28302 - DNA, 25 bp, Homo sapien
tgcccgcgccttagtctgggtgaag

SEQ ID NO: 28303 - DNA, 25 bp, Homo sapien
cgcgccttagtctgggtgaagccga

SEQ ID NO: 28304 - DNA, 25 bp, Homo sapien
cgcgcacaggccaggtgcacaggac

SEQ ID NO: 28305 - DNA, 25 bp, Homo sapien
ttcaccacaaagaaggggtcctcca

SEQ ID NO: 28306 - DNA, 25 bp, Homo sapien
actcaccctttcaccacaaagaagg

SEQ ID NO: 28307 - DNA, 25 bp, Homo sapien
agaaggggtcctccatggacatggc

SEQ ID NO: 28308 - DNA, 25 bp, Homo sapien
gccaagtctacctgagcgacccgtg

SEQ ID NO: 28309 - DNA, 25 bp, Homo sapien
tctcttcggagtcttaggtgatcga

SEQ ID NO: 28310 - DNA, 25 bp, Homo sapien
ccggaacttagagcagccgccgagt

SEQ ID NO: 28311 - DNA, 25 bp, Homo sapien
ggaggctcatcgcatcgtcagcatc

SEQ ID NO: 28312 - DNA, 25 bp, Homo sapien
cgtcagcatctctctgggcaagatc

SEQ ID NO: 28313 - DNA, 25 bp, Homo sapien
gcaagatctacaactcgcgggtcca

SEQ ID NO: 28314 - DNA, 25 bp, Homo sapien
gctgcataagaacctcctggtctcg

SEQ ID NO: 28315 - DNA, 25 bp, Homo sapien
cgcgtcaccagagtcgtttctcttc

SEQ ID NO: 28316 - DNA, 25 bp, Homo sapien
gctgcgacctgggacataacaatgc

SEQ ID NO: 28317 - DNA, 25 bp, Homo sapien
cgagagtattgcaggacagcggcaa

SEQ ID NO: 28318 - DNA, 25 bp, Homo sapien
ggaacggcgcagttatttccagccc

SEQ ID NO: 28319 - DNA, 25 bp, Homo sapien
ttcctcgtcgtcatgggaacggcgc

SEQ ID NO: 28320 - DNA, 25 bp, Homo sapien
gcagagcaccgtccgctaaggtctc

SEQ ID NO: 28321 - DNA, 25 bp, Homo sapien
aagagctggcttcattttcccagtc

SEQ ID NO: 28322 - DNA, 25 bp, Homo sapien
gcctctttgttcacgggatgcctcg

SEQ ID NO: 28323 - DNA, 25 bp, Homo sapien
ccagtagggtgaagcaggcctcttt

SEQ ID NO: 28324 - DNA, 25 bp, Homo sapien
gttttcgcaagccttggggcctctg

SEQ ID NO: 28325 - DNA, 25 bp, Homo sapien
ccttggagatccgtagttggcccta

SEQ ID NO: 28326 - DNA, 25 bp, Homo sapien
ttggccctaaccttctcggaatctc

SEQ ID NO: 28327 - DNA, 25 bp, Homo sapien
gtccgttcctttgcaacttctgtgg

SEQ ID NO: 28328 - DNA, 25 bp, Homo sapien
atcccgctcgaggatgcagggttct

SEQ ID NO: 28329 - DNA, 25 bp, Homo sapien
tgagcttgcagcgaagtttccgtga

SEQ ID NO: 28330 - DNA, 25 bp, Homo sapien
ttccgtgaaggaaactgcatgtgcc

SEQ ID NO: 28331 - DNA, 25 bp, Homo sapien
cacttagggtgtgagtgttgcgccc

SEQ ID NO: 28332 - DNA, 25 bp, Homo sapien
cgcgacatcatcaaggcccacgagg

SEQ ID NO: 28333 - DNA, 25 bp, Homo sapien
gcccacgaggcgcacaagatgcaga

SEQ ID NO: 28334 - DNA, 25 bp, Homo sapien
cgagatgcgtggactgagcccagac

SEQ ID NO: 28335 - DNA, 25 bp, Homo sapien
tggactgagcccagaccgcaggctg

SEQ ID NO: 28336 - DNA, 25 bp, Homo sapien
agcagtgcgctctgctcgaggccga

SEQ ID NO: 28337 - DNA, 25 bp, Homo sapien
tggcttcgacaacttcttccaggtg

SEQ ID NO: 28338 - DNA, 25 bp, Homo sapien
gacaacttcttccaggtgcaggagg

SEQ ID NO: 28339 - DNA, 25 bp, Homo sapien
ggcctcatcgagcagcgcgacatca

SEQ ID NO: 28340 - DNA, 25 bp, Homo sapien
ggctgctaccctttggccacataaa

SEQ ID NO: 28341 - DNA, 25 bp, Homo sapien
cggcaccgaacagggcacagcactg

SEQ ID NO: 28342 - DNA, 25 bp, Homo sapien
aggccctcgctctcttgcggagact

SEQ ID NO: 28343 - DNA, 25 bp, Homo sapien
ggggactcttcactggacctttgca

SEQ ID NO: 28344 - DNA, 25 bp, Homo sapien
atcttctccagtgctccgccgaggg

SEQ ID NO: 28345 - DNA, 25 bp, Homo sapien
gaggctcggctgcaacctgttcctc

SEQ ID NO: 28346 - DNA, 25 bp, Homo sapien
cgcggatcgctgttgcatgctgatc

SEQ ID NO: 28347 - DNA, 25 bp, Homo sapien
gcctctctcttctcggcattacttg

SEQ ID NO: 28348 - DNA, 25 bp, Homo sapien
cagacatagctttggctggcaaacg

SEQ ID NO: 28349 - DNA, 25 bp, Homo sapien
ctttggctggcaaacggtgtccgcc

SEQ ID NO: 28350 - DNA, 25 bp, Homo sapien
gcgccacagctaagaccctcccggg

SEQ ID NO: 28351 - DNA, 25 bp, Homo sapien
cgcacacgtactcggtccggtgctc

SEQ ID NO: 28352 - DNA, 25 bp, Homo sapien
cctcgactagccatggcaagcctgg

SEQ ID NO: 28353 - DNA, 25 bp, Homo sapien
gaaaaaagaattcggcaccctatga

SEQ ID NO: 28354 - DNA, 25 bp, Homo sapien
tcggcaccctatgaagtcggtgagc

SEQ ID NO: 28355 - DNA, 25 bp, Homo sapien
tcggtgagcgcgcagacatagcttt

SEQ ID NO: 28356 - DNA, 25 bp, Homo sapien
tgttcggccgcgatcacctttgtgt

SEQ ID NO: 28357 - DNA, 25 bp, Homo sapien
gtgtcttctgtctgtttaaacctca

SEQ ID NO: 28358 - DNA, 25 bp, Homo sapien
ttaaacctcaggatggctcgcttcg

SEQ ID NO: 28359 - DNA, 25 bp, Homo sapien
ccagagcaggaaccggcaaggaacc

SEQ ID NO: 28360 - DNA, 25 bp, Homo sapien
gcggccgcctacaagcagacgaaag

SEQ ID NO: 28361 - DNA, 25 bp, Homo sapien
ggcgcggactatggctttgtacaac

SEQ ID NO: 28362 - DNA, 25 bp, Homo sapien
attcccgtccggcagaactgtttca

SEQ ID NO: 28363 - DNA, 25 bp, Homo sapien
ggctctgagtctccgtgtgtctttc

SEQ ID NO: 28364 - DNA, 25 bp, Homo sapien
cttcgtgcctcagaaacagcgcctg

SEQ ID NO: 28365 - DNA, 25 bp, Homo sapien
gctcctttcaggaacgctccgatgg

SEQ ID NO: 28366 - DNA, 25 bp, Homo sapien
ccaggtagccttcgtgcctcagaaa

SEQ ID NO: 28367 - DNA, 25 bp, Homo sapien
aaaccagctcaacgtgcgcgggcct

SEQ ID NO: 28368 - DNA, 25 bp, Homo sapien
aaaccctcgaagaggcgccatggca

SEQ ID NO: 28369 - DNA, 25 bp, Homo sapien
ggcacccacggcatacttgccagtg

SEQ ID NO: 28370 - DNA, 25 bp, Homo sapien
gctccgatggctcccaggtagcctt

SEQ ID NO: 28371 - DNA, 25 bp, Homo sapien
atacttgccagtggaatcgcgcctg

SEQ ID NO: 28372 - DNA, 25 bp, Homo sapien
caccacgtggtcaccttttttcacg

SEQ ID NO: 28373 - DNA, 25 bp, Homo sapien
caggcacgtttcctacaccacgtgg

SEQ ID NO: 28374 - DNA, 25 bp, Homo sapien
gcccagccttggagctgagaaacca

SEQ ID NO: 28375 - DNA, 25 bp, Homo sapien
tcagcacctcgggtacttctggccg

SEQ ID NO: 28376 - DNA, 25 bp, Homo sapien
agccatcgttggcacctcggacagc

SEQ ID NO: 28377 - DNA, 25 bp, Homo sapien
gcaaagtgtgccagcagccatcgtt

SEQ ID NO: 28378 - DNA, 25 bp, Homo sapien
tttctttgcggtagacaaagccgcc

SEQ ID NO: 28379 - DNA, 25 bp, Homo sapien
cacgttttctcttccgctgcaaaga

SEQ ID NO: 28380 - DNA, 25 bp, Homo sapien
tctctccacctgctgatggaagcga

SEQ ID NO: 28381 - DNA, 25 bp, Homo sapien
agctctggagagcaacaatgcttgc

SEQ ID NO: 28382 - DNA, 25 bp, Homo sapien
tacagctccctgattcgacacgcgg

SEQ ID NO: 28383 - DNA, 25 bp, Homo sapien
tggcagatgcccaacgggcactatc

SEQ ID NO: 28384 - DNA, 25 bp, Homo sapien
acaatgcttgcctgaccgagtcttc

SEQ ID NO: 28385 - DNA, 25 bp, Homo sapien
gactcccacgcctcagactgtggtg

SEQ ID NO: 28386 - DNA, 25 bp, Homo sapien
ctcactttcgaagcagccgtggcta

SEQ ID NO: 28387 - DNA, 25 bp, Homo sapien
tggctactagcctgggccgttccaa

SEQ ID NO: 28388 - DNA, 25 bp, Homo sapien
agcggagcaggcagcgctttctgcc

SEQ ID NO: 28389 - DNA, 25 bp, Homo sapien
tccaggagaccactccgggcgggat

SEQ ID NO: 28390 - DNA, 25 bp, Homo sapien
gccgtacctttgcttaccgcgagtg

SEQ ID NO: 28391 - DNA, 25 bp, Homo sapien
cgcggcccatcagcgaagatcgctg

SEQ ID NO: 28392 - DNA, 25 bp, Homo sapien
cagcgaagatcgctgagcggcgccc

SEQ ID NO: 28393 - DNA, 25 bp, Homo sapien
ggagagcaccctacatccgggagcc

SEQ ID NO: 28394 - DNA, 25 bp, Homo sapien
cgcccgcccgaggagagaggatcca

SEQ ID NO: 28395 - DNA, 25 bp, Homo sapien
gctttctgcccgctgagtgggtcag

SEQ ID NO: 28396 - DNA, 25 bp, Homo sapien
tgctgttccgcgcttttgccaggac

SEQ ID NO: 28397 - DNA, 25 bp, Homo sapien
cgcagtcagcgcacttgaaaggcct

SEQ ID NO: 28398 - DNA, 25 bp, Homo sapien
cactgcgtgcaaggaaagggcctct

SEQ ID NO: 28399 - DNA, 25 bp, Homo sapien
gggagtaggccttcccgcatagctc

SEQ ID NO: 28400 - DNA, 25 bp, Homo sapien
gcactcggcacagaggaatcccttc

SEQ ID NO: 28401 - DNA, 25 bp, Homo sapien
cgcctggttctgtactttcctgctg

SEQ ID NO: 28402 - DNA, 25 bp, Homo sapien
gcatagctcgcacgcgtagcgcttg

SEQ ID NO: 28403 - DNA, 25 bp, Homo sapien
cagcgacagcggcttgttgaaggtc

SEQ ID NO: 28404 - DNA, 25 bp, Homo sapien
cgcaatcgaggcgtctcaaccatcg

SEQ ID NO: 28405 - DNA, 25 bp, Homo sapien
tcaaccatcgccagaaccaggacga

SEQ ID NO: 28406 - DNA, 25 bp, Homo sapien
accaggacgattgctccgaaggccc

SEQ ID NO: 28407 - DNA, 25 bp, Homo sapien
aagcgccttgtttgcgctccacagg

SEQ ID NO: 28408 - DNA, 25 bp, Homo sapien
gcgcttcggccgcaagtagtgaaaa

SEQ ID NO: 28409 - DNA, 25 bp, Homo sapien
ggaggagcactcatgccggatctca

SEQ ID NO: 28410 - DNA, 25 bp, Homo sapien
agaggaggccgcagtactgctcaca

SEQ ID NO: 28411 - DNA, 25 bp, Homo sapien
ggctctccattgttcggtcacattg

SEQ ID NO: 28412 - DNA, 25 bp, Homo sapien
tagtcaactgcggttgggtttagca

SEQ ID NO: 28413 - DNA, 25 bp, Homo sapien
gtttagcagcctgcaagcgcccaga

SEQ ID NO: 28414 - DNA, 25 bp, Homo sapien
ctgagcggccgctgctttaaatccc

SEQ ID NO: 28415 - DNA, 25 bp, Homo sapien
ggcactgctgaccaatcggagggtg

SEQ ID NO: 28416 - DNA, 25 bp, Homo sapien
gccgggtgcaactttcgcggcagct

SEQ ID NO: 28417 - DNA, 25 bp, Homo sapien
aactttcgcggcagctggagcacgc

SEQ ID NO: 28418 - DNA, 25 bp, Homo sapien
gaaaagcggcaagagaattggcacg

SEQ ID NO: 28419 - DNA, 25 bp, Homo sapien
cgcggtagcaggtgctagtcaactg

SEQ ID NO: 28420 - DNA, 25 bp, Homo sapien
ctggccctctcaggctgcggagaaa

SEQ ID NO: 28421 - DNA, 25 bp, Homo sapien
gggctctgtggcaccatcagcagct

SEQ ID NO: 28422 - DNA, 25 bp, Homo sapien
ccatcagcagcttgcgcaggacaca

SEQ ID NO: 28423 - DNA, 25 bp, Homo sapien
aggacacagacgtcggctcacgcgc

SEQ ID NO: 28424 - DNA, 25 bp, Homo sapien
cagtcaccaggaacgcggcgttttg

SEQ ID NO: 28425 - DNA, 25 bp, Homo sapien
ctccggaaggcgaagctcttccagg

SEQ ID NO: 28426 - DNA, 25 bp, Homo sapien
ggctctccaggactcagtggtttcg

SEQ ID NO: 28427 - DNA, 25 bp, Homo sapien
atgccctgctccgaagctcttgtga

SEQ ID NO: 28428 - DNA, 25 bp, Homo sapien
tcacaacgcagaaccacgagatagt

SEQ ID NO: 28429 - DNA, 25 bp, Homo sapien
tgggattctccgtacgcctcggaaa

SEQ ID NO: 28430 - DNA, 25 bp, Homo sapien
cggcgtcaacccgaagagacctgaa

SEQ ID NO: 28431 - DNA, 25 bp, Homo sapien
gccgccagttcggatgcttccgatc

SEQ ID NO: 28432 - DNA, 25 bp, Homo sapien
cgccggagtcacttcagcccatgtt

SEQ ID NO: 28433 - DNA, 25 bp, Homo sapien
cagcccatgttgttcaggtgacacc

SEQ ID NO: 28434 - DNA, 25 bp, Homo sapien
gactccagtgtgcaaaacgtttcgg

SEQ ID NO: 28435 - DNA, 25 bp, Homo sapien
agccctgcgcaagagaaggaaaatt

SEQ ID NO: 28436 - DNA, 25 bp, Homo sapien
tgtggcgctcgttttacgtcacttc

SEQ ID NO: 28437 - DNA, 25 bp, Homo sapien
gtgcaaaagcaagacgcgcactttc

SEQ ID NO: 28438 - DNA, 25 bp, Homo sapien
cccggtggatgataactatgagtgc

SEQ ID NO: 28439 - DNA, 25 bp, Homo sapien
tcactagttgatgacgcacccatgg

SEQ ID NO: 28440 - DNA, 25 bp, Homo sapien
gtgctctgatccagggtttcgctca

SEQ ID NO: 28441 - DNA, 25 bp, Homo sapien
gctcgcgcaggcactgcagattctc

SEQ ID NO: 28442 - DNA, 25 bp, Homo sapien
cgtgggacgatcaagaacaatctcc

SEQ ID NO: 28443 - DNA, 25 bp, Homo sapien
acccatggcgcctggttgtctagac

SEQ ID NO: 28444 - DNA, 25 bp, Homo sapien
tgagctgataacctcggccaacgcg

SEQ ID NO: 28445 - DNA, 25 bp, Homo sapien
tctctgttgtctcggtagaaggcca

SEQ ID NO: 28446 - DNA, 25 bp, Homo sapien
tccgcagccggctttgttgcgaagc

SEQ ID NO: 28447 - DNA, 25 bp, Homo sapien
gcctctagcaggcaaagcgcgcttc

SEQ ID NO: 28448 - DNA, 25 bp, Homo sapien
agggagagcgcctttggctagtata

SEQ ID NO: 28449 - DNA, 25 bp, Homo sapien
ccatgcgagttgctgtgcgtttctc

SEQ ID NO: 28450 - DNA, 25 bp, Homo sapien
ggcctagggctcttcattcattcaa

SEQ ID NO: 28451 - DNA, 25 bp, Homo sapien
agtcacacacggtcctaagagctgg

SEQ ID NO: 28452 - DNA, 25 bp, Homo sapien
ggtgccgcacacaccagaaggtgcc

SEQ ID NO: 28453 - DNA, 25 bp, Homo sapien
cgacgagcttccgaccgtagtcttc

SEQ ID NO: 28454 - DNA, 25 bp, Homo sapien
gtagtcttcctgtcccggatccgct

SEQ ID NO: 28455 - DNA, 25 bp, Homo sapien
tgcagcacttcgtcgcaatacagcg

SEQ ID NO: 28456 - DNA, 25 bp, Homo sapien
ccctcatacgggacacgcagactgg

SEQ ID NO: 28457 - DNA, 25 bp, Homo sapien
tcatcctcaggcactggcagcaggg

SEQ ID NO: 28458 - DNA, 25 bp, Homo sapien
gaggcagccgttggccacttttccc

SEQ ID NO: 28459 - DNA, 25 bp, Homo sapien
ctctggccaataggcgctctgcgct

SEQ ID NO: 28460 - DNA, 25 bp, Homo sapien
agcatgtccacattgctgtgctggc

SEQ ID NO: 28461 - DNA, 25 bp, Homo sapien
ccaagcccatggcaggaggcacgcg

SEQ ID NO: 28462 - DNA, 25 bp, Homo sapien
taaatgggccctcatcgcgtgggac

SEQ ID NO: 28463 - DNA, 25 bp, Homo sapien
ggtgcaggagctcgtcaaacttctg

SEQ ID NO: 28464 - DNA, 25 bp, Homo sapien
gacttcccgaagctgctggcgatga

SEQ ID NO: 28465 - DNA, 25 bp, Homo sapien
cggtggccgacttcccgaagctgct

SEQ ID NO: 28466 - DNA, 25 bp, Homo sapien
cccagaaaccaagcccatggcagga

SEQ ID NO: 28467 - DNA, 25 bp, Homo sapien
agctgctggcgatgaggttcccgct

SEQ ID NO: 28468 - DNA, 25 bp, Homo sapien
ttcaacgtgactgtggtggccacca

SEQ ID NO: 28469 - DNA, 25 bp, Homo sapien
cagggttgggctttctcctcgccca

SEQ ID NO: 28470 - DNA, 25 bp, Homo sapien
caggctcaagcagcgaagcggcctc

SEQ ID NO: 28471 - DNA, 25 bp, Homo sapien
cccaggcagccatggacgagtgcac

SEQ ID NO: 28472 - DNA, 25 bp, Homo sapien
tgcatgcccgagttcgtcaacgccg

SEQ ID NO: 28473 - DNA, 25 bp, Homo sapien
gtcaacgccgccttcaacgtgactg

SEQ ID NO: 28474 - DNA, 25 bp, Homo sapien
gtggccaccaacacgtgtgggactc

SEQ ID NO: 28475 - DNA, 25 bp, Homo sapien
gactccgcccgaggaatactgtgtg

SEQ ID NO: 28476 - DNA, 25 bp, Homo sapien
cctgagtccaaaatgaaggggccga

SEQ ID NO: 28477 - DNA, 25 bp, Homo sapien
tgacgcctcggaaacgcagtctgcg

SEQ ID NO: 28478 - DNA, 25 bp, Homo sapien
gagctttcggcccatcctaaacaaa

SEQ ID NO: 28479 - DNA, 25 bp, Homo sapien
tttgcgaatcccaggcacatacatg

SEQ ID NO: 28480 - DNA, 25 bp, Homo sapien
gcgggcaatacacggcccacaattc

SEQ ID NO: 28481 - DNA, 25 bp, Homo sapien
acagtcattcgcacattcgtacaca

SEQ ID NO: 28482 - DNA, 25 bp, Homo sapien
aggactcaccaaacatctgaatgtg

SEQ ID NO: 28483 - DNA, 25 bp, Homo sapien
gttcgatcgccctggaaaacacagg

SEQ ID NO: 28484 - DNA, 25 bp, Homo sapien
tcgttgatcccaaaagggagcgcta

SEQ ID NO: 28485 - DNA, 25 bp, Homo sapien
cctgggaatccattggccaagggga

SEQ ID NO: 28486 - DNA, 25 bp, Homo sapien
tgaccctgtccgcacacatcggtta

SEQ ID NO: 28487 - DNA, 25 bp, Homo sapien
ggcagctgcctatccaatccgattg

SEQ ID NO: 28488 - DNA, 25 bp, Homo sapien
ctccaagagtctcccagcgtgcatg

SEQ ID NO: 28489 - DNA, 25 bp, Homo sapien
ttcgagtcactctctacgcgcgagg

SEQ ID NO: 28490 - DNA, 25 bp, Homo sapien
acaggcgccacacagctcgttgatc

SEQ ID NO: 28491 - DNA, 25 bp, Homo sapien
caggcgctgctgaaatctcgcgaga

SEQ ID NO: 28492 - DNA, 25 bp, Homo sapien
agaaacgcttttctgcggtccagtc

SEQ ID NO: 28493 - DNA, 25 bp, Homo sapien
actcgggtgcaacctgaggaatctg

SEQ ID NO: 28494 - DNA, 25 bp, Homo sapien
gcaggcttccaagagtgggaccctc

SEQ ID NO: 28495 - DNA, 25 bp, Homo sapien
cgatcccaaagagacaggttaagcc

SEQ ID NO: 28496 - DNA, 25 bp, Homo sapien
cgacactgtgttcttcgacatccca

SEQ ID NO: 28497 - DNA, 25 bp, Homo sapien
cgaccagcggcaaaggcctcttctt

SEQ ID NO: 28498 - DNA, 25 bp, Homo sapien
cgtccgattgcgtcacgtgattctc

SEQ ID NO: 28499 - DNA, 25 bp, Homo sapien
ttggcgctgcctctacctcagcaag

SEQ ID NO: 28500 - DNA, 25 bp, Homo sapien
gcccagcagacattgcgttggcctc

SEQ ID NO: 28501 - DNA, 25 bp, Homo sapien
gggcgcatcatgcagcgttcgcgca

SEQ ID NO: 28502 - DNA, 25 bp, Homo sapien
ccgagcagggcgcatcatgcagcgt

SEQ ID NO: 28503 - DNA, 25 bp, Homo sapien
agcagacattgcgttggcctccgag

SEQ ID NO: 28504 - DNA, 25 bp, Homo sapien
ggctgagcccagcagacattgcgtt

SEQ ID NO: 28505 - DNA, 25 bp, Homo sapien
cgctccctttgtggcccgagtcgcg

SEQ ID NO: 28506 - DNA, 25 bp, Homo sapien
aggagtctgctcctcgcttgctcgc

SEQ ID NO: 28507 - DNA, 25 bp, Homo sapien
agacattgcgttggcctccgagcag

SEQ ID NO: 28508 - DNA, 25 bp, Homo sapien
acgttccatctgtcgtatctacatg

SEQ ID NO: 28509 - DNA, 25 bp, Homo sapien
agatggccatcctgctcttggggta

SEQ ID NO: 28510 - DNA, 25 bp, Homo sapien
tgtgtgcgccagattttccgcgtgc

SEQ ID NO: 28511 - DNA, 25 bp, Homo sapien
aattcgcaggctaccctccagagct

SEQ ID NO: 28512 - DNA, 25 bp, Homo sapien
tggccaaccgcagttacgttccatc

SEQ ID NO: 28513 - DNA, 25 bp, Homo sapien
caccggaaagtcagagcagcgcact

SEQ ID NO: 28514 - DNA, 25 bp, Homo sapien
ctaggagagctaggagcacatttcc

SEQ ID NO: 28515 - DNA, 25 bp, Homo sapien
tctacatgggaatacggcgacaggc

SEQ ID NO: 28516 - DNA, 25 bp, Homo sapien
gagcgcggcgattccgagccgaccc

SEQ ID NO: 28517 - DNA, 25 bp, Homo sapien
ctcaccctaaggtcaggaggcgcga

SEQ ID NO: 28518 - DNA, 25 bp, Homo sapien
tgggcactcaccctaaggtcaggag

SEQ ID NO: 28519 - DNA, 25 bp, Homo sapien
ctgaggacgcctggatgggcactca

SEQ ID NO: 28520 - DNA, 25 bp, Homo sapien
caccctaaggtcaggaggcgcgaga

SEQ ID NO: 28521 - DNA, 25 bp, Homo sapien
tgcaccacgggagcgccgcaccggc

SEQ ID NO: 28522 - DNA, 25 bp, Homo sapien
agcctcggggaagcggaacccacag

SEQ ID NO: 28523 - DNA, 25 bp, Homo sapien
ctggatgggcactcaccctaaggtc

SEQ ID NO: 28524 - DNA, 25 bp, Homo sapien
ctaaaaccacgagcagccctgagca

SEQ ID NO: 28525 - DNA, 25 bp, Homo sapien
tggtggccgctccctaaaaccacga

SEQ ID NO: 28526 - DNA, 25 bp, Homo sapien
gcaccgtgtggccggacttaagact

SEQ ID NO: 28527 - DNA, 25 bp, Homo sapien
gaaggcaccgtgtggccggacttaa

SEQ ID NO: 28528 - DNA, 25 bp, Homo sapien
ggcggttcagccactgcagcacaca

SEQ ID NO: 28529 - DNA, 25 bp, Homo sapien
agacgcacggcggttcagccactgc

SEQ ID NO: 28530 - DNA, 25 bp, Homo sapien
aaaccacgagcagccctgagcacag

SEQ ID NO: 28531 - DNA, 25 bp, Homo sapien
tcagcgaccagtgaggcacagagca

SEQ ID NO: 28532 - DNA, 25 bp, Homo sapien
aggtaagtgtgagccattgcctgct

SEQ ID NO: 28533 - DNA, 25 bp, Homo sapien
ccgcgaacgcccaaggtaagtgtga

SEQ ID NO: 28534 - DNA, 25 bp, Homo sapien
ccgcccaagtgacaggcccgggaag

SEQ ID NO: 28535 - DNA, 25 bp, Homo sapien
gccgctgcttctttcacactttagt

SEQ ID NO: 28536 - DNA, 25 bp, Homo sapien
ctgcgcgccgcgctcagttactgga

SEQ ID NO: 28537 - DNA, 25 bp, Homo sapien
tcagttactggagagctggccgcgc

SEQ ID NO: 28538 - DNA, 25 bp, Homo sapien
ggcgggaggcttgccaccttcagcc

SEQ ID NO: 28539 - DNA, 25 bp, Homo sapien
cacactttagttgggagctgcgcgc

SEQ ID NO: 28540 - DNA, 25 bp, Homo sapien
tccttgctgaccaggcatcgcgagc

SEQ ID NO: 28541 - DNA, 25 bp, Homo sapien
caggatctctgccttcggttgaagc

SEQ ID NO: 28542 - DNA, 25 bp, Homo sapien
atggaggatgcgctctcctctgtcc

SEQ ID NO: 28543 - DNA, 25 bp, Homo sapien
tcgcgagcagatgaatcctctgggc

SEQ ID NO: 28544 - DNA, 25 bp, Homo sapien
tcaggctgtcaggacctgattttcc

SEQ ID NO: 28545 - DNA, 25 bp, Homo sapien
tgattttccctggtaagccttcgtc

SEQ ID NO: 28546 - DNA, 25 bp, Homo sapien
aagccttcgtcaggcaggtggcctc

SEQ ID NO: 28547 - DNA, 25 bp, Homo sapien
ctcggaaaatgtcagggcgcaagct

SEQ ID NO: 28548 - DNA, 25 bp, Homo sapien
gccgtagagcctcaggaccaatgga

SEQ ID NO: 28549 - DNA, 25 bp, Homo sapien
gacacaccgcgcctggcttcaagga

SEQ ID NO: 28550 - DNA, 25 bp, Homo sapien
tcaaggagcctgcacatgtcaccgg

SEQ ID NO: 28551 - DNA, 25 bp, Homo sapien
gagccgttccaatcgcgacaggaga

SEQ ID NO: 28552 - DNA, 25 bp, Homo sapien
ctgttgtcagcctcaccgagaaacc

SEQ ID NO: 28553 - DNA, 25 bp, Homo sapien
ccggtgagacacattgctggacgct

SEQ ID NO: 28554 - DNA, 25 bp, Homo sapien
cccagctttccggtgtcgtagtcta

SEQ ID NO: 28555 - DNA, 25 bp, Homo sapien
tgtcgtagtctaggaaaccgcctcc

SEQ ID NO: 28556 - DNA, 25 bp, Homo sapien
aaccaggcggcgctctgaggcagaa

SEQ ID NO: 28557 - DNA, 25 bp, Homo sapien
ctacaaagggtcttgaagggacacg

SEQ ID NO: 28558 - DNA, 25 bp, Homo sapien
gcgcaggttcctacaaagggtcttg

SEQ ID NO: 28559 - DNA, 25 bp, Homo sapien
ctctgaggcagaatcctgggcaaga

SEQ ID NO: 28560 - DNA, 25 bp, Homo sapien
gagctggctgttcgcgccagccttc

SEQ ID NO: 28561 - DNA, 25 bp, Homo sapien
ccctagtggagctggctgttcgcgc

SEQ ID NO: 28562 - DNA, 25 bp, Homo sapien
ctgtgcgcaccctgccctagtggag

SEQ ID NO: 28563 - DNA, 25 bp, Homo sapien
aggagcctaggaccgtggcgacctc

SEQ ID NO: 28564 - DNA, 25 bp, Homo sapien
cggcgaacccggctctgaaattaag

SEQ ID NO: 28565 - DNA, 25 bp, Homo sapien
agcaaacttccttcgagaggcgaga

SEQ ID NO: 28566 - DNA, 25 bp, Homo sapien
atgacattgtcctttttgccgctga

SEQ ID NO: 28567 - DNA, 25 bp, Homo sapien
ttctgctttagctgccgggaatccc

SEQ ID NO: 28568 - DNA, 25 bp, Homo sapien
ctcttggcggccagttcagaaaccg

SEQ ID NO: 28569 - DNA, 25 bp, Homo sapien
ctcagaactcagtccagggcaggta

SEQ ID NO: 28570 - DNA, 25 bp, Homo sapien
gtacctcggatgtaagcgcacttgc

SEQ ID NO: 28571 - DNA, 25 bp, Homo sapien
cccgctgctagctcctggaggttga

SEQ ID NO: 28572 - DNA, 25 bp, Homo sapien
acccagtcagcgaagcgccgggatt

SEQ ID NO: 28573 - DNA, 25 bp, Homo sapien
gacggagtggaatgcgagttttttc

SEQ ID NO: 28574 - DNA, 25 bp, Homo sapien
ggttctcattgttcccgtgtcttcg

SEQ ID NO: 28575 - DNA, 25 bp, Homo sapien
ataccagagtcttgctccggccgcg

SEQ ID NO: 28576 - DNA, 25 bp, Homo sapien
ccgcggcagctgataccagagtctt

SEQ ID NO: 28577 - DNA, 25 bp, Homo sapien
tgcggaagctgaggctcgccatatt

SEQ ID NO: 28578 - DNA, 25 bp, Homo sapien
tgtatttcccgagctccattgcgga

SEQ ID NO: 28579 - DNA, 25 bp, Homo sapien
cacgcgtctactcggcagcgttgca

SEQ ID NO: 28580 - DNA, 25 bp, Homo sapien
ccaccacaaactgcgcagaagcgta

SEQ ID NO: 28581 - DNA, 25 bp, Homo sapien
gcctcggaggaagtaaatgcaaatc

SEQ ID NO: 28582 - DNA, 25 bp, Homo sapien
aagccagaggcagcgattccagatg

SEQ ID NO: 28583 - DNA, 25 bp, Homo sapien
ccagtgaccaaatcctgttagtaga

SEQ ID NO: 28584 - DNA, 25 bp, Homo sapien
ggcgggatgcgtgcaacagacaaaa

SEQ ID NO: 28585 - DNA, 25 bp, Homo sapien
atgcccacagggctggatccaagga

SEQ ID NO: 28586 - DNA, 25 bp, Homo sapien
cagagaactgacgtgaatgcccaca

SEQ ID NO: 28587 - DNA, 25 bp, Homo sapien
cacccaggatacactgcgcagtctg

SEQ ID NO: 28588 - DNA, 25 bp, Homo sapien
tcgttcgtagaaccagcgcgtatta

SEQ ID NO: 28589 - DNA, 25 bp, Homo sapien
aggcgtccgttcctgacagcaagaa

SEQ ID NO: 28590 - DNA, 25 bp, Homo sapien
gcgccagtgtagcaaaggggctcca

SEQ ID NO: 28591 - DNA, 25 bp, Homo sapien
cgtctccctcatctgtcgttcgtag

SEQ ID NO: 28592 - DNA, 25 bp, Homo sapien
tcacaggcgagctccataaagatcc

SEQ ID NO: 28593 - DNA, 25 bp, Homo sapien
tccgtctcgaatccatctgcaaatc

SEQ ID NO: 28594 - DNA, 25 bp, Homo sapien
gccgagtctcgagagctcttccaga

SEQ ID NO: 28595 - DNA, 25 bp, Homo sapien
acttggcaaccatggcagcgctgga

SEQ ID NO: 28596 - DNA, 25 bp, Homo sapien
cccgcactccgccacaggctgtcca

SEQ ID NO: 28597 - DNA, 25 bp, Homo sapien
gttgggaacctcagtcgctggccca

SEQ ID NO: 28598 - DNA, 25 bp, Homo sapien
aaagttgggaacctcagtcgctggc

SEQ ID NO: 28599 - DNA, 25 bp, Homo sapien
cagtggaaagttgggaacctcagtc

SEQ ID NO: 28600 - DNA, 25 bp, Homo sapien
cgtgagctgcaaacagtggaaagtt

SEQ ID NO: 28601 - DNA, 25 bp, Homo sapien
gctcgtgagctgcaaacagtggaaa

SEQ ID NO: 28602 - DNA, 25 bp, Homo sapien
tcgctcgtgagctgcaaacagtgga

SEQ ID NO: 28603 - DNA, 25 bp, Homo sapien
tcgtcgctcgtgagctgcaaacagt

SEQ ID NO: 28604 - DNA, 25 bp, Homo sapien
ggtggcgccacatacgtactcgtca

SEQ ID NO: 28605 - DNA, 25 bp, Homo sapien
ttcttttccgggagcccaatgctgc

SEQ ID NO: 28606 - DNA, 25 bp, Homo sapien
aacccgagctcagaggctatccctg

SEQ ID NO: 28607 - DNA, 25 bp, Homo sapien
agccgttggaagctacgaaccctgg

SEQ ID NO: 28608 - DNA, 25 bp, Homo sapien
cacgctctctatggcgcccagaagg

SEQ ID NO: 28609 - DNA, 25 bp, Homo sapien
tccctgaagagctggtgaccttacc

SEQ ID NO: 28610 - DNA, 25 bp, Homo sapien
accctcagcggcagcgtttcagcaa

SEQ ID NO: 28611 - DNA, 25 bp, Homo sapien
tgggaaatcgagtccaccctcagcg

SEQ ID NO: 28612 - DNA, 25 bp, Homo sapien
gagcgcttcggtcacaggcaaagca

SEQ ID NO: 28613 - DNA, 25 bp, Homo sapien
ccgcacctgtgctgaggatcttgtc

SEQ ID NO: 28614 - DNA, 25 bp, Homo sapien
tcttgtccgccattttctgcaggaa

SEQ ID NO: 28615 - DNA, 25 bp, Homo sapien
ggtcccagtacttgtcgttgtaatc

SEQ ID NO: 28616 - DNA, 25 bp, Homo sapien
gtcgttgtaatcctcctggatcctc

SEQ ID NO: 28617 - DNA, 25 bp, Homo sapien
agctcgtgctcctcgaccataaact

SEQ ID NO: 28618 - DNA, 25 bp, Homo sapien
aggcgacacttctccaggccggcag

SEQ ID NO: 28619 - DNA, 25 bp, Homo sapien
tcactaaaaccacagggagcgcttc

SEQ ID NO: 28620 - DNA, 25 bp, Homo sapien
gttgtttgtcggatgctcctggtga

SEQ ID NO: 28621 - DNA, 25 bp, Homo sapien
ccgctaggatcaataaacggcctga

SEQ ID NO: 28622 - DNA, 25 bp, Homo sapien
gcctgagaaacatgcctggcgcgtt

SEQ ID NO: 28623 - DNA, 25 bp, Homo sapien
aagctccttgcgaggacagcggatc

SEQ ID NO: 28624 - DNA, 25 bp, Homo sapien
aggacagcggatcccgcccagtttt

SEQ ID NO: 28625 - DNA, 25 bp, Homo sapien
cggtgtgtccatgccgtgattggtt

SEQ ID NO: 28626 - DNA, 25 bp, Homo sapien
gcggttcgaaagtccagccagtaga

SEQ ID NO: 28627 - DNA, 25 bp, Homo sapien
tccagccagtagacaggccttccgg

SEQ ID NO: 28628 - DNA, 25 bp, Homo sapien
acaggtttccgccagatgtcttttc

SEQ ID NO: 28629 - DNA, 25 bp, Homo sapien
agcgcttccgagagccagttctgga

SEQ ID NO: 28630 - DNA, 25 bp, Homo sapien
tggtcgctaaccgagagaaccttcc

SEQ ID NO: 28631 - DNA, 25 bp, Homo sapien
gacgctcactgcaagtcgtatgaca

SEQ ID NO: 28632 - DNA, 25 bp, Homo sapien
gccgtgtctggtctgtacgtcttta

SEQ ID NO: 28633 - DNA, 25 bp, Homo sapien
tctccaggaatctgagcggccctga

SEQ ID NO: 28634 - DNA, 25 bp, Homo sapien
gcccatgtgacgaaatgactgtttc

SEQ ID NO: 28635 - DNA, 25 bp, Homo sapien
agttctggactgatcgccttggatg

SEQ ID NO: 28636 - DNA, 25 bp, Homo sapien
gaccaatccgcgtcctcttgaggcg

SEQ ID NO: 28637 - DNA, 25 bp, Homo sapien
gctatgtggcccgagtgcgcaagaa

SEQ ID NO: 28638 - DNA, 25 bp, Homo sapien
tcagcaaaaggtcgtgcgcagcggc

SEQ ID NO: 28639 - DNA, 25 bp, Homo sapien
tcctgccagggaatcgccgctctgg

SEQ ID NO: 28640 - DNA, 25 bp, Homo sapien
tcttcattcgaaatcaggccactgc

SEQ ID NO: 28641 - DNA, 25 bp, Homo sapien
tcagggaacgcgctcaaaaaaggaa

SEQ ID NO: 28642 - DNA, 25 bp, Homo sapien
cgaggcctcataaatgctgcgacgc

SEQ ID NO: 28643 - DNA, 25 bp, Homo sapien
cggccgccacgcttcagcaaaaggt

SEQ ID NO: 28644 - DNA, 25 bp, Homo sapien
tggttctcaccgaatcctttaatga

SEQ ID NO: 28645 - DNA, 25 bp, Homo sapien
ttgcagcacccgtagcggattcgga

SEQ ID NO: 28646 - DNA, 25 bp, Homo sapien
ttcacagcgccgaggaggcaacatc

SEQ ID NO: 28647 - DNA, 25 bp, Homo sapien
tcaggctgccttcttttgtcgtttc

SEQ ID NO: 28648 - DNA, 25 bp, Homo sapien
cccagggacgcgcaaattctgacca

SEQ ID NO: 28649 - DNA, 25 bp, Homo sapien
aggctgggcaaacgccgcgaaacta

SEQ ID NO: 28650 - DNA, 25 bp, Homo sapien
accagcatcgcggtagggacatcct

SEQ ID NO: 28651 - DNA, 25 bp, Homo sapien
cctttaatgagctcggtgaagaccc

SEQ ID NO: 28652 - DNA, 25 bp, Homo sapien
ccacgtgtaaacatcctttagaggg

SEQ ID NO: 28653 - DNA, 25 bp, Homo sapien
tccagcgagtgccacccacgtgtaa

SEQ ID NO: 28654 - DNA, 25 bp, Homo sapien
gagcccggatctgcagcgagctcta

SEQ ID NO: 28655 - DNA, 25 bp, Homo sapien
cgccaaatcatggtcagagcccgga

SEQ ID NO: 28656 - DNA, 25 bp, Homo sapien
gttatgactcagagcccacgcgcta

SEQ ID NO: 28657 - DNA, 25 bp, Homo sapien
ctcctgaagtcagcacagccgcgga

SEQ ID NO: 28658 - DNA, 25 bp, Homo sapien
tcgagcgcctctgcgtgttatgact

SEQ ID NO: 28659 - DNA, 25 bp, Homo sapien
cacttgcttatctcgagggttcatc

SEQ ID NO: 28660 - DNA, 25 bp, Homo sapien
ctgcggctacctatgtcgatggcga

SEQ ID NO: 28661 - DNA, 25 bp, Homo sapien
gcttttaaaccagaggcacgagttc

SEQ ID NO: 28662 - DNA, 25 bp, Homo sapien
gagctcgtcctcgtctcgaccagaa

SEQ ID NO: 28663 - DNA, 25 bp, Homo sapien
atcagcgaccctgcggactacaagg

SEQ ID NO: 28664 - DNA, 25 bp, Homo sapien
ggcgttctccaggttgcggaagatc

SEQ ID NO: 28665 - DNA, 25 bp, Homo sapien
ccattttgaaagtgcccggccagct

SEQ ID NO: 28666 - DNA, 25 bp, Homo sapien
ggcagcgtgatgctcttgtccagac

SEQ ID NO: 28667 - DNA, 25 bp, Homo sapien
ccgatgtggccgaagacataaaatt

SEQ ID NO: 28668 - DNA, 25 bp, Homo sapien
ctccgtgcccagctgaagtctggga

SEQ ID NO: 28669 - DNA, 25 bp, Homo sapien
aaatccttgccgaattccatcccgg

SEQ ID NO: 28670 - DNA, 25 bp, Homo sapien
gttcgttaaatactcagtgcacgtg

SEQ ID NO: 28671 - DNA, 25 bp, Homo sapien
gaagtgctgacccactgctcaggta

SEQ ID NO: 28672 - DNA, 25 bp, Homo sapien
actgctcaggtacgcgcgcacctga

SEQ ID NO: 28673 - DNA, 25 bp, Homo sapien
tggtcgcacccgagacagttcgtta

SEQ ID NO: 28674 - DNA, 25 bp, Homo sapien
gccttgccttacagcgcggggtcct

SEQ ID NO: 28675 - DNA, 25 bp, Homo sapien
cagcgctcagcgtttcagcgagtga

SEQ ID NO: 28676 - DNA, 25 bp, Homo sapien
gaagcactttccttaaaggcagttg

SEQ ID NO: 28677 - DNA, 25 bp, Homo sapien
ctactgttccctcgggcgggcttgc

SEQ ID NO: 28678 - DNA, 25 bp, Homo sapien
agagggcagcctcccggctactgtt

SEQ ID NO: 28679 - DNA, 25 bp, Homo sapien
aaggcagttgccagatcctcccaga

SEQ ID NO: 28680 - DNA, 25 bp, Homo sapien
cgccgcttgatggtgaagcactttc

SEQ ID NO: 28681 - DNA, 25 bp, Homo sapien
cttcgccgaaaaagacgcgcggtgc

SEQ ID NO: 28682 - DNA, 25 bp, Homo sapien
agttgccagatcctcccagagggca

SEQ ID NO: 28683 - DNA, 25 bp, Homo sapien
aaaagacgcgcggtgcctagaaaga

SEQ ID NO: 28684 - DNA, 25 bp, Homo sapien
ctcttggagttgcatgtacacgacg

SEQ ID NO: 28685 - DNA, 25 bp, Homo sapien
cgccgtagaggatgggaggacccat

SEQ ID NO: 28686 - DNA, 25 bp, Homo sapien
ctgctcttggagttgcatgtacacg

SEQ ID NO: 28687 - DNA, 25 bp, Homo sapien
gcgaaccgcacctgcgatccgattg

SEQ ID NO: 28688 - DNA, 25 bp, Homo sapien
cgatccgattgtccggggcacgccg

SEQ ID NO: 28689 - DNA, 25 bp, Homo sapien
acctgcgatccgattgtccggggca

SEQ ID NO: 28690 - DNA, 25 bp, Homo sapien
ggaggacccatgaggcgctagcctg

SEQ ID NO: 28691 - DNA, 25 bp, Homo sapien
ctaggggccaaggagcgaaccgcac

SEQ ID NO: 28692 - DNA, 25 bp, Homo sapien
ggagaccctagctacacgccgaatc

SEQ ID NO: 28693 - DNA, 25 bp, Homo sapien
ccgcgagatccgagtctctccatta

SEQ ID NO: 28694 - DNA, 25 bp, Homo sapien
attaacatgctttcctcgggcgggc

SEQ ID NO: 28695 - DNA, 25 bp, Homo sapien
tcttcaggaatagagagcgtccctc

SEQ ID NO: 28696 - DNA, 25 bp, Homo sapien
agcagaagagctttcccaggcccgg

SEQ ID NO: 28697 - DNA, 25 bp, Homo sapien
aatgcgcttgtagtcggcgatcccg

SEQ ID NO: 28698 - DNA, 25 bp, Homo sapien
agcctccaagccctcctgagagaga

SEQ ID NO: 28699 - DNA, 25 bp, Homo sapien
cgccgctttacgcatgctccttaag

SEQ ID NO: 28700 - DNA, 25 bp, Homo sapien
cttgcaaatcaggaagtcgccggga

SEQ ID NO: 28701 - DNA, 25 bp, Homo sapien
gctcctgcaccttcttgcaaatcag

SEQ ID NO: 28702 - DNA, 25 bp, Homo sapien
tgaggcctctcagttcctgcgaccg

SEQ ID NO: 28703 - DNA, 25 bp, Homo sapien
gtcgacaaggcgctagtggcctctc

SEQ ID NO: 28704 - DNA, 25 bp, Homo sapien
cacttggtcctgcagtccatggtta

SEQ ID NO: 28705 - DNA, 25 bp, Homo sapien
gccggtagccgccaccaaagctgag

SEQ ID NO: 28706 - DNA, 25 bp, Homo sapien
cagagcctttctgtgacagcagcgg

SEQ ID NO: 28707 - DNA, 25 bp, Homo sapien
ccgtgcggctcgcaagtcggagact

SEQ ID NO: 28708 - DNA, 25 bp, Homo sapien
gcgcgcacatacagcagcacgtttg

SEQ ID NO: 28709 - DNA, 25 bp, Homo sapien
ctccggagggatcccaatgagctga

SEQ ID NO: 28710 - DNA, 25 bp, Homo sapien
gcatgcccagtgcaagccgctagtt

SEQ ID NO: 28711 - DNA, 25 bp, Homo sapien
gcgcgcccagttgtttccataggaa

SEQ ID NO: 28712 - DNA, 25 bp, Homo sapien
ccgcctgtttgtcaacgtgtgtgtg

SEQ ID NO: 28713 - DNA, 25 bp, Homo sapien
aagccgctagtttggctccagtcta

SEQ ID NO: 28714 - DNA, 25 bp, Homo sapien
ctccagtctaggtttccagtaagtg

SEQ ID NO: 28715 - DNA, 25 bp, Homo sapien
cgtttgcctaaaagccgtgtgagtg

SEQ ID NO: 28716 - DNA, 25 bp, Homo sapien
agcgatggccacgagctgcccaaga

SEQ ID NO: 28717 - DNA, 25 bp, Homo sapien
gatttgttttccgatcagcgtccga

SEQ ID NO: 28718 - DNA, 25 bp, Homo sapien
gaaacctgtgtctgtcttgagtatg

SEQ ID NO: 28719 - DNA, 25 bp, Homo sapien
gcagaggcaaaggttgctggatacc

SEQ ID NO: 28720 - DNA, 25 bp, Homo sapien
cttcggtgagcgaagagttaaccgc

SEQ ID NO: 28721 - DNA, 25 bp, Homo sapien
tcagcgtccgagctaaactccggtc

SEQ ID NO: 28722 - DNA, 25 bp, Homo sapien
tctgccctgctaacgagggaaactg

SEQ ID NO: 28723 - DNA, 25 bp, Homo sapien
ctctgggtaagagctgggttccgac

SEQ ID NO: 28724 - DNA, 25 bp, Homo sapien
tggcggcagcatcttttaggtacaa

SEQ ID NO: 28725 - DNA, 25 bp, Homo sapien
cctgcgaccaggtaatgtggcctcc

SEQ ID NO: 28726 - DNA, 25 bp, Homo sapien
tctatgcaagcaccagctggcggca

SEQ ID NO: 28727 - DNA, 25 bp, Homo sapien
cggtgggtgaacaatcaatggctta

SEQ ID NO: 28728 - DNA, 25 bp, Homo sapien
gcctcaagacgctctgggctttatg

SEQ ID NO: 28729 - DNA, 25 bp, Homo sapien
actcccgagtgctgggttcctgata

SEQ ID NO: 28730 - DNA, 25 bp, Homo sapien
gaacgccgacctcgagcgcagaata

SEQ ID NO: 28731 - DNA, 25 bp, Homo sapien
ctttatgaggttcagttaccgccga

SEQ ID NO: 28732 - DNA, 25 bp, Homo sapien
gaggtatctaggatgtgccaggaca

SEQ ID NO: 28733 - DNA, 25 bp, Homo sapien
ccgggcggctcttgtgaggtatcta

SEQ ID NO: 28734 - DNA, 25 bp, Homo sapien
aaagccgcgttggttcctgccgcag

SEQ ID NO: 28735 - DNA, 25 bp, Homo sapien
cgcagcgctgtgcttcggactccta

SEQ ID NO: 28736 - DNA, 25 bp, Homo sapien
gcctctggccgtttgaatgaatcga

SEQ ID NO: 28737 - DNA, 25 bp, Homo sapien
tattgtggacactttttaatggggc

SEQ ID NO: 28738 - DNA, 25 bp, Homo sapien
acacaggcaccgcagtcctgggaaa

SEQ ID NO: 28739 - DNA, 25 bp, Homo sapien
cctcctctctgggtaaagccgcgtt

SEQ ID NO: 28740 - DNA, 25 bp, Homo sapien
tggctatcctccgtcgcagctgatt

SEQ ID NO: 28741 - DNA, 25 bp, Homo sapien
tgaccggacctgtggagtagattcc

SEQ ID NO: 28742 - DNA, 25 bp, Homo sapien
tctgttaaaccaagccgactccctg

SEQ ID NO: 28743 - DNA, 25 bp, Homo sapien
ttccgacgcgactgggtcatttcca

SEQ ID NO: 28744 - DNA, 25 bp, Homo sapien
ttccagttctctagacgctcggggc

SEQ ID NO: 28745 - DNA, 25 bp, Homo sapien
ctcagggtttctggcatcccgactc

SEQ ID NO: 28746 - DNA, 25 bp, Homo sapien
gacagcactacgtttagcgccagga

SEQ ID NO: 28747 - DNA, 25 bp, Homo sapien
gggtggtggcattctcttctacaga

SEQ ID NO: 28748 - DNA, 25 bp, Homo sapien
ggagagtatccaccgcagctgagct

SEQ ID NO: 28749 - DNA, 25 bp, Homo sapien
agactctgtctaccacctgagctgc

SEQ ID NO: 28750 - DNA, 25 bp, Homo sapien
acttcgagaccctcttgcaaggaga

SEQ ID NO: 28751 - DNA, 25 bp, Homo sapien
tcatgcgcgcccgagactctgtcta

SEQ ID NO: 28752 - DNA, 25 bp, Homo sapien
tacttcaacggtacgggcaccgtgc

SEQ ID NO: 28753 - DNA, 25 bp, Homo sapien
cgctgggagtggacatcgtcaatta

SEQ ID NO: 28754 - DNA, 25 bp, Homo sapien
ttacaactcaggtgtgcctcctatc

SEQ ID NO: 28755 - DNA, 25 bp, Homo sapien
tgctccacttgcaacaagactctga

SEQ ID NO: 28756 - DNA, 25 bp, Homo sapien
gcgcgctcacctttgctgtgcttca

SEQ ID NO: 28757 - DNA, 25 bp, Homo sapien
ccgctggaagtggtacagcagcttc

SEQ ID NO: 28758 - DNA, 25 bp, Homo sapien
tagccttcgctgtagtcctggtgca

SEQ ID NO: 28759 - DNA, 25 bp, Homo sapien
gtgcttcaggtagctgacagccatc

SEQ ID NO: 28760 - DNA, 25 bp, Homo sapien
gccgggcgagtctggtacttactcg

SEQ ID NO: 28761 - DNA, 25 bp, Homo sapien
gcgcacgctaaattgcctgtgaatt

SEQ ID NO: 28762 - DNA, 25 bp, Homo sapien
tgcctgtgaattggcgcgggcacaa

SEQ ID NO: 28763 - DNA, 25 bp, Homo sapien
tcctgcaggcaccacgagtagcctt

SEQ ID NO: 28764 - DNA, 25 bp, Homo sapien
tatctctcgcggattggtgaagtcc

SEQ ID NO: 28765 - DNA, 25 bp, Homo sapien
cgctaggcctgacaaccggaagaga

SEQ ID NO: 28766 - DNA, 25 bp, Homo sapien
ccgtctgtcaggattcggcagcagc

SEQ ID NO: 28767 - DNA, 25 bp, Homo sapien
tggcgacgtcggttatttatctctc

SEQ ID NO: 28768 - DNA, 25 bp, Homo sapien
cggcggcaacaggtctttggtttcg

SEQ ID NO: 28769 - DNA, 25 bp, Homo sapien
ttacactcctgacagcggcggcagc

SEQ ID NO: 28770 - DNA, 25 bp, Homo sapien
ggatgccgggatgtttacactcctg

SEQ ID NO: 28771 - DNA, 25 bp, Homo sapien
agcgacttcggctccagtagggaaa

SEQ ID NO: 28772 - DNA, 25 bp, Homo sapien
tccagccctgggctcggagaaggcc

SEQ ID NO: 28773 - DNA, 25 bp, Homo sapien
gtactgacggccttcgcagccaatg

SEQ ID NO: 28774 - DNA, 25 bp, Homo sapien
caatgcgcagccaggacctcgcgtt

SEQ ID NO: 28775 - DNA, 25 bp, Homo sapien
cgcagccaggacctcgcgttcggga

SEQ ID NO: 28776 - DNA, 25 bp, Homo sapien
gagggcgggtacttcctactccagc

SEQ ID NO: 28777 - DNA, 25 bp, Homo sapien
ctactccagccctgggctcggagaa

SEQ ID NO: 28778 - DNA, 25 bp, Homo sapien
cgggcctgaaattccgctgggtgcc

SEQ ID NO: 28779 - DNA, 25 bp, Homo sapien
tccggagtactgacggccttcgcag

SEQ ID NO: 28780 - DNA, 25 bp, Homo sapien
cggggaaagatgtgtctgccacacc

SEQ ID NO: 28781 - DNA, 25 bp, Homo sapien
cttgaaccgctcctgaaaatcctga

SEQ ID NO: 28782 - DNA, 25 bp, Homo sapien
ctccgaaatgcggtgctgaaccacg

SEQ ID NO: 28783 - DNA, 25 bp, Homo sapien
ggactgcgcttctccggctcatcaa

SEQ ID NO: 28784 - DNA, 25 bp, Homo sapien
tgccacaccttttgcgagcccagga

SEQ ID NO: 28785 - DNA, 25 bp, Homo sapien
cgagccatcatccttcgtaattgca

SEQ ID NO: 28786 - DNA, 25 bp, Homo sapien
cgccgagcgtggataaaatatgcta

SEQ ID NO: 28787 - DNA, 25 bp, Homo sapien
ggtcgagttgattgctcccagctca

SEQ ID NO: 28788 - DNA, 25 bp, Homo sapien
tgggcttccggaccgacacggatcc

SEQ ID NO: 28789 - DNA, 25 bp, Homo sapien
ccttgcggagccgaaccagagggcc

SEQ ID NO: 28790 - DNA, 25 bp, Homo sapien
ttgaatctgtgctgcccgtgtccag

SEQ ID NO: 28791 - DNA, 25 bp, Homo sapien
ggtcgccttgtcatgctgcccaaag

SEQ ID NO: 28792 - DNA, 25 bp, Homo sapien
gactggctcgatcgcatggggaaca

SEQ ID NO: 28793 - DNA, 25 bp, Homo sapien
acagggccagatgccggaaaacatg

SEQ ID NO: 28794 - DNA, 25 bp, Homo sapien
aacatgcaaggtaaggaggcgccgc

SEQ ID NO: 28795 - DNA, 25 bp, Homo sapien
tcttttcgccggagttgaatctgtg

SEQ ID NO: 28796 - DNA, 25 bp, Homo sapien
cgccgttcccgctttctcccgcgag

SEQ ID NO: 28797 - DNA, 25 bp, Homo sapien
ctttgctaggctggccttcccgtgg

SEQ ID NO: 28798 - DNA, 25 bp, Homo sapien
agccgggccagtagctttgctaggc

SEQ ID NO: 28799 - DNA, 25 bp, Homo sapien
cctggagcatcccagtcgctggggc

SEQ ID NO: 28800 - DNA, 25 bp, Homo sapien
ctgcacagtctgagcggccgggact

SEQ ID NO: 28801 - DNA, 25 bp, Homo sapien
cctccctcccagtgggagatgggtt

SEQ ID NO: 28802 - DNA, 25 bp, Homo sapien
ctcgccgcgtgtgacagcccaggga

SEQ ID NO: 28803 - DNA, 25 bp, Homo sapien
agtagctttgctaggctggccttcc

SEQ ID NO: 28804 - DNA, 25 bp, Homo sapien
cccttgcgcgaacttgaaaggactg

SEQ ID NO: 28805 - DNA, 25 bp, Homo sapien
cgggcctgtgatcccggaacgcttc

SEQ ID NO: 28806 - DNA, 25 bp, Homo sapien
atcccggaacgcttcctgccatccc

SEQ ID NO: 28807 - DNA, 25 bp, Homo sapien
cgccgtgcgggttgtgatccgttac

SEQ ID NO: 28808 - DNA, 25 bp, Homo sapien
agagttcagggctggtgcactctgc

SEQ ID NO: 28809 - DNA, 25 bp, Homo sapien
aaatacgtagctggagggcgtgcgc

SEQ ID NO: 28810 - DNA, 25 bp, Homo sapien
cctgtagtcgccctaccgcggaggg

SEQ ID NO: 28811 - DNA, 25 bp, Homo sapien
ttgcgcgaacttgaaaggactggga

SEQ ID NO: 28812 - DNA, 25 bp, Homo sapien
cctagaccgaaactggggaagagtg

SEQ ID NO: 28813 - DNA, 25 bp, Homo sapien
agggaactttgtgcgcctctctgag

SEQ ID NO: 28814 - DNA, 25 bp, Homo sapien
tgcgcctctctgaggccctagcttt

SEQ ID NO: 28815 - DNA, 25 bp, Homo sapien
ccaactttgagggaactttgtgcgc

SEQ ID NO: 28816 - DNA, 25 bp, Homo sapien
tgaggccctagctttccaaggcacc

SEQ ID NO: 28817 - DNA, 25 bp, Homo sapien
cgcctccgtaggagcccagaaagac

SEQ ID NO: 28818 - DNA, 25 bp, Homo sapien
atccactacatggtcccgggacaga

SEQ ID NO: 28819 - DNA, 25 bp, Homo sapien
gcccagaaagacgatccactacatg

SEQ ID NO: 28820 - DNA, 25 bp, Homo sapien
cctgcaaacgccactgattaactta

SEQ ID NO: 28821 - DNA, 25 bp, Homo sapien
gcgcgcagtccttagccgcaaagtg

SEQ ID NO: 28822 - DNA, 25 bp, Homo sapien
tgacggccctttccgaccgaagagc

SEQ ID NO: 28823 - DNA, 25 bp, Homo sapien
agaacaagtcatcactgcggcgata

SEQ ID NO: 28824 - DNA, 25 bp, Homo sapien
cgcgctcccatacttgacctgtgtg

SEQ ID NO: 28825 - DNA, 25 bp, Homo sapien
cgggaaataccggatcaggcacttc

SEQ ID NO: 28826 - DNA, 25 bp, Homo sapien
ctttttagctgcgaagacgccttcg

SEQ ID NO: 28827 - DNA, 25 bp, Homo sapien
cccttcctgtgcatagtttgtcatc

SEQ ID NO: 28828 - DNA, 25 bp, Homo sapien
cgtccacggtgaagacgcggatgcc

SEQ ID NO: 28829 - DNA, 25 bp, Homo sapien
cgaacgctagggcagagcacatttt

SEQ ID NO: 28830 - DNA, 25 bp, Homo sapien
agagcacattttcgcacaggcagcg

SEQ ID NO: 28831 - DNA, 25 bp, Homo sapien
gtcgattgagttgaagtcggacacg

SEQ ID NO: 28832 - DNA, 25 bp, Homo sapien
gctgcagccattggtgagcagtatg

SEQ ID NO: 28833 - DNA, 25 bp, Homo sapien
tgttgccctgtggtaggcgatgcat

SEQ ID NO: 28834 - DNA, 25 bp, Homo sapien
cgatctcctctacacgaacgctagg

SEQ ID NO: 28835 - DNA, 25 bp, Homo sapien
cttgccctggatcttgtcgattgag

SEQ ID NO: 28836 - DNA, 25 bp, Homo sapien
tgagatgcaacctcaccgtggcgca

SEQ ID NO: 28837 - DNA, 25 bp, Homo sapien
aagcggctaatgaacgtcttgggtc

SEQ ID NO: 28838 - DNA, 25 bp, Homo sapien
tgggtcggtttcctcaaaatccagc

SEQ ID NO: 28839 - DNA, 25 bp, Homo sapien
ccggtgagcacgatccgaagcctta

SEQ ID NO: 28840 - DNA, 25 bp, Homo sapien
ccgctgaaactaccagaggttaaag

SEQ ID NO: 28841 - DNA, 25 bp, Homo sapien
gaatctttctgccaacaaccgctga

SEQ ID NO: 28842 - DNA, 25 bp, Homo sapien
taacgcactgtagcccgaatctttc

SEQ ID NO: 28843 - DNA, 25 bp, Homo sapien
gaagccttatcccataacgcactgt

SEQ ID NO: 28844 - DNA, 25 bp, Homo sapien
tgcctgtcaatcactggggccgttg

SEQ ID NO: 28845 - DNA, 25 bp, Homo sapien
gtgtctgctgggaactcctcgaccc

SEQ ID NO: 28846 - DNA, 25 bp, Homo sapien
aaaagcctcccgtgtactgcgcagc

SEQ ID NO: 28847 - DNA, 25 bp, Homo sapien
acaatggaattaaaagcctcccgtg

SEQ ID NO: 28848 - DNA, 25 bp, Homo sapien
aataacgccgtcctctccacaatgg

SEQ ID NO: 28849 - DNA, 25 bp, Homo sapien
ctcctggacccaccggcaatactta

SEQ ID NO: 28850 - DNA, 25 bp, Homo sapien
ggcacgcatggtcctgcgactcttc

SEQ ID NO: 28851 - DNA, 25 bp, Homo sapien
gcggggatttggagccctgctaaaa

SEQ ID NO: 28852 - DNA, 25 bp, Homo sapien
aggcacgcgcgatgccctttgtcac

SEQ ID NO: 28853 - DNA, 25 bp, Homo sapien
gagcagcgcatcgatccgatcagtg

SEQ ID NO: 28854 - DNA, 25 bp, Homo sapien
tcgatccgatcagtgctgggagctg

SEQ ID NO: 28855 - DNA, 25 bp, Homo sapien
caaagggaggctgtagcatgaaggc

SEQ ID NO: 28856 - DNA, 25 bp, Homo sapien
cgcgatgccctttgtcaccagggaa

SEQ ID NO: 28857 - DNA, 25 bp, Homo sapien
cctttgtcaccagggaaggccgcca

SEQ ID NO: 28858 - DNA, 25 bp, Homo sapien
cgagggcagagcagcgcatcgatcc

SEQ ID NO: 28859 - DNA, 25 bp, Homo sapien
ctgcacggacgtgtggacaaaggga

SEQ ID NO: 28860 - DNA, 25 bp, Homo sapien
cgccgacctggaatgctgaggaact

SEQ ID NO: 28861 - DNA, 25 bp, Homo sapien
ccagaaggccgcaatttgaatgggc

SEQ ID NO: 28862 - DNA, 25 bp, Homo sapien
cacgggccgagaggccctgaagtcc

SEQ ID NO: 28863 - DNA, 25 bp, Homo sapien
tcctcgggttctgctaaagcgtgga

SEQ ID NO: 28864 - DNA, 25 bp, Homo sapien
ctccggtagccgtctctgaatgctg

SEQ ID NO: 28865 - DNA, 25 bp, Homo sapien
gggactggagctaagaccacccgcc

SEQ ID NO: 28866 - DNA, 25 bp, Homo sapien
tcgcctgtagggaaagcgtccgcac

SEQ ID NO: 28867 - DNA, 25 bp, Homo sapien
gtcccagcagagacgctgccttgcg

SEQ ID NO: 28868 - DNA, 25 bp, Homo sapien
cggagcgtagagtagaatccacttc

SEQ ID NO: 28869 - DNA, 25 bp, Homo sapien
gcgggaaggctcctcgcgttttcca

SEQ ID NO: 28870 - DNA, 25 bp, Homo sapien
ctggtggtaaatctcggaactggtc

SEQ ID NO: 28871 - DNA, 25 bp, Homo sapien
gggcacgtttgggaatcctcttgga

SEQ ID NO: 28872 - DNA, 25 bp, Homo sapien
cctcttggaagaatttacgtaatcg

SEQ ID NO: 28873 - DNA, 25 bp, Homo sapien
tacgtaatcgaatgggctgggactg

SEQ ID NO: 28874 - DNA, 25 bp, Homo sapien
ttggaccgtccggaaagaagcagga

SEQ ID NO: 28875 - DNA, 25 bp, Homo sapien
cttcacgtcacggagctgctaggag

SEQ ID NO: 28876 - DNA, 25 bp, Homo sapien
gccacattcctatgcccgggagcgg

SEQ ID NO: 28877 - DNA, 25 bp, Homo sapien
cccgatggtttgagcttgcttctcc

SEQ ID NO: 28878 - DNA, 25 bp, Homo sapien
caccttcgccgtcagcaagggagga

SEQ ID NO: 28879 - DNA, 25 bp, Homo sapien
ccaagcccgtgtgactaaaccgaga

SEQ ID NO: 28880 - DNA, 25 bp, Homo sapien
cacaacgtgattgttgaaggctccc

SEQ ID NO: 28881 - DNA, 25 bp, Homo sapien
tggcggggacattttccacaacgtg

SEQ ID NO: 28882 - DNA, 25 bp, Homo sapien
tgattttgacgttttccgctgctgc

SEQ ID NO: 28883 - DNA, 25 bp, Homo sapien
gcctgtgagccgcagtgattttgac

SEQ ID NO: 28884 - DNA, 25 bp, Homo sapien
aacgccgctgctcttggagaggtca

SEQ ID NO: 28885 - DNA, 25 bp, Homo sapien
cgcggaaccgcttactgctgcagct

SEQ ID NO: 28886 - DNA, 25 bp, Homo sapien
cgcaacagcgtgactacagggtatg

SEQ ID NO: 28887 - DNA, 25 bp, Homo sapien
ctgcgggaaccattttacgacaacg

SEQ ID NO: 28888 - DNA, 25 bp, Homo sapien
ctccgtagagaaagagcgtgcgtgc

SEQ ID NO: 28889 - DNA, 25 bp, Homo sapien
cggtcgtgcccttgtcatctcttag

SEQ ID NO: 28890 - DNA, 25 bp, Homo sapien
gaggtacccggaactccacgagtga

SEQ ID NO: 28891 - DNA, 25 bp, Homo sapien
ttttccagaaagcttggccacgccc

SEQ ID NO: 28892 - DNA, 25 bp, Homo sapien
tggcgcgaaggatcagctcagcctc

SEQ ID NO: 28893 - DNA, 25 bp, Homo sapien
tgcctggccttcgtcaacagctgcg

SEQ ID NO: 28894 - DNA, 25 bp, Homo sapien
cttcgccatcgagagcacgtttgtg

SEQ ID NO: 28895 - DNA, 25 bp, Homo sapien
ggaggaactcgctgcgcatcatctt

SEQ ID NO: 28896 - DNA, 25 bp, Homo sapien
tggtcgtcaccctcttctgctactg

SEQ ID NO: 28897 - DNA, 25 bp, Homo sapien
ttcggcgatggcctctgcaagctca

SEQ ID NO: 28898 - DNA, 25 bp, Homo sapien
gtggataccttcgtgctgcacctgg

SEQ ID NO: 28899 - DNA, 25 bp, Homo sapien
acgacagttccgtgttccgttgccg

SEQ ID NO: 28900 - DNA, 25 bp, Homo sapien
cagccagccggagttcagccagcgg

SEQ ID NO: 28901 - DNA, 25 bp, Homo sapien
gcgggtacgtcgtcactcccgcgtg

SEQ ID NO: 28902 - DNA, 25 bp, Homo sapien
aagagagaagcttcgtcccgcctgg

SEQ ID NO: 28903 - DNA, 25 bp, Homo sapien
cggcactgggaccaagagagaagct

SEQ ID NO: 28904 - DNA, 25 bp, Homo sapien
ggtctccaggaatgaaaactggccc

SEQ ID NO: 28905 - DNA, 25 bp, Homo sapien
ctttcattcttccacttaggggtct

SEQ ID NO: 28906 - DNA, 25 bp, Homo sapien
ttcccttcagccagccggagttcag

SEQ ID NO: 28907 - DNA, 25 bp, Homo sapien
ccacttaggggtctccaggaatgaa

SEQ ID NO: 28908 - DNA, 25 bp, Homo sapien
gtgccagattcctgctttcccgcga

SEQ ID NO: 28909 - DNA, 25 bp, Homo sapien
agattcctgctttcccgcgaccaag

SEQ ID NO: 28910 - DNA, 25 bp, Homo sapien
actcctgctcagaagacagtggctc

SEQ ID NO: 28911 - DNA, 25 bp, Homo sapien
gacagtggctctgacgtctccagca

SEQ ID NO: 28912 - DNA, 25 bp, Homo sapien
gtggctctgacgtctccagcatctc

SEQ ID NO: 28913 - DNA, 25 bp, Homo sapien
ctcactacacggtgacagtgccaga

SEQ ID NO: 28914 - DNA, 25 bp, Homo sapien
cctcccaagacccatcgtcaccgcg

SEQ ID NO: 28915 - DNA, 25 bp, Homo sapien
ctacacggtgacagtgccagattcc

SEQ ID NO: 28916 - DNA, 25 bp, Homo sapien
actctctagaagcttagtcctgcac

SEQ ID NO: 28917 - DNA, 25 bp, Homo sapien
cgttcatggcttcactctctagaag

SEQ ID NO: 28918 - DNA, 25 bp, Homo sapien
gatgtagttctggatcagcgcacca

SEQ ID NO: 28919 - DNA, 25 bp, Homo sapien
cggcgcagggactcgttcatggctt

SEQ ID NO: 28920 - DNA, 25 bp, Homo sapien
gatcagcgcaccaatggcctcattg

SEQ ID NO: 28921 - DNA, 25 bp, Homo sapien
tgccacagcccttggcgtcacctgg

SEQ ID NO: 28922 - DNA, 25 bp, Homo sapien
cgtagctcctcgatctcccggatgt

SEQ ID NO: 28923 - DNA, 25 bp, Homo sapien
gctcctcgatctcccggatgtagtt

SEQ ID NO: 28924 - DNA, 25 bp, Homo sapien
tgacggccaccttgacgcagcagtc

SEQ ID NO: 28925 - DNA, 25 bp, Homo sapien
ccgccgctccctacggcgcggcaca

SEQ ID NO: 28926 - DNA, 25 bp, Homo sapien
cggcgcggagctagctgacagccgg

SEQ ID NO: 28927 - DNA, 25 bp, Homo sapien
ccggccatggccctctggagctagg

SEQ ID NO: 28928 - DNA, 25 bp, Homo sapien
ggtccctacctgacggccaccttga

SEQ ID NO: 28929 - DNA, 25 bp, Homo sapien
aaagcccacgcgagacaaagcccga

SEQ ID NO: 28930 - DNA, 25 bp, Homo sapien
ctgcggcagactggccagcgcgcgg

SEQ ID NO: 28931 - DNA, 25 bp, Homo sapien
ccatggccctctggagctagggtct

SEQ ID NO: 28932 - DNA, 25 bp, Homo sapien
cctcgttgacgcacttgactcgctg

SEQ ID NO: 28933 - DNA, 25 bp, Homo sapien
gcgctcgttgcgcttctggatgaag

SEQ ID NO: 28934 - DNA, 25 bp, Homo sapien
gtctccaccttgctgagtcgcttct

SEQ ID NO: 28935 - DNA, 25 bp, Homo sapien
ctaggtctctatcgtgcccatcgta

SEQ ID NO: 28936 - DNA, 25 bp, Homo sapien
acaggcccgatcaatgccaggattc

SEQ ID NO: 28937 - DNA, 25 bp, Homo sapien
tgccaggattcctccgactccaaga

SEQ ID NO: 28938 - DNA, 25 bp, Homo sapien
gcagctcttgcaggtactttatgta

SEQ ID NO: 28939 - DNA, 25 bp, Homo sapien
agcccggcagaagttattgttcatg

SEQ ID NO: 28940 - DNA, 25 bp, Homo sapien
cttctattggttgccagagcagccc

SEQ ID NO: 28941 - DNA, 25 bp, Homo sapien
ccacgcccagaggtcttaagccgga

SEQ ID NO: 28942 - DNA, 25 bp, Homo sapien
tcgccatggcaacaagacccgcctt

SEQ ID NO: 28943 - DNA, 25 bp, Homo sapien
gccctctcctagcttctattggttg

SEQ ID NO: 28944 - DNA, 25 bp, Homo sapien
tgcagccgcaaaagacccagttgtc

SEQ ID NO: 28945 - DNA, 25 bp, Homo sapien
aatgccgcgtccacgaacctacaag

SEQ ID NO: 28946 - DNA, 25 bp, Homo sapien
cagaggtcttaagccggactgggac

SEQ ID NO: 28947 - DNA, 25 bp, Homo sapien
ggagaggcgggcatttctcaaaccc

SEQ ID NO: 28948 - DNA, 25 bp, Homo sapien
cgagctggaccgctggctttaccac

SEQ ID NO: 28949 - DNA, 25 bp, Homo sapien
ctgcggacggcgtcagggcacgaac

SEQ ID NO: 28950 - DNA, 25 bp, Homo sapien
tttgcagcgccgtctaacccggctg

SEQ ID NO: 28951 - DNA, 25 bp, Homo sapien
cctggactttgcagcgccgtctaac

SEQ ID NO: 28952 - DNA, 25 bp, Homo sapien
ggtcctgcggagacgaactcccctg

SEQ ID NO: 28953 - DNA, 25 bp, Homo sapien
cccaccctgatcctcgcagccggct

SEQ ID NO: 28954 - DNA, 25 bp, Homo sapien
gctggctttaccacctggagaagca

SEQ ID NO: 28955 - DNA, 25 bp, Homo sapien
gaccgctggctttaccacctggaga

SEQ ID NO: 28956 - DNA, 25 bp, Homo sapien
gccctcattcattcagactcagacc

SEQ ID NO: 28957 - DNA, 25 bp, Homo sapien
tggaaacccgcgcatcggagagctg

SEQ ID NO: 28958 - DNA, 25 bp, Homo sapien
taacgcggagccagatggtcttttg

SEQ ID NO: 28959 - DNA, 25 bp, Homo sapien
tgctctattataacgcggagccaga

SEQ ID NO: 28960 - DNA, 25 bp, Homo sapien
agacaagccctttattgctctatta

SEQ ID NO: 28961 - DNA, 25 bp, Homo sapien
ctctgaaaggcagacaagcccttta

SEQ ID NO: 28962 - DNA, 25 bp, Homo sapien
agctcgttcccaacctctgaaaggc

SEQ ID NO: 28963 - DNA, 25 bp, Homo sapien
gcggtgtcagagagcagctcgttcc

SEQ ID NO: 28964 - DNA, 25 bp, Homo sapien
atggggatatttcctctgtcttcca

SEQ ID NO: 28965 - DNA, 25 bp, Homo sapien
acagggatcccggtgacaaagatgg

SEQ ID NO: 28966 - DNA, 25 bp, Homo sapien
gtcaaccgggctgtccgaattccgc

SEQ ID NO: 28967 - DNA, 25 bp, Homo sapien
ccgcttcaggctccctagatacttt

SEQ ID NO: 28968 - DNA, 25 bp, Homo sapien
ctagatactttctggggcccaaccg

SEQ ID NO: 28969 - DNA, 25 bp, Homo sapien
aggccgtagccatccaaagcgttcc

SEQ ID NO: 28970 - DNA, 25 bp, Homo sapien
cccagcctttctggggagtgaaact

SEQ ID NO: 28971 - DNA, 25 bp, Homo sapien
ctcagtccgggagagagatctgcct

SEQ ID NO: 28972 - DNA, 25 bp, Homo sapien
gcccgagacaggcacagctcagatt

SEQ ID NO: 28973 - DNA, 25 bp, Homo sapien
gacaaggcttgttgtgcccgagaca

SEQ ID NO: 28974 - DNA, 25 bp, Homo sapien
ggtggcgtcccgcagaatgagaaca

SEQ ID NO: 28975 - DNA, 25 bp, Homo sapien
gccgcggcgatttaccgcgcctgga

SEQ ID NO: 28976 - DNA, 25 bp, Homo sapien
agaacatttctgtgccgggccagca

SEQ ID NO: 28977 - DNA, 25 bp, Homo sapien
ttacctgagtaagattgagattctc

SEQ ID NO: 28978 - DNA, 25 bp, Homo sapien
gagattctctcaccaggcgacaagg

SEQ ID NO: 28979 - DNA, 25 bp, Homo sapien
caaagagggattcctttcaggcccg

SEQ ID NO: 28980 - DNA, 25 bp, Homo sapien
cccacgtcacctggttcaagaatga

SEQ ID NO: 28981 - DNA, 25 bp, Homo sapien
cactgacctgctgggcgtgtgctcc

SEQ ID NO: 28982 - DNA, 25 bp, Homo sapien
ccgcggtgtacagcactgacctgct

SEQ ID NO: 28983 - DNA, 25 bp, Homo sapien
cacctggttcaagaatgaccgcagc

SEQ ID NO: 28984 - DNA, 25 bp, Homo sapien
tgcatgagctgtgccgtgcagggct

SEQ ID NO: 28985 - DNA, 25 bp, Homo sapien
ccccagggctgcgagtgctgcatga

SEQ ID NO: 28986 - DNA, 25 bp, Homo sapien
cgggagcccgacctgagccagaagc

SEQ ID NO: 28987 - DNA, 25 bp, Homo sapien
atgaccgcagcctggaaggaaaccc

SEQ ID NO: 28988 - DNA, 25 bp, Homo sapien
ctggacggctttctctttcggatgc

SEQ ID NO: 28989 - DNA, 25 bp, Homo sapien
ggcttgatctcctggccttcagctg

SEQ ID NO: 28990 - DNA, 25 bp, Homo sapien
gcggaccacgcactctatggccgta

SEQ ID NO: 28991 - DNA, 25 bp, Homo sapien
ccgccttggcgtacgaatgcttcca

SEQ ID NO: 28992 - DNA, 25 bp, Homo sapien
ccaggaccaggacaactccacgttg

SEQ ID NO: 28993 - DNA, 25 bp, Homo sapien
cacgttggctttgccgtcggaccaa

SEQ ID NO: 28994 - DNA, 25 bp, Homo sapien
ccgtcaagcggcagaagtccaagtc

SEQ ID NO: 28995 - DNA, 25 bp, Homo sapien
ttctgagctggtgtaaacgcgaccc

SEQ ID NO: 28996 - DNA, 25 bp, Homo sapien
agcaagaagccgagcggaaaagtta

SEQ ID NO: 28997 - DNA, 25 bp, Homo sapien
gctcagaaccagtccgaccagcttg

SEQ ID NO: 28998 - DNA, 25 bp, Homo sapien
ggcgtcccagacaaagccgcattga

SEQ ID NO: 28999 - DNA, 25 bp, Homo sapien
gccgcattgattgcagcccaggccg

SEQ ID NO: 29000 - DNA, 25 bp, Homo sapien
gcgggagacttcctgctcagaacca

SEQ ID NO: 29001 - DNA, 25 bp, Homo sapien
aagttagcgcaggtactgtgatctc

SEQ ID NO: 29002 - DNA, 25 bp, Homo sapien
cgacttagcccggagacgctcaaga

SEQ ID NO: 29003 - DNA, 25 bp, Homo sapien
ctgtgatctcgggtctagagcgccc

SEQ ID NO: 29004 - DNA, 25 bp, Homo sapien
ctcgcgggatgtgcccttacatgtt

SEQ ID NO: 29005 - DNA, 25 bp, Homo sapien
gcctcgaagagctgcagcccgcgtt

SEQ ID NO: 29006 - DNA, 25 bp, Homo sapien
actccacggccttgatgcgggcgaa

SEQ ID NO: 29007 - DNA, 25 bp, Homo sapien
ccttcggtcaccagcgtgaagtaga

SEQ ID NO: 29008 - DNA, 25 bp, Homo sapien
atctgggcgttccagccgggatctt

SEQ ID NO: 29009 - DNA, 25 bp, Homo sapien
acttgaccaggcctagggtgatctg

SEQ ID NO: 29010 - DNA, 25 bp, Homo sapien
gcctgctggttcttgaacttgacca

SEQ ID NO: 29011 - DNA, 25 bp, Homo sapien
gggctcagtcactcactggaggcgc

SEQ ID NO: 29012 - DNA, 25 bp, Homo sapien
gtcttgcgcaggagctgagtcctca

SEQ ID NO: 29013 - DNA, 25 bp, Homo sapien
ccctccaaggagaagtgagcgtcgg

SEQ ID NO: 29014 - DNA, 25 bp, Homo sapien
ggattagacgcgtgcgctgtcttgc

SEQ ID NO: 29015 - DNA, 25 bp, Homo sapien
tagacgcgtgcgctgtcttgcgcag

SEQ ID NO: 29016 - DNA, 25 bp, Homo sapien
tgagtcctcagggtccacagagaga

SEQ ID NO: 29017 - DNA, 25 bp, Homo sapien
caagcgccgcgcttgcagatgctgg

SEQ ID NO: 29018 - DNA, 25 bp, Homo sapien
agcgcgacagccctccaaggagaag

SEQ ID NO: 29019 - DNA, 25 bp, Homo sapien
gtcctcagggtccacagagagagga

SEQ ID NO: 29020 - DNA, 25 bp, Homo sapien
tcagtggcgcgcagaatcgccgatt

SEQ ID NO: 29021 - DNA, 25 bp, Homo sapien
gggccacgccaaccagtgggctttg

SEQ ID NO: 29022 - DNA, 25 bp, Homo sapien
gggctaactgcggtcacttctcaca

SEQ ID NO: 29023 - DNA, 25 bp, Homo sapien
ggacggacctagtgcctccagaaaa

SEQ ID NO: 29024 - DNA, 25 bp, Homo sapien
cggaagtcaactgtgtccaggaagc

SEQ ID NO: 29025 - DNA, 25 bp, Homo sapien
tgggtcacgcacacgcggaagtcaa

SEQ ID NO: 29026 - DNA, 25 bp, Homo sapien
gtgggctttgcacactgcaccactc

SEQ ID NO: 29027 - DNA, 25 bp, Homo sapien
atcgccgattgttctgcccgacttg

SEQ ID NO: 29028 - DNA, 25 bp, Homo sapien
cccgggaaactttgtgctcgcgaga

SEQ ID NO: 29029 - DNA, 25 bp, Homo sapien
taacaaccaagatgctcgcggcttc

SEQ ID NO: 29030 - DNA, 25 bp, Homo sapien
gactgactgcgcgtttgattctaga

SEQ ID NO: 29031 - DNA, 25 bp, Homo sapien
ggctgcctaacttcagtccctctga

SEQ ID NO: 29032 - DNA, 25 bp, Homo sapien
tcttatcatgagacaccaggtgctg

SEQ ID NO: 29033 - DNA, 25 bp, Homo sapien
accaggtgctgcgttcttatactcg

SEQ ID NO: 29034 - DNA, 25 bp, Homo sapien
cgcacctctgcctttcgttgaagca

SEQ ID NO: 29035 - DNA, 25 bp, Homo sapien
gcactttgttcaggatgccgcctcc

SEQ ID NO: 29036 - DNA, 25 bp, Homo sapien
tgctctccagcaaggccaaggcgca

SEQ ID NO: 29037 - DNA, 25 bp, Homo sapien
ctgcagctttatgagcccgaatgga

SEQ ID NO: 29038 - DNA, 25 bp, Homo sapien
tgaagctccgctgatgtccaagacg

SEQ ID NO: 29039 - DNA, 25 bp, Homo sapien
cggccgtgagcgaagatggcaaatc

SEQ ID NO: 29040 - DNA, 25 bp, Homo sapien
tggctttctcctaaccagctgctgg

SEQ ID NO: 29041 - DNA, 25 bp, Homo sapien
gagggccctcctgttcacgatcagg

SEQ ID NO: 29042 - DNA, 25 bp, Homo sapien
atgcgcatggctcaagtgtaccttc

SEQ ID NO: 29043 - DNA, 25 bp, Homo sapien
ggactccgagaaaaagctgcagctt

SEQ ID NO: 29044 - DNA, 25 bp, Homo sapien
aggcttcggtggctctttgtctacc

SEQ ID NO: 29045 - DNA, 25 bp, Homo sapien
ctgagccggggaagatgcttcatct

SEQ ID NO: 29046 - DNA, 25 bp, Homo sapien
gtggcccacagctcataccttttcg

SEQ ID NO: 29047 - DNA, 25 bp, Homo sapien
gccgtaagtacaagccctggtggtg

SEQ ID NO: 29048 - DNA, 25 bp, Homo sapien
gtcactttaagtacagctggagccg

SEQ ID NO: 29049 - DNA, 25 bp, Homo sapien
gggaaatggggctctgtcactttaa

SEQ ID NO: 29050 - DNA, 25 bp, Homo sapien
cagatccggaagaacggtgaatttc

SEQ ID NO: 29051 - DNA, 25 bp, Homo sapien
gtctacctgctctgggtgttaaaga

SEQ ID NO: 29052 - DNA, 25 bp, Homo sapien
tcgacttccggttcacccagcattt

SEQ ID NO: 29053 - DNA, 25 bp, Homo sapien
ttggtggatgaccttgagccctcag

SEQ ID NO: 29054 - DNA, 25 bp, Homo sapien
gacgggtgtgcaccgcctctcgact

SEQ ID NO: 29055 - DNA, 25 bp, Homo sapien
ttccgacagctgtgtttgcgcatgc

SEQ ID NO: 29056 - DNA, 25 bp, Homo sapien
cttgagccctcaggaacgagatggc

SEQ ID NO: 29057 - DNA, 25 bp, Homo sapien
aggcgctgcaactccgcttcatcgg

SEQ ID NO: 29058 - DNA, 25 bp, Homo sapien
agtaaactgcgccttctgctgctcg

SEQ ID NO: 29059 - DNA, 25 bp, Homo sapien
ctgttttctttcgtcgtcgtgggtg

SEQ ID NO: 29060 - DNA, 25 bp, Homo sapien
ggtgggcgctccttgccacctttct

SEQ ID NO: 29061 - DNA, 25 bp, Homo sapien
gggccgtgcttcttctggccctggc

SEQ ID NO: 29062 - DNA, 25 bp, Homo sapien
ctggcctccaattggctgccgggcg

SEQ ID NO: 29063 - DNA, 25 bp, Homo sapien
tctccctgctgtccgagaagttcgt

SEQ ID NO: 29064 - DNA, 25 bp, Homo sapien
tccaccgagtactggggagtctcag

SEQ ID NO: 29065 - DNA, 25 bp, Homo sapien
caggccacggtgaatgaagagcaac

SEQ ID NO: 29066 - DNA, 25 bp, Homo sapien
ggacgtatgggcaggctcctcctcc

SEQ ID NO: 29067 - DNA, 25 bp, Homo sapien
ccgagaagttcgtgcggtgccagcc

SEQ ID NO: 29068 - DNA, 25 bp, Homo sapien
gggcggctgctgaagaacagattaa

SEQ ID NO: 29069 - DNA, 25 bp, Homo sapien
cgcagctccgtaccggctggggaca

SEQ ID NO: 29070 - DNA, 25 bp, Homo sapien
atggctcagccgcacaatccgctga

SEQ ID NO: 29071 - DNA, 25 bp, Homo sapien
aacagattaaggtgctggaggtgac

SEQ ID NO: 29072 - DNA, 25 bp, Homo sapien
tggatacgctcaccgggatcctatc

SEQ ID NO: 29073 - DNA, 25 bp, Homo sapien
tgccgggtccagtggcacaaggatt

SEQ ID NO: 29074 - DNA, 25 bp, Homo sapien
tggcacaaggattaaaggaagcgtt

SEQ ID NO: 29075 - DNA, 25 bp, Homo sapien
ggaccgtcacgaggatggctcagcc

SEQ ID NO: 29076 - DNA, 25 bp, Homo sapien
cgcgttgatttcagtccacggaacc

SEQ ID NO: 29077 - DNA, 25 bp, Homo sapien
agcttcaccgctgtctttgcatttc

SEQ ID NO: 29078 - DNA, 25 bp, Homo sapien
agcctcgtcgacttgggcctggtaa

SEQ ID NO: 29079 - DNA, 25 bp, Homo sapien
tggtaactgggcaatgcggtctttc

SEQ ID NO: 29080 - DNA, 25 bp, Homo sapien
ggccagtcggcttcttagccctgta

SEQ ID NO: 29081 - DNA, 25 bp, Homo sapien
aacgcagggcgtaatcgactttatg

SEQ ID NO: 29082 - DNA, 25 bp, Homo sapien
accgggtagtgtgactccgtcattg

SEQ ID NO: 29083 - DNA, 25 bp, Homo sapien
ccagcacccgtgtgaccttgtgatg

SEQ ID NO: 29084 - DNA, 25 bp, Homo sapien
ggcctttgagctgctgcacttgcac

SEQ ID NO: 29085 - DNA, 25 bp, Homo sapien
ggcttgtccagattgcgccgcattc

SEQ ID NO: 29086 - DNA, 25 bp, Homo sapien
gagcgtccctagaggggcctactcc

SEQ ID NO: 29087 - DNA, 25 bp, Homo sapien
ggaggacccttccagagcgtcccta

SEQ ID NO: 29088 - DNA, 25 bp, Homo sapien
cggagcccgtgagcttctacacgca

SEQ ID NO: 29089 - DNA, 25 bp, Homo sapien
actcgcacccgtgcctggaggtgac

SEQ ID NO: 29090 - DNA, 25 bp, Homo sapien
gctcatcgcacactgccgtttctaa

SEQ ID NO: 29091 - DNA, 25 bp, Homo sapien
ctggtttccttctggacttcctcca

SEQ ID NO: 29092 - DNA, 25 bp, Homo sapien
cgtaccgcgatcacgttgacgaagg

SEQ ID NO: 29093 - DNA, 25 bp, Homo sapien
agcgggtccctcctgcttcgagagc

SEQ ID NO: 29094 - DNA, 25 bp, Homo sapien
aagcgatcatggtcgctgccgccgg

SEQ ID NO: 29095 - DNA, 25 bp, Homo sapien
cttgttgaacaaagcgatcatggtc

SEQ ID NO: 29096 - DNA, 25 bp, Homo sapien
ttgaaccagtccagcagcttgttga

SEQ ID NO: 29097 - DNA, 25 bp, Homo sapien
actgaagcccgaccagcgtgagctc

SEQ ID NO: 29098 - DNA, 25 bp, Homo sapien
ctccttccagaatagggccttgaac

SEQ ID NO: 29099 - DNA, 25 bp, Homo sapien
ttgcccgagtactgaagcccgacca

SEQ ID NO: 29100 - DNA, 25 bp, Homo sapien
gcgctgtgcgcttcccggagggccg

SEQ ID NO: 29101 - DNA, 25 bp, Homo sapien
tctgccgactgctctgagctcgggc

SEQ ID NO: 29102 - DNA, 25 bp, Homo sapien
gcgctatggctttgcgccgcgctgt

SEQ ID NO: 29103 - DNA, 25 bp, Homo sapien
tccgggcgctatggctttgcgccgc

SEQ ID NO: 29104 - DNA, 25 bp, Homo sapien
tagcccgaccgccgagatgcccagc

SEQ ID NO: 29105 - DNA, 25 bp, Homo sapien
cgccaggtgccccagtagcccgacc

SEQ ID NO: 29106 - DNA, 25 bp, Homo sapien
agctgcggccatcgcgccgtgcgtc

SEQ ID NO: 29107 - DNA, 25 bp, Homo sapien
tgagctcgggctgtccgccgttccg

SEQ ID NO: 29108 - DNA, 25 bp, Homo sapien
cgggacagaacctctcccgggctgg

SEQ ID NO: 29109 - DNA, 25 bp, Homo sapien
ttccattgttctgggagccgaggcc

SEQ ID NO: 29110 - DNA, 25 bp, Homo sapien
gcaggacccagaaaccgacgcgacg

SEQ ID NO: 29111 - DNA, 25 bp, Homo sapien
cgagctccggaaagttccacaggtc

SEQ ID NO: 29112 - DNA, 25 bp, Homo sapien
cagcgagggcgggacagaacctctc

SEQ ID NO: 29113 - DNA, 25 bp, Homo sapien
aactggcactcgaggtcccaggggc

SEQ ID NO: 29114 - DNA, 25 bp, Homo sapien
gcactggaccgcagaactggcactc

SEQ ID NO: 29115 - DNA, 25 bp, Homo sapien
ggaaagttccacaggtcctccgcag

SEQ ID NO: 29116 - DNA, 25 bp, Homo sapien
gcggctgaaccctgagacgtcatcc

SEQ ID NO: 29117 - DNA, 25 bp, Homo sapien
gacgtcatccggcagtccaaattcg

SEQ ID NO: 29118 - DNA, 25 bp, Homo sapien
gcattcaaatgagagcgcgcgctgg

SEQ ID NO: 29119 - DNA, 25 bp, Homo sapien
cagtgctctgaacgctcacgcattc

SEQ ID NO: 29120 - DNA, 25 bp, Homo sapien
ctcctctctattggccagtgctctg

SEQ ID NO: 29121 - DNA, 25 bp, Homo sapien
taatccaccgggaaagaagcgcagc

SEQ ID NO: 29122 - DNA, 25 bp, Homo sapien
ccctgtctggggaagattgtgattg

SEQ ID NO: 29123 - DNA, 25 bp, Homo sapien
ctgcgcgacctctgactgttggcgt

SEQ ID NO: 29124 - DNA, 25 bp, Homo sapien
gcttcgaggacggtgctgtctttct

SEQ ID NO: 29125 - DNA, 25 bp, Homo sapien
ctacgagtcccgtgatgacccgagg

SEQ ID NO: 29126 - DNA, 25 bp, Homo sapien
ttacggccaccaagtgcacttaggg

SEQ ID NO: 29127 - DNA, 25 bp, Homo sapien
gatgcatccagggatttgtagttcc

SEQ ID NO: 29128 - DNA, 25 bp, Homo sapien
cctcgccttttttctgatgcatcca

SEQ ID NO: 29129 - DNA, 25 bp, Homo sapien
gcgaaagagagagccgccggtcctc

SEQ ID NO: 29130 - DNA, 25 bp, Homo sapien
ggcagcgcctgcgtattgaagccga

SEQ ID NO: 29131 - DNA, 25 bp, Homo sapien
tagggcaggcctcttactacgagtc

SEQ ID NO: 29132 - DNA, 25 bp, Homo sapien
tagtttaccccgcagtgagcaccaa

SEQ ID NO: 29133 - DNA, 25 bp, Homo sapien
cctattgatatgctcctcacattcg

SEQ ID NO: 29134 - DNA, 25 bp, Homo sapien
ctccagtccggactgccagcggagg

SEQ ID NO: 29135 - DNA, 25 bp, Homo sapien
ccagcggaggggaaaatgggcgaca

SEQ ID NO: 29136 - DNA, 25 bp, Homo sapien
ttctccagtccggactgccagcgga

SEQ ID NO: 29137 - DNA, 25 bp, Homo sapien
attgatatgctcctcacattcgcct

SEQ ID NO: 29138 - DNA, 25 bp, Homo sapien
tattgatatgctcctcacattcgcc

SEQ ID NO: 29139 - DNA, 25 bp, Homo sapien
cgcctattgatatgctcctcacatt

SEQ ID NO: 29140 - DNA, 25 bp, Homo sapien
tctctctgcagtagtaacaacctga

SEQ ID NO: 29141 - DNA, 25 bp, Homo sapien
ccgacgcccatggatttccggatta

SEQ ID NO: 29142 - DNA, 25 bp, Homo sapien
ttcccacggcttctctgcggcgagt

SEQ ID NO: 29143 - DNA, 25 bp, Homo sapien
tagccaggtaattccgacgcccatg

SEQ ID NO: 29144 - DNA, 25 bp, Homo sapien
tggatttccggattacagttcccac

SEQ ID NO: 29145 - DNA, 25 bp, Homo sapien
ccaaaagtcggagtgtcaccgtttg

SEQ ID NO: 29146 - DNA, 25 bp, Homo sapien
ttcgctcgggactactggctgccct

SEQ ID NO: 29147 - DNA, 25 bp, Homo sapien
agcgctaaggcaccgcggcttctct

SEQ ID NO: 29148 - DNA, 25 bp, Homo sapien
gacgcacttcctaggggcgcgtctg

SEQ ID NO: 29149 - DNA, 25 bp, Homo sapien
attgtacaggtagggtgtgcacaca

SEQ ID NO: 29150 - DNA, 25 bp, Homo sapien
cacacccggttctgcgactcgaaga

SEQ ID NO: 29151 - DNA, 25 bp, Homo sapien
tccttcagcgcgagccaccgattgt

SEQ ID NO: 29152 - DNA, 25 bp, Homo sapien
gccgtcgctgccaggcacaagtgtc

SEQ ID NO: 29153 - DNA, 25 bp, Homo sapien
tggggcttcggacggcctccagcat

SEQ ID NO: 29154 - DNA, 25 bp, Homo sapien
gcgcgagccaccgattgtacaggta

SEQ ID NO: 29155 - DNA, 25 bp, Homo sapien
cttgatggttaacggagccgactgc

SEQ ID NO: 29156 - DNA, 25 bp, Homo sapien
tgagactggggcaaaagaaccttcc

SEQ ID NO: 29157 - DNA, 25 bp, Homo sapien
gccgcaagacttgctgagcttagca

SEQ ID NO: 29158 - DNA, 25 bp, Homo sapien
gctccgaagtgcctttgccgcaaga

SEQ ID NO: 29159 - DNA, 25 bp, Homo sapien
ccctcgactcagtagcaggaaagga

SEQ ID NO: 29160 - DNA, 25 bp, Homo sapien
agacgaaccttccatccggacgctt

SEQ ID NO: 29161 - DNA, 25 bp, Homo sapien
tggacttaccggagagcgacccgaa

SEQ ID NO: 29162 - DNA, 25 bp, Homo sapien
agaaccttccttggagaccgctagg

SEQ ID NO: 29163 - DNA, 25 bp, Homo sapien
tctctgcagcaacccgcgggaggaa

SEQ ID NO: 29164 - DNA, 25 bp, Homo sapien
gacccaggatttggcgccgcgatct

SEQ ID NO: 29165 - DNA, 25 bp, Homo sapien
tgagtccagcccagtctcgcgcgag

SEQ ID NO: 29166 - DNA, 25 bp, Homo sapien
cgccaatggccgacggggtccaagt

SEQ ID NO: 29167 - DNA, 25 bp, Homo sapien
ccaggacgcgggacagcaactgtcc

SEQ ID NO: 29168 - DNA, 25 bp, Homo sapien
cgatctcgaggcttggcctggagta

SEQ ID NO: 29169 - DNA, 25 bp, Homo sapien
tgcatcctgaagcatgcggtgaccg

SEQ ID NO: 29170 - DNA, 25 bp, Homo sapien
tgtgccgctggatcgcccaggacct

SEQ ID NO: 29171 - DNA, 25 bp, Homo sapien
gccatgagcacggtggaccttgctc

SEQ ID NO: 29172 - DNA, 25 bp, Homo sapien
gccaccacacaaaggaccaggggct

SEQ ID NO: 29173 - DNA, 25 bp, Homo sapien
tccgcgaactcttcccagctgggtt

SEQ ID NO: 29174 - DNA, 25 bp, Homo sapien
gccggatcttgtggatgaaagcgaa

SEQ ID NO: 29175 - DNA, 25 bp, Homo sapien
agatgccagtctgctcggctatggg

SEQ ID NO: 29176 - DNA, 25 bp, Homo sapien
gcggccgcaccttacagatgccagt

SEQ ID NO: 29177 - DNA, 25 bp, Homo sapien
ttgaaaactttcctcctcgcacgac

SEQ ID NO: 29178 - DNA, 25 bp, Homo sapien
cagctgggttcgaagaccgggcact

SEQ ID NO: 29179 - DNA, 25 bp, Homo sapien
gctcccgccgccatattgaaaactt

SEQ ID NO: 29180 - DNA, 25 bp, Homo sapien
acctagggaccgagaggactctccg

SEQ ID NO: 29181 - DNA, 25 bp, Homo sapien
ttttaaagagcctagccacgggcgc

SEQ ID NO: 29182 - DNA, 25 bp, Homo sapien
ccgcattgtctcgtctagggccggc

SEQ ID NO: 29183 - DNA, 25 bp, Homo sapien
gttcctaggccatagcggagctgca

SEQ ID NO: 29184 - DNA, 25 bp, Homo sapien
ctcatttgtgcagcgccagatcctt

SEQ ID NO: 29185 - DNA, 25 bp, Homo sapien
gatccttcggacacatccctaggtg

SEQ ID NO: 29186 - DNA, 25 bp, Homo sapien
tccggtaaccgcgttgcgaagacca

SEQ ID NO: 29187 - DNA, 25 bp, Homo sapien
ccttgccctttatgatgtttacatg

SEQ ID NO: 29188 - DNA, 25 bp, Homo sapien
caagcgggcacctctttgtccagga

SEQ ID NO: 29189 - DNA, 25 bp, Homo sapien
attggccagccgcttacgaaacagc

SEQ ID NO: 29190 - DNA, 25 bp, Homo sapien
actcccattgggtcgcagctggaca

SEQ ID NO: 29191 - DNA, 25 bp, Homo sapien
gttgctggcgggaccttataaatcc

SEQ ID NO: 29192 - DNA, 25 bp, Homo sapien
cacgaatcccaacgcgcggttgctg

SEQ ID NO: 29193 - DNA, 25 bp, Homo sapien
tgactgcagacaccatacgggtctc

SEQ ID NO: 29194 - DNA, 25 bp, Homo sapien
tcagaacgtttctagctcgcaccgc

SEQ ID NO: 29195 - DNA, 25 bp, Homo sapien
gcacagcatccttcaccatggttga

SEQ ID NO: 29196 - DNA, 25 bp, Homo sapien
gtctctgctggctcgttattcactg

SEQ ID NO: 29197 - DNA, 25 bp, Homo sapien
cggctgacactaactcgctcggctg

SEQ ID NO: 29198 - DNA, 25 bp, Homo sapien
ctccctacctgtcggcgagagaaga

SEQ ID NO: 29199 - DNA, 25 bp, Homo sapien
agactgtgggtgtaaacggcctcca

SEQ ID NO: 29200 - DNA, 25 bp, Homo sapien
gttcagattctgactgcggcggctc

SEQ ID NO: 29201 - DNA, 25 bp, Homo sapien
cgcggttgccggaaattgaagagcc

SEQ ID NO: 29202 - DNA, 25 bp, Homo sapien
acggtcactatgtctctgcgcaggc

SEQ ID NO: 29203 - DNA, 25 bp, Homo sapien
tcgttattcactgcgctggcgcggc

SEQ ID NO: 29204 - DNA, 25 bp, Homo sapien
acgtgacctgtctgtaccctagcgc

SEQ ID NO: 29205 - DNA, 25 bp, Homo sapien
cgctgctaggaagccgaattacaaa

SEQ ID NO: 29206 - DNA, 25 bp, Homo sapien
gtctgtaccctagcgcggggcttct

SEQ ID NO: 29207 - DNA, 25 bp, Homo sapien
aggtggtgtcacgtgacctgtctgt

SEQ ID NO: 29208 - DNA, 25 bp, Homo sapien
ccgcgcgacgtgatgacgcaatgca

SEQ ID NO: 29209 - DNA, 25 bp, Homo sapien
cagacccggaggctctggaggctct

SEQ ID NO: 29210 - DNA, 25 bp, Homo sapien
cggggcttctgtacgctgctaggaa

SEQ ID NO: 29211 - DNA, 25 bp, Homo sapien
tgacgcaatgcagctggagcaccgc

SEQ ID NO: 29212 - DNA, 25 bp, Homo sapien
ccctgggagacttacagccgggcag

SEQ ID NO: 29213 - DNA, 25 bp, Homo sapien
tcggggccaggcttaactctggctc

SEQ ID NO: 29214 - DNA, 25 bp, Homo sapien
atctggggaacccatgcatctccac

SEQ ID NO: 29215 - DNA, 25 bp, Homo sapien
ggctaaaggcgcagcactcacagga

SEQ ID NO: 29216 - DNA, 25 bp, Homo sapien
tgtttacaacctgaccggctggatg

SEQ ID NO: 29217 - DNA, 25 bp, Homo sapien
aggcggttcgcgacctaggcccgca

SEQ ID NO: 29218 - DNA, 25 bp, Homo sapien
ctctctggtcccgatctggggaacc

SEQ ID NO: 29219 - DNA, 25 bp, Homo sapien
agcactcacaggactgccgggagtc

SEQ ID NO: 29220 - DNA, 25 bp, Homo sapien
gccaagggcagaggggtaacctggc

SEQ ID NO: 29221 - DNA, 25 bp, Homo sapien
gtcccgagcccggatgtgcgggatc

SEQ ID NO: 29222 - DNA, 25 bp, Homo sapien
ccaggggtggcgatcccgagctcca

SEQ ID NO: 29223 - DNA, 25 bp, Homo sapien
ggcagaggggtaacctggcggagtc

SEQ ID NO: 29224 - DNA, 25 bp, Homo sapien
ccagcgcggaggcatgccaagggca

SEQ ID NO: 29225 - DNA, 25 bp, Homo sapien
gaccgccaggctgggtaagagcccg

SEQ ID NO: 29226 - DNA, 25 bp, Homo sapien
tggtgaccgtcccaggggtggcgat

SEQ ID NO: 29227 - DNA, 25 bp, Homo sapien
ccagcatccacggtgggcccagagc

SEQ ID NO: 29228 - DNA, 25 bp, Homo sapien
ctggaacccggacccagcttgattc

SEQ ID NO: 29229 - DNA, 25 bp, Homo sapien
atgatgacgtatccttgcacctggc

SEQ ID NO: 29230 - DNA, 25 bp, Homo sapien
cgcgactcggaacccggacctatgt

SEQ ID NO: 29231 - DNA, 25 bp, Homo sapien
cggacctatgttctcgcgagagtta

SEQ ID NO: 29232 - DNA, 25 bp, Homo sapien
gacgctgacgagagaaggcctcttc

SEQ ID NO: 29233 - DNA, 25 bp, Homo sapien
ctgttcagcaggaaggtaagctttg

SEQ ID NO: 29234 - DNA, 25 bp, Homo sapien
ttgcgcgagcctttaaagactcatg

SEQ ID NO: 29235 - DNA, 25 bp, Homo sapien
cgaggtacggcgatacgcgacacca

SEQ ID NO: 29236 - DNA, 25 bp, Homo sapien
agcagcggccctctggcagacacgg

SEQ ID NO: 29237 - DNA, 25 bp, Homo sapien
tgacaccgaggtgagccacggtcct

SEQ ID NO: 29238 - DNA, 25 bp, Homo sapien
gcaagacgttaagttgggtgacacc

SEQ ID NO: 29239 - DNA, 25 bp, Homo sapien
tattctgtacccgtgatttgtggcg

SEQ ID NO: 29240 - DNA, 25 bp, Homo sapien
cgccctggttattctgtacccgtga

SEQ ID NO: 29241 - DNA, 25 bp, Homo sapien
catggcacgccctggttattctgta

SEQ ID NO: 29242 - DNA, 25 bp, Homo sapien
cagcccacgcctcccagggattgca

SEQ ID NO: 29243 - DNA, 25 bp, Homo sapien
cctctggcagacacggtgcgtgccg

SEQ ID NO: 29244 - DNA, 25 bp, Homo sapien
aggcgtcggtactgcttaccctgcc

SEQ ID NO: 29245 - DNA, 25 bp, Homo sapien
acgcgattctgatgggctgaggtct

SEQ ID NO: 29246 - DNA, 25 bp, Homo sapien
ctcaaagcggcgctctcgtcacgtg

SEQ ID NO: 29247 - DNA, 25 bp, Homo sapien
agccgcctggccttcggcatttgca

SEQ ID NO: 29248 - DNA, 25 bp, Homo sapien
ggtctcgtctatcgcacctcgggaa

SEQ ID NO: 29249 - DNA, 25 bp, Homo sapien
ctccgtatgtgctacctccggcagg

SEQ ID NO: 29250 - DNA, 25 bp, Homo sapien
cactcctttggggacgcgattctga

SEQ ID NO: 29251 - DNA, 25 bp, Homo sapien
acagccctttttgactccgtatgtg

SEQ ID NO: 29252 - DNA, 25 bp, Homo sapien
gcttccgtgtgtccaccctggggac

SEQ ID NO: 29253 - DNA, 25 bp, Homo sapien
cccgccaaagaagatcatgcctgaa

SEQ ID NO: 29254 - DNA, 25 bp, Homo sapien
tcatgcctgaaggtgagtaacaggc

SEQ ID NO: 29255 - DNA, 25 bp, Homo sapien
actaacccgccgctctgtgtgttct

SEQ ID NO: 29256 - DNA, 25 bp, Homo sapien
gtcgcagagactggagacctccacg

SEQ ID NO: 29257 - DNA, 25 bp, Homo sapien
cacggttcggacctactcctgctga

SEQ ID NO: 29258 - DNA, 25 bp, Homo sapien
ctttgcgcttggagcacgctgcgtt

SEQ ID NO: 29259 - DNA, 25 bp, Homo sapien
gcatgctcagcgcttccgcggagac

SEQ ID NO: 29260 - DNA, 25 bp, Homo sapien
cgtgcccagatccagtcggggctgc

SEQ ID NO: 29261 - DNA, 25 bp, Homo sapien
cttcttcttggactcctcgtccatc

SEQ ID NO: 29262 - DNA, 25 bp, Homo sapien
gccacataccttctcctgcgccttc

SEQ ID NO: 29263 - DNA, 25 bp, Homo sapien
tgacctctgcgagccacataccttc

SEQ ID NO: 29264 - DNA, 25 bp, Homo sapien
ccgtgcccagatccagtcggggctg

SEQ ID NO: 29265 - DNA, 25 bp, Homo sapien
tgcccgtgcccagatccagtcgggg

SEQ ID NO: 29266 - DNA, 25 bp, Homo sapien
tggggaccgtcaggaggctttgtcg

SEQ ID NO: 29267 - DNA, 25 bp, Homo sapien
tctgcgagccacataccttctcctg

SEQ ID NO: 29268 - DNA, 25 bp, Homo sapien
cccaggtgcgaaacaggggcgctac

SEQ ID NO: 29269 - DNA, 25 bp, Homo sapien
caggggcgctacctctttaaaagcg

SEQ ID NO: 29270 - DNA, 25 bp, Homo sapien
gggctgagtctctgccgtaccatgt

SEQ ID NO: 29271 - DNA, 25 bp, Homo sapien
ctgccgtaccatgtgattgcttgaa

SEQ ID NO: 29272 - DNA, 25 bp, Homo sapien
catgtgattgcttgaaaggccgggc

SEQ ID NO: 29273 - DNA, 25 bp, Homo sapien
aggactatgagctgccgcgcgttgt

SEQ ID NO: 29274 - DNA, 25 bp, Homo sapien
cccagtcccaggtgcgaaacagggg

SEQ ID NO: 29275 - DNA, 25 bp, Homo sapien
ctctttaaaagcgtccggggctgag

SEQ ID NO: 29276 - DNA, 25 bp, Homo sapien
agagccgtctctccggtgctcttgc

SEQ ID NO: 29277 - DNA, 25 bp, Homo sapien
tcgccaagtcagtgtgaggcccgga

SEQ ID NO: 29278 - DNA, 25 bp, Homo sapien
gctgtgggctttgtgctgagccaaa

SEQ ID NO: 29279 - DNA, 25 bp, Homo sapien
gccactctgtgtgccctgcagcggg

SEQ ID NO: 29280 - DNA, 25 bp, Homo sapien
gtagaccgcctccttggccggtgac

SEQ ID NO: 29281 - DNA, 25 bp, Homo sapien
ggtgacccctgcaacagagccgtct

SEQ ID NO: 29282 - DNA, 25 bp, Homo sapien
gctcttgctcgccaagtcagtgtga

SEQ ID NO: 29283 - DNA, 25 bp, Homo sapien
tctccggtgctcttgctcgccaagt

SEQ ID NO: 29284 - DNA, 25 bp, Homo sapien
gtgcagtcgagccttttcaacaatt

SEQ ID NO: 29285 - DNA, 25 bp, Homo sapien
ggaaccgacatgctcccggagatcg

SEQ ID NO: 29286 - DNA, 25 bp, Homo sapien
gctggaccctcgagatcttaagacc

SEQ ID NO: 29287 - DNA, 25 bp, Homo sapien
atttggagtcccagtgcggttcttc

SEQ ID NO: 29288 - DNA, 25 bp, Homo sapien
gggccgtctttcttctactcctgcg

SEQ ID NO: 29289 - DNA, 25 bp, Homo sapien
tccctggacctcctgaaaaacgctg

SEQ ID NO: 29290 - DNA, 25 bp, Homo sapien
ggtaacgctgtcttgtggacccgca

SEQ ID NO: 29291 - DNA, 25 bp, Homo sapien
gcgcaggttcctagcactgacgaca

SEQ ID NO: 29292 - DNA, 25 bp, Homo sapien
aaggcgatcccacacgggctgcctg

SEQ ID NO: 29293 - DNA, 25 bp, Homo sapien
cggagctcaggtccctaaaacctcg

SEQ ID NO: 29294 - DNA, 25 bp, Homo sapien
aggtggcttcccaacggagttgctc

SEQ ID NO: 29295 - DNA, 25 bp, Homo sapien
cggcgtttggccgagaactattaag

SEQ ID NO: 29296 - DNA, 25 bp, Homo sapien
gacgccctcacaagtctgctttctt

SEQ ID NO: 29297 - DNA, 25 bp, Homo sapien
tgggacctgaaagtgccaccagacg

SEQ ID NO: 29298 - DNA, 25 bp, Homo sapien
cacgagcagctgactgggacctgaa

SEQ ID NO: 29299 - DNA, 25 bp, Homo sapien
cagacctgtccagcaaggaagcttc

SEQ ID NO: 29300 - DNA, 25 bp, Homo sapien
ctacctgcggctggatggaaactac

SEQ ID NO: 29301 - DNA, 25 bp, Homo sapien
cgacctagtggcgttccatgacttc

SEQ ID NO: 29302 - DNA, 25 bp, Homo sapien
cagtccgtggtcatctaggccctac

SEQ ID NO: 29303 - DNA, 25 bp, Homo sapien
catgatgtgcttccgcctcctgcag

SEQ ID NO: 29304 - DNA, 25 bp, Homo sapien
tggaaactacttgaagccgcccatc

SEQ ID NO: 29305 - DNA, 25 bp, Homo sapien
ggagaacgtgccacacctgcgctac

SEQ ID NO: 29306 - DNA, 25 bp, Homo sapien
catgacttctcctcggacctggaga

SEQ ID NO: 29307 - DNA, 25 bp, Homo sapien
tcccgctggacctcatgatgtgctt

SEQ ID NO: 29308 - DNA, 25 bp, Homo sapien
cgccatctgttctccatcagtgtgc

SEQ ID NO: 29309 - DNA, 25 bp, Homo sapien
ggcccagccatttccaccctcggga

SEQ ID NO: 29310 - DNA, 25 bp, Homo sapien
ttctccatcagtgtgcgcggcccag

SEQ ID NO: 29311 - DNA, 25 bp, Homo sapien
gaggagggttcacagtgtttttgtg

SEQ ID NO: 29312 - DNA, 25 bp, Homo sapien
tctgttctccatcagtgtgcgcggc

SEQ ID NO: 29313 - DNA, 25 bp, Homo sapien
tccacgtttgaaaatgcgcctcctc

SEQ ID NO: 29314 - DNA, 25 bp, Homo sapien
cccgcgtgacgtcgatgggtcctgc

SEQ ID NO: 29315 - DNA, 25 bp, Homo sapien
ctcctcctcggagacagacgcatcg

SEQ ID NO: 29316 - DNA, 25 bp, Homo sapien
gaggctcagagtgcagctattcctg

SEQ ID NO: 29317 - DNA, 25 bp, Homo sapien
gaactccgtggagaatgcgaaccga

SEQ ID NO: 29318 - DNA, 25 bp, Homo sapien
ttatttagcgcgcaccgggtcgcct

SEQ ID NO: 29319 - DNA, 25 bp, Homo sapien
gccaaaggggtaatcggctcccgca

SEQ ID NO: 29320 - DNA, 25 bp, Homo sapien
ccgggctctgctgtagtctgagaac

SEQ ID NO: 29321 - DNA, 25 bp, Homo sapien
gggcaggattgactgcgcaaccctg

SEQ ID NO: 29322 - DNA, 25 bp, Homo sapien
tctccgtgaggtcgttatttagcgc

SEQ ID NO: 29323 - DNA, 25 bp, Homo sapien
gcagccggccttcctattttcagta

SEQ ID NO: 29324 - DNA, 25 bp, Homo sapien
ctgcccggcagtttccgaggaaata

SEQ ID NO: 29325 - DNA, 25 bp, Homo sapien
acggcgaccaatcagtgcgaagctg

SEQ ID NO: 29326 - DNA, 25 bp, Homo sapien
cctccacccaaggatttgcgctttg

SEQ ID NO: 29327 - DNA, 25 bp, Homo sapien
tcccgatcctggcaaagtgtgaaca

SEQ ID NO: 29328 - DNA, 25 bp, Homo sapien
ctggttagttgcaaagcctaccctc

SEQ ID NO: 29329 - DNA, 25 bp, Homo sapien
tgtctcctttctttgggcgaggttc

SEQ ID NO: 29330 - DNA, 25 bp, Homo sapien
gcccagagaacctcggcagtgtgca

SEQ ID NO: 29331 - DNA, 25 bp, Homo sapien
ggcctccctggaaaattcttctgtg

SEQ ID NO: 29332 - DNA, 25 bp, Homo sapien
gccatcttaggcatcgcctcataga

SEQ ID NO: 29333 - DNA, 25 bp, Homo sapien
ctgttctctggtaactagacccgtt

SEQ ID NO: 29334 - DNA, 25 bp, Homo sapien
tcacgtgaccctgtgacccggagca

SEQ ID NO: 29335 - DNA, 25 bp, Homo sapien
ccacatccggtgttcgctaatctcg

SEQ ID NO: 29336 - DNA, 25 bp, Homo sapien
ggatccttcagcttcgccgtaacga

SEQ ID NO: 29337 - DNA, 25 bp, Homo sapien
ccgggaagtcagagcggatccttca

SEQ ID NO: 29338 - DNA, 25 bp, Homo sapien
agccggcttcgaggcattcctctga

SEQ ID NO: 29339 - DNA, 25 bp, Homo sapien
gttcgctaatctcgaggagcccgga

SEQ ID NO: 29340 - DNA, 25 bp, Homo sapien
tggtgcagcccatcgtatcctacgc

SEQ ID NO: 29341 - DNA, 25 bp, Homo sapien
cgggtgtgctctttgtgaaattcca

SEQ ID NO: 29342 - DNA, 25 bp, Homo sapien
tccacagcgcagacgcctcagtttg

SEQ ID NO: 29343 - DNA, 25 bp, Homo sapien
ctcggaggccatgcagcgaagaaac

SEQ ID NO: 29344 - DNA, 25 bp, Homo sapien
cttcatggctagaggggcatttccc

SEQ ID NO: 29345 - DNA, 25 bp, Homo sapien
gggcatttcccaggagccgcccatg

SEQ ID NO: 29346 - DNA, 25 bp, Homo sapien
tattccggaagttgctctcagaggc

SEQ ID NO: 29347 - DNA, 25 bp, Homo sapien
tgaaattccaccatggcgtaccgtg

SEQ ID NO: 29348 - DNA, 25 bp, Homo sapien
ccagcgcggcatcctgtttgttttc

SEQ ID NO: 29349 - DNA, 25 bp, Homo sapien
gttcccagcggctcgccattgtttt

SEQ ID NO: 29350 - DNA, 25 bp, Homo sapien
ccctgggatatcgtaggtgagcctt

SEQ ID NO: 29351 - DNA, 25 bp, Homo sapien
cgcgcgttccgtacgtaaacacaca

SEQ ID NO: 29352 - DNA, 25 bp, Homo sapien
tcagcccgactatgcgcctagttta

SEQ ID NO: 29353 - DNA, 25 bp, Homo sapien
gactaggtctttctcatcagcccga

SEQ ID NO: 29354 - DNA, 25 bp, Homo sapien
cctgcgagtttccaccctgtgcaaa

SEQ ID NO: 29355 - DNA, 25 bp, Homo sapien
ggtgagccttttcatcccgattccg

SEQ ID NO: 29356 - DNA, 25 bp, Homo sapien
cccttgtcggtgaatctggcctccg

SEQ ID NO: 29357 - DNA, 25 bp, Homo sapien
tccagatgaagaggtcgatgaggac

SEQ ID NO: 29358 - DNA, 25 bp, Homo sapien
ggtcgtcgttccagatgaagaggtc

SEQ ID NO: 29359 - DNA, 25 bp, Homo sapien
actgtgagttcatcagcgccagctg

SEQ ID NO: 29360 - DNA, 25 bp, Homo sapien
gacgcgcctgttgaactgtgagttc

SEQ ID NO: 29361 - DNA, 25 bp, Homo sapien
tcgtacgtagatgatgtgccggctg

SEQ ID NO: 29362 - DNA, 25 bp, Homo sapien
ctggagttctggtcgtcgttccaga

SEQ ID NO: 29363 - DNA, 25 bp, Homo sapien
cgcggctcgtacgtagatgatgtgc

SEQ ID NO: 29364 - DNA, 25 bp, Homo sapien
aacttgctcgggtttccaatgcggc

SEQ ID NO: 29365 - DNA, 25 bp, Homo sapien
agtccatgactcaggcgcgagctgc

SEQ ID NO: 29366 - DNA, 25 bp, Homo sapien
gcgtgtgcctcctcaggtgaaagga

SEQ ID NO: 29367 - DNA, 25 bp, Homo sapien
tcgtccgggtccacggaaatgccga

SEQ ID NO: 29368 - DNA, 25 bp, Homo sapien
cgcacacgcagcatgccgacagtgg

SEQ ID NO: 29369 - DNA, 25 bp, Homo sapien
gcctagttttggtagcgacgaaatc

SEQ ID NO: 29370 - DNA, 25 bp, Homo sapien
actccgctaccttggtccgaacttg

SEQ ID NO: 29371 - DNA, 25 bp, Homo sapien
tgacacccggaaggatgcgaggact

SEQ ID NO: 29372 - DNA, 25 bp, Homo sapien
ttgtagttcggcaggtccttctccc

SEQ ID NO: 29373 - DNA, 25 bp, Homo sapien
ccgaaggagttccagttgtagttcg

SEQ ID NO: 29374 - DNA, 25 bp, Homo sapien
agttcggcaggtccttctcccgctg

SEQ ID NO: 29375 - DNA, 25 bp, Homo sapien
ttgccgaagcgcaggccgaaggagt

SEQ ID NO: 29376 - DNA, 25 bp, Homo sapien
ttctgccgtggttccctggtgccgc

SEQ ID NO: 29377 - DNA, 25 bp, Homo sapien
cgcttctgccgtggttccctggtgc

SEQ ID NO: 29378 - DNA, 25 bp, Homo sapien
agttccagttgtagttcggcaggtc

SEQ ID NO: 29379 - DNA, 25 bp, Homo sapien
tccagttgtagttcggcaggtcctt

SEQ ID NO: 29380 - DNA, 25 bp, Homo sapien
tggcagccgctcaaaacgggcactg

SEQ ID NO: 29381 - DNA, 25 bp, Homo sapien
atggaacagatgctctccggccgca

SEQ ID NO: 29382 - DNA, 25 bp, Homo sapien
gctgatccgatcataggccggcatg

SEQ ID NO: 29383 - DNA, 25 bp, Homo sapien
atggcgcttgtcctccagggcccag

SEQ ID NO: 29384 - DNA, 25 bp, Homo sapien
cccattgcggaaggcatggcgcttg

SEQ ID NO: 29385 - DNA, 25 bp, Homo sapien
cttgggatccagacggtggcatcct

SEQ ID NO: 29386 - DNA, 25 bp, Homo sapien
catcataatagactggctgccggga

SEQ ID NO: 29387 - DNA, 25 bp, Homo sapien
agctagaggcggcatccagctcatc

SEQ ID NO: 29388 - DNA, 25 bp, Homo sapien
agctcctcttcggaccgtttcctga

SEQ ID NO: 29389 - DNA, 25 bp, Homo sapien
ctcctgccgggactgttaacgggca

SEQ ID NO: 29390 - DNA, 25 bp, Homo sapien
gccgcctcggaaggtaattcacagc

SEQ ID NO: 29391 - DNA, 25 bp, Homo sapien
aattacgatgcctctcctgccggga

SEQ ID NO: 29392 - DNA, 25 bp, Homo sapien
gtttcctgaactttaatgacgggca

SEQ ID NO: 29393 - DNA, 25 bp, Homo sapien
aatctcatcggccatctcggtgtcc

SEQ ID NO: 29394 - DNA, 25 bp, Homo sapien
gcaggtccagccagtcaatctcatc

SEQ ID NO: 29395 - DNA, 25 bp, Homo sapien
ttagcgcggtgagtaattacgatgc

SEQ ID NO: 29396 - DNA, 25 bp, Homo sapien
gccgccgattggttttgccagattt

SEQ ID NO: 29397 - DNA, 25 bp, Homo sapien
tgtcggcttccttactcgaggtaga

SEQ ID NO: 29398 - DNA, 25 bp, Homo sapien
ggccgatcttcgagccagcagaaaa

SEQ ID NO: 29399 - DNA, 25 bp, Homo sapien
tccgactgacagagggttgaaaagc

SEQ ID NO: 29400 - DNA, 25 bp, Homo sapien
tcttgacagtctctcaggtagggcc

SEQ ID NO: 29401 - DNA, 25 bp, Homo sapien
gcctcggcgatggttttccgactga

SEQ ID NO: 29402 - DNA, 25 bp, Homo sapien
gctcgacgcttcaacaccatggata

SEQ ID NO: 29403 - DNA, 25 bp, Homo sapien
agaagagcctgcttgcgatcgccga

SEQ ID NO: 29404 - DNA, 25 bp, Homo sapien
aggcgcctcttgcaccagcgcgaga

SEQ ID NO: 29405 - DNA, 25 bp, Homo sapien
cccgggtgagacaatagcggcagca

SEQ ID NO: 29406 - DNA, 25 bp, Homo sapien
ctgctgcaacatccgacgtgtcttg

SEQ ID NO: 29407 - DNA, 25 bp, Homo sapien
atgcgtgtcctacctgcgctagctg

SEQ ID NO: 29408 - DNA, 25 bp, Homo sapien
tgcaacccgcaggatgcgtgtccta

SEQ ID NO: 29409 - DNA, 25 bp, Homo sapien
actttacagacgctggggccgatgc

SEQ ID NO: 29410 - DNA, 25 bp, Homo sapien
gcacctccgctgttgccatgttgga

SEQ ID NO: 29411 - DNA, 25 bp, Homo sapien
ggctgcttccattgttgcacctccg

SEQ ID NO: 29412 - DNA, 25 bp, Homo sapien
ctaccgagtgaagcactgagcgcgg

SEQ ID NO: 29413 - DNA, 25 bp, Homo sapien
gcagccctaccgagtgaagcactga

SEQ ID NO: 29414 - DNA, 25 bp, Homo sapien
tgccgcagccctaccgagtgaagca

SEQ ID NO: 29415 - DNA, 25 bp, Homo sapien
gcaacagtgcgtgcggcctggcctc

SEQ ID NO: 29416 - DNA, 25 bp, Homo sapien
cccagagcatgggaaggtcttggct

SEQ ID NO: 29417 - DNA, 25 bp, Homo sapien
gcactggccttcagagccgagcaga

SEQ ID NO: 29418 - DNA, 25 bp, Homo sapien
tggtcctgcactggccttcagagcc

SEQ ID NO: 29419 - DNA, 25 bp, Homo sapien
agctggtcctgcactggccttcaga

SEQ ID NO: 29420 - DNA, 25 bp, Homo sapien
ggcctcaccggaagccctcgtgtga

SEQ ID NO: 29421 - DNA, 25 bp, Homo sapien
gaggccggaagttgcggcttcatta

SEQ ID NO: 29422 - DNA, 25 bp, Homo sapien
gcggcttcattactcgccatttcaa

SEQ ID NO: 29423 - DNA, 25 bp, Homo sapien
atttcaaaatgctgccgaggcccta

SEQ ID NO: 29424 - DNA, 25 bp, Homo sapien
cgaggccctaggatctgtgactgcc

SEQ ID NO: 29425 - DNA, 25 bp, Homo sapien
caggcggccgtaccgccagttgtgc

SEQ ID NO: 29426 - DNA, 25 bp, Homo sapien
ccgtaccgccagttgtgcgggtagc

SEQ ID NO: 29427 - DNA, 25 bp, Homo sapien
taaggtgtggctcttggccttcgtc

SEQ ID NO: 29428 - DNA, 25 bp, Homo sapien
tgagggcgatggcagaatcccaatc

SEQ ID NO: 29429 - DNA, 25 bp, Homo sapien
gcgatggcagaatcccaatccgtcc

SEQ ID NO: 29430 - DNA, 25 bp, Homo sapien
tggagttatcctgggagcggctcca

SEQ ID NO: 29431 - DNA, 25 bp, Homo sapien
cccaacgtggagttatcctgggagc

SEQ ID NO: 29432 - DNA, 25 bp, Homo sapien
ccacgccagcgacctcggtgtccac

SEQ ID NO: 29433 - DNA, 25 bp, Homo sapien
ctccctctcccaagtctccggctcc

SEQ ID NO: 29434 - DNA, 25 bp, Homo sapien
ctggccgcttctgggcattctccag

SEQ ID NO: 29435 - DNA, 25 bp, Homo sapien
gggcgatggcagaatcccaatccgt

SEQ ID NO: 29436 - DNA, 25 bp, Homo sapien
gggctgcgtccggagcatccttccc

SEQ ID NO: 29437 - DNA, 25 bp, Homo sapien
agcggacagctcggacagcgcccag

SEQ ID NO: 29438 - DNA, 25 bp, Homo sapien
acgcgcacgggctggtctctgccct

SEQ ID NO: 29439 - DNA, 25 bp, Homo sapien
gtctctgccctaatgcggcggctgg

SEQ ID NO: 29440 - DNA, 25 bp, Homo sapien
ctctgccctaatgcggcggctggcg

SEQ ID NO: 29441 - DNA, 25 bp, Homo sapien
cggccgctaggagcgcgaagggagg

SEQ ID NO: 29442 - DNA, 25 bp, Homo sapien
ttggaggtaggcgagcgcgaacacc

SEQ ID NO: 29443 - DNA, 25 bp, Homo sapien
ccggcagcggacagctcggacagcg

SEQ ID NO: 29444 - DNA, 25 bp, Homo sapien
tccgagtccaggctgaaaatgactt

SEQ ID NO: 29445 - DNA, 25 bp, Homo sapien
tcaggacccttgtggctaggtcgca

SEQ ID NO: 29446 - DNA, 25 bp, Homo sapien
tccggagaagattgtgagtagtctc

SEQ ID NO: 29447 - DNA, 25 bp, Homo sapien
ctgagccagagtccgtcatcggtta

SEQ ID NO: 29448 - DNA, 25 bp, Homo sapien
acgtgccctatgagatccgagtcca

SEQ ID NO: 29449 - DNA, 25 bp, Homo sapien
aacaacgtcacagtgtggggctctc

SEQ ID NO: 29450 - DNA, 25 bp, Homo sapien
gactcgagaggcctggaacaacgtc

SEQ ID NO: 29451 - DNA, 25 bp, Homo sapien
ccgtcatcggttactccggagaaga

SEQ ID NO: 29452 - DNA, 25 bp, Homo sapien
gccaccagggcagcggtcaccagca

SEQ ID NO: 29453 - DNA, 25 bp, Homo sapien
acagcccgaggttccagcgagcagc

SEQ ID NO: 29454 - DNA, 25 bp, Homo sapien
tggccacgcctttgtctccgtggga

SEQ ID NO: 29455 - DNA, 25 bp, Homo sapien
ggcaggaccctcaggtctctccgca

SEQ ID NO: 29456 - DNA, 25 bp, Homo sapien
ggcagagctttctggaagggaccgc

SEQ ID NO: 29457 - DNA, 25 bp, Homo sapien
tcacctctgcggtcggcgtagagga

SEQ ID NO: 29458 - DNA, 25 bp, Homo sapien
aaggtgaccaggtctacgggtgcct

SEQ ID NO: 29459 - DNA, 25 bp, Homo sapien
ggcgtagaggacacccaaggccacc

SEQ ID NO: 29460 - DNA, 25 bp, Homo sapien
gccctacacgccctttgaggtcaag

SEQ ID NO: 29461 - DNA, 25 bp, Homo sapien
agcaacgagagcgtccggccctaca

SEQ ID NO: 29462 - DNA, 25 bp, Homo sapien
agggccgctactcttggcaaaggtt

SEQ ID NO: 29463 - DNA, 25 bp, Homo sapien
aacggagacggcttcggctacctgc

SEQ ID NO: 29464 - DNA, 25 bp, Homo sapien
ctttgtctacagcaacgagagcgtc

SEQ ID NO: 29465 - DNA, 25 bp, Homo sapien
tcacgggagtaccagaacggagacg

SEQ ID NO: 29466 - DNA, 25 bp, Homo sapien
tgaggtcaagatccgcagctacaac

SEQ ID NO: 29467 - DNA, 25 bp, Homo sapien
gcgccgatgcccagtactttgtcta

SEQ ID NO: 29468 - DNA, 25 bp, Homo sapien
gctccatctctaaactggggctctg

SEQ ID NO: 29469 - DNA, 25 bp, Homo sapien
aaggatcgctggaggacaccctcgc

SEQ ID NO: 29470 - DNA, 25 bp, Homo sapien
tctccactatccagaagcgtgaggg

SEQ ID NO: 29471 - DNA, 25 bp, Homo sapien
cagtgcgccgctatcggaacctttc

SEQ ID NO: 29472 - DNA, 25 bp, Homo sapien
cgtcactgccgttgcaaacaaacca

SEQ ID NO: 29473 - DNA, 25 bp, Homo sapien
cggaagaacttctgggtctcgcgca

SEQ ID NO: 29474 - DNA, 25 bp, Homo sapien
ggagcacttgatgtcgcggaagaac

SEQ ID NO: 29475 - DNA, 25 bp, Homo sapien
gattaactgctaccctctccgaacg

SEQ ID NO: 29476 - DNA, 25 bp, Homo sapien
cagcccgctctctgcaatgcaaaaa

SEQ ID NO: 29477 - DNA, 25 bp, Homo sapien
tcctcggcagggtccctcaagctgg

SEQ ID NO: 29478 - DNA, 25 bp, Homo sapien
tggagccgaaactgcgactcccacg

SEQ ID NO: 29479 - DNA, 25 bp, Homo sapien
tgcaatgcaaaaacgcagcagcatc

SEQ ID NO: 29480 - DNA, 25 bp, Homo sapien
aaaacgcagcagcatcgtcctccag

SEQ ID NO: 29481 - DNA, 25 bp, Homo sapien
ggggatcgcacggtgcaaccaaccc

SEQ ID NO: 29482 - DNA, 25 bp, Homo sapien
tcccattggccggttgccgctgtca

SEQ ID NO: 29483 - DNA, 25 bp, Homo sapien
ggtccctcaagctggagccgaaact

SEQ ID NO: 29484 - DNA, 25 bp, Homo sapien
agcccagcccgcgacttagctctcg

SEQ ID NO: 29485 - DNA, 25 bp, Homo sapien
cctgatttaaaggtgagcgcagacc

SEQ ID NO: 29486 - DNA, 25 bp, Homo sapien
cccgaagcaagcctcctgatttaaa

SEQ ID NO: 29487 - DNA, 25 bp, Homo sapien
tggcgggccaacttcagacgccggc

SEQ ID NO: 29488 - DNA, 25 bp, Homo sapien
tgctaactctgctggcgggccaact

SEQ ID NO: 29489 - DNA, 25 bp, Homo sapien
agaccacgggtgctaactctgctgg

SEQ ID NO: 29490 - DNA, 25 bp, Homo sapien
ctgggctggaagatgccgcttccca

SEQ ID NO: 29491 - DNA, 25 bp, Homo sapien
cctggggagaccacgggtgctaact

SEQ ID NO: 29492 - DNA, 25 bp, Homo sapien
aaggagcgctctccggagatgcatc

SEQ ID NO: 29493 - DNA, 25 bp, Homo sapien
tgctgcagcagatccgctcccggcc

SEQ ID NO: 29494 - DNA, 25 bp, Homo sapien
gctctccggagatgcatcgcgtctc

SEQ ID NO: 29495 - DNA, 25 bp, Homo sapien
cccagatgagaaggagcgctctccg

SEQ ID NO: 29496 - DNA, 25 bp, Homo sapien
cagggtatgtccgaccatgactccc

SEQ ID NO: 29497 - DNA, 25 bp, Homo sapien
gcagcagcagggtatgtccgaccat

SEQ ID NO: 29498 - DNA, 25 bp, Homo sapien
agggagcaccagacgtctcaggatt

SEQ ID NO: 29499 - DNA, 25 bp, Homo sapien
gatgcatcgcgtctcctacgccatg

SEQ ID NO: 29500 - DNA, 25 bp, Homo sapien
gttcggccaggactcaccgcagtcc

SEQ ID NO: 29501 - DNA, 25 bp, Homo sapien
ggccaggactcaccgcagtcccgga

SEQ ID NO: 29502 - DNA, 25 bp, Homo sapien
gcgttcggccaggactcaccgcagt

SEQ ID NO: 29503 - DNA, 25 bp, Homo sapien
gttcggggaccgctgcacagccaga

SEQ ID NO: 29504 - DNA, 25 bp, Homo sapien
agagttcggggaccgctgcacagcc

SEQ ID NO: 29505 - DNA, 25 bp, Homo sapien
ccagagttcggggaccgctgcacag

SEQ ID NO: 29506 - DNA, 25 bp, Homo sapien
gtgcaggcccgaagggcttcggccc

SEQ ID NO: 29507 - DNA, 25 bp, Homo sapien
cgggagacgacaggcggggcaaggc

SEQ ID NO: 29508 - DNA, 25 bp, Homo sapien
gaaaaagtagttgtaggatccagtg

SEQ ID NO: 29509 - DNA, 25 bp, Homo sapien
cgccctttcgcttcgttgcgcgccc

SEQ ID NO: 29510 - DNA, 25 bp, Homo sapien
gcttcccgcgggagcaccagttctt

SEQ ID NO: 29511 - DNA, 25 bp, Homo sapien
cggaagtgagcgtgacgtcacgtcc

SEQ ID NO: 29512 - DNA, 25 bp, Homo sapien
accagttcttcgaggtgcgtgagca

SEQ ID NO: 29513 - DNA, 25 bp, Homo sapien
tcttcgaggtgcgtgagcaaaagag

SEQ ID NO: 29514 - DNA, 25 bp, Homo sapien
tagttgtaggatccagtggggccta

SEQ ID NO: 29515 - DNA, 25 bp, Homo sapien
cgctgcctgtagagcgggatcccgc

SEQ ID NO: 29516 - DNA, 25 bp, Homo sapien
ccgtctcaccagagggcttggccag

SEQ ID NO: 29517 - DNA, 25 bp, Homo sapien
ctggcgagaagcagggccctaagaa

SEQ ID NO: 29518 - DNA, 25 bp, Homo sapien
cagctgaatgaacgagcggctgaag

SEQ ID NO: 29519 - DNA, 25 bp, Homo sapien
gcaggcgacagctgaatgaacgagc

SEQ ID NO: 29520 - DNA, 25 bp, Homo sapien
gcagcgatcagcaggcgacagctga

SEQ ID NO: 29521 - DNA, 25 bp, Homo sapien
agccagcaccgcgtagccaggcaga

SEQ ID NO: 29522 - DNA, 25 bp, Homo sapien
ctctcctttcctggcccactccggc

SEQ ID NO: 29523 - DNA, 25 bp, Homo sapien
cagggccctaagaagccgggctctc

SEQ ID NO: 29524 - DNA, 25 bp, Homo sapien
cgcgacgacaatgtggcagagtatc

SEQ ID NO: 29525 - DNA, 25 bp, Homo sapien
tgcacaagaagctggagcactaccg

SEQ ID NO: 29526 - DNA, 25 bp, Homo sapien
ctgaaactggccaacaacgcggaca

SEQ ID NO: 29527 - DNA, 25 bp, Homo sapien
agaccatcgcccagctgcacaagaa

SEQ ID NO: 29528 - DNA, 25 bp, Homo sapien
ggtgtcacgcatcaagcaagtgttc

SEQ ID NO: 29529 - DNA, 25 bp, Homo sapien
cagcccaaggacgtgctgcgggaca

SEQ ID NO: 29530 - DNA, 25 bp, Homo sapien
tcaccgagcagatcaagattgagca

SEQ ID NO: 29531 - DNA, 25 bp, Homo sapien
agaagatcctgaagatcaccgagca

SEQ ID NO: 29532 - DNA, 25 bp, Homo sapien
agttgttataaacgccctgagcccg

SEQ ID NO: 29533 - DNA, 25 bp, Homo sapien
gcgcgcagtaaagcacagcattcca

SEQ ID NO: 29534 - DNA, 25 bp, Homo sapien
tcaccgcctgcttcttcattagggg

SEQ ID NO: 29535 - DNA, 25 bp, Homo sapien
cgcaagtttgcgaccactgtccctg

SEQ ID NO: 29536 - DNA, 25 bp, Homo sapien
gtctccaggaactcgtagcggtgcc

SEQ ID NO: 29537 - DNA, 25 bp, Homo sapien
tggcaatcatcacagcagtacggtg

SEQ ID NO: 29538 - DNA, 25 bp, Homo sapien
cggactgacacatctgccagggaca

SEQ ID NO: 29539 - DNA, 25 bp, Homo sapien
accagcgactccatggcgagcagga

SEQ ID NO: 29540 - DNA, 25 bp, Homo sapien
gcgcgccgctgtcacacatgcagat

SEQ ID NO: 29541 - DNA, 25 bp, Homo sapien
ccctggtcaacttcactgggaagac

SEQ ID NO: 29542 - DNA, 25 bp, Homo sapien
tgacgttaggcacctccatggcagc

SEQ ID NO: 29543 - DNA, 25 bp, Homo sapien
cttccactggaagtccttgacgtta

SEQ ID NO: 29544 - DNA, 25 bp, Homo sapien
tctccagcagggagcagtagacccg

SEQ ID NO: 29545 - DNA, 25 bp, Homo sapien
ggagtagacctcgaagcagtccatg

SEQ ID NO: 29546 - DNA, 25 bp, Homo sapien
cgcagacgacgcatcactggggagc

SEQ ID NO: 29547 - DNA, 25 bp, Homo sapien
acacctgtgcaggaatccgcgtgcg

SEQ ID NO: 29548 - DNA, 25 bp, Homo sapien
cgccgaggtacccaatcaatgcaca

SEQ ID NO: 29549 - DNA, 25 bp, Homo sapien
gccagcgctgccttacttttgtctc

SEQ ID NO: 29550 - DNA, 25 bp, Homo sapien
tttccgggcacagctagaaagaccg

SEQ ID NO: 29551 - DNA, 25 bp, Homo sapien
acgggctcagcctgtgaacaaactc

SEQ ID NO: 29552 - DNA, 25 bp, Homo sapien
tatcacaagcttctacccgggtttc

SEQ ID NO: 29553 - DNA, 25 bp, Homo sapien
ctccgggagttaattatgaagccta

SEQ ID NO: 29554 - DNA, 25 bp, Homo sapien
gggtccctttaacctctgcggatga

SEQ ID NO: 29555 - DNA, 25 bp, Homo sapien
tcaatgcacaaatcttcggggtccc

SEQ ID NO: 29556 - DNA, 25 bp, Homo sapien
tataaggagcaaaggtaagcggaac

SEQ ID NO: 29557 - DNA, 25 bp, Homo sapien
gagcaaaggtaagcggaacggctct

SEQ ID NO: 29558 - DNA, 25 bp, Homo sapien
taagcggaacggctcttaaaggcgc

SEQ ID NO: 29559 - DNA, 25 bp, Homo sapien
cggaacggctcttaaaggcgcagtt

SEQ ID NO: 29560 - DNA, 25 bp, Homo sapien
acggctcttaaaggcgcagttttgc

SEQ ID NO: 29561 - DNA, 25 bp, Homo sapien
ttggagggaaataccggagcggcga

SEQ ID NO: 29562 - DNA, 25 bp, Homo sapien
aggggagagcagagatcacgaggcg

SEQ ID NO: 29563 - DNA, 25 bp, Homo sapien
gcgccgggtataaggagcaaaggta

SEQ ID NO: 29564 - DNA, 25 bp, Homo sapien
aggcaaccatttcgcgtcctgcaga

SEQ ID NO: 29565 - DNA, 25 bp, Homo sapien
ctgcagattcttgcctgtgccggga

SEQ ID NO: 29566 - DNA, 25 bp, Homo sapien
tccgctcaagaatctgcaggggttc

SEQ ID NO: 29567 - DNA, 25 bp, Homo sapien
ctgcctgaggaacacgccaaggtgc

SEQ ID NO: 29568 - DNA, 25 bp, Homo sapien
ttctgccagctgtgagcggcgctga

SEQ ID NO: 29569 - DNA, 25 bp, Homo sapien
gcgcaggacccgcacatttgggccg

SEQ ID NO: 29570 - DNA, 25 bp, Homo sapien
cactgttggctcatttccgggtggg

SEQ ID NO: 29571 - DNA, 25 bp, Homo sapien
aagcggggcgaaaccactgttggct

SEQ ID NO: 29572 - DNA, 25 bp, Homo sapien
ggaggagctgcacctcatctttcgc

SEQ ID NO: 29573 - DNA, 25 bp, Homo sapien
atctttcgcctcctcggtcagtctc

SEQ ID NO: 29574 - DNA, 25 bp, Homo sapien
atccactacgagatggccacaggga

SEQ ID NO: 29575 - DNA, 25 bp, Homo sapien
ctctgagttccgcacctacagcttc

SEQ ID NO: 29576 - DNA, 25 bp, Homo sapien
ccacagaagagacgtggcccggcgt

SEQ ID NO: 29577 - DNA, 25 bp, Homo sapien
tacattgcatccctttcaagtcggc

SEQ ID NO: 29578 - DNA, 25 bp, Homo sapien
atctttgctcccacctcatacattg

SEQ ID NO: 29579 - DNA, 25 bp, Homo sapien
ggcgtgggctgcatccactacgaga

SEQ ID NO: 29580 - DNA, 25 bp, Homo sapien
tgcgctgtcagacgcacagctcgct

SEQ ID NO: 29581 - DNA, 25 bp, Homo sapien
gggctctaaaatgggcgctcggtcc

SEQ ID NO: 29582 - DNA, 25 bp, Homo sapien
ccctagccttatccggagatacagg

SEQ ID NO: 29583 - DNA, 25 bp, Homo sapien
tggagcgtcttcttcagcttcggcc

SEQ ID NO: 29584 - DNA, 25 bp, Homo sapien
cagatctcctgggtcttcttctcgc

SEQ ID NO: 29585 - DNA, 25 bp, Homo sapien
gtcttcaaaaggacgtgagtgccgc

SEQ ID NO: 29586 - DNA, 25 bp, Homo sapien
gatacaggatgtctcgggctctcca

SEQ ID NO: 29587 - DNA, 25 bp, Homo sapien
gggctctccatctgccgggctctaa

SEQ ID NO: 29588 - DNA, 25 bp, Homo sapien
actcgctgcagtacaaaggtgaggg

SEQ ID NO: 29589 - DNA, 25 bp, Homo sapien
ctacaacgtcgtcttcctgttcgtg

SEQ ID NO: 29590 - DNA, 25 bp, Homo sapien
ggaacactgcggttcccgcctggtc

SEQ ID NO: 29591 - DNA, 25 bp, Homo sapien
tccttgggctagagaggaaacgcca

SEQ ID NO: 29592 - DNA, 25 bp, Homo sapien
gatgctcagcttttcgcaattccta

SEQ ID NO: 29593 - DNA, 25 bp, Homo sapien
cacctctgccgcgacaggttggcgt

SEQ ID NO: 29594 - DNA, 25 bp, Homo sapien
gtgctgcttattttctcctacaacg

SEQ ID NO: 29595 - DNA, 25 bp, Homo sapien
cagcatgctggcctacacggaggac

SEQ ID NO: 29596 - DNA, 25 bp, Homo sapien
cgtctgccagcaaacccgggtttgg

SEQ ID NO: 29597 - DNA, 25 bp, Homo sapien
gcgccactttctcctcggttggagg

SEQ ID NO: 29598 - DNA, 25 bp, Homo sapien
ggactcctcaaaggcgcgccacttt

SEQ ID NO: 29599 - DNA, 25 bp, Homo sapien
gtcgcgttcggtgcggttgcttcca

SEQ ID NO: 29600 - DNA, 25 bp, Homo sapien
gtcgtgagccgcgtctgccagcaaa

SEQ ID NO: 29601 - DNA, 25 bp, Homo sapien
cgtagtcgctacacgtcacttccgg

SEQ ID NO: 29602 - DNA, 25 bp, Homo sapien
tcctcctcacgctggaaactcgagg

SEQ ID NO: 29603 - DNA, 25 bp, Homo sapien
cgggacctcggactcctcaaaggcg

SEQ ID NO: 29604 - DNA, 25 bp, Homo sapien
acccgcgacgacttcgagggcgact

SEQ ID NO: 29605 - DNA, 25 bp, Homo sapien
acccgacgccgccaggtactgccag

SEQ ID NO: 29606 - DNA, 25 bp, Homo sapien
gacggagtacgccatcaagtgcgcc

SEQ ID NO: 29607 - DNA, 25 bp, Homo sapien
acttcgagggcgactggcgcctagt

SEQ ID NO: 29608 - DNA, 25 bp, Homo sapien
gtcttcacccgcgacgacttcgagg

SEQ ID NO: 29609 - DNA, 25 bp, Homo sapien
gctccttcggccacccaggcagcag

SEQ ID NO: 29610 - DNA, 25 bp, Homo sapien
ccctctcccggacccgaggagcagg

SEQ ID NO: 29611 - DNA, 25 bp, Homo sapien
cgctggcggacggagtacgccatca

SEQ ID NO: 29612 - DNA, 25 bp, Homo sapien
tcgcccacgaaatccgtgtaaaaca

SEQ ID NO: 29613 - DNA, 25 bp, Homo sapien
ccttctgctggctcggtggggccca

SEQ ID NO: 29614 - DNA, 25 bp, Homo sapien
agctcagccacgaagagccggcgca

SEQ ID NO: 29615 - DNA, 25 bp, Homo sapien
gcacagctcagccacgaagagccgg

SEQ ID NO: 29616 - DNA, 25 bp, Homo sapien
gtcatgagtgccatccagctgcaca

SEQ ID NO: 29617 - DNA, 25 bp, Homo sapien
taaaacagcgtgaaggtcatgagtg

SEQ ID NO: 29618 - DNA, 25 bp, Homo sapien
tccgtgtaaaacagcgtgaaggtca

SEQ ID NO: 29619 - DNA, 25 bp, Homo sapien
tcagctctgggcacgccctggtaca

SEQ ID NO: 29620 - DNA, 25 bp, Homo sapien
cgcggggcgcaaaacacgcgacagc

SEQ ID NO: 29621 - DNA, 25 bp, Homo sapien
aagtcccggactgtgcgcgccgcag

SEQ ID NO: 29622 - DNA, 25 bp, Homo sapien
gccagccggcggcttttaaatctcc

SEQ ID NO: 29623 - DNA, 25 bp, Homo sapien
ctatcattacctagggcagggcacc

SEQ ID NO: 29624 - DNA, 25 bp, Homo sapien
tctgtcgctcgccaccaaacattta

SEQ ID NO: 29625 - DNA, 25 bp, Homo sapien
ttaggtgaaagctacccggcttcgc

SEQ ID NO: 29626 - DNA, 25 bp, Homo sapien
cctccgcggaagaaagcacagctca

SEQ ID NO: 29627 - DNA, 25 bp, Homo sapien
aaaagtctgacacgggaggctgcaa

SEQ ID NO: 29628 - DNA, 25 bp, Homo sapien
ttcagggctcctggaacagacgagc

SEQ ID NO: 29629 - DNA, 25 bp, Homo sapien
aaactccgctgctctttggttcagg

SEQ ID NO: 29630 - DNA, 25 bp, Homo sapien
cgaacttcagccgatgggaccgctg

SEQ ID NO: 29631 - DNA, 25 bp, Homo sapien
ttcgctgtcgaaacaggaccgagtc

SEQ ID NO: 29632 - DNA, 25 bp, Homo sapien
ggatccagtcccgaactctcacttt

SEQ ID NO: 29633 - DNA, 25 bp, Homo sapien
gcccattattttccaggatccagtc

SEQ ID NO: 29634 - DNA, 25 bp, Homo sapien
cgcacctccctgagtacggacattt

SEQ ID NO: 29635 - DNA, 25 bp, Homo sapien
gcgaactttggggttaactctctca

SEQ ID NO: 29636 - DNA, 25 bp, Homo sapien
gctgtcctgggaatatcgctgcacc

SEQ ID NO: 29637 - DNA, 25 bp, Homo sapien
gttgcctgtggcactacatttccca

SEQ ID NO: 29638 - DNA, 25 bp, Homo sapien
agctccttacaccactggggccaga

SEQ ID NO: 29639 - DNA, 25 bp, Homo sapien
gagcggctccaagtcagtgactgaa

SEQ ID NO: 29640 - DNA, 25 bp, Homo sapien
cccagctttcctcgcggtaaagaga

SEQ ID NO: 29641 - DNA, 25 bp, Homo sapien
ggatccggaccctcttcaaactgaa

SEQ ID NO: 29642 - DNA, 25 bp, Homo sapien
ctcccaccgtggacttgtagtgttt

SEQ ID NO: 29643 - DNA, 25 bp, Homo sapien
tctgggctgctctgacgagaaagca

SEQ ID NO: 29644 - DNA, 25 bp, Homo sapien
cgtcactttaggctccctccagatt

SEQ ID NO: 29645 - DNA, 25 bp, Homo sapien
aggatatatcgcttcgggcccggcg

SEQ ID NO: 29646 - DNA, 25 bp, Homo sapien
ttctcggatggacaacagcagcagc

SEQ ID NO: 29647 - DNA, 25 bp, Homo sapien
cctctggatgtttccttggagcctc

SEQ ID NO: 29648 - DNA, 25 bp, Homo sapien
gtaaacgtccctgtggagccagcca

SEQ ID NO: 29649 - DNA, 25 bp, Homo sapien
tcccacttggtacccggacagaaca

SEQ ID NO: 29650 - DNA, 25 bp, Homo sapien
tggcaaacgtgatctggggcagact

SEQ ID NO: 29651 - DNA, 25 bp, Homo sapien
ccagattccgcgttccttgagcaaa

SEQ ID NO: 29652 - DNA, 25 bp, Homo sapien
ggagggacccacatatgagcatagg

SEQ ID NO: 29653 - DNA, 25 bp, Homo sapien
gacgcgttcctctttgctgaactga

SEQ ID NO: 29654 - DNA, 25 bp, Homo sapien
cgggcccatcgatctggagacggta

SEQ ID NO: 29655 - DNA, 25 bp, Homo sapien
cggtagggaaaactaggagcagcat

SEQ ID NO: 29656 - DNA, 25 bp, Homo sapien
tccagctgcagtagcagatgctttg

SEQ ID NO: 29657 - DNA, 25 bp, Homo sapien
agcgcctctttcatcgcgacgcgtt

SEQ ID NO: 29658 - DNA, 25 bp, Homo sapien
aggagcagcatagccaccagggcca

SEQ ID NO: 29659 - DNA, 25 bp, Homo sapien
agggattcgcgacgccctttgatgc

SEQ ID NO: 29660 - DNA, 25 bp, Homo sapien
tggtcctggacagagaacacggcct

SEQ ID NO: 29661 - DNA, 25 bp, Homo sapien
agaacacggcctggaactgcctccg

SEQ ID NO: 29662 - DNA, 25 bp, Homo sapien
gagatcgctgcagcatcccacgggc

SEQ ID NO: 29663 - DNA, 25 bp, Homo sapien
gtgacatagtccagcgtgcccagga

SEQ ID NO: 29664 - DNA, 25 bp, Homo sapien
ggttccgcacggcttcctggaagcg

SEQ ID NO: 29665 - DNA, 25 bp, Homo sapien
actaccgtctggaagtcctccatgg

SEQ ID NO: 29666 - DNA, 25 bp, Homo sapien
cgctcacctgcggagagaaacagag

SEQ ID NO: 29667 - DNA, 25 bp, Homo sapien
tgcaggttccaaaacacgtcctggg

SEQ ID NO: 29668 - DNA, 25 bp, Homo sapien
agaggagcttatctgcctgcctgcg

SEQ ID NO: 29669 - DNA, 25 bp, Homo sapien
gtgggtgcctgcgaacctcactcct

SEQ ID NO: 29670 - DNA, 25 bp, Homo sapien
tgagtgcgcagaggagcttatctgc

SEQ ID NO: 29671 - DNA, 25 bp, Homo sapien
cttcctgccctgagcgcgacaccga

SEQ ID NO: 29672 - DNA, 25 bp, Homo sapien
ctctgcaggagccaactggcgagcc

SEQ ID NO: 29673 - DNA, 25 bp, Homo sapien
atgcacctgtggagagacggcccga

SEQ ID NO: 29674 - DNA, 25 bp, Homo sapien
ggaggagtgactgcctctcaccatc

SEQ ID NO: 29675 - DNA, 25 bp, Homo sapien
gccaacagccgccagccgaagtgcc

SEQ ID NO: 29676 - DNA, 25 bp, Homo sapien
ttctcttgggtcgtccttcctgcca

SEQ ID NO: 29677 - DNA, 25 bp, Homo sapien
agcatcttcgagcagccgcaggatc

SEQ ID NO: 29678 - DNA, 25 bp, Homo sapien
gagtagcgcagtcgccaaagccgcc

SEQ ID NO: 29679 - DNA, 25 bp, Homo sapien
aggcgctcctctgcggaatcctgca

SEQ ID NO: 29680 - DNA, 25 bp, Homo sapien
gctgtactgtacagaggcgctcctc

SEQ ID NO: 29681 - DNA, 25 bp, Homo sapien
gaaatgcgccctctgagctgtactg

SEQ ID NO: 29682 - DNA, 25 bp, Homo sapien
tcctgtcggcaccatcagcgggaga

SEQ ID NO: 29683 - DNA, 25 bp, Homo sapien
cgccgcgctatctacagagcctgag

SEQ ID NO: 29684 - DNA, 25 bp, Homo sapien
agccggctttgaggaaccttgcaga

SEQ ID NO: 29685 - DNA, 25 bp, Homo sapien
cagagctaggggcttacgccaagcg

SEQ ID NO: 29686 - DNA, 25 bp, Homo sapien
ctgaaagaaacgcaggcggcccgcc

SEQ ID NO: 29687 - DNA, 25 bp, Homo sapien
cgaaaccgcagagcccggacgagtc

SEQ ID NO: 29688 - DNA, 25 bp, Homo sapien
gccggggacacgaaaccgcagagcc

SEQ ID NO: 29689 - DNA, 25 bp, Homo sapien
actgctttacgcgaggggcaggaaa

SEQ ID NO: 29690 - DNA, 25 bp, Homo sapien
ttcagaactgctttacgcgaggggc

SEQ ID NO: 29691 - DNA, 25 bp, Homo sapien
aagtggcttcagaactgctttacgc

SEQ ID NO: 29692 - DNA, 25 bp, Homo sapien
gtggccgcacaaacttctggtcctg

SEQ ID NO: 29693 - DNA, 25 bp, Homo sapien
gtcaggtcgcaccaacacagagttg

SEQ ID NO: 29694 - DNA, 25 bp, Homo sapien
attcccttctaagtggcgaggaggc

SEQ ID NO: 29695 - DNA, 25 bp, Homo sapien
cccatccttagcttctgccttagaa

SEQ ID NO: 29696 - DNA, 25 bp, Homo sapien
catccggccggtgcttaccttcaag

SEQ ID NO: 29697 - DNA, 25 bp, Homo sapien
ttaccttcaagccatagggcgcccg

SEQ ID NO: 29698 - DNA, 25 bp, Homo sapien
gttcggcactgaagctggacagctc

SEQ ID NO: 29699 - DNA, 25 bp, Homo sapien
gagttgccaaaaacagcccttcttc

SEQ ID NO: 29700 - DNA, 25 bp, Homo sapien
ttccccgtccgtagcgactcggcca

SEQ ID NO: 29701 - DNA, 25 bp, Homo sapien
tacctggaactaaagcagggcaggg

SEQ ID NO: 29702 - DNA, 25 bp, Homo sapien
gtacctggaactaaagcagggcagg

SEQ ID NO: 29703 - DNA, 25 bp, Homo sapien
ggtacctggaactaaagcagggcag

SEQ ID NO: 29704 - DNA, 25 bp, Homo sapien
cggtacctggaactaaagcagggca

SEQ ID NO: 29705 - DNA, 25 bp, Homo sapien
gcggtacctggaactaaagcagggc

SEQ ID NO: 29706 - DNA, 25 bp, Homo sapien
tggccgttgccgctggggaggccgc

SEQ ID NO: 29707 - DNA, 25 bp, Homo sapien
gcgcagcttcgtggccgttgccgct

SEQ ID NO: 29708 - DNA, 25 bp, Homo sapien
gcgccagggacccaaacagcctagg

SEQ ID NO: 29709 - DNA, 25 bp, Homo sapien
ttagaacttccaggacgcaacgtgc

SEQ ID NO: 29710 - DNA, 25 bp, Homo sapien
ccagcagcggaggtaacggcgccac

SEQ ID NO: 29711 - DNA, 25 bp, Homo sapien
ctgcagtgtctggtcgagagtaccc

SEQ ID NO: 29712 - DNA, 25 bp, Homo sapien
gcgccagtactagcacccgctagga

SEQ ID NO: 29713 - DNA, 25 bp, Homo sapien
cgtagctgcgccgaggcgtttcccg

SEQ ID NO: 29714 - DNA, 25 bp, Homo sapien
gatcgcgggctaactgctactttca

SEQ ID NO: 29715 - DNA, 25 bp, Homo sapien
cgcaacgtgctattaagggaccgtg

SEQ ID NO: 29716 - DNA, 25 bp, Homo sapien
gtcaagtccggcctgcagatcaaga

SEQ ID NO: 29717 - DNA, 25 bp, Homo sapien
gttggcttcgggacttctgctaatt

SEQ ID NO: 29718 - DNA, 25 bp, Homo sapien
aagtcggatcgcagaggtttattta

SEQ ID NO: 29719 - DNA, 25 bp, Homo sapien
ggcccattactcattgagccggttg

SEQ ID NO: 29720 - DNA, 25 bp, Homo sapien
ggctgggcatcaacggcaaagtttt

SEQ ID NO: 29721 - DNA, 25 bp, Homo sapien
gaaattcgccctcaaagtaggtctg

SEQ ID NO: 29722 - DNA, 25 bp, Homo sapien
atgctgtccaactcccagggccaga

SEQ ID NO: 29723 - DNA, 25 bp, Homo sapien
agcagttcccgcagttccacgtcaa

SEQ ID NO: 29724 - DNA, 25 bp, Homo sapien
agctccaccctgtgggaagccctgg

SEQ ID NO: 29725 - DNA, 25 bp, Homo sapien
gggagctctccagggcgcgcatcct

SEQ ID NO: 29726 - DNA, 25 bp, Homo sapien
ggcgcgggaagccacactcgggtcc

SEQ ID NO: 29727 - DNA, 25 bp, Homo sapien
cgtcatgctactactcccagctcca

SEQ ID NO: 29728 - DNA, 25 bp, Homo sapien
cggagccagcgcactctttccgcta

SEQ ID NO: 29729 - DNA, 25 bp, Homo sapien
gcaggcgctgtagatgttgttttgg

SEQ ID NO: 29730 - DNA, 25 bp, Homo sapien
tagatgttgttttgggagcgcggtc

SEQ ID NO: 29731 - DNA, 25 bp, Homo sapien
cctgtgcctagggaacagcgagggc

SEQ ID NO: 29732 - DNA, 25 bp, Homo sapien
ccctgcaaaacatgggtgccgtcct

SEQ ID NO: 29733 - DNA, 25 bp, Homo sapien
cggggccaaacatcgcgagaagttg

SEQ ID NO: 29734 - DNA, 25 bp, Homo sapien
tggttgcagttatcgcgacgcttcg

SEQ ID NO: 29735 - DNA, 25 bp, Homo sapien
cggcttctgccttagtaccttagca

SEQ ID NO: 29736 - DNA, 25 bp, Homo sapien
ccaggcgccgggtggactccaaaat

SEQ ID NO: 29737 - DNA, 25 bp, Homo sapien
atggcggcaatttggccctggagtt

SEQ ID NO: 29738 - DNA, 25 bp, Homo sapien
atccgacgaggattcgctgaccgcc

SEQ ID NO: 29739 - DNA, 25 bp, Homo sapien
tggcgacctttagcggggccaaaca

SEQ ID NO: 29740 - DNA, 25 bp, Homo sapien
gcccgattggtggatgattctctcc

SEQ ID NO: 29741 - DNA, 25 bp, Homo sapien
gttaccaagcaacagtgccaccagg

SEQ ID NO: 29742 - DNA, 25 bp, Homo sapien
ccttcccgagccagttaggcgattg

SEQ ID NO: 29743 - DNA, 25 bp, Homo sapien
ggccagacgggctcacatgatttgc

SEQ ID NO: 29744 - DNA, 25 bp, Homo sapien
ctctcgcgagagtcagaaaaaagtc

SEQ ID NO: 29745 - DNA, 25 bp, Homo sapien
ttctctccaggtgaggacctacgcg

SEQ ID NO: 29746 - DNA, 25 bp, Homo sapien
ctgggaaactcaggagcttgtgatc

SEQ ID NO: 29747 - DNA, 25 bp, Homo sapien
ttgtgatctctctggttccgacttc

SEQ ID NO: 29748 - DNA, 25 bp, Homo sapien
catttaactggtattgcggagccac

SEQ ID NO: 29749 - DNA, 25 bp, Homo sapien
gggatgctccgcttagacgaactca

SEQ ID NO: 29750 - DNA, 25 bp, Homo sapien
ttctagaaggcaggtcatcgcaggc

SEQ ID NO: 29751 - DNA, 25 bp, Homo sapien
gggcagcaaggcctgcgatacttga

SEQ ID NO: 29752 - DNA, 25 bp, Homo sapien
gccgtcctgtgcctttaaggctctc

SEQ ID NO: 29753 - DNA, 25 bp, Homo sapien
gccacgaggcttctgcttactgcaa

SEQ ID NO: 29754 - DNA, 25 bp, Homo sapien
acccagcagtggagagagtgagtcc

SEQ ID NO: 29755 - DNA, 25 bp, Homo sapien
tcggtctctgagacacgcacagggg

SEQ ID NO: 29756 - DNA, 25 bp, Homo sapien
gccaggagtcgctggccaccggtct

SEQ ID NO: 29757 - DNA, 25 bp, Homo sapien
ctgtcagggagaccactgccatgcc

SEQ ID NO: 29758 - DNA, 25 bp, Homo sapien
aaggcagaggccagcgaccctgtca

SEQ ID NO: 29759 - DNA, 25 bp, Homo sapien
gcagcgttgcaccacttcttcgtga

SEQ ID NO: 29760 - DNA, 25 bp, Homo sapien
ccaggacttgctgtgcatgagagtc

SEQ ID NO: 29761 - DNA, 25 bp, Homo sapien
aggcctggagataggcggccacacc

SEQ ID NO: 29762 - DNA, 25 bp, Homo sapien
tgcgaatgaaagctaccgtccggtc

SEQ ID NO: 29763 - DNA, 25 bp, Homo sapien
actgccatgccgtcccagtggatgg

SEQ ID NO: 29764 - DNA, 25 bp, Homo sapien
ccagctagccacgtgaggctgtttc

SEQ ID NO: 29765 - DNA, 25 bp, Homo sapien
gggttttcttggctctcgtcgcacc

SEQ ID NO: 29766 - DNA, 25 bp, Homo sapien
gaaccgcgctcttgcccagcaaaag

SEQ ID NO: 29767 - DNA, 25 bp, Homo sapien
aggctgtttctgtacacccgaaccg

SEQ ID NO: 29768 - DNA, 25 bp, Homo sapien
ccgctagctttgagggaccactgca

SEQ ID NO: 29769 - DNA, 25 bp, Homo sapien
cgtgtgccggacactatttaagggc

SEQ ID NO: 29770 - DNA, 25 bp, Homo sapien
tgcgctcagaactagcacgtgtgcc

SEQ ID NO: 29771 - DNA, 25 bp, Homo sapien
ccaggattctgcaggtgctcatcgc

SEQ ID NO: 29772 - DNA, 25 bp, Homo sapien
ttaagtcgtgacgagcgcagtggaa

SEQ ID NO: 29773 - DNA, 25 bp, Homo sapien
cgtgacgagcgcagtggaaggcgca

SEQ ID NO: 29774 - DNA, 25 bp, Homo sapien
ccttctgctgcggaggatccctgct

SEQ ID NO: 29775 - DNA, 25 bp, Homo sapien
tctgctgcggaggatccctgctggc

SEQ ID NO: 29776 - DNA, 25 bp, Homo sapien
gatccttctgcgcactggagaccct

SEQ ID NO: 29777 - DNA, 25 bp, Homo sapien
ttctgcgcactggagaccctcgctg

SEQ ID NO: 29778 - DNA, 25 bp, Homo sapien
cttaagtcgtgacgagcgcagtgga

SEQ ID NO: 29779 - DNA, 25 bp, Homo sapien
tgcaggggcttaagtcgtgacgagc

SEQ ID NO: 29780 - DNA, 25 bp, Homo sapien
gcagacgcgttttcttccttagttg

SEQ ID NO: 29781 - DNA, 25 bp, Homo sapien
agcctcccggagtgtgccaaaactt

SEQ ID NO: 29782 - DNA, 25 bp, Homo sapien
ttctgtcacgaacgaggccatggcc

SEQ ID NO: 29783 - DNA, 25 bp, Homo sapien
ccaagacgggaaccaacgctgactg

SEQ ID NO: 29784 - DNA, 25 bp, Homo sapien
gctgactgggtcactctcgtagcca

SEQ ID NO: 29785 - DNA, 25 bp, Homo sapien
cgcgccaatcccgagatgggatttc

SEQ ID NO: 29786 - DNA, 25 bp, Homo sapien
cacggtgtcccgtagttggcaaact

SEQ ID NO: 29787 - DNA, 25 bp, Homo sapien
ttggcaaactgtaagcagacgcgtt

SEQ ID NO: 29788 - DNA, 25 bp, Homo sapien
gcgggaaccacgcagaagcttgttt

SEQ ID NO: 29789 - DNA, 25 bp, Homo sapien
tgcggccctggaaactgtgagtttg

SEQ ID NO: 29790 - DNA, 25 bp, Homo sapien
ttggggattgttgtgtccactaacc

SEQ ID NO: 29791 - DNA, 25 bp, Homo sapien
tgctcacctccggataaatcacggg

SEQ ID NO: 29792 - DNA, 25 bp, Homo sapien
aggctagagctctgctcagtcagtc

SEQ ID NO: 29793 - DNA, 25 bp, Homo sapien
cgaagctcactgcacgtcgtgcctg

SEQ ID NO: 29794 - DNA, 25 bp, Homo sapien
cccggcgctaagactcaatttcaca

SEQ ID NO: 29795 - DNA, 25 bp, Homo sapien
tggctgcgttcccaaaagaagcgtg

SEQ ID NO: 29796 - DNA, 25 bp, Homo sapien
ctggggtgaaacgctggggggcgtg

SEQ ID NO: 29797 - DNA, 25 bp, Homo sapien
gggctgacgaggcacccagggcccc

SEQ ID NO: 29798 - DNA, 25 bp, Homo sapien
ccgggctgacgaggcacccagggcc

SEQ ID NO: 29799 - DNA, 25 bp, Homo sapien
cgggctgacgaggcacccagggccc

SEQ ID NO: 29800 - DNA, 25 bp, Homo sapien
ctgacgaggcacccagggccccgca

SEQ ID NO: 29801 - DNA, 25 bp, Homo sapien
gctgacgaggcacccagggccccgc

SEQ ID NO: 29802 - DNA, 25 bp, Homo sapien
gaagccgggagcctgttgggcagcc

SEQ ID NO: 29803 - DNA, 25 bp, Homo sapien
gggagcctgttgggcagccggcgcc

SEQ ID NO: 29804 - DNA, 25 bp, Homo sapien
tatctggacccagaagggacttccc

SEQ ID NO: 29805 - DNA, 25 bp, Homo sapien
tagagctctcctcagtcgggcaaga

SEQ ID NO: 29806 - DNA, 25 bp, Homo sapien
ggcgagccagtcctttcccgcagga

SEQ ID NO: 29807 - DNA, 25 bp, Homo sapien
ctgttctgttaggttccgccagggc

SEQ ID NO: 29808 - DNA, 25 bp, Homo sapien
cctgtcctgcagcactggatgcttt

SEQ ID NO: 29809 - DNA, 25 bp, Homo sapien
cctccggagaaataacagcgtcttc

SEQ ID NO: 29810 - DNA, 25 bp, Homo sapien
ggctctcggtttctctgctttcctc

SEQ ID NO: 29811 - DNA, 25 bp, Homo sapien
cagagcccgaggtgaagcttgtttg

SEQ ID NO: 29812 - DNA, 25 bp, Homo sapien
ggcctgccaactgattcggaaattc

SEQ ID NO: 29813 - DNA, 25 bp, Homo sapien
tcccagaatttgaccatgggcttgc

SEQ ID NO: 29814 - DNA, 25 bp, Homo sapien
cgtgtccgggaaaatctgcagcagc

SEQ ID NO: 29815 - DNA, 25 bp, Homo sapien
cgctgcacgctcgtgtccgggaaaa

SEQ ID NO: 29816 - DNA, 25 bp, Homo sapien
ggggtactgcgcaaacaggctctcc

SEQ ID NO: 29817 - DNA, 25 bp, Homo sapien
aatacctcgagccttggcgcaccag

SEQ ID NO: 29818 - DNA, 25 bp, Homo sapien
tacgcattaatacctcgagccttgg

SEQ ID NO: 29819 - DNA, 25 bp, Homo sapien
acctgtcaggccgtgtggccgtcgc

SEQ ID NO: 29820 - DNA, 25 bp, Homo sapien
ggctcctagagagacgcaccgagtg

SEQ ID NO: 29821 - DNA, 25 bp, Homo sapien
tgctgaccgattcacacctcggcta

SEQ ID NO: 29822 - DNA, 25 bp, Homo sapien
acactactcggcttggccaggacgc

SEQ ID NO: 29823 - DNA, 25 bp, Homo sapien
acgcaccgagtggaagacactactc

SEQ ID NO: 29824 - DNA, 25 bp, Homo sapien
ggtactcacgcagcaaactcagcaa

SEQ ID NO: 29825 - DNA, 25 bp, Homo sapien
tcagcaagcaaagcgcggtccagcc

SEQ ID NO: 29826 - DNA, 25 bp, Homo sapien
ctccgtgagactctgctctgctgtt

SEQ ID NO: 29827 - DNA, 25 bp, Homo sapien
gcgggcggtactcacgcagcaaact

SEQ ID NO: 29828 - DNA, 25 bp, Homo sapien
cgcgccggtcctcaagtctcttgag

SEQ ID NO: 29829 - DNA, 25 bp, Homo sapien
ccacgcttgcaacaccagggctgta

SEQ ID NO: 29830 - DNA, 25 bp, Homo sapien
gccgctcctccaaacatgattcaga

SEQ ID NO: 29831 - DNA, 25 bp, Homo sapien
gactcctagtttttgccgccgctga

SEQ ID NO: 29832 - DNA, 25 bp, Homo sapien
ggggaagccagcatctcttgccctc

SEQ ID NO: 29833 - DNA, 25 bp, Homo sapien
catcccacgtaagtgctgtggaacc

SEQ ID NO: 29834 - DNA, 25 bp, Homo sapien
cgcgcgaggatttcttttgcagaga

SEQ ID NO: 29835 - DNA, 25 bp, Homo sapien
cttgagccatttcggttccgggcgc

SEQ ID NO: 29836 - DNA, 25 bp, Homo sapien
acagctcactgaaggctgcagcctc

SEQ ID NO: 29837 - DNA, 25 bp, Homo sapien
gccggggaattcgttcccagctcca

SEQ ID NO: 29838 - DNA, 25 bp, Homo sapien
cgctgtgtttttccaggtccgcgcg

SEQ ID NO: 29839 - DNA, 25 bp, Homo sapien
gaggcctgaaatccgccatttgttc

SEQ ID NO: 29840 - DNA, 25 bp, Homo sapien
gcaaggcgccatggcacggccgctt

SEQ ID NO: 29841 - DNA, 25 bp, Homo sapien
acggccgcttccacgcagcggaggt

SEQ ID NO: 29842 - DNA, 25 bp, Homo sapien
accagccaagcgctgtgtttttcca

SEQ ID NO: 29843 - DNA, 25 bp, Homo sapien
tgcatggcccggaggcctgaaatcc

SEQ ID NO: 29844 - DNA, 25 bp, Homo sapien
tcattatcatagaggccgcgcgcgt

SEQ ID NO: 29845 - DNA, 25 bp, Homo sapien
gtattcctgaagtcgctcctcggtc

SEQ ID NO: 29846 - DNA, 25 bp, Homo sapien
tcagatttttccagcgcgactttcc

SEQ ID NO: 29847 - DNA, 25 bp, Homo sapien
tccggttcgttcacagtcccatttc

SEQ ID NO: 29848 - DNA, 25 bp, Homo sapien
ccgggagcctggctttccagatcta

SEQ ID NO: 29849 - DNA, 25 bp, Homo sapien
tccagatctatttcgaggtttgctc

SEQ ID NO: 29850 - DNA, 25 bp, Homo sapien
cgctcgccctctcggctgaaaaatt

SEQ ID NO: 29851 - DNA, 25 bp, Homo sapien
tcggaatcagggagacgaccaaatc

SEQ ID NO: 29852 - DNA, 25 bp, Homo sapien
cgcgttcgcaagactcggctaattg

SEQ ID NO: 29853 - DNA, 25 bp, Homo sapien
attgattcgacgctggctttgcttc

SEQ ID NO: 29854 - DNA, 25 bp, Homo sapien
gccggctcggcgaaagattaaaaca

SEQ ID NO: 29855 - DNA, 25 bp, Homo sapien
tgcccgcgaagattagtttcaatta

SEQ ID NO: 29856 - DNA, 25 bp, Homo sapien
ggaccatgtgaacttcctcggagga

SEQ ID NO: 29857 - DNA, 25 bp, Homo sapien
tgacaggcaggaactcgcaagcatg

SEQ ID NO: 29858 - DNA, 25 bp, Homo sapien
cctctgtcgccttgtgcgaaatgta

SEQ ID NO: 29859 - DNA, 25 bp, Homo sapien
gttctgcgctatcttgccctctgtc

SEQ ID NO: 29860 - DNA, 25 bp, Homo sapien
cactcggcccagagggaccggtcca

SEQ ID NO: 29861 - DNA, 25 bp, Homo sapien
cccaacggagcggacggaagcacgg

SEQ ID NO: 29862 - DNA, 25 bp, Homo sapien
gcccacttgtcagaattaccggtca

SEQ ID NO: 29863 - DNA, 25 bp, Homo sapien
cttgtcagaattaccggtcagctgg

SEQ ID NO: 29864 - DNA, 25 bp, Homo sapien
tcagaattaccggtcagctgggccg

SEQ ID NO: 29865 - DNA, 25 bp, Homo sapien
tctgcacgttgctccgggacccagg

SEQ ID NO: 29866 - DNA, 25 bp, Homo sapien
cacgagtctgcacgttgctccggga

SEQ ID NO: 29867 - DNA, 25 bp, Homo sapien
tccacggactggaccgccgggacca

SEQ ID NO: 29868 - DNA, 25 bp, Homo sapien
cgtatcaggggcagcagtacctgtg

SEQ ID NO: 29869 - DNA, 25 bp, Homo sapien
ttttctccgcacgtgcgcgccttct

SEQ ID NO: 29870 - DNA, 25 bp, Homo sapien
ttctccgcacgtgcgcgccttctct

SEQ ID NO: 29871 - DNA, 25 bp, Homo sapien
gcgtatcaggggcagcagtacctgt

SEQ ID NO: 29872 - DNA, 25 bp, Homo sapien
tatcaggggcagcagtacctgtggc

SEQ ID NO: 29873 - DNA, 25 bp, Homo sapien
tcaggggcagcagtacctgtggcag

SEQ ID NO: 29874 - DNA, 25 bp, Homo sapien
atcaggggcagcagtacctgtggca

SEQ ID NO: 29875 - DNA, 25 bp, Homo sapien
cagttttctccgcacgtgcgcgcct

SEQ ID NO: 29876 - DNA, 25 bp, Homo sapien
ttgctgtaaccgacaaagacacctt

SEQ ID NO: 29877 - DNA, 25 bp, Homo sapien
aagacaccttcgaattaagcacatt

SEQ ID NO: 29878 - DNA, 25 bp, Homo sapien
ccgacaaagacaccttcgaattaag

SEQ ID NO: 29879 - DNA, 25 bp, Homo sapien
tgtaaccgacaaagacaccttcgaa

SEQ ID NO: 29880 - DNA, 25 bp, Homo sapien
gattccagcaaagcaccgcaacatg

SEQ ID NO: 29881 - DNA, 25 bp, Homo sapien
gctgtaaccgacaaagacaccttcg

SEQ ID NO: 29882 - DNA, 25 bp, Homo sapien
ggcagcattggcctttgcagcggcg

SEQ ID NO: 29883 - DNA, 25 bp, Homo sapien
tcgattccagcaaagcaccgcaaca

SEQ ID NO: 29884 - DNA, 25 bp, Homo sapien
gtggcattgcggagtctaccaaagc

SEQ ID NO: 29885 - DNA, 25 bp, Homo sapien
cagcggcctgatgccttgtcgcagc

SEQ ID NO: 29886 - DNA, 25 bp, Homo sapien
ctgctcccggaggtccgcatcatag

SEQ ID NO: 29887 - DNA, 25 bp, Homo sapien
ccgcatcataggtctggaagcaagg

SEQ ID NO: 29888 - DNA, 25 bp, Homo sapien
tggcaggccacgcacaccgggtagc

SEQ ID NO: 29889 - DNA, 25 bp, Homo sapien
ggagtctaccaaagcgcagggcctg

SEQ ID NO: 29890 - DNA, 25 bp, Homo sapien
accgggtagcgattacagtagcctc

SEQ ID NO: 29891 - DNA, 25 bp, Homo sapien
agtagcctcgctggcactggtcaca

SEQ ID NO: 29892 - DNA, 25 bp, Homo sapien
tggaaacggtccaggagctgatccc

SEQ ID NO: 29893 - DNA, 25 bp, Homo sapien
ggaccttcgcgtgcacactggcctt

SEQ ID NO: 29894 - DNA, 25 bp, Homo sapien
agctcacacagtcggagcgtgctca

SEQ ID NO: 29895 - DNA, 25 bp, Homo sapien
tctccaactgggagagctgcagctg

SEQ ID NO: 29896 - DNA, 25 bp, Homo sapien
tcgcgccgtgccactaaggtagtcc

SEQ ID NO: 29897 - DNA, 25 bp, Homo sapien
aggtagtccgcctttctatgagccc

SEQ ID NO: 29898 - DNA, 25 bp, Homo sapien
agccgttctttggtggctgaagccc

SEQ ID NO: 29899 - DNA, 25 bp, Homo sapien
agcacgcctcctaggaactgtggga

SEQ ID NO: 29900 - DNA, 25 bp, Homo sapien
cttgcccagtgcgtatcaggttcta

SEQ ID NO: 29901 - DNA, 25 bp, Homo sapien
caccgtccttgaacagtaccgtgga

SEQ ID NO: 29902 - DNA, 25 bp, Homo sapien
cgtggaccacaaaagagcaaggctg

SEQ ID NO: 29903 - DNA, 25 bp, Homo sapien
ggtgtaccacgcttcacgcaatctc

SEQ ID NO: 29904 - DNA, 25 bp, Homo sapien
gtgcctaccagtgagtcatcgctta

SEQ ID NO: 29905 - DNA, 25 bp, Homo sapien
tggggcctacgtttggcattgagcc

SEQ ID NO: 29906 - DNA, 25 bp, Homo sapien
atctctctgctgagcgactcgctgc

SEQ ID NO: 29907 - DNA, 25 bp, Homo sapien
agtcatcgcttagggccctgaactg

SEQ ID NO: 29908 - DNA, 25 bp, Homo sapien
cgcgcgcctcgcgttagaatcacta

SEQ ID NO: 29909 - DNA, 25 bp, Homo sapien
tgccctcattttgcttcgccgaacg

SEQ ID NO: 29910 - DNA, 25 bp, Homo sapien
catctgtcggcttaggaactgggaa

SEQ ID NO: 29911 - DNA, 25 bp, Homo sapien
tagaatcactagctaggcagcctta

SEQ ID NO: 29912 - DNA, 25 bp, Homo sapien
acgcccagccgcaagtaacactgga

SEQ ID NO: 29913 - DNA, 25 bp, Homo sapien
ctcagaaactttttgcggcttcctg

SEQ ID NO: 29914 - DNA, 25 bp, Homo sapien
cgttctttttccacgtccgctacag

SEQ ID NO: 29915 - DNA, 25 bp, Homo sapien
aggcagccttactgcgcgccggaag

SEQ ID NO: 29916 - DNA, 25 bp, Homo sapien
agtccgcagcgaagatcacccgtcg

SEQ ID NO: 29917 - DNA, 25 bp, Homo sapien
ctccgaaccaagtccgcagcgaaga

SEQ ID NO: 29918 - DNA, 25 bp, Homo sapien
cgggattggcgagttgcaagaaata

SEQ ID NO: 29919 - DNA, 25 bp, Homo sapien
aggtgcgccgagctcacgtcagcgc

SEQ ID NO: 29920 - DNA, 25 bp, Homo sapien
acgctcctcgacgtcttagccaagg

SEQ ID NO: 29921 - DNA, 25 bp, Homo sapien
atgacactccgcgtttctgggctgc

SEQ ID NO: 29922 - DNA, 25 bp, Homo sapien
gttgcaagaaatatgacactccgcg

SEQ ID NO: 29923 - DNA, 25 bp, Homo sapien
cctggctctacccaagtagggactg

SEQ ID NO: 29924 - DNA, 25 bp, Homo sapien
agcggatctgctttatggcaccttg

SEQ ID NO: 29925 - DNA, 25 bp, Homo sapien
aaacttgacgttttcgctatgggca

SEQ ID NO: 29926 - DNA, 25 bp, Homo sapien
aaccggatgttctaagcctgtcgta

SEQ ID NO: 29927 - DNA, 25 bp, Homo sapien
ctagtgaacgaactcccgtgctttc

SEQ ID NO: 29928 - DNA, 25 bp, Homo sapien
tggcaccttgctttcgccgtaaagc

SEQ ID NO: 29929 - DNA, 25 bp, Homo sapien
cccacgtgcttgtgttgactggaca

SEQ ID NO: 29930 - DNA, 25 bp, Homo sapien
agggctctgagaacactagtgaacg

SEQ ID NO: 29931 - DNA, 25 bp, Homo sapien
tcctggtggaaaaccgcgactcttg

SEQ ID NO: 29932 - DNA, 25 bp, Homo sapien
ccggccgcggcaaaccatccttccg

SEQ ID NO: 29933 - DNA, 25 bp, Homo sapien
ggttccatttcttccgcggcccgca

SEQ ID NO: 29934 - DNA, 25 bp, Homo sapien
gccatccagttggtgcggtccatgg

SEQ ID NO: 29935 - DNA, 25 bp, Homo sapien
cggtccatggcgagcgcatcatggc

SEQ ID NO: 29936 - DNA, 25 bp, Homo sapien
cgcatcatggcgattgaaggtaagt

SEQ ID NO: 29937 - DNA, 25 bp, Homo sapien
ttgaaggtaagtggaggctgacagc

SEQ ID NO: 29938 - DNA, 25 bp, Homo sapien
ccgggcacctgtttcgaatcgaggc

SEQ ID NO: 29939 - DNA, 25 bp, Homo sapien
agcgaggaccgggaccacccagctg

SEQ ID NO: 29940 - DNA, 25 bp, Homo sapien
cgaggtcaccgagtggactcgcagc

SEQ ID NO: 29941 - DNA, 25 bp, Homo sapien
cctcgctagacagagccgctcatta

SEQ ID NO: 29942 - DNA, 25 bp, Homo sapien
agccgctcattaccataaccgtctg

SEQ ID NO: 29943 - DNA, 25 bp, Homo sapien
gcgcgcaccgagacaactccagggg

SEQ ID NO: 29944 - DNA, 25 bp, Homo sapien
tcaggagcgcgcgtttgcaagaaaa

SEQ ID NO: 29945 - DNA, 25 bp, Homo sapien
ttgatgcagtagctgacaccttctg

SEQ ID NO: 29946 - DNA, 25 bp, Homo sapien
acgggtttcacacgctcctcgctag

SEQ ID NO: 29947 - DNA, 25 bp, Homo sapien
ccgcttagtccctcatcgtagggga

SEQ ID NO: 29948 - DNA, 25 bp, Homo sapien
ttgtttactttctcctgcggccagc

SEQ ID NO: 29949 - DNA, 25 bp, Homo sapien
gccttcaagaggtcggccctccaaa

SEQ ID NO: 29950 - DNA, 25 bp, Homo sapien
gtgttgtttactttctcctgcggcc

SEQ ID NO: 29951 - DNA, 25 bp, Homo sapien
tggggtgttgtttactttctcctgc

SEQ ID NO: 29952 - DNA, 25 bp, Homo sapien
cttgcctttgttcccggacacttgg

SEQ ID NO: 29953 - DNA, 25 bp, Homo sapien
caacttgcctttgttcccggacact

SEQ ID NO: 29954 - DNA, 25 bp, Homo sapien
tgcggcaccgtagaaagacaacttg

SEQ ID NO: 29955 - DNA, 25 bp, Homo sapien
gcaccgtagaaagacaacttgcctt

SEQ ID NO: 29956 - DNA, 25 bp, Homo sapien
tttgtaggactgacctccggctcca

SEQ ID NO: 29957 - DNA, 25 bp, Homo sapien
cgctgccgctttcggaagtttctca

SEQ ID NO: 29958 - DNA, 25 bp, Homo sapien
cccaggagggctcaccttactgatc

SEQ ID NO: 29959 - DNA, 25 bp, Homo sapien
ttcagctcgcccacggacgcgaaga

SEQ ID NO: 29960 - DNA, 25 bp, Homo sapien
gacgcgaagatgcagtcctcaatct

SEQ ID NO: 29961 - DNA, 25 bp, Homo sapien
accagacgtcggtcacgtgatcccg

SEQ ID NO: 29962 - DNA, 25 bp, Homo sapien
cctgtcgctgttggtcagcttcaca

SEQ ID NO: 29963 - DNA, 25 bp, Homo sapien
gttcctgagtcttctccgctctctg

SEQ ID NO: 29964 - DNA, 25 bp, Homo sapien
tggttggcgctctcccggaattcct

SEQ ID NO: 29965 - DNA, 25 bp, Homo sapien
tgccatcggcaaccatttgttcctg

SEQ ID NO: 29966 - DNA, 25 bp, Homo sapien
ctgaagggctcttgccatcggcaac

SEQ ID NO: 29967 - DNA, 25 bp, Homo sapien
ccggaattcctcttcctggcggtca

SEQ ID NO: 29968 - DNA, 25 bp, Homo sapien
tggacaccccggagtgcgatcatcc

SEQ ID NO: 29969 - DNA, 25 bp, Homo sapien
atcatccgtggtgggcgagcctcct

SEQ ID NO: 29970 - DNA, 25 bp, Homo sapien
attcctcttcctggcggtcaggccg

SEQ ID NO: 29971 - DNA, 25 bp, Homo sapien
gcaaccatttgttcctggtgagccc

SEQ ID NO: 29972 - DNA, 25 bp, Homo sapien
gatcaggtttcagctcgactaacga

SEQ ID NO: 29973 - DNA, 25 bp, Homo sapien
cccagactttccacgatcaggtttc

SEQ ID NO: 29974 - DNA, 25 bp, Homo sapien
aagaacgcgcgacttccgcgggccg

SEQ ID NO: 29975 - DNA, 25 bp, Homo sapien
ctgacttgacgcgaacgggccacct

SEQ ID NO: 29976 - DNA, 25 bp, Homo sapien
atcctccgaggcgtcgtcgtccgag

SEQ ID NO: 29977 - DNA, 25 bp, Homo sapien
tgttctgcgggaggaacttctgcta

SEQ ID NO: 29978 - DNA, 25 bp, Homo sapien
acttctgctaaagccggtcctcgag

SEQ ID NO: 29979 - DNA, 25 bp, Homo sapien
agagctggccgggtctgacacccgc

SEQ ID NO: 29980 - DNA, 25 bp, Homo sapien
tctgcgtcagtttactctgttaaaa

SEQ ID NO: 29981 - DNA, 25 bp, Homo sapien
gcggttcagaaacgcaggccgcgct

SEQ ID NO: 29982 - DNA, 25 bp, Homo sapien
tgcgctgctcctccaaagggcagct

SEQ ID NO: 29983 - DNA, 25 bp, Homo sapien
ccgccgatgtcgctgggactcggaa

SEQ ID NO: 29984 - DNA, 25 bp, Homo sapien
cggaggttggtaactggtgaccata

SEQ ID NO: 29985 - DNA, 25 bp, Homo sapien
ctggggaggttagatgctgaatttt

SEQ ID NO: 29986 - DNA, 25 bp, Homo sapien
ggagttgcgaactctggtcctcttg

SEQ ID NO: 29987 - DNA, 25 bp, Homo sapien
tctggtcctcttggcagtatcggcg

SEQ ID NO: 29988 - DNA, 25 bp, Homo sapien
ggcccagcttttgcgcttggcacaa

SEQ ID NO: 29989 - DNA, 25 bp, Homo sapien
gcttttgcgcttggcacaatcgccc

SEQ ID NO: 29990 - DNA, 25 bp, Homo sapien
ttggggcccaggcactcggaccctg

SEQ ID NO: 29991 - DNA, 25 bp, Homo sapien
gcctgtagctttgcgtggtctggca

SEQ ID NO: 29992 - DNA, 25 bp, Homo sapien
acgctggccttcacgaggctgtggt

SEQ ID NO: 29993 - DNA, 25 bp, Homo sapien
atacgggcgtggcaggactctcacg

SEQ ID NO: 29994 - DNA, 25 bp, Homo sapien
aggactctcacgcacggtgaccacg

SEQ ID NO: 29995 - DNA, 25 bp, Homo sapien
caagcatctttgaagcgggcccagc

SEQ ID NO: 29996 - DNA, 25 bp, Homo sapien
ctccttagcagagctcgcgggttct

SEQ ID NO: 29997 - DNA, 25 bp, Homo sapien
ggacctggagttgcccgtctctact

SEQ ID NO: 29998 - DNA, 25 bp, Homo sapien
tgcagccagctttccatcacttttc

SEQ ID NO: 29999 - DNA, 25 bp, Homo sapien
ttttcccagtactttgctcagcagc

SEQ ID NO: 30000 - DNA, 25 bp, Homo sapien
cagctgtcacgcatccttggagata

SEQ ID NO: 30001 - DNA, 25 bp, Homo sapien
tctcctgttaggatggggacccatc

SEQ ID NO: 30002 - DNA, 25 bp, Homo sapien
cgcggcttcttacgacagcaggaaa

SEQ ID NO: 30003 - DNA, 25 bp, Homo sapien
cgcccgggtaatcgaaatccgaatg

SEQ ID NO: 30004 - DNA, 25 bp, Homo sapien
agcgtgcaacggagctcctgggacc

SEQ ID NO: 30005 - DNA, 25 bp, Homo sapien
gagcgtgcaacggagctcctgggac

SEQ ID NO: 30006 - DNA, 25 bp, Homo sapien
agagcgtgcaacggagctcctggga

SEQ ID NO: 30007 - DNA, 25 bp, Homo sapien
cagagcgtgcaacggagctcctggg

SEQ ID NO: 30008 - DNA, 25 bp, Homo sapien
ccagagcgtgcaacggagctcctgg

SEQ ID NO: 30009 - DNA, 25 bp, Homo sapien
gccagagcgtgcaacggagctcctg

SEQ ID NO: 30010 - DNA, 25 bp, Homo sapien
ggccagagcgtgcaacggagctcct

SEQ ID NO: 30011 - DNA, 25 bp, Homo sapien
gcgtgcaacggagctcctgggacca

SEQ ID NO: 30012 - DNA, 25 bp, Homo sapien
cgagcacggtggtagcctcgaactc

SEQ ID NO: 30013 - DNA, 25 bp, Homo sapien
ttatggcggctccatattaacagcc

SEQ ID NO: 30014 - DNA, 25 bp, Homo sapien
cctgttctaccatgcccggcatgat

SEQ ID NO: 30015 - DNA, 25 bp, Homo sapien
accaacggcgggctgcactactcag

SEQ ID NO: 30016 - DNA, 25 bp, Homo sapien
gagttgatatcttcccatccacccg

SEQ ID NO: 30017 - DNA, 25 bp, Homo sapien
taccaagctcggatccctgaatttg

SEQ ID NO: 30018 - DNA, 25 bp, Homo sapien
ttactggggaagaaccgatcggcca

SEQ ID NO: 30019 - DNA, 25 bp, Homo sapien
tccaggtagatatatttgcttaagc

SEQ ID NO: 30020 - DNA, 25 bp, Homo sapien
ggggacaccgacgagcgcttttcat

SEQ ID NO: 30021 - DNA, 25 bp, Homo sapien
cgagcgcttttcatctcgtcccagt

SEQ ID NO: 30022 - DNA, 25 bp, Homo sapien
catctcgtcccagttactttgaaac

SEQ ID NO: 30023 - DNA, 25 bp, Homo sapien
ctttgaaaccgaaagcgcctgctgg

SEQ ID NO: 30024 - DNA, 25 bp, Homo sapien
aaccgaaagcgcctgctggcgtccg

SEQ ID NO: 30025 - DNA, 25 bp, Homo sapien
ggaggactttcaggcacgtcccgca

SEQ ID NO: 30026 - DNA, 25 bp, Homo sapien
gccctgggcaccctcgcgacggaag

SEQ ID NO: 30027 - DNA, 25 bp, Homo sapien
ggactttcaggcacgtcccgcacat

SEQ ID NO: 30028 - DNA, 25 bp, Homo sapien
ggccggacatttctagtcgactgtt

SEQ ID NO: 30029 - DNA, 25 bp, Homo sapien
aaaacgcttcgagaggggtgcagcc

SEQ ID NO: 30030 - DNA, 25 bp, Homo sapien
gtccagcagctcttgcctaaggctc

SEQ ID NO: 30031 - DNA, 25 bp, Homo sapien
cgccgcactggttgttcagcacctt

SEQ ID NO: 30032 - DNA, 25 bp, Homo sapien
tgttcagcaccttcggtccggttga

SEQ ID NO: 30033 - DNA, 25 bp, Homo sapien
ttgtcaagtcggaccaaacaggttg

SEQ ID NO: 30034 - DNA, 25 bp, Homo sapien
tgcagtttccagtaagtgaccgttc

SEQ ID NO: 30035 - DNA, 25 bp, Homo sapien
cgcggacacaaaaaccgtggcttga

SEQ ID NO: 30036 - DNA, 25 bp, Homo sapien
agatgtgcctgtccttagcggccca

SEQ ID NO: 30037 - DNA, 25 bp, Homo sapien
tcaggctcagcctgtacctgagctg

SEQ ID NO: 30038 - DNA, 25 bp, Homo sapien
ccgatgcgaccgacagtggcggcgc

SEQ ID NO: 30039 - DNA, 25 bp, Homo sapien
aggagatgtgcctgtccttagcggc

SEQ ID NO: 30040 - DNA, 25 bp, Homo sapien
atgcaccccgatgcgaccgacagtg

SEQ ID NO: 30041 - DNA, 25 bp, Homo sapien
ccaggaagcagcatgcaccccgatg

SEQ ID NO: 30042 - DNA, 25 bp, Homo sapien
ggctcagcctgtacctgagctgcgc

SEQ ID NO: 30043 - DNA, 25 bp, Homo sapien
gtgcctgtccttagcggcccaggaa

SEQ ID NO: 30044 - DNA, 25 bp, Homo sapien
gtgggcgcgagcttcacgcgcactc

SEQ ID NO: 30045 - DNA, 25 bp, Homo sapien
ccgtgagccgcagaaagtcaacttc

SEQ ID NO: 30046 - DNA, 25 bp, Homo sapien
cctgctggcaaaatcaggcccgtga

SEQ ID NO: 30047 - DNA, 25 bp, Homo sapien
ttctggcctccagcggacggaggtc

SEQ ID NO: 30048 - DNA, 25 bp, Homo sapien
gcatcccagattgaagcctcacaat

SEQ ID NO: 30049 - DNA, 25 bp, Homo sapien
tctctgcaccaggattctctgacct

SEQ ID NO: 30050 - DNA, 25 bp, Homo sapien
attctctgacctggtcactgcctgg

SEQ ID NO: 30051 - DNA, 25 bp, Homo sapien
gtttttaaaaagcatcccagattga

SEQ ID NO: 30052 - DNA, 25 bp, Homo sapien
aattcgggcatgctccaggaccgca

SEQ ID NO: 30053 - DNA, 25 bp, Homo sapien
gcaggctccactggcgcgtcagctt

SEQ ID NO: 30054 - DNA, 25 bp, Homo sapien
gcgtcagcttgtgggcctcctcttc

SEQ ID NO: 30055 - DNA, 25 bp, Homo sapien
caccgagcggaagagctgggacacc

SEQ ID NO: 30056 - DNA, 25 bp, Homo sapien
aagagctgggacacctcctgcacct

SEQ ID NO: 30057 - DNA, 25 bp, Homo sapien
gggcgctggggacattcacccacaa

SEQ ID NO: 30058 - DNA, 25 bp, Homo sapien
ttcacccacaacagcgggtctggca

SEQ ID NO: 30059 - DNA, 25 bp, Homo sapien
agatggtcctgatgtcgctggcgaa

SEQ ID NO: 30060 - DNA, 25 bp, Homo sapien
cgttcaatatatcccgcgccggcgt

SEQ ID NO: 30061 - DNA, 25 bp, Homo sapien
cagataggcggtccactgtcccagt

SEQ ID NO: 30062 - DNA, 25 bp, Homo sapien
ggcgattcgtctcccatcttcaagg

SEQ ID NO: 30063 - DNA, 25 bp, Homo sapien
tgctggcagagctgttaccgtgaca

SEQ ID NO: 30064 - DNA, 25 bp, Homo sapien
aacatggcatgctggtgacagtcca

SEQ ID NO: 30065 - DNA, 25 bp, Homo sapien
ctggcccgttaactgtgctggcaga

SEQ ID NO: 30066 - DNA, 25 bp, Homo sapien
gtggcctatcgaaacccggcgctca

SEQ ID NO: 30067 - DNA, 25 bp, Homo sapien
ttctgctaacagattgtggcctatc

SEQ ID NO: 30068 - DNA, 25 bp, Homo sapien
ttaaccgtcctgtggccaggcccag

SEQ ID NO: 30069 - DNA, 25 bp, Homo sapien
ccgcggcgaggtcttgggcttccca

SEQ ID NO: 30070 - DNA, 25 bp, Homo sapien
gtgccacctagctgagtcaccgcgg

SEQ ID NO: 30071 - DNA, 25 bp, Homo sapien
attaatcattaaccgtcctgtggcc

SEQ ID NO: 30072 - DNA, 25 bp, Homo sapien
acccggtatggaacattaatcatta

SEQ ID NO: 30073 - DNA, 25 bp, Homo sapien
agaggagagagttcacggcttgctc

SEQ ID NO: 30074 - DNA, 25 bp, Homo sapien
ctagctgagtcaccgcggtctgggc

SEQ ID NO: 30075 - DNA, 25 bp, Homo sapien
cgtctccacccggtatggaacatta

SEQ ID NO: 30076 - DNA, 25 bp, Homo sapien
ccagtcaggaagatggcgttcacca

SEQ ID NO: 30077 - DNA, 25 bp, Homo sapien
ggctcggatccagccgaacgtgttc

SEQ ID NO: 30078 - DNA, 25 bp, Homo sapien
ccgaacgtgttcttctgggtggcgt

SEQ ID NO: 30079 - DNA, 25 bp, Homo sapien
cgtccgacagcatgtggaaggagtc

SEQ ID NO: 30080 - DNA, 25 bp, Homo sapien
ctccagcaccatgaacatgaaggtc

SEQ ID NO: 30081 - DNA, 25 bp, Homo sapien
aaggtcagcgccagcatgcacagca

SEQ ID NO: 30082 - DNA, 25 bp, Homo sapien
acggacccgagcgtgacaaggcctt

SEQ ID NO: 30083 - DNA, 25 bp, Homo sapien
cgcgccgagaaagctccgagcatct

SEQ ID NO: 30084 - DNA, 25 bp, Homo sapien
tcgcctctctcattggctaagaaga

SEQ ID NO: 30085 - DNA, 25 bp, Homo sapien
gcgggccctgatctcgcagtctatt

SEQ ID NO: 30086 - DNA, 25 bp, Homo sapien
ctccagggaccaggaactccaggga

SEQ ID NO: 30087 - DNA, 25 bp, Homo sapien
ttcatagtcctcagcccgggaaggc

SEQ ID NO: 30088 - DNA, 25 bp, Homo sapien
gagcctgtgccaatggtgtacaaca

SEQ ID NO: 30089 - DNA, 25 bp, Homo sapien
cggcgtctgcttttaacctgtggga

SEQ ID NO: 30090 - DNA, 25 bp, Homo sapien
aaagtgtcactaggcaaccgcgtcg

SEQ ID NO: 30091 - DNA, 25 bp, Homo sapien
cctaggcattttgggaaaagtgtca

SEQ ID NO: 30092 - DNA, 25 bp, Homo sapien
tcagaggccggacctgtcacccggg

SEQ ID NO: 30093 - DNA, 25 bp, Homo sapien
agccggtggagcctgcagcggtttc

SEQ ID NO: 30094 - DNA, 25 bp, Homo sapien
acagcgccctctaatgaaagcgccg

SEQ ID NO: 30095 - DNA, 25 bp, Homo sapien
tttccgcggatgtggaagggtcgtg

SEQ ID NO: 30096 - DNA, 25 bp, Homo sapien
ccgccgaggggtcgcggtcatggac

SEQ ID NO: 30097 - DNA, 25 bp, Homo sapien
agaggagccggaagaatgcatggcc

SEQ ID NO: 30098 - DNA, 25 bp, Homo sapien
gagccggaggttacctcgggctggc

SEQ ID NO: 30099 - DNA, 25 bp, Homo sapien
gcgccctcgtccctcaggccgctgc

SEQ ID NO: 30100 - DNA, 25 bp, Homo sapien
atgctcttcaattcggtgctccgcc

SEQ ID NO: 30101 - DNA, 25 bp, Homo sapien
cccagcttggcgtcctgagaaatgg

SEQ ID NO: 30102 - DNA, 25 bp, Homo sapien
ggacgtcgctcggaagccaatcaga

SEQ ID NO: 30103 - DNA, 25 bp, Homo sapien
gctgaggcttttcctccgaccctga

SEQ ID NO: 30104 - DNA, 25 bp, Homo sapien
ctacgacttttctctcagctgaggc

SEQ ID NO: 30105 - DNA, 25 bp, Homo sapien
tgcgatttctgctgaacttggaggc

SEQ ID NO: 30106 - DNA, 25 bp, Homo sapien
tgtcaagccctgttacgcatgcgcc

SEQ ID NO: 30107 - DNA, 25 bp, Homo sapien
tcggagctggcggaattcatttccc

SEQ ID NO: 30108 - DNA, 25 bp, Homo sapien
gttgtctaaacttcgggctctcttc

SEQ ID NO: 30109 - DNA, 25 bp, Homo sapien
gcgcgcccagagtcaacaacttctt

SEQ ID NO: 30110 - DNA, 25 bp, Homo sapien
ccagtcttctcgtagacggtcagga

SEQ ID NO: 30111 - DNA, 25 bp, Homo sapien
cccaagcgatttgccgcatttgttc

SEQ ID NO: 30112 - DNA, 25 bp, Homo sapien
catttgttctgacgcaggggcaccc

SEQ ID NO: 30113 - DNA, 25 bp, Homo sapien
cgctcgccgtcttcacttacgattg

SEQ ID NO: 30114 - DNA, 25 bp, Homo sapien
cccgcggaagttgtcagtcaaactc

SEQ ID NO: 30115 - DNA, 25 bp, Homo sapien
cttctcaagttgtagcggtcgctcg

SEQ ID NO: 30116 - DNA, 25 bp, Homo sapien
tgcaacccgcagcatacggagaacg

SEQ ID NO: 30117 - DNA, 25 bp, Homo sapien
tggcactgaccagagcttcggcaca

SEQ ID NO: 30118 - DNA, 25 bp, Homo sapien
gaccgcgcatcagatctcgccggga

SEQ ID NO: 30119 - DNA, 25 bp, Homo sapien
cgggcgctccacttgttgcaaagaa

SEQ ID NO: 30120 - DNA, 25 bp, Homo sapien
atcattcacctgctggttacgggtc

SEQ ID NO: 30121 - DNA, 25 bp, Homo sapien
acctcgtacctcctggtaggatgtg

SEQ ID NO: 30122 - DNA, 25 bp, Homo sapien
cgctcctgccggatcatggcactga

SEQ ID NO: 30123 - DNA, 25 bp, Homo sapien
gggcctcaggtagcttcaatcattc

SEQ ID NO: 30124 - DNA, 25 bp, Homo sapien
actttttggttttcatgttagcatc

SEQ ID NO: 30125 - DNA, 25 bp, Homo sapien
cagtgcggcttttcaccgaggagga

SEQ ID NO: 30126 - DNA, 25 bp, Homo sapien
aggacgagtcctcaacagtcggagc

SEQ ID NO: 30127 - DNA, 25 bp, Homo sapien
cctctagccgccttttcgttgatga

SEQ ID NO: 30128 - DNA, 25 bp, Homo sapien
ttcgttgatgatctgcgtacagacc

SEQ ID NO: 30129 - DNA, 25 bp, Homo sapien
tgcgtacagacctcagaactttttg

SEQ ID NO: 30130 - DNA, 25 bp, Homo sapien
catgttagcatcagccgaggcgttt

SEQ ID NO: 30131 - DNA, 25 bp, Homo sapien
gaggcgtttactgtgcccacgcata

SEQ ID NO: 30132 - DNA, 25 bp, Homo sapien
tgggctttttcttgattggacttga

SEQ ID NO: 30133 - DNA, 25 bp, Homo sapien
caggactgggactgcttacgttttg

SEQ ID NO: 30134 - DNA, 25 bp, Homo sapien
tgctcttatgtatgcggaccggtgc

SEQ ID NO: 30135 - DNA, 25 bp, Homo sapien
gcaacagagcccgtgggtgctctta

SEQ ID NO: 30136 - DNA, 25 bp, Homo sapien
tatttggcgtgttcccttcctgccg

SEQ ID NO: 30137 - DNA, 25 bp, Homo sapien
ggtgatttgctaacctcgcagcaga

SEQ ID NO: 30138 - DNA, 25 bp, Homo sapien
tctgcacctgatgcgttcgggatgc

SEQ ID NO: 30139 - DNA, 25 bp, Homo sapien
gccgtgatacggagagcaacagttc

SEQ ID NO: 30140 - DNA, 25 bp, Homo sapien
tcctggagccggcaaggacttcgca

SEQ ID NO: 30141 - DNA, 25 bp, Homo sapien
cacagtcgggcagtccaaggctgcc

SEQ ID NO: 30142 - DNA, 25 bp, Homo sapien
ctacctctctgtgccggccatgaag

SEQ ID NO: 30143 - DNA, 25 bp, Homo sapien
gccggccatgaagccgggacttcgt

SEQ ID NO: 30144 - DNA, 25 bp, Homo sapien
tgaagccgggacttcgttagaggac

SEQ ID NO: 30145 - DNA, 25 bp, Homo sapien
cggcaaggacttcgcagtgctctgc

SEQ ID NO: 30146 - DNA, 25 bp, Homo sapien
ccatctctacgctctgagccgcgcg

SEQ ID NO: 30147 - DNA, 25 bp, Homo sapien
ctagatcctacagaccgcctagggg

SEQ ID NO: 30148 - DNA, 25 bp, Homo sapien
tctgcgcttggcctgaccctagaag

SEQ ID NO: 30149 - DNA, 25 bp, Homo sapien
taaaattagcaacccgcgcagcgcg

SEQ ID NO: 30150 - DNA, 25 bp, Homo sapien
ggaagccgccggagctaaaattagc

SEQ ID NO: 30151 - DNA, 25 bp, Homo sapien
ggaacgaggagagccacgctccttg

SEQ ID NO: 30152 - DNA, 25 bp, Homo sapien
ctaggttctcgcctcggtaagcgcc

SEQ ID NO: 30153 - DNA, 25 bp, Homo sapien
agcgccgactgtgtccaaggccgag

SEQ ID NO: 30154 - DNA, 25 bp, Homo sapien
cttcgattcatttattgagcgccga

SEQ ID NO: 30155 - DNA, 25 bp, Homo sapien
actcgccaagaacgcgctgacgtca

SEQ ID NO: 30156 - DNA, 25 bp, Homo sapien
tccagtccggtttcatctccggatg

SEQ ID NO: 30157 - DNA, 25 bp, Homo sapien
ccggtttcatctccggatgccctgg

SEQ ID NO: 30158 - DNA, 25 bp, Homo sapien
ggtgcagacaggaccctggagaaca

SEQ ID NO: 30159 - DNA, 25 bp, Homo sapien
gctgcgcatggcacgtgtcgtgtgt

SEQ ID NO: 30160 - DNA, 25 bp, Homo sapien
tcgtgtgtggatccacagcagggcc

SEQ ID NO: 30161 - DNA, 25 bp, Homo sapien
cgggattccagtccggtttcatctc

SEQ ID NO: 30162 - DNA, 25 bp, Homo sapien
gacgggattccagtccggtttcatc

SEQ ID NO: 30163 - DNA, 25 bp, Homo sapien
gtggatccacagcagggccgctgcc

SEQ ID NO: 30164 - DNA, 25 bp, Homo sapien
tttagagaaaggtcgtgcccgcttc

SEQ ID NO: 30165 - DNA, 25 bp, Homo sapien
ttctcccgggaagctattaatagca

SEQ ID NO: 30166 - DNA, 25 bp, Homo sapien
gggttgcctctgattcctcctggac

SEQ ID NO: 30167 - DNA, 25 bp, Homo sapien
ggactccgatcttttcacgctcttg

SEQ ID NO: 30168 - DNA, 25 bp, Homo sapien
cacgctcttgttggtttcactgaca

SEQ ID NO: 30169 - DNA, 25 bp, Homo sapien
cctgggactggcaacacggagtaaa

SEQ ID NO: 30170 - DNA, 25 bp, Homo sapien
ggggtattttcctgaagctccagaa

SEQ ID NO: 30171 - DNA, 25 bp, Homo sapien
taaaaggggtgatgcaacgctctcc

SEQ ID NO: 30172 - DNA, 25 bp, Homo sapien
tttctccgcggcgatcagtcatccg

SEQ ID NO: 30173 - DNA, 25 bp, Homo sapien
aggagctggctcaggagccattcca

SEQ ID NO: 30174 - DNA, 25 bp, Homo sapien
agccattccaggagccgcggacact

SEQ ID NO: 30175 - DNA, 25 bp, Homo sapien
acactgtgcgcacgacagggtccct

SEQ ID NO: 30176 - DNA, 25 bp, Homo sapien
cttcgtggaagtcacgtggtggctc

SEQ ID NO: 30177 - DNA, 25 bp, Homo sapien
catgcagcctttggggtccttcggc

SEQ ID NO: 30178 - DNA, 25 bp, Homo sapien
gagcccttgcgacatgccgggcgct

SEQ ID NO: 30179 - DNA, 25 bp, Homo sapien
cggggaactcaggttgagaaacaca

SEQ ID NO: 30180 - DNA, 25 bp, Homo sapien
agcggccgcacagttgtagcatttc

SEQ ID NO: 30181 - DNA, 25 bp, Homo sapien
cccggactttgaccgcgtatgtgag

SEQ ID NO: 30182 - DNA, 25 bp, Homo sapien
tcaggacgctgcagctgaaacgttc

SEQ ID NO: 30183 - DNA, 25 bp, Homo sapien
tgcatccggctggaaactcaggacg

SEQ ID NO: 30184 - DNA, 25 bp, Homo sapien
ctggtgtaaccagcatgcatccggc

SEQ ID NO: 30185 - DNA, 25 bp, Homo sapien
cccgccatttttcgtcggaactgtg

SEQ ID NO: 30186 - DNA, 25 bp, Homo sapien
aggtgcagcgcacccgaaagtcttc

SEQ ID NO: 30187 - DNA, 25 bp, Homo sapien
gcatttcggtcacagcccgcttcga

SEQ ID NO: 30188 - DNA, 25 bp, Homo sapien
gctcgcgaaaggatacctcccgttg

SEQ ID NO: 30189 - DNA, 25 bp, Homo sapien
tctgttcacgcggtagcgcggattg

SEQ ID NO: 30190 - DNA, 25 bp, Homo sapien
accagacaaggggtgactgccgcgc

SEQ ID NO: 30191 - DNA, 25 bp, Homo sapien
gccatgcatccttccgggcaggaaa

SEQ ID NO: 30192 - DNA, 25 bp, Homo sapien
gggaggagaccttcatctgttcacg

SEQ ID NO: 30193 - DNA, 25 bp, Homo sapien
aaagcgggcaccttcccggtgaatg

SEQ ID NO: 30194 - DNA, 25 bp, Homo sapien
aaaatgtcagccagcgctcgccggc

SEQ ID NO: 30195 - DNA, 25 bp, Homo sapien
tagtcatgcaggacgcgcgactcta

SEQ ID NO: 30196 - DNA, 25 bp, Homo sapien
tgcccgggtgacttggttatatgtc

SEQ ID NO: 30197 - DNA, 25 bp, Homo sapien
ccaaccgtcccgaggtaggatcttg

SEQ ID NO: 30198 - DNA, 25 bp, Homo sapien
gcgctcacatgccagcacgttcgtg

SEQ ID NO: 30199 - DNA, 25 bp, Homo sapien
ccgctgatttcaggcaccgccggta

SEQ ID NO: 30200 - DNA, 25 bp, Homo sapien
gctggaagcccgtcatcgattctca

SEQ ID NO: 30201 - DNA, 25 bp, Homo sapien
ctttctaggtaatcgcagggctgga

SEQ ID NO: 30202 - DNA, 25 bp, Homo sapien
tctcttggccacatctgaggaccca

SEQ ID NO: 30203 - DNA, 25 bp, Homo sapien
ggccaatagacgcattcggaacatc

SEQ ID NO: 30204 - DNA, 25 bp, Homo sapien
caggccagggatccaaagccactgg

SEQ ID NO: 30205 - DNA, 25 bp, Homo sapien
taacccggaattctgctcaaggagc

SEQ ID NO: 30206 - DNA, 25 bp, Homo sapien
catcttgcgcagtcagagtccctga

SEQ ID NO: 30207 - DNA, 25 bp, Homo sapien
tccagtcctggctgcaaggcatgct

SEQ ID NO: 30208 - DNA, 25 bp, Homo sapien
ctcttaagtaccgactccagtcctg

SEQ ID NO: 30209 - DNA, 25 bp, Homo sapien
tctctataatcgatgcgacggccta

SEQ ID NO: 30210 - DNA, 25 bp, Homo sapien
ttacctatcccgcttggtctctgga

SEQ ID NO: 30211 - DNA, 25 bp, Homo sapien
ccgggttccacctcaatctctataa

SEQ ID NO: 30212 - DNA, 25 bp, Homo sapien
aggggctacacagtatataaggtca

SEQ ID NO: 30213 - DNA, 25 bp, Homo sapien
cgggtttccctcatgatcccgggcg

SEQ ID NO: 30214 - DNA, 25 bp, Homo sapien
cagtatataaggtcaccgcccgggt

SEQ ID NO: 30215 - DNA, 25 bp, Homo sapien
cacccgaggggctacacagtatata

SEQ ID NO: 30216 - DNA, 25 bp, Homo sapien
ggcccgtttctacactgtcaccgag

SEQ ID NO: 30217 - DNA, 25 bp, Homo sapien
gagtgccgacctggcccgtttctac

SEQ ID NO: 30218 - DNA, 25 bp, Homo sapien
ctcttaccgggagcggagtgccgac

SEQ ID NO: 30219 - DNA, 25 bp, Homo sapien
aggatgacctcttaccgggagcgga

SEQ ID NO: 30220 - DNA, 25 bp, Homo sapien
acgcaatgtctgcaaaccgacagtg

SEQ ID NO: 30221 - DNA, 25 bp, Homo sapien
aaccgacagtggcatggggagataa

SEQ ID NO: 30222 - DNA, 25 bp, Homo sapien
ccaacgttgtgtaacgaggggcatg

SEQ ID NO: 30223 - DNA, 25 bp, Homo sapien
catgggctgtttgcccgagtggctc

SEQ ID NO: 30224 - DNA, 25 bp, Homo sapien
tgctaacctcaacggaggagcgggc

SEQ ID NO: 30225 - DNA, 25 bp, Homo sapien
ccagtctcggctgtggtcgtagcac

SEQ ID NO: 30226 - DNA, 25 bp, Homo sapien
ccctgggtaactgctaacctcaacg

SEQ ID NO: 30227 - DNA, 25 bp, Homo sapien
gtcgtagcactacgcaatgtctgca

SEQ ID NO: 30228 - DNA, 25 bp, Homo sapien
gcggcagcagcaagaccagtgtcac

SEQ ID NO: 30229 - DNA, 25 bp, Homo sapien
ggcggatttatcagcgcagccatgc

SEQ ID NO: 30230 - DNA, 25 bp, Homo sapien
tccctgctcacaagaggctcgcgtg

SEQ ID NO: 30231 - DNA, 25 bp, Homo sapien
tcacaagaggctcgcgtgcacatgc

SEQ ID NO: 30232 - DNA, 25 bp, Homo sapien
cgtgcacatgcgtgtggacatggct

SEQ ID NO: 30233 - DNA, 25 bp, Homo sapien
acatggctgtctcgcgtctgcatcc

SEQ ID NO: 30234 - DNA, 25 bp, Homo sapien
gtctgcatccgcgtgcacactgatg

SEQ ID NO: 30235 - DNA, 25 bp, Homo sapien
ccgcgtgcacactgatggcggcttg

SEQ ID NO: 30236 - DNA, 25 bp, Homo sapien
aggaagccgagacgcgtcggccttc

SEQ ID NO: 30237 - DNA, 25 bp, Homo sapien
aggctgcgggtccaagtctttcagc

SEQ ID NO: 30238 - DNA, 25 bp, Homo sapien
ctgccagatttagcctcccgcctgg

SEQ ID NO: 30239 - DNA, 25 bp, Homo sapien
ttcaaaagtctaggcgagaggaagc

SEQ ID NO: 30240 - DNA, 25 bp, Homo sapien
gcgagccagccgcttcaaaagtcta

SEQ ID NO: 30241 - DNA, 25 bp, Homo sapien
caacccgggattagcgagccagccg

SEQ ID NO: 30242 - DNA, 25 bp, Homo sapien
tctttcagccaacccgggattagcg

SEQ ID NO: 30243 - DNA, 25 bp, Homo sapien
ctcctccggggaaactggcgctctt

SEQ ID NO: 30244 - DNA, 25 bp, Homo sapien
cgagcgggatcgagcgcttaaaacc

SEQ ID NO: 30245 - DNA, 25 bp, Homo sapien
cagcttggaagtgtagcggtgccca

SEQ ID NO: 30246 - DNA, 25 bp, Homo sapien
cagaggctttgcgtaactttgccca

SEQ ID NO: 30247 - DNA, 25 bp, Homo sapien
gcttaaaaccctgccacagcttgga

SEQ ID NO: 30248 - DNA, 25 bp, Homo sapien
caggcggccacacatccgaaaggga

SEQ ID NO: 30249 - DNA, 25 bp, Homo sapien
cctggcacactggaggaggtacaca

SEQ ID NO: 30250 - DNA, 25 bp, Homo sapien
ctggagaggagattcccagccttcc

SEQ ID NO: 30251 - DNA, 25 bp, Homo sapien
cgcaggcgtattcctcgcaggattc

SEQ ID NO: 30252 - DNA, 25 bp, Homo sapien
atctgcgatcgtaacccaatgctgg

SEQ ID NO: 30253 - DNA, 25 bp, Homo sapien
tcgccaacgtgttttcggtattgtc

SEQ ID NO: 30254 - DNA, 25 bp, Homo sapien
ccaatgctggcctcgccaacgtgtt

SEQ ID NO: 30255 - DNA, 25 bp, Homo sapien
cggctgcacttgaagtcggaatctg

SEQ ID NO: 30256 - DNA, 25 bp, Homo sapien
ctccaggcagcggaatcccatggtg

SEQ ID NO: 30257 - DNA, 25 bp, Homo sapien
ttgtcgggataattgaaagtccaga

SEQ ID NO: 30258 - DNA, 25 bp, Homo sapien
aatttggctatcagggctccaggca

SEQ ID NO: 30259 - DNA, 25 bp, Homo sapien
gtccagacaaatttggctatcaggg

SEQ ID NO: 30260 - DNA, 25 bp, Homo sapien
cgtggtgtgtgcaaaacgtgcattc

SEQ ID NO: 30261 - DNA, 25 bp, Homo sapien
gaaccgatctcgctcgcctagcgtg

SEQ ID NO: 30262 - DNA, 25 bp, Homo sapien
ggcgcgcgctcctatttcaagtcgc

SEQ ID NO: 30263 - DNA, 25 bp, Homo sapien
cctgcgccctaatgcgggctgcgaa

SEQ ID NO: 30264 - DNA, 25 bp, Homo sapien
ggagagcttccttgttcggcaagcg

SEQ ID NO: 30265 - DNA, 25 bp, Homo sapien
cgacttcgactcaggcctgcttttg

SEQ ID NO: 30266 - DNA, 25 bp, Homo sapien
ttgcccacggcgtgacacaggactt

SEQ ID NO: 30267 - DNA, 25 bp, Homo sapien
cacaggacttactggggttctcagg

SEQ ID NO: 30268 - DNA, 25 bp, Homo sapien
gctgtatctgggaaatgaaaaaaga

SEQ ID NO: 30269 - DNA, 25 bp, Homo sapien
gtatacttttccgtgccttcctcca

SEQ ID NO: 30270 - DNA, 25 bp, Homo sapien
cccaagtcggaggagcgctcactcg

SEQ ID NO: 30271 - DNA, 25 bp, Homo sapien
atagtgcccgcagatggctcgctcc

SEQ ID NO: 30272 - DNA, 25 bp, Homo sapien
ggccactcggcgaactcgatcagct

SEQ ID NO: 30273 - DNA, 25 bp, Homo sapien
cggcgaactcgatcagctgtatctg

SEQ ID NO: 30274 - DNA, 25 bp, Homo sapien
ctcgatcagctgtatctgggaaatg

SEQ ID NO: 30275 - DNA, 25 bp, Homo sapien
tcccgctttgcatagtgcccgcaga

SEQ ID NO: 30276 - DNA, 25 bp, Homo sapien
caccattgcagccggggaaagcaga

SEQ ID NO: 30277 - DNA, 25 bp, Homo sapien
ctgtgacgtgcagtcttcctgtttc

SEQ ID NO: 30278 - DNA, 25 bp, Homo sapien
gtgcagtcttcctgtttccttcagc

SEQ ID NO: 30279 - DNA, 25 bp, Homo sapien
cttcagctgtgtcttaaagtaaatc

SEQ ID NO: 30280 - DNA, 25 bp, Homo sapien
gctgagggagcgctctgaaataata

SEQ ID NO: 30281 - DNA, 25 bp, Homo sapien
gcgctctgaaataatacaccattgc

SEQ ID NO: 30282 - DNA, 25 bp, Homo sapien
agtaaatcttgttgtggagcggagc

SEQ ID NO: 30283 - DNA, 25 bp, Homo sapien
gccgggtacgtcagatagactgtga

SEQ ID NO: 30284 - DNA, 25 bp, Homo sapien
tcaaaacgctgtcgaagccgaattg

SEQ ID NO: 30285 - DNA, 25 bp, Homo sapien
tcaagttgagtagggtaaggcggca

SEQ ID NO: 30286 - DNA, 25 bp, Homo sapien
ttccgagctcctggacccagggctg

SEQ ID NO: 30287 - DNA, 25 bp, Homo sapien
tgtcgaagccgaattgtggaaatcc

SEQ ID NO: 30288 - DNA, 25 bp, Homo sapien
attgggacaccagcacgaggaggac

SEQ ID NO: 30289 - DNA, 25 bp, Homo sapien
gctctgttactttcgtctcaaaacg

SEQ ID NO: 30290 - DNA, 25 bp, Homo sapien
ccgaattgtggaaatccggcttgga

SEQ ID NO: 30291 - DNA, 25 bp, Homo sapien
tttcgtctcaaaacgctgtcgaagc

SEQ ID NO: 30292 - DNA, 25 bp, Homo sapien
cgggtcacagacaagagagcggctt

SEQ ID NO: 30293 - DNA, 25 bp, Homo sapien
tgagaaaacttagctcgccgcgctc

SEQ ID NO: 30294 - DNA, 25 bp, Homo sapien
ggacaggagcccgtgagaaaactta

SEQ ID NO: 30295 - DNA, 25 bp, Homo sapien
aagaacgctgcctcggttgcctgcg

SEQ ID NO: 30296 - DNA, 25 bp, Homo sapien
gcgggcaggcagcaatcagctaatt

SEQ ID NO: 30297 - DNA, 25 bp, Homo sapien
agagcggcttgttttctctctgtca

SEQ ID NO: 30298 - DNA, 25 bp, Homo sapien
catcgtcgtcttgaaccgtgtggtc

SEQ ID NO: 30299 - DNA, 25 bp, Homo sapien
cggcgcttggcacatcccgaagaac

SEQ ID NO: 30300 - DNA, 25 bp, Homo sapien
cctgcactgcacgttttcagagttg

SEQ ID NO: 30301 - DNA, 25 bp, Homo sapien
gccacgtgcgagaggaaacaggacc

SEQ ID NO: 30302 - DNA, 25 bp, Homo sapien
cgagtactgcttcaccaggtagggc

SEQ ID NO: 30303 - DNA, 25 bp, Homo sapien
cggggcaaccactgcgagtactgct

SEQ ID NO: 30304 - DNA, 25 bp, Homo sapien
ggcctatgcctacgtgctcacggtc

SEQ ID NO: 30305 - DNA, 25 bp, Homo sapien
cgtctccaataacagctcgccggga

SEQ ID NO: 30306 - DNA, 25 bp, Homo sapien
cgcagctctaggtgacgcgtctcca

SEQ ID NO: 30307 - DNA, 25 bp, Homo sapien
tcagagttgctcacgctggatgcgc

SEQ ID NO: 30308 - DNA, 25 bp, Homo sapien
tgtgattgcagattaccattgggga

SEQ ID NO: 30309 - DNA, 25 bp, Homo sapien
ccaccctagtggaaatgtgattgca

SEQ ID NO: 30310 - DNA, 25 bp, Homo sapien
gaccgggatgccagacacggatgct

SEQ ID NO: 30311 - DNA, 25 bp, Homo sapien
cctgggatagggattttggacatgt

SEQ ID NO: 30312 - DNA, 25 bp, Homo sapien
agggctgaagctcatttcctccaca

SEQ ID NO: 30313 - DNA, 25 bp, Homo sapien
cctccacagacatcttgagtgtttc

SEQ ID NO: 30314 - DNA, 25 bp, Homo sapien
tgagtgtttctcgatgccagacatg

SEQ ID NO: 30315 - DNA, 25 bp, Homo sapien
tttggacatgtatgctgggacctgg

SEQ ID NO: 30316 - DNA, 25 bp, Homo sapien
tcctcttggaaggtcttcaccgaga

SEQ ID NO: 30317 - DNA, 25 bp, Homo sapien
ctgctgccgctgacgtacttgtggc

SEQ ID NO: 30318 - DNA, 25 bp, Homo sapien
tggagcgacttgagcgtcatggcct

SEQ ID NO: 30319 - DNA, 25 bp, Homo sapien
atgctgttcatcacctccaggctgt

SEQ ID NO: 30320 - DNA, 25 bp, Homo sapien
aggctgtggcgcttgttcacagtgc

SEQ ID NO: 30321 - DNA, 25 bp, Homo sapien
actgatgaaccaccggagagctgtc

SEQ ID NO: 30322 - DNA, 25 bp, Homo sapien
accgagagctgcaccttccgggtca

SEQ ID NO: 30323 - DNA, 25 bp, Homo sapien
cacctcctggagagactgatgaacc

SEQ ID NO: 30324 - DNA, 25 bp, Homo sapien
gggcagctcccaccgcgagataaca

SEQ ID NO: 30325 - DNA, 25 bp, Homo sapien
cccacggaattgattccagtgactg

SEQ ID NO: 30326 - DNA, 25 bp, Homo sapien
ttggacggggcttacctgcttacat

SEQ ID NO: 30327 - DNA, 25 bp, Homo sapien
ccaatcgcaagttggcgttgccagc

SEQ ID NO: 30328 - DNA, 25 bp, Homo sapien
tctcgttcccaaaacgcagaaggga

SEQ ID NO: 30329 - DNA, 25 bp, Homo sapien
cgtcgttcgtctttcatcctctagc

SEQ ID NO: 30330 - DNA, 25 bp, Homo sapien
ttgccagcgtctgcccaagtcatct

SEQ ID NO: 30331 - DNA, 25 bp, Homo sapien
ggtatctctagttgcccttccgagg

SEQ ID NO: 30332 - DNA, 25 bp, Homo sapien
ggaccggatgaaactccctggagta

SEQ ID NO: 30333 - DNA, 25 bp, Homo sapien
tcacagcgctggaatccgaggaatg

SEQ ID NO: 30334 - DNA, 25 bp, Homo sapien
ctgctcccgccgttggggagaaaga

SEQ ID NO: 30335 - DNA, 25 bp, Homo sapien
ccgtccttggggacgtcacagcgct

SEQ ID NO: 30336 - DNA, 25 bp, Homo sapien
aagagcccacctagacttccgagga

SEQ ID NO: 30337 - DNA, 25 bp, Homo sapien
ggcccggagaagtcgcacactttta

SEQ ID NO: 30338 - DNA, 25 bp, Homo sapien
tccctggagtaagagacgtggaagt

SEQ ID NO: 30339 - DNA, 25 bp, Homo sapien
ggcaaggcaaggaagagcccaccta

SEQ ID NO: 30340 - DNA, 25 bp, Homo sapien
gccttcctaatcagcgggcgcattc

SEQ ID NO: 30341 - DNA, 25 bp, Homo sapien
gccagaactgtactctccgagaggt

SEQ ID NO: 30342 - DNA, 25 bp, Homo sapien
ccgcagctacttagagtgaccaata

SEQ ID NO: 30343 - DNA, 25 bp, Homo sapien
gcattagcaaaagcacgtggtctcc

SEQ ID NO: 30344 - DNA, 25 bp, Homo sapien
gtccaaaaccgcgtctagcattagc

SEQ ID NO: 30345 - DNA, 25 bp, Homo sapien
gcgcattccctgacttttgcggaaa

SEQ ID NO: 30346 - DNA, 25 bp, Homo sapien
gctgcgggcagtttgaattagactc

SEQ ID NO: 30347 - DNA, 25 bp, Homo sapien
ctgcgcccttctgctcgggttcaaa

SEQ ID NO: 30348 - DNA, 25 bp, Homo sapien
cgactggagtgaagcctgggacctg

SEQ ID NO: 30349 - DNA, 25 bp, Homo sapien
cgactggagtgaagcctcggacctg

SEQ ID NO: 30350 - DNA, 25 bp, Homo sapien
gactggagtgaagcctcggacctgc

SEQ ID NO: 30351 - DNA, 25 bp, Homo sapien
gacctgccccgcgactggagtgaag

SEQ ID NO: 30352 - DNA, 25 bp, Homo sapien
gactggagtgaagcctgggacctgc

SEQ ID NO: 30353 - DNA, 25 bp, Homo sapien
tgccccgcgactggagtgaagcctg

SEQ ID NO: 30354 - DNA, 25 bp, Homo sapien
acctgccccgcgactggagtgaagc

SEQ ID NO: 30355 - DNA, 25 bp, Homo sapien
tgccccgcgactggagtgaagcctc

SEQ ID NO: 30356 - DNA, 25 bp, Homo sapien
tgagctagaagaatccgctttgttt

SEQ ID NO: 30357 - DNA, 25 bp, Homo sapien
ctgagctagaagaatccgctttgtt

SEQ ID NO: 30358 - DNA, 25 bp, Homo sapien
cctgagctagaagaatccgctttgt

SEQ ID NO: 30359 - DNA, 25 bp, Homo sapien
gcctgagctagaagaatccgctttg

SEQ ID NO: 30360 - DNA, 25 bp, Homo sapien
tgcctgagctagaagaatccgcttt

SEQ ID NO: 30361 - DNA, 25 bp, Homo sapien
agctagaagaatccgctttgttttt

SEQ ID NO: 30362 - DNA, 25 bp, Homo sapien
cgctaggcgagctggctggcagctc

SEQ ID NO: 30363 - DNA, 25 bp, Homo sapien
gagctagaagaatccgctttgtttt

SEQ ID NO: 30364 - DNA, 25 bp, Homo sapien
ctcgcgctggctgtactggaagtcg

SEQ ID NO: 30365 - DNA, 25 bp, Homo sapien
cacgcagcgaacatacatgcaggag

SEQ ID NO: 30366 - DNA, 25 bp, Homo sapien
ccagctcgcgctggctgtactggaa

SEQ ID NO: 30367 - DNA, 25 bp, Homo sapien
aggcgagcttggcagcgatgcggcc

SEQ ID NO: 30368 - DNA, 25 bp, Homo sapien
cagggagcctcgcaaccacaggtct

SEQ ID NO: 30369 - DNA, 25 bp, Homo sapien
agggagcctcgcaaccacaggtctc

SEQ ID NO: 30370 - DNA, 25 bp, Homo sapien
cctcgcaaccacaggtctccatgtc

SEQ ID NO: 30371 - DNA, 25 bp, Homo sapien
cgcagcgaacatacatgcaggagac

SEQ ID NO: 30372 - DNA, 25 bp, Homo sapien
gccgcatccctaagacaccatggtt

SEQ ID NO: 30373 - DNA, 25 bp, Homo sapien
tcctattcgacagacagccacatct

SEQ ID NO: 30374 - DNA, 25 bp, Homo sapien
catcttcttgtgcagtgccagccgc

SEQ ID NO: 30375 - DNA, 25 bp, Homo sapien
gacaccatggttaaagtgaaggatg

SEQ ID NO: 30376 - DNA, 25 bp, Homo sapien
gatggagtaaatggttttggccgta

SEQ ID NO: 30377 - DNA, 25 bp, Homo sapien
gccgtattgggcacctggtcaccag

SEQ ID NO: 30378 - DNA, 25 bp, Homo sapien
tggtcaccagggctgcttttaattc

SEQ ID NO: 30379 - DNA, 25 bp, Homo sapien
acagccacatcttcttgtgcagtgc

SEQ ID NO: 30380 - DNA, 25 bp, Homo sapien
gctgaacgaggctcgcgcacaaaga

SEQ ID NO: 30381 - DNA, 25 bp, Homo sapien
tcgcgcacaaagacgccggggcgca

SEQ ID NO: 30382 - DNA, 25 bp, Homo sapien
agacacacaaagacatgcgaagagg

SEQ ID NO: 30383 - DNA, 25 bp, Homo sapien
aaagacatgcgaagaggggctgaac

SEQ ID NO: 30384 - DNA, 25 bp, Homo sapien
ggcgcccggaccgtgccacacaccc

SEQ ID NO: 30385 - DNA, 25 bp, Homo sapien
tcccgcgatttcgtttcttctcacg

SEQ ID NO: 30386 - DNA, 25 bp, Homo sapien
caaagccggggaaaatgcctgcccg

SEQ ID NO: 30387 - DNA, 25 bp, Homo sapien
cggggaaaatgcctgcccgtgcagc

SEQ ID NO: 30388 - DNA, 25 bp, Homo sapien
aacgaaatggaatcccgcgtgggca

SEQ ID NO: 30389 - DNA, 25 bp, Homo sapien
ggcggctggccaggagcacattccc

SEQ ID NO: 30390 - DNA, 25 bp, Homo sapien
cctcctcattctaggcggcagtggc

SEQ ID NO: 30391 - DNA, 25 bp, Homo sapien
agcgctgcggtattttgtcccgaac

SEQ ID NO: 30392 - DNA, 25 bp, Homo sapien
ccttgtgcaccgcaggattgacccg

SEQ ID NO: 30393 - DNA, 25 bp, Homo sapien
cggcgagatcgtccaactgaacgta

SEQ ID NO: 30394 - DNA, 25 bp, Homo sapien
cggcctcctcctttggtgtcgacgg

SEQ ID NO: 30395 - DNA, 25 bp, Homo sapien
cctccaggcggcaagaacgtcgggc

SEQ ID NO: 30396 - DNA, 25 bp, Homo sapien
caggtaagcgaatgggcagtgccta

SEQ ID NO: 30397 - DNA, 25 bp, Homo sapien
acggcgcacttttcctgcaggatgg

SEQ ID NO: 30398 - DNA, 25 bp, Homo sapien
tggggacgtgcagcgccacctctac

SEQ ID NO: 30399 - DNA, 25 bp, Homo sapien
ctacctccaggacgtgatcatgcag

SEQ ID NO: 30400 - DNA, 25 bp, Homo sapien
gatcatgcaggtggccgacgtgcct

SEQ ID NO: 30401 - DNA, 25 bp, Homo sapien
cgctgtgcctgtccagctttggcgt

SEQ ID NO: 30402 - DNA, 25 bp, Homo sapien
tgtgctgccgctcttccatgtgcgg

SEQ ID NO: 30403 - DNA, 25 bp, Homo sapien
gtgcctagccagtgctactcctgcg

SEQ ID NO: 30404 - DNA, 25 bp, Homo sapien
cgcctgccgaggtcctagatgaatc

SEQ ID NO: 30405 - DNA, 25 bp, Homo sapien
ggaagcggatcgcactctctttgtg

SEQ ID NO: 30406 - DNA, 25 bp, Homo sapien
agaagccgccttgcctttaacgagg

SEQ ID NO: 30407 - DNA, 25 bp, Homo sapien
ggaacccataactgagcctgcggaa

SEQ ID NO: 30408 - DNA, 25 bp, Homo sapien
gtgtcggacccgatgactaagcaca

SEQ ID NO: 30409 - DNA, 25 bp, Homo sapien
cgtccctttgtgaaggcaggccctt

SEQ ID NO: 30410 - DNA, 25 bp, Homo sapien
ggacacattgttcagggccatattc

SEQ ID NO: 30411 - DNA, 25 bp, Homo sapien
gatcaccggaggacagggacacatt

SEQ ID NO: 30412 - DNA, 25 bp, Homo sapien
tccgcagactcccagggacttcctg

SEQ ID NO: 30413 - DNA, 25 bp, Homo sapien
ctccccggttctctgcctggattgg

SEQ ID NO: 30414 - DNA, 25 bp, Homo sapien
tgcccactgccacccgcaggctgcc

SEQ ID NO: 30415 - DNA, 25 bp, Homo sapien
tcgcggaggcctaggaagcccggca

SEQ ID NO: 30416 - DNA, 25 bp, Homo sapien
ggctctgctcgctccatggacagct

SEQ ID NO: 30417 - DNA, 25 bp, Homo sapien
tcaaacagaaaccaaagcccgctcc

SEQ ID NO: 30418 - DNA, 25 bp, Homo sapien
gctcccgtgggttgctgaggccctc

SEQ ID NO: 30419 - DNA, 25 bp, Homo sapien
cgctccatggacagctgggtggaaa

SEQ ID NO: 30420 - DNA, 25 bp, Homo sapien
gctgtgcactcaccgagccgggctg

SEQ ID NO: 30421 - DNA, 25 bp, Homo sapien
cgcccacggctagccggagcgccaa

SEQ ID NO: 30422 - DNA, 25 bp, Homo sapien
cggggtccgcgtcccgagcggctgt

SEQ ID NO: 30423 - DNA, 25 bp, Homo sapien
cctcccttttctcttggtagcgtcg

SEQ ID NO: 30424 - DNA, 25 bp, Homo sapien
ctcccttttctcttggtagcgtcgg

SEQ ID NO: 30425 - DNA, 25 bp, Homo sapien
cttttctcttggtagcgtcggtccg

SEQ ID NO: 30426 - DNA, 25 bp, Homo sapien
ggctgtgcactcaccgagccgggct

SEQ ID NO: 30427 - DNA, 25 bp, Homo sapien
gagcggctgtgcactcaccgagccg

SEQ ID NO: 30428 - DNA, 25 bp, Homo sapien
ctgaccctgactctatttccggcta

SEQ ID NO: 30429 - DNA, 25 bp, Homo sapien
cttgactcattttgcgcccagatgc

SEQ ID NO: 30430 - DNA, 25 bp, Homo sapien
cctcccacgtaaaggccagtcttga

SEQ ID NO: 30431 - DNA, 25 bp, Homo sapien
cccagggcggttctgagattttgat

SEQ ID NO: 30432 - DNA, 25 bp, Homo sapien
cagcgcccagtttacctggaattca

SEQ ID NO: 30433 - DNA, 25 bp, Homo sapien
tgctctcacagcaagcgagtcctgg

SEQ ID NO: 30434 - DNA, 25 bp, Homo sapien
gtctgcggctctggcatttagaaaa

SEQ ID NO: 30435 - DNA, 25 bp, Homo sapien
actgcgtcctcattcccaggtcaga

SEQ ID NO: 30436 - DNA, 25 bp, Homo sapien
gggttggaagcagtacagacgtccc

SEQ ID NO: 30437 - DNA, 25 bp, Homo sapien
tccacgcaggcgtttgcgcgcgtct

SEQ ID NO: 30438 - DNA, 25 bp, Homo sapien
gcccatggctccacgcaggcgtttg

SEQ ID NO: 30439 - DNA, 25 bp, Homo sapien
ctcgagagctgacggactgcccttt

SEQ ID NO: 30440 - DNA, 25 bp, Homo sapien
agctgacggactgccctttccaggc

SEQ ID NO: 30441 - DNA, 25 bp, Homo sapien
gtcccgagcgcgcttgcttaagagt

SEQ ID NO: 30442 - DNA, 25 bp, Homo sapien
gcgcgcttgcttaagagttctcaaa

SEQ ID NO: 30443 - DNA, 25 bp, Homo sapien
ctcaaagacggggttggaagcagta

SEQ ID NO: 30444 - DNA, 25 bp, Homo sapien
cacctcattcgtccctttccgcttc

SEQ ID NO: 30445 - DNA, 25 bp, Homo sapien
ggccacctcattcgtccctttccgc

SEQ ID NO: 30446 - DNA, 25 bp, Homo sapien
cgaggccacctcattcgtccctttc

SEQ ID NO: 30447 - DNA, 25 bp, Homo sapien
ggcacgaggccacctcattcgtccc

SEQ ID NO: 30448 - DNA, 25 bp, Homo sapien
ggagaggcacgaggccacctcattc

SEQ ID NO: 30449 - DNA, 25 bp, Homo sapien
agggagaggcacgaggccacctcat

SEQ ID NO: 30450 - DNA, 25 bp, Homo sapien
gaggcacgaggccacctcattcgtc

SEQ ID NO: 30451 - DNA, 25 bp, Homo sapien
gggagaggcacgaggccacctcatt

SEQ ID NO: 30452 - DNA, 25 bp, Homo sapien
cgtctattgttttatgcctccggga

SEQ ID NO: 30453 - DNA, 25 bp, Homo sapien
cgcacgaacagcgtctctgtggctg

SEQ ID NO: 30454 - DNA, 25 bp, Homo sapien
cagcgcgaggttcacgtctattgtt

SEQ ID NO: 30455 - DNA, 25 bp, Homo sapien
cagatccatcactggaagaaaaacc

SEQ ID NO: 30456 - DNA, 25 bp, Homo sapien
aaaccctggtgataacgattatctc

SEQ ID NO: 30457 - DNA, 25 bp, Homo sapien
acagcgtctctgtggctgtctgcag

SEQ ID NO: 30458 - DNA, 25 bp, Homo sapien
taacgattatctcccgctcgcgcta

SEQ ID NO: 30459 - DNA, 25 bp, Homo sapien
cccgcgtgatagatcttttcagatc

SEQ ID NO: 30460 - DNA, 25 bp, Homo sapien
cacaacactgtttttaaggagcgta

SEQ ID NO: 30461 - DNA, 25 bp, Homo sapien
agcgtaatgaatgcacggtattgtg

SEQ ID NO: 30462 - DNA, 25 bp, Homo sapien
gttctccagacacacaacactgttt

SEQ ID NO: 30463 - DNA, 25 bp, Homo sapien
tccgtggcttcagatggcttttaca

SEQ ID NO: 30464 - DNA, 25 bp, Homo sapien
tgattgagaacatacctggtccgtg

SEQ ID NO: 30465 - DNA, 25 bp, Homo sapien
tttactgcctgcttcctgattgaga

SEQ ID NO: 30466 - DNA, 25 bp, Homo sapien
cggctgcgggacgtaaatgtttatt

SEQ ID NO: 30467 - DNA, 25 bp, Homo sapien
cggtattgtggacgcaatcgccgcc

SEQ ID NO: 30468 - DNA, 25 bp, Homo sapien
atgagcttccggaagccgacaggcg

SEQ ID NO: 30469 - DNA, 25 bp, Homo sapien
gttcagcattttgagatgagcttcc

SEQ ID NO: 30470 - DNA, 25 bp, Homo sapien
ggatgcccggagcaaccattagttc

SEQ ID NO: 30471 - DNA, 25 bp, Homo sapien
gacttccaaagagcagttcagcatt

SEQ ID NO: 30472 - DNA, 25 bp, Homo sapien
aacagcaccggcgacttccaaagag

SEQ ID NO: 30473 - DNA, 25 bp, Homo sapien
ggcccgtgaacagactccaactaca

SEQ ID NO: 30474 - DNA, 25 bp, Homo sapien
gcctcgaagctcaggcccgtgaaca

SEQ ID NO: 30475 - DNA, 25 bp, Homo sapien
acattaacgacacccgggagcctgg

SEQ ID NO: 30476 - DNA, 25 bp, Homo sapien
tctcgccttcacttgctgctccgga

SEQ ID NO: 30477 - DNA, 25 bp, Homo sapien
agatgtcaacggctttccatcacgc

SEQ ID NO: 30478 - DNA, 25 bp, Homo sapien
actggcagggccgtcagatgtcaac

SEQ ID NO: 30479 - DNA, 25 bp, Homo sapien
gatgggttcgccaggatgagcaccc

SEQ ID NO: 30480 - DNA, 25 bp, Homo sapien
attagtgctagctgtgatgtggaga

SEQ ID NO: 30481 - DNA, 25 bp, Homo sapien
gaggaccaattagtgctagctgtga

SEQ ID NO: 30482 - DNA, 25 bp, Homo sapien
tgacagccagcgagaggaccaatta

SEQ ID NO: 30483 - DNA, 25 bp, Homo sapien
gcccagctgcgggaattgctgaccg

SEQ ID NO: 30484 - DNA, 25 bp, Homo sapien
ggcggagttccacagacctcgttag

SEQ ID NO: 30485 - DNA, 25 bp, Homo sapien
ttgaagtgatttgtcaggcggccca

SEQ ID NO: 30486 - DNA, 25 bp, Homo sapien
ggatcggaccatatgccggagcttt

SEQ ID NO: 30487 - DNA, 25 bp, Homo sapien
aagacaaacatctggggatcggacc

SEQ ID NO: 30488 - DNA, 25 bp, Homo sapien
gtccttcaaagttcggctgcccttg

SEQ ID NO: 30489 - DNA, 25 bp, Homo sapien
cttatggtctagagccttgaggcgc

SEQ ID NO: 30490 - DNA, 25 bp, Homo sapien
tgttccgcactttacccagcagggg

SEQ ID NO: 30491 - DNA, 25 bp, Homo sapien
ccggagctttgtcttgtccttcaaa

SEQ ID NO: 30492 - DNA, 25 bp, Homo sapien
aaggtattcgcaccctcggtctgca

SEQ ID NO: 30493 - DNA, 25 bp, Homo sapien
tcctggaacggacttcgcgtaaaca

SEQ ID NO: 30494 - DNA, 25 bp, Homo sapien
gagctctctccaagtcacattctga

SEQ ID NO: 30495 - DNA, 25 bp, Homo sapien
acgcttccggcgcagaaaaatggca

SEQ ID NO: 30496 - DNA, 25 bp, Homo sapien
agccgctgattttcgtcctggaacg

SEQ ID NO: 30497 - DNA, 25 bp, Homo sapien
ccgccgaggctaggaaatcaaagtg

SEQ ID NO: 30498 - DNA, 25 bp, Homo sapien
tgcaagaaaggtctcgcgtgttatc

SEQ ID NO: 30499 - DNA, 25 bp, Homo sapien
ccggcactaaatgcagaagttcctc

SEQ ID NO: 30500 - DNA, 25 bp, Homo sapien
tgggcgtctcgtacaccgcgtagcc

SEQ ID NO: 30501 - DNA, 25 bp, Homo sapien
agcctccataatagctggcacgtcc

SEQ ID NO: 30502 - DNA, 25 bp, Homo sapien
tctcacctcatcgaagatctcgaga

SEQ ID NO: 30503 - DNA, 25 bp, Homo sapien
tcgagatagaaagagtccacgcctg

SEQ ID NO: 30504 - DNA, 25 bp, Homo sapien
caccgtgcagtggatgaccttattc

SEQ ID NO: 30505 - DNA, 25 bp, Homo sapien
gatgaccttattccagcggggattc

SEQ ID NO: 30506 - DNA, 25 bp, Homo sapien
tattccagcggggattcttggcgcc

SEQ ID NO: 30507 - DNA, 25 bp, Homo sapien
attcttggcgccattgtgtgccgtg

SEQ ID NO: 30508 - DNA, 25 bp, Homo sapien
aacgcaaccgcgacggctgatcgtc

SEQ ID NO: 30509 - DNA, 25 bp, Homo sapien
caacgtggagtaaccaagcgggtca

SEQ ID NO: 30510 - DNA, 25 bp, Homo sapien
gaccgagtaccgagcgccctgcgaa

SEQ ID NO: 30511 - DNA, 25 bp, Homo sapien
tggaaggcaggaccgaaccgctcct

SEQ ID NO: 30512 - DNA, 25 bp, Homo sapien
gaaccgctccttctttaaatatata

SEQ ID NO: 30513 - DNA, 25 bp, Homo sapien
atataaatttcagcccaggtcagcc

SEQ ID NO: 30514 - DNA, 25 bp, Homo sapien
ggagccgagttcagatccgccactc

SEQ ID NO: 30515 - DNA, 25 bp, Homo sapien
tgcgcttctctgctccggagctgct

SEQ ID NO: 30516 - DNA, 25 bp, Homo sapien
aaaatagacatgccgcccttcttcc

SEQ ID NO: 30517 - DNA, 25 bp, Homo sapien
cgacgaagagtactacgccaaggag

SEQ ID NO: 30518 - DNA, 25 bp, Homo sapien
aggaggtttacaaaatagacatgcc

SEQ ID NO: 30519 - DNA, 25 bp, Homo sapien
tccatcccctgaggtttagctctgc

SEQ ID NO: 30520 - DNA, 25 bp, Homo sapien
cggagctctcaaaaccgcagcagct

SEQ ID NO: 30521 - DNA, 25 bp, Homo sapien
cgagaggagcgacgaagagtactac

SEQ ID NO: 30522 - DNA, 25 bp, Homo sapien
gccaaggaggtttacaaaatagaca

SEQ ID NO: 30523 - DNA, 25 bp, Homo sapien
gatcgcccttccctctcgcggttcc

SEQ ID NO: 30524 - DNA, 25 bp, Homo sapien
gcatagcgcctctctgatcttcctg

SEQ ID NO: 30525 - DNA, 25 bp, Homo sapien
ctcaggtggatttcaattttacgtc

SEQ ID NO: 30526 - DNA, 25 bp, Homo sapien
ccagtattgcccaagtggaggtgtc

SEQ ID NO: 30527 - DNA, 25 bp, Homo sapien
aaccgcatgactggcagtggcatca

SEQ ID NO: 30528 - DNA, 25 bp, Homo sapien
tcctctttctatcgggcggtcactg

SEQ ID NO: 30529 - DNA, 25 bp, Homo sapien
ctgatcttcctgcatggctcaggtg

SEQ ID NO: 30530 - DNA, 25 bp, Homo sapien
ttctgcagcgctgtatcgtgtcgcc

SEQ ID NO: 30531 - DNA, 25 bp, Homo sapien
ccaccctcgctttggggccttgtgt

SEQ ID NO: 30532 - DNA, 25 bp, Homo sapien
accaagactgccagcgtcaaagatg

SEQ ID NO: 30533 - DNA, 25 bp, Homo sapien
gcccggccggtaaaagtgccagcac

SEQ ID NO: 30534 - DNA, 25 bp, Homo sapien
ccgcttgctgccacgtctttcttct

SEQ ID NO: 30535 - DNA, 25 bp, Homo sapien
gactcccgcttgctgccacgtcttt

SEQ ID NO: 30536 - DNA, 25 bp, Homo sapien
cggccggtaaaagtgccagcacgac

SEQ ID NO: 30537 - DNA, 25 bp, Homo sapien
taaaagtgccagcacgacgcagggc

SEQ ID NO: 30538 - DNA, 25 bp, Homo sapien
aaagtgccagcacgacgcagggcgc

SEQ ID NO: 30539 - DNA, 25 bp, Homo sapien
gcagcactagcagaaaaccaagact

SEQ ID NO: 30540 - DNA, 25 bp, Homo sapien
gcagtatctgaacagcccgtgcacc

SEQ ID NO: 30541 - DNA, 25 bp, Homo sapien
tcttgccagagtagcggcccatctc

SEQ ID NO: 30542 - DNA, 25 bp, Homo sapien
acctgctacgtttgcgaacacggtc

SEQ ID NO: 30543 - DNA, 25 bp, Homo sapien
tggccacgagccgatgtctctcttt

SEQ ID NO: 30544 - DNA, 25 bp, Homo sapien
cgctttttataacgcgaggccgagc

SEQ ID NO: 30545 - DNA, 25 bp, Homo sapien
tctctttgtgggacaggactgtgca

SEQ ID NO: 30546 - DNA, 25 bp, Homo sapien
acggtgagcaccagcatgaagagca

SEQ ID NO: 30547 - DNA, 25 bp, Homo sapien
tcaggcccacgcacagcgagatcag

SEQ ID NO: 30548 - DNA, 25 bp, Homo sapien
ggagcctcctccacgtacaattctg

SEQ ID NO: 30549 - DNA, 25 bp, Homo sapien
gctggtccacctgtcagtacgcctg

SEQ ID NO: 30550 - DNA, 25 bp, Homo sapien
ttcacggtcagagagagcgtcgcca

SEQ ID NO: 30551 - DNA, 25 bp, Homo sapien
ggagggtctcctgaattcacggtca

SEQ ID NO: 30552 - DNA, 25 bp, Homo sapien
tggctgatgcaacccacacaggtca

SEQ ID NO: 30553 - DNA, 25 bp, Homo sapien
aggggcaggtccaacatcccagatg

SEQ ID NO: 30554 - DNA, 25 bp, Homo sapien
catgcccgggaaaaccatcttcagg

SEQ ID NO: 30555 - DNA, 25 bp, Homo sapien
gtgaccaccactgcgcaaagccggg

SEQ ID NO: 30556 - DNA, 25 bp, Homo sapien
ggcagagctgtcgttaaatccctta

SEQ ID NO: 30557 - DNA, 25 bp, Homo sapien
taatgacggcggtgttttctctggt

SEQ ID NO: 30558 - DNA, 25 bp, Homo sapien
aatagacgcctctctgtgcactggg

SEQ ID NO: 30559 - DNA, 25 bp, Homo sapien
ccgtgggttagacatgcgtctgtga

SEQ ID NO: 30560 - DNA, 25 bp, Homo sapien
cgtctgtgatcggtggcttcataaa

SEQ ID NO: 30561 - DNA, 25 bp, Homo sapien
tggcttcataaaacgccttctaatg

SEQ ID NO: 30562 - DNA, 25 bp, Homo sapien
cagagacagccgttataatagacgc

SEQ ID NO: 30563 - DNA, 25 bp, Homo sapien
cccgagaaatgcttgttactgtgga

SEQ ID NO: 30564 - DNA, 25 bp, Homo sapien
cacggagctggagatccagcaggta

SEQ ID NO: 30565 - DNA, 25 bp, Homo sapien
ccgctctcaggggttgccggaccat

SEQ ID NO: 30566 - DNA, 25 bp, Homo sapien
gtgctgctgccgcagacgagcttcc

SEQ ID NO: 30567 - DNA, 25 bp, Homo sapien
gcaggcgccacacctctaggctcca

SEQ ID NO: 30568 - DNA, 25 bp, Homo sapien
agataccgggacacggtgctgctgc

SEQ ID NO: 30569 - DNA, 25 bp, Homo sapien
tcgaatagtggcagataccgggaca

SEQ ID NO: 30570 - DNA, 25 bp, Homo sapien
ccgaactcgaatagtggcagatacc

SEQ ID NO: 30571 - DNA, 25 bp, Homo sapien
cagtaaccaccagccgaactcgaat

SEQ ID NO: 30572 - DNA, 25 bp, Homo sapien
ccagagaggcacttactggggtccc

SEQ ID NO: 30573 - DNA, 25 bp, Homo sapien
accaaaccggaagctgtcactgaca

SEQ ID NO: 30574 - DNA, 25 bp, Homo sapien
cctggaggtcctggaagtagcagaa

SEQ ID NO: 30575 - DNA, 25 bp, Homo sapien
taggagactcgaacccgtgagcaga

SEQ ID NO: 30576 - DNA, 25 bp, Homo sapien
actgacacgggtccgctgtctccga

SEQ ID NO: 30577 - DNA, 25 bp, Homo sapien
tagctctagccaagcagaaggcgga

SEQ ID NO: 30578 - DNA, 25 bp, Homo sapien
tgtctccgagtactgcgcaggcgca

SEQ ID NO: 30579 - DNA, 25 bp, Homo sapien
cagaactggacaatggagcaggcca

SEQ ID NO: 30580 - DNA, 25 bp, Homo sapien
acgccattgccgacggtgaacgagc

SEQ ID NO: 30581 - DNA, 25 bp, Homo sapien
ggaccgagccgagacattcgcgccg

SEQ ID NO: 30582 - DNA, 25 bp, Homo sapien
cgccgtacacctgaggcggagaacg

SEQ ID NO: 30583 - DNA, 25 bp, Homo sapien
agccaggcagtgatttgaggcaccg

SEQ ID NO: 30584 - DNA, 25 bp, Homo sapien
cttcacccatggtccggagagccta

SEQ ID NO: 30585 - DNA, 25 bp, Homo sapien
tgaacgagcgggacacggaaaatgt

SEQ ID NO: 30586 - DNA, 25 bp, Homo sapien
gaaaatgtgagtaaccggagcctcc

SEQ ID NO: 30587 - DNA, 25 bp, Homo sapien
agtgatttgaggcaccggcttcacc

SEQ ID NO: 30588 - DNA, 25 bp, Homo sapien
cgagtgaggtttcgctcgtggaacc

SEQ ID NO: 30589 - DNA, 25 bp, Homo sapien
atctggtcgcaaccgcaggtgagac

SEQ ID NO: 30590 - DNA, 25 bp, Homo sapien
cgcaggtgagactctaagtcccatc

SEQ ID NO: 30591 - DNA, 25 bp, Homo sapien
taagtcccatcattcccttcggcag

SEQ ID NO: 30592 - DNA, 25 bp, Homo sapien
acgtgtggtttcagctcgtgcgcct

SEQ ID NO: 30593 - DNA, 25 bp, Homo sapien
ctcgtggaaccgaggagtcgagccc

SEQ ID NO: 30594 - DNA, 25 bp, Homo sapien
tttagcgactattgcgcctgcgcca

SEQ ID NO: 30595 - DNA, 25 bp, Homo sapien
cgtgggtttgcgacgtttagcgact

SEQ ID NO: 30596 - DNA, 25 bp, Homo sapien
gcgagtcgtgatagaaacttaaatc

SEQ ID NO: 30597 - DNA, 25 bp, Homo sapien
taccggaggaagctgaagaagtacg

SEQ ID NO: 30598 - DNA, 25 bp, Homo sapien
cagttcggagcggagccaacgctat

SEQ ID NO: 30599 - DNA, 25 bp, Homo sapien
gcggagggtgcacttcgccctcctg

SEQ ID NO: 30600 - DNA, 25 bp, Homo sapien
gagccgggtccttaccatcgactca

SEQ ID NO: 30601 - DNA, 25 bp, Homo sapien
agtttctccgggctgcacctgcgac

SEQ ID NO: 30602 - DNA, 25 bp, Homo sapien
ccgcgagttgcgagtcgtgatagaa

SEQ ID NO: 30603 - DNA, 25 bp, Homo sapien
tctttgcgctcggaccttcgccaga

SEQ ID NO: 30604 - DNA, 25 bp, Homo sapien
cattagctcgcttgctttgggcggc

SEQ ID NO: 30605 - DNA, 25 bp, Homo sapien
ggtcaactttgactcctctcgcctg

SEQ ID NO: 30606 - DNA, 25 bp, Homo sapien
aactgctctgccgtctcggcggtga

SEQ ID NO: 30607 - DNA, 25 bp, Homo sapien
tccattaccgcgcaggcttggtcac

SEQ ID NO: 30608 - DNA, 25 bp, Homo sapien
aggtcatgttgcatgggtaactgtc

SEQ ID NO: 30609 - DNA, 25 bp, Homo sapien
tcgagcgactaagcgtgcagtatta

SEQ ID NO: 30610 - DNA, 25 bp, Homo sapien
acgttctgcggtgatcttgtcgagc

SEQ ID NO: 30611 - DNA, 25 bp, Homo sapien
gcttggtcaccgcattaaggcattc

SEQ ID NO: 30612 - DNA, 25 bp, Homo sapien
aaggacgcactgctctgattggccc

SEQ ID NO: 30613 - DNA, 25 bp, Homo sapien
cgcgctttgtcctcctcgcgcaatc

SEQ ID NO: 30614 - DNA, 25 bp, Homo sapien
ccacctcgcggagaagccagccatg

SEQ ID NO: 30615 - DNA, 25 bp, Homo sapien
ccctgcagcgcaggcgacggaaggt

SEQ ID NO: 30616 - DNA, 25 bp, Homo sapien
cccggaagggttcaggagctgccca

SEQ ID NO: 30617 - DNA, 25 bp, Homo sapien
cccagaaggacgcactgctctgatt

SEQ ID NO: 30618 - DNA, 25 bp, Homo sapien
gctcggggccaaaggccgcaccttc

SEQ ID NO: 30619 - DNA, 25 bp, Homo sapien
caagtggaagctgagccaccacctc

SEQ ID NO: 30620 - DNA, 25 bp, Homo sapien
gttgcaacttgcactccagccgcgg

SEQ ID NO: 30621 - DNA, 25 bp, Homo sapien
gctgataggggagtcttatttctta

SEQ ID NO: 30622 - DNA, 25 bp, Homo sapien
ccggagcgtcgcaaaccttggaaag

SEQ ID NO: 30623 - DNA, 25 bp, Homo sapien
tccgggccttgaatctcggcagatg

SEQ ID NO: 30624 - DNA, 25 bp, Homo sapien
cgcgcaggcgaagttgcaacttgca

SEQ ID NO: 30625 - DNA, 25 bp, Homo sapien
aagacttgtatttcgcgtttgcctc

SEQ ID NO: 30626 - DNA, 25 bp, Homo sapien
gggtcgctccaaagacttgtatttc

SEQ ID NO: 30627 - DNA, 25 bp, Homo sapien
ttgtgggcacctagggaaccctgag

SEQ ID NO: 30628 - DNA, 25 bp, Homo sapien
gcctgactcgaaagctcctgccaaa

SEQ ID NO: 30629 - DNA, 25 bp, Homo sapien
ccgctcccattggtcacgaggatga

SEQ ID NO: 30630 - DNA, 25 bp, Homo sapien
cacgcggccgcagcaaaaactttgg

SEQ ID NO: 30631 - DNA, 25 bp, Homo sapien
atgtgcgctactaagcccacgcggc

SEQ ID NO: 30632 - DNA, 25 bp, Homo sapien
aagctcctgtgatcaaccctccttg

SEQ ID NO: 30633 - DNA, 25 bp, Homo sapien
cccgggtgacaagcgcttcaggaaa

SEQ ID NO: 30634 - DNA, 25 bp, Homo sapien
agccctaaagagtgagattaccgtc

SEQ ID NO: 30635 - DNA, 25 bp, Homo sapien
ctctcttcctcagtgcgggcggaga

SEQ ID NO: 30636 - DNA, 25 bp, Homo sapien
cagttccaagacacgtttccaggta

SEQ ID NO: 30637 - DNA, 25 bp, Homo sapien
ccggccagttcttcgcatctctaga

SEQ ID NO: 30638 - DNA, 25 bp, Homo sapien
gccacggtgtcgcaatctcacaatt

SEQ ID NO: 30639 - DNA, 25 bp, Homo sapien
aatctcaggactgacgcctccaggg

SEQ ID NO: 30640 - DNA, 25 bp, Homo sapien
ctccagagtactgcctaacgggcga

SEQ ID NO: 30641 - DNA, 25 bp, Homo sapien
ggcttctgcaatcctgagtccctta

SEQ ID NO: 30642 - DNA, 25 bp, Homo sapien
gatcccattaacgaggcttctgcaa

SEQ ID NO: 30643 - DNA, 25 bp, Homo sapien
acgggcgagccgactaacagtcaga

SEQ ID NO: 30644 - DNA, 25 bp, Homo sapien
gcaggtccctatgctgtgctcacga

SEQ ID NO: 30645 - DNA, 25 bp, Homo sapien
cgcagacgtacaaaaggaagcgttc

SEQ ID NO: 30646 - DNA, 25 bp, Homo sapien
gctgtgttctccaacctgcagagga

SEQ ID NO: 30647 - DNA, 25 bp, Homo sapien
ttcagaagtacgtgaccaagccgga

SEQ ID NO: 30648 - DNA, 25 bp, Homo sapien
ctgggcctcacggacgcacaggtaa

SEQ ID NO: 30649 - DNA, 25 bp, Homo sapien
cacaggtaaggcagttctggctcca

SEQ ID NO: 30650 - DNA, 25 bp, Homo sapien
cagcgcacggcctagtctggtaggt

SEQ ID NO: 30651 - DNA, 25 bp, Homo sapien
cgaaggacaccatgccgcagacgta

SEQ ID NO: 30652 - DNA, 25 bp, Homo sapien
atgcattctgcctgtcatggacacg

SEQ ID NO: 30653 - DNA, 25 bp, Homo sapien
tcttggacgtccacactcttggatg

SEQ ID NO: 30654 - DNA, 25 bp, Homo sapien
ggcaccgtgtcatcgtcactggctc

SEQ ID NO: 30655 - DNA, 25 bp, Homo sapien
tgtcatcgtcactggctcaagaaat

SEQ ID NO: 30656 - DNA, 25 bp, Homo sapien
tccgtagctcccagatccatgcatt

SEQ ID NO: 30657 - DNA, 25 bp, Homo sapien
ctggctcaagaaatagcctgcaaac

SEQ ID NO: 30658 - DNA, 25 bp, Homo sapien
agcctgcaaactaaaggacagcgcc

SEQ ID NO: 30659 - DNA, 25 bp, Homo sapien
ggacgtccacactcttggatgccca

SEQ ID NO: 30660 - DNA, 25 bp, Homo sapien
cgcgagtcggataggagcaaacctg

SEQ ID NO: 30661 - DNA, 25 bp, Homo sapien
tggcgagaagccatcaggtggagcc

SEQ ID NO: 30662 - DNA, 25 bp, Homo sapien
ggcggatgaagtggcggcactccaa

SEQ ID NO: 30663 - DNA, 25 bp, Homo sapien
ggtctcatctcggtgtctcttcttg

SEQ ID NO: 30664 - DNA, 25 bp, Homo sapien
caaacctgggtctcatctcggtgtc

SEQ ID NO: 30665 - DNA, 25 bp, Homo sapien
tcggataggagcaaacctgggtctc

SEQ ID NO: 30666 - DNA, 25 bp, Homo sapien
agcgactccgagtccctggacatgg

SEQ ID NO: 30667 - DNA, 25 bp, Homo sapien
ggacatggcccccagcgacacggag

SEQ ID NO: 30668 - DNA, 25 bp, Homo sapien
tgctctttgagcaaagctttgccta

SEQ ID NO: 30669 - DNA, 25 bp, Homo sapien
tcctgcacacaacccgagactccag

SEQ ID NO: 30670 - DNA, 25 bp, Homo sapien
tagaaccgctcagggttgaggcttg

SEQ ID NO: 30671 - DNA, 25 bp, Homo sapien
agactccagccagcgattgctcttt

SEQ ID NO: 30672 - DNA, 25 bp, Homo sapien
ccagccagcgattgctctttgagca

SEQ ID NO: 30673 - DNA, 25 bp, Homo sapien
ccagcgattgctctttgagcaaagc

SEQ ID NO: 30674 - DNA, 25 bp, Homo sapien
aagctttgcctagcccgctgaagtc

SEQ ID NO: 30675 - DNA, 25 bp, Homo sapien
ccgtgcggggcgctagaaccgctca

SEQ ID NO: 30676 - DNA, 25 bp, Homo sapien
tcggggacagtatgtgctacgcact

SEQ ID NO: 30677 - DNA, 25 bp, Homo sapien
cactgactgtgtgatcggagacacc

SEQ ID NO: 30678 - DNA, 25 bp, Homo sapien
ttaaagtggttgacctccaaggtga

SEQ ID NO: 30679 - DNA, 25 bp, Homo sapien
ggggcttctcttcactaaacatata

SEQ ID NO: 30680 - DNA, 25 bp, Homo sapien
tccaaggtgacatctgtttctaaga

SEQ ID NO: 30681 - DNA, 25 bp, Homo sapien
tcctcatgccagtgtgggccacaca

SEQ ID NO: 30682 - DNA, 25 bp, Homo sapien
ccacacactgtgtgatcggggacag

SEQ ID NO: 30683 - DNA, 25 bp, Homo sapien
ctaagagttatgtctggggcttctc

SEQ ID NO: 30684 - DNA, 25 bp, Homo sapien
cccagcacgtggtagaagctcaaga

SEQ ID NO: 30685 - DNA, 25 bp, Homo sapien
actacctgctgaaatgcgggccgcg

SEQ ID NO: 30686 - DNA, 25 bp, Homo sapien
attcattcagttcacggtcagcgcg

SEQ ID NO: 30687 - DNA, 25 bp, Homo sapien
cgagcctctcttggaacacggaaga

SEQ ID NO: 30688 - DNA, 25 bp, Homo sapien
agtgcctgttctgcggaattcccta

SEQ ID NO: 30689 - DNA, 25 bp, Homo sapien
tctctgcggagcaaaagtgcctgtt

SEQ ID NO: 30690 - DNA, 25 bp, Homo sapien
cgagttggtcttagtgcgtctgcac

SEQ ID NO: 30691 - DNA, 25 bp, Homo sapien
tcagaatccgcgtgacgagtgcacc

SEQ ID NO: 30692 - DNA, 25 bp, Homo sapien
cagcgggcaccagctacgttttgct

SEQ ID NO: 30693 - DNA, 25 bp, Homo sapien
cccagatttgattccggttcgtcga

SEQ ID NO: 30694 - DNA, 25 bp, Homo sapien
ccgtccttgcaagggcccagatttg

SEQ ID NO: 30695 - DNA, 25 bp, Homo sapien
actgggcttacttcgggatctagac

SEQ ID NO: 30696 - DNA, 25 bp, Homo sapien
ttctggaaacttgcacggaagcctg

SEQ ID NO: 30697 - DNA, 25 bp, Homo sapien
gtatagtgcccacccgactctgttc

SEQ ID NO: 30698 - DNA, 25 bp, Homo sapien
ccggaccctcaggtataattctgga

SEQ ID NO: 30699 - DNA, 25 bp, Homo sapien
ccaacgctactagggtgctgtaaca

SEQ ID NO: 30700 - DNA, 25 bp, Homo sapien
ttgatttactgtcgcactgggtctc

SEQ ID NO: 30701 - DNA, 25 bp, Homo sapien
cgagtccataaacacgggccattta

SEQ ID NO: 30702 - DNA, 25 bp, Homo sapien
tcgccgtctgctgtcttttgattta

SEQ ID NO: 30703 - DNA, 25 bp, Homo sapien
gtgggcagaattcccaaagaacctc

SEQ ID NO: 30704 - DNA, 25 bp, Homo sapien
tcgggtcagtttacccactcgcaga

SEQ ID NO: 30705 - DNA, 25 bp, Homo sapien
tgagtcgctgtgacactggcttctc

SEQ ID NO: 30706 - DNA, 25 bp, Homo sapien
tcccgcaggcgacagtgggcagaat

SEQ ID NO: 30707 - DNA, 25 bp, Homo sapien
ggtctcagcacccagtcgctcaggg

SEQ ID NO: 30708 - DNA, 25 bp, Homo sapien
gcggtgatgtcattggcaaccaatc

SEQ ID NO: 30709 - DNA, 25 bp, Homo sapien
gctaagccaaaattcgcggacctcg

SEQ ID NO: 30710 - DNA, 25 bp, Homo sapien
tcgctcgaggtgacttgacaaacgc

SEQ ID NO: 30711 - DNA, 25 bp, Homo sapien
ctgcgatcaccgtccctagtgggaa

SEQ ID NO: 30712 - DNA, 25 bp, Homo sapien
cctccttactatggacagatgatca

SEQ ID NO: 30713 - DNA, 25 bp, Homo sapien
gctgctccgctaaaactggctcttc

SEQ ID NO: 30714 - DNA, 25 bp, Homo sapien
gtcttctgcgctaggaccagcatga

SEQ ID NO: 30715 - DNA, 25 bp, Homo sapien
ccggcaggatgcagttaacccttta

SEQ ID NO: 30716 - DNA, 25 bp, Homo sapien
atcgcctcaccggaggctagcggct

SEQ ID NO: 30717 - DNA, 25 bp, Homo sapien
tccccatcgcctcaccggaggctag

SEQ ID NO: 30718 - DNA, 25 bp, Homo sapien
ccccatcgcctcaccggaggctagc

SEQ ID NO: 30719 - DNA, 25 bp, Homo sapien
cccatcgcctcaccggaggctagcg

SEQ ID NO: 30720 - DNA, 25 bp, Homo sapien
ccatcgcctcaccggaggctagcgg

SEQ ID NO: 30721 - DNA, 25 bp, Homo sapien
catcgcctcaccggaggctagcggc

SEQ ID NO: 30722 - DNA, 25 bp, Homo sapien
ctccccatcgcctcaccggaggcta

SEQ ID NO: 30723 - DNA, 25 bp, Homo sapien
gctccccatcgcctcaccggaggct

SEQ ID NO: 30724 - DNA, 25 bp, Homo sapien
gcccgtggcagtcccaccacgcgcc

SEQ ID NO: 30725 - DNA, 25 bp, Homo sapien
ttccggacgtcgcacatcaggacct

SEQ ID NO: 30726 - DNA, 25 bp, Homo sapien
agttccttccggacgtcgcacatca

SEQ ID NO: 30727 - DNA, 25 bp, Homo sapien
cagggggcgagaaagcctctctttt

SEQ ID NO: 30728 - DNA, 25 bp, Homo sapien
ccaggcccgtggcagtcccaccacg

SEQ ID NO: 30729 - DNA, 25 bp, Homo sapien
ttccttccggacgtcgcacatcagg

SEQ ID NO: 30730 - DNA, 25 bp, Homo sapien
aagcctctcttttgagggccccacg

SEQ ID NO: 30731 - DNA, 25 bp, Homo sapien
tccggacgtcgcacatcaggacctg

SEQ ID NO: 30732 - DNA, 25 bp, Homo sapien
tcgcgcaatcgctccagcttgaatg

SEQ ID NO: 30733 - DNA, 25 bp, Homo sapien
ggacgcgcagcgtccgtcgcgcaat

SEQ ID NO: 30734 - DNA, 25 bp, Homo sapien
aagcgcagcggacgcctgtagatga

SEQ ID NO: 30735 - DNA, 25 bp, Homo sapien
ctcggagtcccagaaacacggtcct

SEQ ID NO: 30736 - DNA, 25 bp, Homo sapien
tccagagataatggtgctgattatg

SEQ ID NO: 30737 - DNA, 25 bp, Homo sapien
tcctcgggttcttttcacaggccgc

SEQ ID NO: 30738 - DNA, 25 bp, Homo sapien
cttgaatgcgagacacgcgggttta

SEQ ID NO: 30739 - DNA, 25 bp, Homo sapien
ttcacaggccgcatcgcggagagga

SEQ ID NO: 30740 - DNA, 25 bp, Homo sapien
gagccgttgtccctagagcagcctc

SEQ ID NO: 30741 - DNA, 25 bp, Homo sapien
tggttctgtagtctcggttctccga

SEQ ID NO: 30742 - DNA, 25 bp, Homo sapien
cgaagcgttttgaggggactgcaac

SEQ ID NO: 30743 - DNA, 25 bp, Homo sapien
ggtaggggcaactcttctcttcctg

SEQ ID NO: 30744 - DNA, 25 bp, Homo sapien
tttgccgccacagccaaactttgcg

SEQ ID NO: 30745 - DNA, 25 bp, Homo sapien
cgcggttagtcactcacatctgata

SEQ ID NO: 30746 - DNA, 25 bp, Homo sapien
agccttggctgcagatacggtgatg

SEQ ID NO: 30747 - DNA, 25 bp, Homo sapien
ccctctttttctcgcttgtggactc

SEQ ID NO: 30748 - DNA, 25 bp, Homo sapien
tctgcagcgtcctcgggaggtctca

SEQ ID NO: 30749 - DNA, 25 bp, Homo sapien
cgcagcaggcgcctggaagatgcct

SEQ ID NO: 30750 - DNA, 25 bp, Homo sapien
tggctgcacccgcactgttcgttca

SEQ ID NO: 30751 - DNA, 25 bp, Homo sapien
agggatggcaggcttcagccacttc

SEQ ID NO: 30752 - DNA, 25 bp, Homo sapien
gcattgtgaagtggcccgagcgtca

SEQ ID NO: 30753 - DNA, 25 bp, Homo sapien
acccagctgccaggcgcattgtgaa

SEQ ID NO: 30754 - DNA, 25 bp, Homo sapien
tctgaagactgcgaggacccagctg

SEQ ID NO: 30755 - DNA, 25 bp, Homo sapien
gagaacgagagtccacgcagcggct

SEQ ID NO: 30756 - DNA, 25 bp, Homo sapien
agagcaccgaaaacagtgccaggtg

SEQ ID NO: 30757 - DNA, 25 bp, Homo sapien
agcagcgcaagaccctccagagccc

SEQ ID NO: 30758 - DNA, 25 bp, Homo sapien
ggacagccagaggaagaacgtgccc

SEQ ID NO: 30759 - DNA, 25 bp, Homo sapien
ggaaagccggtggaaggagcaacca

SEQ ID NO: 30760 - DNA, 25 bp, Homo sapien
aaggagcaaccagaggaccaggaga

SEQ ID NO: 30761 - DNA, 25 bp, Homo sapien
gcgcccaggcagagcaccgaaaaca

SEQ ID NO: 30762 - DNA, 25 bp, Homo sapien
gcaggagaagatgctacggaacctc

SEQ ID NO: 30763 - DNA, 25 bp, Homo sapien
agagcccgcgccaggagaagctgga

SEQ ID NO: 30764 - DNA, 25 bp, Homo sapien
gagttggggccctactccagcaaaa

SEQ ID NO: 30765 - DNA, 25 bp, Homo sapien
tactccagcaaaacccggggcatcg

SEQ ID NO: 30766 - DNA, 25 bp, Homo sapien
gaagccgcaagccaggacctcgcag

SEQ ID NO: 30767 - DNA, 25 bp, Homo sapien
caccacgctttcctgggcgggtcga

SEQ ID NO: 30768 - DNA, 25 bp, Homo sapien
gggccatcaagtacctcaaccagga

SEQ ID NO: 30769 - DNA, 25 bp, Homo sapien
ctccggtgaatcatcgctcgcagcg

SEQ ID NO: 30770 - DNA, 25 bp, Homo sapien
ggagctgtccgcagatggcagcacc

SEQ ID NO: 30771 - DNA, 25 bp, Homo sapien
tgggctcccacgacagggccatcaa

SEQ ID NO: 30772 - DNA, 25 bp, Homo sapien
tgtgtttgcagatcaccagcgccgc

SEQ ID NO: 30773 - DNA, 25 bp, Homo sapien
ctctggtattctcggcgttcaagca

SEQ ID NO: 30774 - DNA, 25 bp, Homo sapien
gttgcattccgccttttctctggta

SEQ ID NO: 30775 - DNA, 25 bp, Homo sapien
gaatgcctgtgctcgttccgcgaga

SEQ ID NO: 30776 - DNA, 25 bp, Homo sapien
tggatgcgctattcacacgggaatg

SEQ ID NO: 30777 - DNA, 25 bp, Homo sapien
ccagcctgcagaaatccgtggatgc

SEQ ID NO: 30778 - DNA, 25 bp, Homo sapien
tcggaggccatcacgtttcagaagc

SEQ ID NO: 30779 - DNA, 25 bp, Homo sapien
cccacggtggtccagtttacactcg

SEQ ID NO: 30780 - DNA, 25 bp, Homo sapien
tctcttcgacgctcgtgacggtcgg

SEQ ID NO: 30781 - DNA, 25 bp, Homo sapien
acgcggctttgtctcttcgacgctc

SEQ ID NO: 30782 - DNA, 25 bp, Homo sapien
tcctcggcggctccgagtcgtgcga

SEQ ID NO: 30783 - DNA, 25 bp, Homo sapien
atggtagtgaatggcaccgagccgc

SEQ ID NO: 30784 - DNA, 25 bp, Homo sapien
cctcaggaaaacaggatggtagtga

SEQ ID NO: 30785 - DNA, 25 bp, Homo sapien
aaggccgcgcctcaggaaaacagga

SEQ ID NO: 30786 - DNA, 25 bp, Homo sapien
tcttggacccgaaccgcatggaagc

SEQ ID NO: 30787 - DNA, 25 bp, Homo sapien
ctgaaacccgctcgaagctcggaaa

SEQ ID NO: 30788 - DNA, 25 bp, Homo sapien
gagctcctcatgcagctgctcctgg

SEQ ID NO: 30789 - DNA, 25 bp, Homo sapien
gcgtgcccgctttctacctgtcgga

SEQ ID NO: 30790 - DNA, 25 bp, Homo sapien
ccatctttgagggttactccctgcc

SEQ ID NO: 30791 - DNA, 25 bp, Homo sapien
agggacatcacggagctcctcatgc

SEQ ID NO: 30792 - DNA, 25 bp, Homo sapien
ccctgccagctggacaagggtctcg

SEQ ID NO: 30793 - DNA, 25 bp, Homo sapien
tcctgagggagtacaagctgcccga

SEQ ID NO: 30794 - DNA, 25 bp, Homo sapien
tgcccgacgggaacatcatcagcct

SEQ ID NO: 30795 - DNA, 25 bp, Homo sapien
cagtcaccaagctccacgtggcggg

SEQ ID NO: 30796 - DNA, 25 bp, Homo sapien
ctcattcacacttagccgggcaggg

SEQ ID NO: 30797 - DNA, 25 bp, Homo sapien
aaggggctcacagatgccctcagcc

SEQ ID NO: 30798 - DNA, 25 bp, Homo sapien
ccctccgcttcggatgtaggaagtg

SEQ ID NO: 30799 - DNA, 25 bp, Homo sapien
tgccttcggagatttaggggccaac

SEQ ID NO: 30800 - DNA, 25 bp, Homo sapien
actgggatccgctcggcagcactac

SEQ ID NO: 30801 - DNA, 25 bp, Homo sapien
atgtcgggcacctgcctcagactgg

SEQ ID NO: 30802 - DNA, 25 bp, Homo sapien
cccgagcggacagctaatgagatgc

SEQ ID NO: 30803 - DNA, 25 bp, Homo sapien
ccctggggactctcattcacactta

SEQ ID NO: 30804 - DNA, 25 bp, Homo sapien
gcctgccttttgtatgccgcttcca

SEQ ID NO: 30805 - DNA, 25 bp, Homo sapien
tggctccggaccagctgcctcaaaa

SEQ ID NO: 30806 - DNA, 25 bp, Homo sapien
aacaacacgcttgtggcgctgccca

SEQ ID NO: 30807 - DNA, 25 bp, Homo sapien
cgctgcccatcgtagccatcgagaa

SEQ ID NO: 30808 - DNA, 25 bp, Homo sapien
atcctcagctttatgtcctacgacg

SEQ ID NO: 30809 - DNA, 25 bp, Homo sapien
tcctacgacgaaattagccagctcc

SEQ ID NO: 30810 - DNA, 25 bp, Homo sapien
ctctcccttggcgtcagtcagcagg

SEQ ID NO: 30811 - DNA, 25 bp, Homo sapien
ttcccgattgcgtcctagctgcgga

SEQ ID NO: 30812 - DNA, 25 bp, Homo sapien
gtgccagccttgagtagatcttttc

SEQ ID NO: 30813 - DNA, 25 bp, Homo sapien
ttcgctagaagattcctgtgccctc

SEQ ID NO: 30814 - DNA, 25 bp, Homo sapien
gcactcgcaagaacgcggcatcctg

SEQ ID NO: 30815 - DNA, 25 bp, Homo sapien
gtggccgagtcaccgaagctcagaa

SEQ ID NO: 30816 - DNA, 25 bp, Homo sapien
gtcccagaatcgctgagagccggcc

SEQ ID NO: 30817 - DNA, 25 bp, Homo sapien
gagagccgacagctagtctgcaagc

SEQ ID NO: 30818 - DNA, 25 bp, Homo sapien
caagccaccgctgtcgccatgggga

SEQ ID NO: 30819 - DNA, 25 bp, Homo sapien
cgcgtctcgcgggaagacttcgagt

SEQ ID NO: 30820 - DNA, 25 bp, Homo sapien
ccgggccagttgcacctgaaatgcg

SEQ ID NO: 30821 - DNA, 25 bp, Homo sapien
cgaggccaagcggtgcagaatacac

SEQ ID NO: 30822 - DNA, 25 bp, Homo sapien
cacacctggatgactcgctgcttga

SEQ ID NO: 30823 - DNA, 25 bp, Homo sapien
ttcatcgcgtcggtcttccaagcca

SEQ ID NO: 30824 - DNA, 25 bp, Homo sapien
cgcgccgtttccgtcagaataaaag

SEQ ID NO: 30825 - DNA, 25 bp, Homo sapien
ctcagggagtttctaggggccttat

SEQ ID NO: 30826 - DNA, 25 bp, Homo sapien
cagtggaccctggaagattaggacc

SEQ ID NO: 30827 - DNA, 25 bp, Homo sapien
ttattatccacgaaccctgcaggtc

SEQ ID NO: 30828 - DNA, 25 bp, Homo sapien
ctcgggagagaagcgtcgctgtttt

SEQ ID NO: 30829 - DNA, 25 bp, Homo sapien
tcgctgtttttctgggagaggccct

SEQ ID NO: 30830 - DNA, 25 bp, Homo sapien
tctcctcgattgttgcgcgctcatc

SEQ ID NO: 30831 - DNA, 25 bp, Homo sapien
acttcgtatccttgcctgaggcagg

SEQ ID NO: 30832 - DNA, 25 bp, Homo sapien
ataagtgcgggccatttgcctcctc

SEQ ID NO: 30833 - DNA, 25 bp, Homo sapien
cccaagggcggtcgcttgcgacagt

SEQ ID NO: 30834 - DNA, 25 bp, Homo sapien
tgcgccgtgctcttcgtcggatatt

SEQ ID NO: 30835 - DNA, 25 bp, Homo sapien
tcttcctctcggtctacttcgtatc

SEQ ID NO: 30836 - DNA, 25 bp, Homo sapien
ctgggccgacaagcaggcgagttcc

SEQ ID NO: 30837 - DNA, 25 bp, Homo sapien
cccgttattgacattcaggctgttg

SEQ ID NO: 30838 - DNA, 25 bp, Homo sapien
ttgacattcaggctgttgctattgt

SEQ ID NO: 30839 - DNA, 25 bp, Homo sapien
ccgttctgggccgacaagcaggcga

SEQ ID NO: 30840 - DNA, 25 bp, Homo sapien
cccattggcctgcatgatgctgccg

SEQ ID NO: 30841 - DNA, 25 bp, Homo sapien
atgctgccgctgaccaggctgtggc

SEQ ID NO: 30842 - DNA, 25 bp, Homo sapien
cagagtttcctcgccgagagaggcc

SEQ ID NO: 30843 - DNA, 25 bp, Homo sapien
cctgcatgatgctgccgctgaccag

SEQ ID NO: 30844 - DNA, 25 bp, Homo sapien
cccgactcctatccgatcctatccc

SEQ ID NO: 30845 - DNA, 25 bp, Homo sapien
cagtaagttcgtagccgccctccga

SEQ ID NO: 30846 - DNA, 25 bp, Homo sapien
agcagtaagttcgtagccgccctcc

SEQ ID NO: 30847 - DNA, 25 bp, Homo sapien
ctcgacgagcagtaagttcgtagcc

SEQ ID NO: 30848 - DNA, 25 bp, Homo sapien
tggctcgacgagcagtaagttcgta

SEQ ID NO: 30849 - DNA, 25 bp, Homo sapien
gctcggctggctcgacgagcagtaa

SEQ ID NO: 30850 - DNA, 25 bp, Homo sapien
atgggatggcagagttggcgtgcgt

SEQ ID NO: 30851 - DNA, 25 bp, Homo sapien
taagttcgtagccgccctccgaagc

SEQ ID NO: 30852 - DNA, 25 bp, Homo sapien
gcacctcgctggacactatccgttt

SEQ ID NO: 30853 - DNA, 25 bp, Homo sapien
ccgctacagttctcgcagtggcaaa

SEQ ID NO: 30854 - DNA, 25 bp, Homo sapien
gcgctcgtctctcctcagcggttta

SEQ ID NO: 30855 - DNA, 25 bp, Homo sapien
gggctcacagcttggcactaatttg

SEQ ID NO: 30856 - DNA, 25 bp, Homo sapien
tcttcttcgatttgcggacggttcc

SEQ ID NO: 30857 - DNA, 25 bp, Homo sapien
gcgactctcgacacacgttttcctg

SEQ ID NO: 30858 - DNA, 25 bp, Homo sapien
gcgcttattcgctgaccctcgagtc

SEQ ID NO: 30859 - DNA, 25 bp, Homo sapien
gtttggcctgaaacccactgctgca

SEQ ID NO: 30860 - DNA, 25 bp, Homo sapien
aagagaagtactgagagagcgcgca

SEQ ID NO: 30861 - DNA, 25 bp, Homo sapien
gaataggggaagagaagtactgaga

SEQ ID NO: 30862 - DNA, 25 bp, Homo sapien
aataggggaagagaagtactgagag

SEQ ID NO: 30863 - DNA, 25 bp, Homo sapien
aggggaagagaagtactgagagagc

SEQ ID NO: 30864 - DNA, 25 bp, Homo sapien
agagcgcgcaggagtgcgtacgccg

SEQ ID NO: 30865 - DNA, 25 bp, Homo sapien
agagaagtactgagagagcgcgcag

SEQ ID NO: 30866 - DNA, 25 bp, Homo sapien
gagagcgcgcaggagtgcgtacgcc

SEQ ID NO: 30867 - DNA, 25 bp, Homo sapien
ataggggaagagaagtactgagaga

SEQ ID NO: 30868 - DNA, 25 bp, Homo sapien
gactgggaagggcaggcatcattaa

SEQ ID NO: 30869 - DNA, 25 bp, Homo sapien
tccatctgccctcttggcgtctgaa

SEQ ID NO: 30870 - DNA, 25 bp, Homo sapien
ttaaggccatggaggaaagtcacga

SEQ ID NO: 30871 - DNA, 25 bp, Homo sapien
agagcgacgacggtgtcctccatct

SEQ ID NO: 30872 - DNA, 25 bp, Homo sapien
tgggaatagaggagcgcaagcttct

SEQ ID NO: 30873 - DNA, 25 bp, Homo sapien
cctgcaggtggcgaacctccgctag

SEQ ID NO: 30874 - DNA, 25 bp, Homo sapien
gcagccgtggatcccagttctttag

SEQ ID NO: 30875 - DNA, 25 bp, Homo sapien
ctcttggcgtctgaagtccgactcc

SEQ ID NO: 30876 - DNA, 25 bp, Homo sapien
tggaatctcgcaagagccagggccc

SEQ ID NO: 30877 - DNA, 25 bp, Homo sapien
agcgtcttcctgtcagcggtcggca

SEQ ID NO: 30878 - DNA, 25 bp, Homo sapien
gtaaggtcgtcagcgtcttcctgtc

SEQ ID NO: 30879 - DNA, 25 bp, Homo sapien
tccaggaagggccacaacggccgtc

SEQ ID NO: 30880 - DNA, 25 bp, Homo sapien
attcaccctagtctggcgctcgccg

SEQ ID NO: 30881 - DNA, 25 bp, Homo sapien
tgtgctgcgcggtccttcccattca

SEQ ID NO: 30882 - DNA, 25 bp, Homo sapien
ccattgtggcctcttcgccagggcg

SEQ ID NO: 30883 - DNA, 25 bp, Homo sapien
gcgtacccgcggtggaatctcgcaa

SEQ ID NO: 30884 - DNA, 25 bp, Homo sapien
cggggacccgtaattgctctggagt

SEQ ID NO: 30885 - DNA, 25 bp, Homo sapien
tccaggggcttgtgccaagtaatta

SEQ ID NO: 30886 - DNA, 25 bp, Homo sapien
taccaagcaaattcccggcgatttc

SEQ ID NO: 30887 - DNA, 25 bp, Homo sapien
agtgcccgctgcgtgttccctgatt

SEQ ID NO: 30888 - DNA, 25 bp, Homo sapien
ttcctgttacatgtcgcagctggga

SEQ ID NO: 30889 - DNA, 25 bp, Homo sapien
cctgcgagtttgcaaggtaagcacg

SEQ ID NO: 30890 - DNA, 25 bp, Homo sapien
tgtgcaatcagctccaggtaacctg

SEQ ID NO: 30891 - DNA, 25 bp, Homo sapien
ccttagccgtgtgggctgtagcaca

SEQ ID NO: 30892 - DNA, 25 bp, Homo sapien
atgagcaaccatcgcatgccgggta

SEQ ID NO: 30893 - DNA, 25 bp, Homo sapien
gcaaccatcgcatgccgggtacagc

SEQ ID NO: 30894 - DNA, 25 bp, Homo sapien
ggttgctcggctccctttcctgaag

SEQ ID NO: 30895 - DNA, 25 bp, Homo sapien
ggagctgatccatgagcaaccatcg

SEQ ID NO: 30896 - DNA, 25 bp, Homo sapien
gtcggggagctgatccatgagcaac

SEQ ID NO: 30897 - DNA, 25 bp, Homo sapien
tcccggaccttgagacagtcgggga

SEQ ID NO: 30898 - DNA, 25 bp, Homo sapien
gaaagtcccggaccttgagacagtc

SEQ ID NO: 30899 - DNA, 25 bp, Homo sapien
gctccctttcctgaagccatgtggc

SEQ ID NO: 30900 - DNA, 25 bp, Homo sapien
ctcgccattttcgttgctgccaggg

SEQ ID NO: 30901 - DNA, 25 bp, Homo sapien
tccacactctgcaggatttggggtg

SEQ ID NO: 30902 - DNA, 25 bp, Homo sapien
tcatctcaggttcgagtctgcgcga

SEQ ID NO: 30903 - DNA, 25 bp, Homo sapien
cttctggagacccaaagggacctga

SEQ ID NO: 30904 - DNA, 25 bp, Homo sapien
cagccctgcaataaactcccggaga

SEQ ID NO: 30905 - DNA, 25 bp, Homo sapien
tcacctgcggggtattaatctctca

SEQ ID NO: 30906 - DNA, 25 bp, Homo sapien
ctctcaggatgaaaggcaaaatttg

SEQ ID NO: 30907 - DNA, 25 bp, Homo sapien
gctttgcaagccgagtctggattcc

SEQ ID NO: 30908 - DNA, 25 bp, Homo sapien
agcgcgacgtttgccaccgccttat

SEQ ID NO: 30909 - DNA, 25 bp, Homo sapien
tgctcatctgtcagacgggcgctcg

SEQ ID NO: 30910 - DNA, 25 bp, Homo sapien
catggagggaaacgtccgcagttta

SEQ ID NO: 30911 - DNA, 25 bp, Homo sapien
cgaccacccgactgggccagaaaag

SEQ ID NO: 30912 - DNA, 25 bp, Homo sapien
tggctcctcgaccttttgaatcatc

SEQ ID NO: 30913 - DNA, 25 bp, Homo sapien
tcccagcgctcgcagcagtgtttgg

SEQ ID NO: 30914 - DNA, 25 bp, Homo sapien
gccagtgacaagcagcgcgaatcta

SEQ ID NO: 30915 - DNA, 25 bp, Homo sapien
acggctcccggagaatagtcgcaca

SEQ ID NO: 30916 - DNA, 25 bp, Homo sapien
ctgccgagcatgaccgccaggggtc

SEQ ID NO: 30917 - DNA, 25 bp, Homo sapien
gcagaacccggctggccttaggcgc

SEQ ID NO: 30918 - DNA, 25 bp, Homo sapien
ctgcggccttgggacgtgccgcctt

SEQ ID NO: 30919 - DNA, 25 bp, Homo sapien
cgcctttccctgctccacactctcc

SEQ ID NO: 30920 - DNA, 25 bp, Homo sapien
atccgagtggttgcctgcaaatccc

SEQ ID NO: 30921 - DNA, 25 bp, Homo sapien
tcgctcgagcgccaccgtccaggcc

SEQ ID NO: 30922 - DNA, 25 bp, Homo sapien
gaggatccgagtggttgcctgcaaa

SEQ ID NO: 30923 - DNA, 25 bp, Homo sapien
ccttaggcgcccagcggacctgcac

SEQ ID NO: 30924 - DNA, 25 bp, Homo sapien
agagaggctctttgttgcctcccta

SEQ ID NO: 30925 - DNA, 25 bp, Homo sapien
cgcccaacacctccggccagttgtc

SEQ ID NO: 30926 - DNA, 25 bp, Homo sapien
ttcctcgcccgtggttgtccttgac

SEQ ID NO: 30927 - DNA, 25 bp, Homo sapien
cgccgagacctcctgggcgccagac

SEQ ID NO: 30928 - DNA, 25 bp, Homo sapien
ggggcatcccggtcagcccaactgc

SEQ ID NO: 30929 - DNA, 25 bp, Homo sapien
cgcccagcgattcctgcggagttga

SEQ ID NO: 30930 - DNA, 25 bp, Homo sapien
ccagcgattcctgcggagttgagga

SEQ ID NO: 30931 - DNA, 25 bp, Homo sapien
aggccgtgtgcaaccggcagctgct

SEQ ID NO: 30932 - DNA, 25 bp, Homo sapien
gctagcgcctcggttacagcctttc

SEQ ID NO: 30933 - DNA, 25 bp, Homo sapien
tccggggatgctgccttctctcggg

SEQ ID NO: 30934 - DNA, 25 bp, Homo sapien
aggcttcattcagtcgcgccggctc

SEQ ID NO: 30935 - DNA, 25 bp, Homo sapien
ctcggttacagcctttcccgcaagg

SEQ ID NO: 30936 - DNA, 25 bp, Homo sapien
gatgctgccttctctcgggccggtg

SEQ ID NO: 30937 - DNA, 25 bp, Homo sapien
gcgagcctcgctagcgcctcggtta

SEQ ID NO: 30938 - DNA, 25 bp, Homo sapien
acacggaggcgagcctcgctagcgc

SEQ ID NO: 30939 - DNA, 25 bp, Homo sapien
ttcccgcaaggcttcattcagtcgc

SEQ ID NO: 30940 - DNA, 25 bp, Homo sapien
tccttcctcgtatatgcagcgacta

SEQ ID NO: 30941 - DNA, 25 bp, Homo sapien
cgcagagccgcttaatctttgttga

SEQ ID NO: 30942 - DNA, 25 bp, Homo sapien
ctttgttgaaggcagctgcggttca

SEQ ID NO: 30943 - DNA, 25 bp, Homo sapien
acttttccactctaggccacgatgc

SEQ ID NO: 30944 - DNA, 25 bp, Homo sapien
cacgatgccgcagtaccagacctgg

SEQ ID NO: 30945 - DNA, 25 bp, Homo sapien
agccgcgctgccgagaagctttacc

SEQ ID NO: 30946 - DNA, 25 bp, Homo sapien
gaagctttacctcgctgaccctatg

SEQ ID NO: 30947 - DNA, 25 bp, Homo sapien
ccctatgaaggtaaatcgctggcgg

SEQ ID NO: 30948 - DNA, 25 bp, Homo sapien
tgctgaaaactagccgaggagagcc

SEQ ID NO: 30949 - DNA, 25 bp, Homo sapien
ggaattccgcgtcccagactgtggg

SEQ ID NO: 30950 - DNA, 25 bp, Homo sapien
ccgcggacttctcgcagggaattcc

SEQ ID NO: 30951 - DNA, 25 bp, Homo sapien
agcctgcaggcgaccgcggacttct

SEQ ID NO: 30952 - DNA, 25 bp, Homo sapien
aggagactgcgcgtgccgcctactg

SEQ ID NO: 30953 - DNA, 25 bp, Homo sapien
gcctgcgagccgagaccgtaagcgc

SEQ ID NO: 30954 - DNA, 25 bp, Homo sapien
ttaggcaggcctagagactttcccg

SEQ ID NO: 30955 - DNA, 25 bp, Homo sapien
agtagcccgttttatccctggcaga

SEQ ID NO: 30956 - DNA, 25 bp, Homo sapien
gcatctgcaaacgttggtccctgta

SEQ ID NO: 30957 - DNA, 25 bp, Homo sapien
ccctggggctagtccattactgctc

SEQ ID NO: 30958 - DNA, 25 bp, Homo sapien
ttacaaagtgaaactccggcgcctc

SEQ ID NO: 30959 - DNA, 25 bp, Homo sapien
ccaatttggagtcttggcccgcggc

SEQ ID NO: 30960 - DNA, 25 bp, Homo sapien
ggcgcaagcctgtacgcagctgact

SEQ ID NO: 30961 - DNA, 25 bp, Homo sapien
tccaggctccaagaagggatccgcc

SEQ ID NO: 30962 - DNA, 25 bp, Homo sapien
ggagctcagcaggattcagcccgca

SEQ ID NO: 30963 - DNA, 25 bp, Homo sapien
gtccctgtagtgctttgaatttccc

SEQ ID NO: 30964 - DNA, 25 bp, Homo sapien
cctgcgaggcaaagcggaccagctt

SEQ ID NO: 30965 - DNA, 25 bp, Homo sapien
tcggtcacgtcgaaggccttccagc

SEQ ID NO: 30966 - DNA, 25 bp, Homo sapien
gcctgcaccagctcgctgttgggcg

SEQ ID NO: 30967 - DNA, 25 bp, Homo sapien
agccgctctcgtggacggacaccag

SEQ ID NO: 30968 - DNA, 25 bp, Homo sapien
tgccagaagttcacggcctcggtca

SEQ ID NO: 30969 - DNA, 25 bp, Homo sapien
gaaggccttccagccgctctcgtgg

SEQ ID NO: 30970 - DNA, 25 bp, Homo sapien
gctgctgccagaagttcacggcctc

SEQ ID NO: 30971 - DNA, 25 bp, Homo sapien
tgcaccgacacctgtagcagcagcg

SEQ ID NO: 30972 - DNA, 25 bp, Homo sapien
cacgcctctaccttgggcgggtttg

SEQ ID NO: 30973 - DNA, 25 bp, Homo sapien
tttgggaggagcaaaagagcctctc

SEQ ID NO: 30974 - DNA, 25 bp, Homo sapien
gccgggtcatcagaagcacagtgga

SEQ ID NO: 30975 - DNA, 25 bp, Homo sapien
cgcgggtcatcagtgtcagcgttga

SEQ ID NO: 30976 - DNA, 25 bp, Homo sapien
ttaccgcggaagcagcagaagccgg

SEQ ID NO: 30977 - DNA, 25 bp, Homo sapien
cgccgagtgtcattaccgcggaagc

SEQ ID NO: 30978 - DNA, 25 bp, Homo sapien
tcctccagtgaaagtaccagaagag

SEQ ID NO: 30979 - DNA, 25 bp, Homo sapien
agctgctcggctgagctgcggacca

SEQ ID NO: 30980 - DNA, 25 bp, Homo sapien
cagccgcggcttattcacttgaact

SEQ ID NO: 30981 - DNA, 25 bp, Homo sapien
cttgagtgtttctcgcgaatttgtc

SEQ ID NO: 30982 - DNA, 25 bp, Homo sapien
gccctcctggcgtaggttcagacca

SEQ ID NO: 30983 - DNA, 25 bp, Homo sapien
attctccaggttgccgatttgcggg

SEQ ID NO: 30984 - DNA, 25 bp, Homo sapien
tcaaggcccacaggaattctccagg

SEQ ID NO: 30985 - DNA, 25 bp, Homo sapien
cagcttctgggatggtgcaacccta

SEQ ID NO: 30986 - DNA, 25 bp, Homo sapien
ttcattcgctcatgctggtgggacg

SEQ ID NO: 30987 - DNA, 25 bp, Homo sapien
accggcgagctaacagcagcttctg

SEQ ID NO: 30988 - DNA, 25 bp, Homo sapien
tgatacacacgacacggagacccag

SEQ ID NO: 30989 - DNA, 25 bp, Homo sapien
ggccgagcagcctcctactcctgcc

SEQ ID NO: 30990 - DNA, 25 bp, Homo sapien
atacacacgacacggagacccagcg

SEQ ID NO: 30991 - DNA, 25 bp, Homo sapien
catgatacacacgacacggagaccc

SEQ ID NO: 30992 - DNA, 25 bp, Homo sapien
agacatgatacacacgacacggaga

SEQ ID NO: 30993 - DNA, 25 bp, Homo sapien
tgagacatgatacacacgacacgga

SEQ ID NO: 30994 - DNA, 25 bp, Homo sapien
cctgagacatgatacacacgacacg

SEQ ID NO: 30995 - DNA, 25 bp, Homo sapien
cagcctgagacatgatacacacgac

SEQ ID NO: 30996 - DNA, 25 bp, Homo sapien
cttggtgcgaacaagaccgggcgtt

SEQ ID NO: 30997 - DNA, 25 bp, Homo sapien
tgggccctaagctggaacgagaaag

SEQ ID NO: 30998 - DNA, 25 bp, Homo sapien
ttcgctgcaagcgagaggcggactc

SEQ ID NO: 30999 - DNA, 25 bp, Homo sapien
cgcggcggttttccgaagctccgct

SEQ ID NO: 31000 - DNA, 25 bp, Homo sapien
gcgcggccctggaaacttccgagag

SEQ ID NO: 31001 - DNA, 25 bp, Homo sapien
tccgctcaggaccagaagtggtgcc

SEQ ID NO: 31002 - DNA, 25 bp, Homo sapien
tcccgagtttgtgccggacgctcct

SEQ ID NO: 31003 - DNA, 25 bp, Homo sapien
ccagggaaaagcagctcccgagttt

SEQ ID NO: 31004 - DNA, 25 bp, Homo sapien
ccgaatctgggttcgaatctgagca

SEQ ID NO: 31005 - DNA, 25 bp, Homo sapien
gctgctgcgtttcacctcctttaac

SEQ ID NO: 31006 - DNA, 25 bp, Homo sapien
gagccgccacaggtcttattacaca

SEQ ID NO: 31007 - DNA, 25 bp, Homo sapien
caggctgactctgcggcagctccaa

SEQ ID NO: 31008 - DNA, 25 bp, Homo sapien
tcgattcccagatactcagatgaga

SEQ ID NO: 31009 - DNA, 25 bp, Homo sapien
aaatccgcactcaggccgtcaggct

SEQ ID NO: 31010 - DNA, 25 bp, Homo sapien
gaccagccgaggacgcctggtgttt

SEQ ID NO: 31011 - DNA, 25 bp, Homo sapien
cgcctctgctaggacaccggggtct

SEQ ID NO: 31012 - DNA, 25 bp, Homo sapien
tcagattgagtgctctgtgcgcatg

SEQ ID NO: 31013 - DNA, 25 bp, Homo sapien
ggccagttccgagctgcgctgaaaa

SEQ ID NO: 31014 - DNA, 25 bp, Homo sapien
gcgccgaacacggaatgttttctta

SEQ ID NO: 31015 - DNA, 25 bp, Homo sapien
gccaaaagtaagtctcccgcgctcg

SEQ ID NO: 31016 - DNA, 25 bp, Homo sapien
cgagtggctctcagtcctggtcaaa

SEQ ID NO: 31017 - DNA, 25 bp, Homo sapien
ctggtcaaatcatattccgggcttt

SEQ ID NO: 31018 - DNA, 25 bp, Homo sapien
tccgggcttttgaaatagtgggcgc

SEQ ID NO: 31019 - DNA, 25 bp, Homo sapien
gcgagccgacaccatgcgatccaag

SEQ ID NO: 31020 - DNA, 25 bp, Homo sapien
accggctataaaaggctggcgctgg

SEQ ID NO: 31021 - DNA, 25 bp, Homo sapien
cgctgggttaggtttcgagcttcct

SEQ ID NO: 31022 - DNA, 25 bp, Homo sapien
cagtgccggtggataaaatcccgga

SEQ ID NO: 31023 - DNA, 25 bp, Homo sapien
ttcctaacaggaaccgaaatcctca

SEQ ID NO: 31024 - DNA, 25 bp, Homo sapien
tcaagcctctctgagacaccaggcg

SEQ ID NO: 31025 - DNA, 25 bp, Homo sapien
gcctcttgatgacgcgagcatcttc

SEQ ID NO: 31026 - DNA, 25 bp, Homo sapien
tcgagggaccggctataaaaggctg

SEQ ID NO: 31027 - DNA, 25 bp, Homo sapien
atcctcacctgatcttggcagtgcc

SEQ ID NO: 31028 - DNA, 25 bp, Homo sapien
ctttttggcccagaaatggaggtga

SEQ ID NO: 31029 - DNA, 25 bp, Homo sapien
gcttcgcaccctggggtaactcgct

SEQ ID NO: 31030 - DNA, 25 bp, Homo sapien
cctcagcgtgtcttttgtgtttgta

SEQ ID NO: 31031 - DNA, 25 bp, Homo sapien
ccgagccttccctccattgtgtgtg

SEQ ID NO: 31032 - DNA, 25 bp, Homo sapien
ctttcaattgtgttcgcagccgccg

SEQ ID NO: 31033 - DNA, 25 bp, Homo sapien
tgaggagcgagtttccctgttccct

SEQ ID NO: 31034 - DNA, 25 bp, Homo sapien
tggctcctctttcttcggtgaaatc

SEQ ID NO: 31035 - DNA, 25 bp, Homo sapien
ctcggtgtcagccatctttcaattg

SEQ ID NO: 31036 - DNA, 25 bp, Homo sapien
ctgatcctttcagacgcctcgcgtt

SEQ ID NO: 31037 - DNA, 25 bp, Homo sapien
ctagcctcggtcgttgtcacgtgac

SEQ ID NO: 31038 - DNA, 25 bp, Homo sapien
ggccctgaaggtgccgcatatcctg

SEQ ID NO: 31039 - DNA, 25 bp, Homo sapien
agcgtggcactttggaaaacaaatc

SEQ ID NO: 31040 - DNA, 25 bp, Homo sapien
tactatgaactgagagcccgcgagc

SEQ ID NO: 31041 - DNA, 25 bp, Homo sapien
cccaggtgccagagagaactttccc

SEQ ID NO: 31042 - DNA, 25 bp, Homo sapien
tcgtctcttagtggaggaagtagcc

SEQ ID NO: 31043 - DNA, 25 bp, Homo sapien
acaaatcgggttagtgctcagcagc

SEQ ID NO: 31044 - DNA, 25 bp, Homo sapien
tccaggaagtttgtgcctattaata

SEQ ID NO: 31045 - DNA, 25 bp, Homo sapien
agaggcaagccgacctgcttccgga

SEQ ID NO: 31046 - DNA, 25 bp, Homo sapien
ttgtgttgaggacgcaaatctttcc

SEQ ID NO: 31047 - DNA, 25 bp, Homo sapien
gggaatcccgggagatgcgaatatc

SEQ ID NO: 31048 - DNA, 25 bp, Homo sapien
cgcatttctaaacgccaggtggaga

SEQ ID NO: 31049 - DNA, 25 bp, Homo sapien
tgaggttcctaaatgacagatgtcc

SEQ ID NO: 31050 - DNA, 25 bp, Homo sapien
cgcgcccaagccctgcttaaaaaag

SEQ ID NO: 31051 - DNA, 25 bp, Homo sapien
tcccgcgggacgttccaagagcagt

SEQ ID NO: 31052 - DNA, 25 bp, Homo sapien
cctgcactttgggacgacctggcct

SEQ ID NO: 31053 - DNA, 25 bp, Homo sapien
ctaggggccgaagcactgcacgcac

SEQ ID NO: 31054 - DNA, 25 bp, Homo sapien
tggccgcgcttccttcgctacaaaa

SEQ ID NO: 31055 - DNA, 25 bp, Homo sapien
gcacatcttggaaacaccgaacttc

SEQ ID NO: 31056 - DNA, 25 bp, Homo sapien
acaccgaacttctgtgacaccagta

SEQ ID NO: 31057 - DNA, 25 bp, Homo sapien
ccagtagttacacctggcctctgaa

SEQ ID NO: 31058 - DNA, 25 bp, Homo sapien
cgctacaaaaaggaagcacatcttg

SEQ ID NO: 31059 - DNA, 25 bp, Homo sapien
gtcgccgttgtttaagagccaggtc

SEQ ID NO: 31060 - DNA, 25 bp, Homo sapien
acggcagccacgtatcgacttcctg

SEQ ID NO: 31061 - DNA, 25 bp, Homo sapien
cggaatcgtcagttgccctggctca

SEQ ID NO: 31062 - DNA, 25 bp, Homo sapien
gtatcgacttcctgctgacctctga

SEQ ID NO: 31063 - DNA, 25 bp, Homo sapien
ggctcacctttgaagaagcgcagtg

SEQ ID NO: 31064 - DNA, 25 bp, Homo sapien
acctcgagtcgctctgcgttcagca

SEQ ID NO: 31065 - DNA, 25 bp, Homo sapien
aggccgtcgacggacacctcgagtc

SEQ ID NO: 31066 - DNA, 25 bp, Homo sapien
tttcggatcccagttgctccaggtg

SEQ ID NO: 31067 - DNA, 25 bp, Homo sapien
cggaacttccgctgctgaggaggct

SEQ ID NO: 31068 - DNA, 25 bp, Homo sapien
ctgcggactctaggtctggactgcg

SEQ ID NO: 31069 - DNA, 25 bp, Homo sapien
tcctgaggccacacccgggacgttg

SEQ ID NO: 31070 - DNA, 25 bp, Homo sapien
agtcccgtgcgctccagtttgccga

SEQ ID NO: 31071 - DNA, 25 bp, Homo sapien
ttgacccggagaagagagttctgtc

SEQ ID NO: 31072 - DNA, 25 bp, Homo sapien
ccaggcaaatagtccttcggggatg

SEQ ID NO: 31073 - DNA, 25 bp, Homo sapien
gcagccggcggaagcgattattccc

SEQ ID NO: 31074 - DNA, 25 bp, Homo sapien
cgcacccggaggagacacgggtctc

SEQ ID NO: 31075 - DNA, 25 bp, Homo sapien
agcgcacgtctttcagcgccgaaca

SEQ ID NO: 31076 - DNA, 25 bp, Homo sapien
ggccaccttcgagttgcccagtgct

SEQ ID NO: 31077 - DNA, 25 bp, Homo sapien
ttacccgcagaagtcggcggtggcc

SEQ ID NO: 31078 - DNA, 25 bp, Homo sapien
gacagaaacactcggggccaggagc

SEQ ID NO: 31079 - DNA, 25 bp, Homo sapien
agccgccgcactccctaaatgaatg

SEQ ID NO: 31080 - DNA, 25 bp, Homo sapien
tgaactggctgctccaaaaccgcgg

SEQ ID NO: 31081 - DNA, 25 bp, Homo sapien
accgcggcgcaattggcagttattg

SEQ ID NO: 31082 - DNA, 25 bp, Homo sapien
ggcagttattgctggcagtttatca

SEQ ID NO: 31083 - DNA, 25 bp, Homo sapien
gtattaactgattaggcccgggatg

SEQ ID NO: 31084 - DNA, 25 bp, Homo sapien
aactgcaggctgtttgttccgagtg

SEQ ID NO: 31085 - DNA, 25 bp, Homo sapien
cagttcccgaaacccacgttgcttg

SEQ ID NO: 31086 - DNA, 25 bp, Homo sapien
gctactcactctcgtcaggcaactg

SEQ ID NO: 31087 - DNA, 25 bp, Homo sapien
gcaactggtcgagctccgccatctt

SEQ ID NO: 31088 - DNA, 25 bp, Homo sapien
gcgccgctttttcaaaggctgcccg

SEQ ID NO: 31089 - DNA, 25 bp, Homo sapien
aagaagccctcggttctgggtcgca

SEQ ID NO: 31090 - DNA, 25 bp, Homo sapien
actgtctttgcgagggaggttcgaa

SEQ ID NO: 31091 - DNA, 25 bp, Homo sapien
gggctctacgcaaagtgaaatactc

SEQ ID NO: 31092 - DNA, 25 bp, Homo sapien
gctcttggcgtactcgactcgatag

SEQ ID NO: 31093 - DNA, 25 bp, Homo sapien
gaagcccgacgccacgacctagaaa

SEQ ID NO: 31094 - DNA, 25 bp, Homo sapien
tagctgccgccaaagctccggaagc

SEQ ID NO: 31095 - DNA, 25 bp, Homo sapien
ccatccggagcgagtccttggggat

SEQ ID NO: 31096 - DNA, 25 bp, Homo sapien
tgcatttcttgcaagaggcgcgccc

SEQ ID NO: 31097 - DNA, 25 bp, Homo sapien
accgccgttccctgatagattgctg

SEQ ID NO: 31098 - DNA, 25 bp, Homo sapien
gagcttatccgaagactccgccatc

SEQ ID NO: 31099 - DNA, 25 bp, Homo sapien
ttggggatgctctcgctgcatttct

SEQ ID NO: 31100 - DNA, 25 bp, Homo sapien
acgagccgggctagatatacctgca

SEQ ID NO: 31101 - DNA, 25 bp, Homo sapien
cctcaacactttcgtgccgggactg

SEQ ID NO: 31102 - DNA, 25 bp, Homo sapien
gagccctcgcacaaagacgccgaga

SEQ ID NO: 31103 - DNA, 25 bp, Homo sapien
tgctccttctctccgtcgtgtgcat

SEQ ID NO: 31104 - DNA, 25 bp, Homo sapien
tcagaatgagctctagggcctcggc

SEQ ID NO: 31105 - DNA, 25 bp, Homo sapien
gcctcggcggcgaggatcaaactcc

SEQ ID NO: 31106 - DNA, 25 bp, Homo sapien
aaactcccgggcgtcgaagtcagct

SEQ ID NO: 31107 - DNA, 25 bp, Homo sapien
aactttgcggccaatgttggagccc

SEQ ID NO: 31108 - DNA, 25 bp, Homo sapien
agtcgcggccaactaccgcggagca

SEQ ID NO: 31109 - DNA, 25 bp, Homo sapien
gtagacccgcctgcccagtctgatc

SEQ ID NO: 31110 - DNA, 25 bp, Homo sapien
tctggctttccagggtagacccgcc

SEQ ID NO: 31111 - DNA, 25 bp, Homo sapien
tcagaatcgagccaccgagggctgc

SEQ ID NO: 31112 - DNA, 25 bp, Homo sapien
cggccgcgggctcagaatcgagcca

SEQ ID NO: 31113 - DNA, 25 bp, Homo sapien
gaccaggagcagctccggcgacttc

SEQ ID NO: 31114 - DNA, 25 bp, Homo sapien
cgtgtaacgagtcttggaagctgca

SEQ ID NO: 31115 - DNA, 25 bp, Homo sapien
cgcttgcctgggttccctgcgacat

SEQ ID NO: 31116 - DNA, 25 bp, Homo sapien
cctcgatcatcttctggtacatgtc

SEQ ID NO: 31117 - DNA, 25 bp, Homo sapien
tcaccttgattccctcgatcctgaa

SEQ ID NO: 31118 - DNA, 25 bp, Homo sapien
tcggggtccacctcgatcatcttct

SEQ ID NO: 31119 - DNA, 25 bp, Homo sapien
atgtccttccgcaggctgggcttct

SEQ ID NO: 31120 - DNA, 25 bp, Homo sapien
tcatcttctggtacatgtccttccg

SEQ ID NO: 31121 - DNA, 25 bp, Homo sapien
tggcttggtcacagcccgctgtgct

SEQ ID NO: 31122 - DNA, 25 bp, Homo sapien
ccgctgtgctttttcctcctcggtg

SEQ ID NO: 31123 - DNA, 25 bp, Homo sapien
actgcatgtaccgtggcttggtcac

SEQ ID NO: 31124 - DNA, 25 bp, Homo sapien
gcgccggagtccctccgccctcagc

SEQ ID NO: 31125 - DNA, 25 bp, Homo sapien
ggatttcgggcagggcggtgaagca

SEQ ID NO: 31126 - DNA, 25 bp, Homo sapien
cccaccgcccgacgctggctggccg

SEQ ID NO: 31127 - DNA, 25 bp, Homo sapien
gccgtctcccggcatgctcggcggc

SEQ ID NO: 31128 - DNA, 25 bp, Homo sapien
tctacagggggcttttcttcgccgc

SEQ ID NO: 31129 - DNA, 25 bp, Homo sapien
agggcctgctctacagggggctttt

SEQ ID NO: 31130 - DNA, 25 bp, Homo sapien
ggcggtgccggtcacgtgacgggaa

SEQ ID NO: 31131 - DNA, 25 bp, Homo sapien
tcgccttcgccagcgctagcgggcc

SEQ ID NO: 31132 - DNA, 25 bp, Homo sapien
gggccgcagccgaagcatttttcag

SEQ ID NO: 31133 - DNA, 25 bp, Homo sapien
cttggctcctaagtatgctgtgtgc

SEQ ID NO: 31134 - DNA, 25 bp, Homo sapien
gcgatgcgctttatgaggtcccttc

SEQ ID NO: 31135 - DNA, 25 bp, Homo sapien
accggacatctcacctatggggacg

SEQ ID NO: 31136 - DNA, 25 bp, Homo sapien
gagcgcatagcagtacacagccata

SEQ ID NO: 31137 - DNA, 25 bp, Homo sapien
ggcgctattcatgatcaccaggcta

SEQ ID NO: 31138 - DNA, 25 bp, Homo sapien
gctcttcatctcgttggcgctattc

SEQ ID NO: 31139 - DNA, 25 bp, Homo sapien
ttcagggctagccttgtcgcctatc

SEQ ID NO: 31140 - DNA, 25 bp, Homo sapien
tgcatttaaaggagcggtgcacgtg

SEQ ID NO: 31141 - DNA, 25 bp, Homo sapien
ctgccaggcccgcaggaagatgaca

SEQ ID NO: 31142 - DNA, 25 bp, Homo sapien
attcggcctctagcaccgggtcctg

SEQ ID NO: 31143 - DNA, 25 bp, Homo sapien
ccactccttctaaggtcgtcgctta

SEQ ID NO: 31144 - DNA, 25 bp, Homo sapien
tcgcttagttccgacgtcgggatga

SEQ ID NO: 31145 - DNA, 25 bp, Homo sapien
gagacctccgttgcgccgagtccat

SEQ ID NO: 31146 - DNA, 25 bp, Homo sapien
tcagccagctgcgtaaactccgctg

SEQ ID NO: 31147 - DNA, 25 bp, Homo sapien
gaccctgtcatccacgcggcgtgaa

SEQ ID NO: 31148 - DNA, 25 bp, Homo sapien
cctcggagtgctttttgtggaccct

SEQ ID NO: 31149 - DNA, 25 bp, Homo sapien
atgcgcgcaggccagcaactccaaa

SEQ ID NO: 31150 - DNA, 25 bp, Homo sapien
ctccggtgagggtactatctctcta

SEQ ID NO: 31151 - DNA, 25 bp, Homo sapien
cctgttttgaggatggcgccacaca

SEQ ID NO: 31152 - DNA, 25 bp, Homo sapien
aggcatcgcccggtccttaaagcgg

SEQ ID NO: 31153 - DNA, 25 bp, Homo sapien
gcaccagtctggaggcaacaagcac

SEQ ID NO: 31154 - DNA, 25 bp, Homo sapien
aaaaggctcccgttctcaaggcgca

SEQ ID NO: 31155 - DNA, 25 bp, Homo sapien
ctgcatcgcagtgaaaaaggctccc

SEQ ID NO: 31156 - DNA, 25 bp, Homo sapien
tgcttctctgaattcaaaggacaca

SEQ ID NO: 31157 - DNA, 25 bp, Homo sapien
cgaggcttctggtgcagatcgcgaa

SEQ ID NO: 31158 - DNA, 25 bp, Homo sapien
agcccactccatgtcggtggtcgct

SEQ ID NO: 31159 - DNA, 25 bp, Homo sapien
taagggcatctttccacagcgagga

SEQ ID NO: 31160 - DNA, 25 bp, Homo sapien
tgggctcagcgaggctcctccagtc

SEQ ID NO: 31161 - DNA, 25 bp, Homo sapien
cttgcggacgagtctggatccaata

SEQ ID NO: 31162 - DNA, 25 bp, Homo sapien
tctggatccaatatggcggcctggc

SEQ ID NO: 31163 - DNA, 25 bp, Homo sapien
gaagcggctacttggccgcccgagc

SEQ ID NO: 31164 - DNA, 25 bp, Homo sapien
cccgcaggctaattaggtcgtgttt

SEQ ID NO: 31165 - DNA, 25 bp, Homo sapien
ccatctgtctagattgcggcaaaga

SEQ ID NO: 31166 - DNA, 25 bp, Homo sapien
cgcccgctccagacggtacggaatt

SEQ ID NO: 31167 - DNA, 25 bp, Homo sapien
gtttattttagagccggcgactcgc

SEQ ID NO: 31168 - DNA, 25 bp, Homo sapien
gttaacttggcaccaccggcgcttc

SEQ ID NO: 31169 - DNA, 25 bp, Homo sapien
ggccgaactgcaaggcgagtctcaa

SEQ ID NO: 31170 - DNA, 25 bp, Homo sapien
cttcaaagcggtgcagctgtggcta

SEQ ID NO: 31171 - DNA, 25 bp, Homo sapien
accctccgtctgatgggtgacttga

SEQ ID NO: 31172 - DNA, 25 bp, Homo sapien
tgcgagagacacgaggggccaaaca

SEQ ID NO: 31173 - DNA, 25 bp, Homo sapien
tccggcctgaagatcctcccgaatg

SEQ ID NO: 31174 - DNA, 25 bp, Homo sapien
atcctcccgaatggcgctgagcaca

SEQ ID NO: 31175 - DNA, 25 bp, Homo sapien
cgctgagcacacagagccgatggtg

SEQ ID NO: 31176 - DNA, 25 bp, Homo sapien
catcagcgaggagagggccgccatt

SEQ ID NO: 31177 - DNA, 25 bp, Homo sapien
tccctcatggccactgctggactag

SEQ ID NO: 31178 - DNA, 25 bp, Homo sapien
ccagtgctccgccaacgctaaaata

SEQ ID NO: 31179 - DNA, 25 bp, Homo sapien
tccacatccacaagcacagggcggg

SEQ ID NO: 31180 - DNA, 25 bp, Homo sapien
ttattttagcgttggcggagcactg

SEQ ID NO: 31181 - DNA, 25 bp, Homo sapien
gctcagcgccattcgggaggatctt

SEQ ID NO: 31182 - DNA, 25 bp, Homo sapien
atcggctctgtgtgctcagcgccat

SEQ ID NO: 31183 - DNA, 25 bp, Homo sapien
gggcaccatcggctctgtgtgctca

SEQ ID NO: 31184 - DNA, 25 bp, Homo sapien
cccgccctgtgcttgtggatgtgga

SEQ ID NO: 31185 - DNA, 25 bp, Homo sapien
ggaggatcttcaggccggacgactt

SEQ ID NO: 31186 - DNA, 25 bp, Homo sapien
gaatggcggccctctcctcgctgat

SEQ ID NO: 31187 - DNA, 25 bp, Homo sapien
cgccctagtccagcagtggccatga

SEQ ID NO: 31188 - DNA, 25 bp, Homo sapien
cgcgacttcccgctctagagagttt

SEQ ID NO: 31189 - DNA, 25 bp, Homo sapien
cgcgcactgtgcaacagaggcctgc

SEQ ID NO: 31190 - DNA, 25 bp, Homo sapien
tcgacctcgcggtgcactcagcagg

SEQ ID NO: 31191 - DNA, 25 bp, Homo sapien
cacccagtgggctcggatctcgagc

SEQ ID NO: 31192 - DNA, 25 bp, Homo sapien
ccagagggcggagaagtccaaagca

SEQ ID NO: 31193 - DNA, 25 bp, Homo sapien
gagaagtccaaagcagcagcccgga

SEQ ID NO: 31194 - DNA, 25 bp, Homo sapien
gagcacgccaaatgccggacggagc

SEQ ID NO: 31195 - DNA, 25 bp, Homo sapien
tgggcagctagctcaccgaagaccc

SEQ ID NO: 31196 - DNA, 25 bp, Homo sapien
ggggtccacgattgtagcaccacca

SEQ ID NO: 31197 - DNA, 25 bp, Homo sapien
gcgctgcctccaccgtccaagctgg

SEQ ID NO: 31198 - DNA, 25 bp, Homo sapien
cggaacctccaggtaattcaattca

SEQ ID NO: 31199 - DNA, 25 bp, Homo sapien
ggttccctgcagtcctgagaggttt

SEQ ID NO: 31200 - DNA, 25 bp, Homo sapien
cctgacctcaaagacgcaggggcgg

SEQ ID NO: 31201 - DNA, 25 bp, Homo sapien
ccagggcctgacctcaaagacgcag

SEQ ID NO: 31202 - DNA, 25 bp, Homo sapien
accaggtagcggcatcccacctctt

SEQ ID NO: 31203 - DNA, 25 bp, Homo sapien
acgattgtagcaccaccaggtagcg

SEQ ID NO: 31204 - DNA, 25 bp, Homo sapien
ccggggaaatctgagcagccacagg

SEQ ID NO: 31205 - DNA, 25 bp, Homo sapien
cgaccctgagcccacatgagtagca

SEQ ID NO: 31206 - DNA, 25 bp, Homo sapien
ccgggcaactgctcctggatttctg

SEQ ID NO: 31207 - DNA, 25 bp, Homo sapien
cctggatttctgttccgaggaacat

SEQ ID NO: 31208 - DNA, 25 bp, Homo sapien
ccgaggaacatgttgggcggtttct

SEQ ID NO: 31209 - DNA, 25 bp, Homo sapien
agccacaggcgaatctgggacgatg

SEQ ID NO: 31210 - DNA, 25 bp, Homo sapien
ctgggacgatggcagattgttaata

SEQ ID NO: 31211 - DNA, 25 bp, Homo sapien
agagactcggcgtctccgaccctga

SEQ ID NO: 31212 - DNA, 25 bp, Homo sapien
aatccctcagcgctaaggcggacga

SEQ ID NO: 31213 - DNA, 25 bp, Homo sapien
ctcgggaaaggcaacggtggtgaag

SEQ ID NO: 31214 - DNA, 25 bp, Homo sapien
gcaacggtggtgaaggctttgtgag

SEQ ID NO: 31215 - DNA, 25 bp, Homo sapien
cctcagcgctaaggcggacgaccag

SEQ ID NO: 31216 - DNA, 25 bp, Homo sapien
gctgggtcggcttatcgcccttggg

SEQ ID NO: 31217 - DNA, 25 bp, Homo sapien
caaaacaatccctcagcgctaaggc

SEQ ID NO: 31218 - DNA, 25 bp, Homo sapien
aacaatccctcagcgctaaggcgga

SEQ ID NO: 31219 - DNA, 25 bp, Homo sapien
ggaccccttgttgcccacaggcagg

SEQ ID NO: 31220 - DNA, 25 bp, Homo sapien
acctcgagagcccgaagcctgtgca

SEQ ID NO: 31221 - DNA, 25 bp, Homo sapien
agggaggccacctcgagagcccgaa

SEQ ID NO: 31222 - DNA, 25 bp, Homo sapien
ggtacttgatccgagccccgtggac

SEQ ID NO: 31223 - DNA, 25 bp, Homo sapien
gctcaggggtacttgatccgagccc

SEQ ID NO: 31224 - DNA, 25 bp, Homo sapien
gccaccagctactgcgggaggctct

SEQ ID NO: 31225 - DNA, 25 bp, Homo sapien
agcagctcaggggtacttgatccga

SEQ ID NO: 31226 - DNA, 25 bp, Homo sapien
gatgcctggagtcgggcgcgcaaga

SEQ ID NO: 31227 - DNA, 25 bp, Homo sapien
tggccaccagctactgcgggaggct

SEQ ID NO: 31228 - DNA, 25 bp, Homo sapien
cactctggtgccttcacgcagggga

SEQ ID NO: 31229 - DNA, 25 bp, Homo sapien
caggcacgcatctctgagtggggcc

SEQ ID NO: 31230 - DNA, 25 bp, Homo sapien
gcacgggctgtctgattctccttcg

SEQ ID NO: 31231 - DNA, 25 bp, Homo sapien
gcctccgatgggagcaggcacgcat

SEQ ID NO: 31232 - DNA, 25 bp, Homo sapien
cccgattcccgacaggagaggcgag

SEQ ID NO: 31233 - DNA, 25 bp, Homo sapien
gatggccggatttgaaggtaatacc

SEQ ID NO: 31234 - DNA, 25 bp, Homo sapien
ttctccttcgctgtggcgggaagat

SEQ ID NO: 31235 - DNA, 25 bp, Homo sapien
aggatccacgagctgcggctctcta

SEQ ID NO: 31236 - DNA, 25 bp, Homo sapien
caccgtaggtccgtagcaggtggtc

SEQ ID NO: 31237 - DNA, 25 bp, Homo sapien
cgctggaaaacacgcagggcaggtt

SEQ ID NO: 31238 - DNA, 25 bp, Homo sapien
cccgcacaaagtcggcgtaggagaa

SEQ ID NO: 31239 - DNA, 25 bp, Homo sapien
cggctccgagacgaaggctacccgg

SEQ ID NO: 31240 - DNA, 25 bp, Homo sapien
tcagcacgggtcgaaggaccctcct

SEQ ID NO: 31241 - DNA, 25 bp, Homo sapien
ggaccagcctcggaaccagaagacg

SEQ ID NO: 31242 - DNA, 25 bp, Homo sapien
tctgggactcgtctggcgtccctca

SEQ ID NO: 31243 - DNA, 25 bp, Homo sapien
cgtccctcaggtgagcgacggtgtt

SEQ ID NO: 31244 - DNA, 25 bp, Homo sapien
gcggccctgagatagtgccacactc

SEQ ID NO: 31245 - DNA, 25 bp, Homo sapien
agcccgagaggggacgtcatagttt

SEQ ID NO: 31246 - DNA, 25 bp, Homo sapien
ggacgtcatagtttgcccactggtc

SEQ ID NO: 31247 - DNA, 25 bp, Homo sapien
tttgcccactggtcacgaatacgga

SEQ ID NO: 31248 - DNA, 25 bp, Homo sapien
actggtcacgaatacggaacgcttg

SEQ ID NO: 31249 - DNA, 25 bp, Homo sapien
atacggaacgcttgatgggcacctc

SEQ ID NO: 31250 - DNA, 25 bp, Homo sapien
cggaacgcttgatgggcacctcagt

SEQ ID NO: 31251 - DNA, 25 bp, Homo sapien
ggcttgctccgcacactcagggttc

SEQ ID NO: 31252 - DNA, 25 bp, Homo sapien
gcacggaaatgtttgctccttttgc

SEQ ID NO: 31253 - DNA, 25 bp, Homo sapien
agggctcctgaagcacgtctccttg

SEQ ID NO: 31254 - DNA, 25 bp, Homo sapien
agcacgtctccttggcagggtgccc

SEQ ID NO: 31255 - DNA, 25 bp, Homo sapien
cactaccacacgctgcacggaaatg

SEQ ID NO: 31256 - DNA, 25 bp, Homo sapien
tgctccttttgcaagcgggccttcc

SEQ ID NO: 31257 - DNA, 25 bp, Homo sapien
ctgctggacgcccacatcctggagt

SEQ ID NO: 31258 - DNA, 25 bp, Homo sapien
ccacatcctggagtggcacgattcg

SEQ ID NO: 31259 - DNA, 25 bp, Homo sapien
atgccctggacgactacgagcacca

SEQ ID NO: 31260 - DNA, 25 bp, Homo sapien
atggtgcaatctggccgcgccgcac

SEQ ID NO: 31261 - DNA, 25 bp, Homo sapien
cacaggcagatggtgcaatctggcc

SEQ ID NO: 31262 - DNA, 25 bp, Homo sapien
gctccacttccgcacaggcagatgg

SEQ ID NO: 31263 - DNA, 25 bp, Homo sapien
cgaacacaacacctgcgctccactt

SEQ ID NO: 31264 - DNA, 25 bp, Homo sapien
tggctcagccgtcagcaattacctg

SEQ ID NO: 31265 - DNA, 25 bp, Homo sapien
ctggagaccgtaagccaggagagct

SEQ ID NO: 31266 - DNA, 25 bp, Homo sapien
ccgtgacagcgctcgcgccaggtgt

SEQ ID NO: 31267 - DNA, 25 bp, Homo sapien
ccgctggagaccgtaagccaggaga

SEQ ID NO: 31268 - DNA, 25 bp, Homo sapien
gacctagatttggaagcgatccctc

SEQ ID NO: 31269 - DNA, 25 bp, Homo sapien
tccgtgatttcaaaggagacgcttc

SEQ ID NO: 31270 - DNA, 25 bp, Homo sapien
gcctgtcggcatagactttccgtga

SEQ ID NO: 31271 - DNA, 25 bp, Homo sapien
gcgatccctccagagcttacatttg

SEQ ID NO: 31272 - DNA, 25 bp, Homo sapien
ttacatttggagaccggtagagacc

SEQ ID NO: 31273 - DNA, 25 bp, Homo sapien
ttgggacaacagctccgagggctac

SEQ ID NO: 31274 - DNA, 25 bp, Homo sapien
tacgctgcgtggactaggttccaga

SEQ ID NO: 31275 - DNA, 25 bp, Homo sapien
cccagtgaacctatggctcagcatt

SEQ ID NO: 31276 - DNA, 25 bp, Homo sapien
tcctcaatgagtactgggtgctgtc

SEQ ID NO: 31277 - DNA, 25 bp, Homo sapien
ccattgtcgactcccttcaccactg

SEQ ID NO: 31278 - DNA, 25 bp, Homo sapien
actgctttcacaggtaagcgggcgc

SEQ ID NO: 31279 - DNA, 25 bp, Homo sapien
tactgggtgctgtcagctgcgcact

SEQ ID NO: 31280 - DNA, 25 bp, Homo sapien
gcggctccatcctcaatgagtactg

SEQ ID NO: 31281 - DNA, 25 bp, Homo sapien
ggtcagcgtgcactacgcaggcctc

SEQ ID NO: 31282 - DNA, 25 bp, Homo sapien
gccgtggcaggtcagcgtgcactac

SEQ ID NO: 31283 - DNA, 25 bp, Homo sapien
cagctgcgcactgctttcacaggta

SEQ ID NO: 31284 - DNA, 25 bp, Homo sapien
gaacgtgcagccagagaccgtgcta

SEQ ID NO: 31285 - DNA, 25 bp, Homo sapien
tgcagccagagaccgtgctaagacc

SEQ ID NO: 31286 - DNA, 25 bp, Homo sapien
gctgcaccgcgccactgtgtgtggt

SEQ ID NO: 31287 - DNA, 25 bp, Homo sapien
cgccacctccgatgtccttataaaa

SEQ ID NO: 31288 - DNA, 25 bp, Homo sapien
atcagagcggagtgcagacgccacc

SEQ ID NO: 31289 - DNA, 25 bp, Homo sapien
tttttaataaaatgcatcagagcgg

SEQ ID NO: 31290 - DNA, 25 bp, Homo sapien
tgtgggagccactcatttatttttc

SEQ ID NO: 31291 - DNA, 25 bp, Homo sapien
ccttataaaacgtgtgcgcgggtgc

SEQ ID NO: 31292 - DNA, 25 bp, Homo sapien
acactcacctcgcttgagcaggctg

SEQ ID NO: 31293 - DNA, 25 bp, Homo sapien
ccagcgtgcagttccagcgctcaaa

SEQ ID NO: 31294 - DNA, 25 bp, Homo sapien
agttccagcgctcaaagcggaactg

SEQ ID NO: 31295 - DNA, 25 bp, Homo sapien
gaactggcactcgagcgcactcatg

SEQ ID NO: 31296 - DNA, 25 bp, Homo sapien
gcactcatgctcacggcctccacca

SEQ ID NO: 31297 - DNA, 25 bp, Homo sapien
agcttcagccggtcgcaggccttgt

SEQ ID NO: 31298 - DNA, 25 bp, Homo sapien
cggtcgcaggccttgtagtgcgcct

SEQ ID NO: 31299 - DNA, 25 bp, Homo sapien
gtagcggccctccagcgtgcagttc

SEQ ID NO: 31300 - DNA, 25 bp, Homo sapien
cgccgaaggcacctacccgaagtag

SEQ ID NO: 31301 - DNA, 25 bp, Homo sapien
aggctccagccttttggcaaggaca

SEQ ID NO: 31302 - DNA, 25 bp, Homo sapien
agcacgggcaatgacaccgcgggac

SEQ ID NO: 31303 - DNA, 25 bp, Homo sapien
gacgactctgcggtcacggaggacc

SEQ ID NO: 31304 - DNA, 25 bp, Homo sapien
agtcgggacctgatcccagtcccta

SEQ ID NO: 31305 - DNA, 25 bp, Homo sapien
cccgggccacagagtcagaagcaaa

SEQ ID NO: 31306 - DNA, 25 bp, Homo sapien
tccctaagcgcgaggcagtcctgct

SEQ ID NO: 31307 - DNA, 25 bp, Homo sapien
ctcagcgcgaggaacatctggattt

SEQ ID NO: 31308 - DNA, 25 bp, Homo sapien
cggcctccagattaaacgtctcgtc

SEQ ID NO: 31309 - DNA, 25 bp, Homo sapien
tccagattaaacgtctcgtccgaga

SEQ ID NO: 31310 - DNA, 25 bp, Homo sapien
tctcgtccgagaccactggatgagc

SEQ ID NO: 31311 - DNA, 25 bp, Homo sapien
tccgagaccactggatgagcgcagt

SEQ ID NO: 31312 - DNA, 25 bp, Homo sapien
cagtggcaatggctaggagacgcag

SEQ ID NO: 31313 - DNA, 25 bp, Homo sapien
caccaagcagcaacctggcggctgg

SEQ ID NO: 31314 - DNA, 25 bp, Homo sapien
cgcgctcatttcaaggcagtgcggc

SEQ ID NO: 31315 - DNA, 25 bp, Homo sapien
ggcggcgcgctcatttcaaggcagt

SEQ ID NO: 31316 - DNA, 25 bp, Homo sapien
ggaccctcaatcagaaagcgctgtg

SEQ ID NO: 31317 - DNA, 25 bp, Homo sapien
tacccgatctggtggtgagtgagcc

SEQ ID NO: 31318 - DNA, 25 bp, Homo sapien
acggccactttggacctgttcaggc

SEQ ID NO: 31319 - DNA, 25 bp, Homo sapien
gcggagtttccggagacattgattc

SEQ ID NO: 31320 - DNA, 25 bp, Homo sapien
ccgcatgggtccacctggcaatgag

SEQ ID NO: 31321 - DNA, 25 bp, Homo sapien
tccacaccagaaaaggcgcgttccg

SEQ ID NO: 31322 - DNA, 25 bp, Homo sapien
cagcctggcgatggaagtgcagata

SEQ ID NO: 31323 - DNA, 25 bp, Homo sapien
gtggccacactttcgccagggcttg

SEQ ID NO: 31324 - DNA, 25 bp, Homo sapien
tcgccggccattgtgggcctaactc

SEQ ID NO: 31325 - DNA, 25 bp, Homo sapien
gtggcgcacaaagccggattcaagc

SEQ ID NO: 31326 - DNA, 25 bp, Homo sapien
cgcggcgcatacttccaggttgcta

SEQ ID NO: 31327 - DNA, 25 bp, Homo sapien
taaagcgtctgaatggggatttccc

SEQ ID NO: 31328 - DNA, 25 bp, Homo sapien
tgcgctcgcctaatcaccgactagg

SEQ ID NO: 31329 - DNA, 25 bp, Homo sapien
cgtccggctgggagcacaatatccc

SEQ ID NO: 31330 - DNA, 25 bp, Homo sapien
cccagcgacggcgacaagattaagc

SEQ ID NO: 31331 - DNA, 25 bp, Homo sapien
acgcccttcgcggtgctgaattaaa

SEQ ID NO: 31332 - DNA, 25 bp, Homo sapien
tcctcaaggacaagtacgacagcgc

SEQ ID NO: 31333 - DNA, 25 bp, Homo sapien
gcgccatcggtgacttcctcaagga

SEQ ID NO: 31334 - DNA, 25 bp, Homo sapien
aagacatgctggtggtcgcaacccg

SEQ ID NO: 31335 - DNA, 25 bp, Homo sapien
gtctacgacgtgcacacctgcaagt

SEQ ID NO: 31336 - DNA, 25 bp, Homo sapien
gcgacctggtctactacgaggcctc

SEQ ID NO: 31337 - DNA, 25 bp, Homo sapien
ggccgcgctacacctacttcaaggt

SEQ ID NO: 31338 - DNA, 25 bp, Homo sapien
gcaacgtcagctcgcacggcatcga

SEQ ID NO: 31339 - DNA, 25 bp, Homo sapien
ttctgcgagcccaaccctgagacgg

SEQ ID NO: 31340 - DNA, 25 bp, Homo sapien
cggctttaacgcactgacgctactg

SEQ ID NO: 31341 - DNA, 25 bp, Homo sapien
gcttcggccgctttttgcgacgctt

SEQ ID NO: 31342 - DNA, 25 bp, Homo sapien
cgacgcttgcgaccggactcagatc

SEQ ID NO: 31343 - DNA, 25 bp, Homo sapien
cccggacaagtaacgcttcagatac

SEQ ID NO: 31344 - DNA, 25 bp, Homo sapien
cgcttcagatactcggccttggaaa

SEQ ID NO: 31345 - DNA, 25 bp, Homo sapien
tggggacaaaatgcctcaacgcgta

SEQ ID NO: 31346 - DNA, 25 bp, Homo sapien
agtgctaagaatcgcgcggctggca

SEQ ID NO: 31347 - DNA, 25 bp, Homo sapien
cctcaagcgatgtgagtggggccct

SEQ ID NO: 31348 - DNA, 25 bp, Homo sapien
tcttcgcggaagactcacaggcgca

SEQ ID NO: 31349 - DNA, 25 bp, Homo sapien
tgtgggagcaaaaccaacgcctggc

SEQ ID NO: 31350 - DNA, 25 bp, Homo sapien
tcacaggttcccgaagtcgctcgcg

SEQ ID NO: 31351 - DNA, 25 bp, Homo sapien
tgagccacaggctgtcttcgcggaa

SEQ ID NO: 31352 - DNA, 25 bp, Homo sapien
tcagtctccaaatacgccaaacggg

SEQ ID NO: 31353 - DNA, 25 bp, Homo sapien
cccgactccatccagttcgtgtttg

SEQ ID NO: 31354 - DNA, 25 bp, Homo sapien
tcgtgtttgctgtgaagacggtacc

SEQ ID NO: 31355 - DNA, 25 bp, Homo sapien
cctgagacgccgtcaaggtcatgta

SEQ ID NO: 31356 - DNA, 25 bp, Homo sapien
cactgcagggacatggcgatgaaga

SEQ ID NO: 31357 - DNA, 25 bp, Homo sapien
gtcagtcttcacgtcctcccagttg

SEQ ID NO: 31358 - DNA, 25 bp, Homo sapien
acccaggtagttctcccgctgcttg

SEQ ID NO: 31359 - DNA, 25 bp, Homo sapien
taccggcgccatcagcgagttgcct

SEQ ID NO: 31360 - DNA, 25 bp, Homo sapien
ttcttgtagccactgcgagagggcc

SEQ ID NO: 31361 - DNA, 25 bp, Homo sapien
tgggctgcttcttcacgttcttgta

SEQ ID NO: 31362 - DNA, 25 bp, Homo sapien
agttacctccttgctcaggcccgtg

SEQ ID NO: 31363 - DNA, 25 bp, Homo sapien
gcttgcagacctccgcgaagtcctg

SEQ ID NO: 31364 - DNA, 25 bp, Homo sapien
gtggatggtggagccatcctgcttc

SEQ ID NO: 31365 - DNA, 25 bp, Homo sapien
gtggagccatcctgcttcaccagca

SEQ ID NO: 31366 - DNA, 25 bp, Homo sapien
cagcacggggtagagtcgtgcataa

SEQ ID NO: 31367 - DNA, 25 bp, Homo sapien
tcgtgcataagcctggcggtgcaca

SEQ ID NO: 31368 - DNA, 25 bp, Homo sapien
taagcctggcggtgcacacgagtga

SEQ ID NO: 31369 - DNA, 25 bp, Homo sapien
cctgctgctgtcagctcgccaggag

SEQ ID NO: 31370 - DNA, 25 bp, Homo sapien
tagagtcgtgcataagcctggcggt

SEQ ID NO: 31371 - DNA, 25 bp, Homo sapien
cgccgtggctccctgtagcggatgt

SEQ ID NO: 31372 - DNA, 25 bp, Homo sapien
tcaaggtactcactgcgttgggtgc

SEQ ID NO: 31373 - DNA, 25 bp, Homo sapien
actccaccgggagggtacagcgcct

SEQ ID NO: 31374 - DNA, 25 bp, Homo sapien
ccacgcaggagatcaaggtactcac

SEQ ID NO: 31375 - DNA, 25 bp, Homo sapien
tgggcggtgagacacgaagatatac

SEQ ID NO: 31376 - DNA, 25 bp, Homo sapien
ctgtggcggtacaagaacccaggcg

SEQ ID NO: 31377 - DNA, 25 bp, Homo sapien
ggcgagcaggtgacctccgtcccta

SEQ ID NO: 31378 - DNA, 25 bp, Homo sapien
cgtcgcgcggtatgacgtgttccat

SEQ ID NO: 31379 - DNA, 25 bp, Homo sapien
tcccgctgcccggtggaactaagac

SEQ ID NO: 31380 - DNA, 25 bp, Homo sapien
acttctctgagtgacaagcgggaca

SEQ ID NO: 31381 - DNA, 25 bp, Homo sapien
gcgctgcactgaggtacttctctga

SEQ ID NO: 31382 - DNA, 25 bp, Homo sapien
tcgttagttaggtccctgcagtgta

SEQ ID NO: 31383 - DNA, 25 bp, Homo sapien
tgccgcattcaactgtgggccctga

SEQ ID NO: 31384 - DNA, 25 bp, Homo sapien
ccaccggacggtgagtacgacaagc

SEQ ID NO: 31385 - DNA, 25 bp, Homo sapien
ggcagtcgcctcatgacgtcagtct

SEQ ID NO: 31386 - DNA, 25 bp, Homo sapien
agcgaggcactgaggtaagtacttc

SEQ ID NO: 31387 - DNA, 25 bp, Homo sapien
cggggctcccaggattctgcctact

SEQ ID NO: 31388 - DNA, 25 bp, Homo sapien
gtcttccgcatcgtgctgacggctg

SEQ ID NO: 31389 - DNA, 25 bp, Homo sapien
ctactcggacgagcaggccaagttc

SEQ ID NO: 31390 - DNA, 25 bp, Homo sapien
agttcacttgcaacacgcggcagcc

SEQ ID NO: 31391 - DNA, 25 bp, Homo sapien
ccaggctgcgacaacgtctgctatg

SEQ ID NO: 31392 - DNA, 25 bp, Homo sapien
ctgggtcttccagattgtggtcatc

SEQ ID NO: 31393 - DNA, 25 bp, Homo sapien
cagtacctgctgtacggcttcgagg

SEQ ID NO: 31394 - DNA, 25 bp, Homo sapien
gaggtgcgaccgttctttccctgca

SEQ ID NO: 31395 - DNA, 25 bp, Homo sapien
cgcgccctactgaaaagacggtctt

SEQ ID NO: 31396 - DNA, 25 bp, Homo sapien
ctttgaaaaggtgggccgcctctgc

SEQ ID NO: 31397 - DNA, 25 bp, Homo sapien
caggtaccggccttttgtctgctgc

SEQ ID NO: 31398 - DNA, 25 bp, Homo sapien
tgaaaaggcccagcgccacatcagg

SEQ ID NO: 31399 - DNA, 25 bp, Homo sapien
tcaggcgacacacggctgcctattc

SEQ ID NO: 31400 - DNA, 25 bp, Homo sapien
tggacagcgccacgataattcactc

SEQ ID NO: 31401 - DNA, 25 bp, Homo sapien
cccagcaagataaatcatgtactcg

SEQ ID NO: 31402 - DNA, 25 bp, Homo sapien
ttaacttccattgagagggagggca

SEQ ID NO: 31403 - DNA, 25 bp, Homo sapien
ccaatcactggacagcgccacgata

SEQ ID NO: 31404 - DNA, 25 bp, Homo sapien
cacttcctgaacgtgcagggccgga

SEQ ID NO: 31405 - DNA, 25 bp, Homo sapien
acgtcatcttgtacgggtgagcgcg

SEQ ID NO: 31406 - DNA, 25 bp, Homo sapien
cgaggaaggccaccgaatgggacat

SEQ ID NO: 31407 - DNA, 25 bp, Homo sapien
tggcgcttaagaggccggcagaaac

SEQ ID NO: 31408 - DNA, 25 bp, Homo sapien
tcctgcagtcctggtggcgacccaa

SEQ ID NO: 31409 - DNA, 25 bp, Homo sapien
cctgctagggctgctgaccaatgaa

SEQ ID NO: 31410 - DNA, 25 bp, Homo sapien
tgaccaatgaactgccgcttccgag

SEQ ID NO: 31411 - DNA, 25 bp, Homo sapien
gggccggacgctctatgacgtcatc

SEQ ID NO: 31412 - DNA, 25 bp, Homo sapien
tcacccaggatgaaggcccagccct

SEQ ID NO: 31413 - DNA, 25 bp, Homo sapien
gcacctcgcgctatacaggatccgg

SEQ ID NO: 31414 - DNA, 25 bp, Homo sapien
cgccatcctcatccgcgacccgcga

SEQ ID NO: 31415 - DNA, 25 bp, Homo sapien
cgctgcagaagcacctcgcgctata

SEQ ID NO: 31416 - DNA, 25 bp, Homo sapien
ggctgcatcgctgcaggagagggca

SEQ ID NO: 31417 - DNA, 25 bp, Homo sapien
gcgacccgcgaacagcacgcatggg

SEQ ID NO: 31418 - DNA, 25 bp, Homo sapien
cacgcatggggtggcggctcctcac

SEQ ID NO: 31419 - DNA, 25 bp, Homo sapien
cgcgctatacaggatccggcggaag

SEQ ID NO: 31420 - DNA, 25 bp, Homo sapien
tcgtgggccagacctacagctctgt

SEQ ID NO: 31421 - DNA, 25 bp, Homo sapien
gacgcgcaggagaacttcgtgctca

SEQ ID NO: 31422 - DNA, 25 bp, Homo sapien
cggttcccttcaaaaagcggctgca

SEQ ID NO: 31423 - DNA, 25 bp, Homo sapien
ttcgtgctcaagatcctcttctgca

SEQ ID NO: 31424 - DNA, 25 bp, Homo sapien
tcggccacgttcctatgtgaggtgc

SEQ ID NO: 31425 - DNA, 25 bp, Homo sapien
aatccagggttgcaggtgtccgttc

SEQ ID NO: 31426 - DNA, 25 bp, Homo sapien
tacagctctgtgctggtcgtagtgc

SEQ ID NO: 31427 - DNA, 25 bp, Homo sapien
tgtccgttcctggtgcgcaaaatgc

SEQ ID NO: 31428 - DNA, 25 bp, Homo sapien
ttctaatcaaagctgtggccggtcc

SEQ ID NO: 31429 - DNA, 25 bp, Homo sapien
gttccctcctttcacttctaatcaa

SEQ ID NO: 31430 - DNA, 25 bp, Homo sapien
tgtccacatacaagttccctccttt

SEQ ID NO: 31431 - DNA, 25 bp, Homo sapien
ctgccaggtcctctgttttctattc

SEQ ID NO: 31432 - DNA, 25 bp, Homo sapien
gctgtggccggtccttttaggtcaa

SEQ ID NO: 31433 - DNA, 25 bp, Homo sapien
tgcccacatctctggactgccaggt

SEQ ID NO: 31434 - DNA, 25 bp, Homo sapien
ccctctgagagtactgccaccctgt

SEQ ID NO: 31435 - DNA, 25 bp, Homo sapien
acggccaccctgtcctcactgaacc

SEQ ID NO: 31436 - DNA, 25 bp, Homo sapien
agatccactgtgatcgcacccggca

SEQ ID NO: 31437 - DNA, 25 bp, Homo sapien
agtgtgtatgagatccactgtgatc

SEQ ID NO: 31438 - DNA, 25 bp, Homo sapien
aaggccagcagtgtgtatgagatcc

SEQ ID NO: 31439 - DNA, 25 bp, Homo sapien
ctttctccgtggacctcacggtggc

SEQ ID NO: 31440 - DNA, 25 bp, Homo sapien
tggcgaggtcactttctccgtggac

SEQ ID NO: 31441 - DNA, 25 bp, Homo sapien
agctggccgtgaggacaccgctgaa

SEQ ID NO: 31442 - DNA, 25 bp, Homo sapien
cagctgaagttcgtggccaacggca

SEQ ID NO: 31443 - DNA, 25 bp, Homo sapien
cgtggccaacggcattgagagcagc

SEQ ID NO: 31444 - DNA, 25 bp, Homo sapien
gctgagctgtcagatcaggctgcgg

SEQ ID NO: 31445 - DNA, 25 bp, Homo sapien
ctggctgagctgtcagatcaggctg

SEQ ID NO: 31446 - DNA, 25 bp, Homo sapien
tgctggctgagctgtcagatcaggc

SEQ ID NO: 31447 - DNA, 25 bp, Homo sapien
ctgctggctgagctgtcagatcagg

SEQ ID NO: 31448 - DNA, 25 bp, Homo sapien
agctgctggctgagctgtcagatca

SEQ ID NO: 31449 - DNA, 25 bp, Homo sapien
tgctggctcggctgcacgaggaggc

SEQ ID NO: 31450 - DNA, 25 bp, Homo sapien
tggctgagctgtcagatcaggctgc

SEQ ID NO: 31451 - DNA, 25 bp, Homo sapien
ctgcccgggaggtgctggctcggct

SEQ ID NO: 31452 - DNA, 25 bp, Homo sapien
gatgcaggcctctacgagtgcgtca

SEQ ID NO: 31453 - DNA, 25 bp, Homo sapien
ggcccgggacgatgcaggcctctac

SEQ ID NO: 31454 - DNA, 25 bp, Homo sapien
tgctccttgtgcgagatgtggcccg

SEQ ID NO: 31455 - DNA, 25 bp, Homo sapien
cccaagtatgaggtgcaggcatcgg

SEQ ID NO: 31456 - DNA, 25 bp, Homo sapien
ctgaaggatggtcgcacactgtccc

SEQ ID NO: 31457 - DNA, 25 bp, Homo sapien
gggccgcatcgcctaccagctctcc

SEQ ID NO: 31458 - DNA, 25 bp, Homo sapien
aggcctctacgagtgcgtcagccgc

SEQ ID NO: 31459 - DNA, 25 bp, Homo sapien
acgtggctgaaggatggtcgcacac

SEQ ID NO: 31460 - DNA, 25 bp, Homo sapien
gctccgcgtctctggtgagcacgct

SEQ ID NO: 31461 - DNA, 25 bp, Homo sapien
tcaccaggcaggatgaaggcaccta

SEQ ID NO: 31462 - DNA, 25 bp, Homo sapien
tctctggtgagcacgctgtgtgtgc

SEQ ID NO: 31463 - DNA, 25 bp, Homo sapien
actctgtggacttccggctccgcgt

SEQ ID NO: 31464 - DNA, 25 bp, Homo sapien
accggctggtggcagccacagtcac

SEQ ID NO: 31465 - DNA, 25 bp, Homo sapien
cgaggactctgtggacttccggctc

SEQ ID NO: 31466 - DNA, 25 bp, Homo sapien
gcaggatgaaggcacctactcctgc

SEQ ID NO: 31467 - DNA, 25 bp, Homo sapien
ccaggcaggatgaaggcacctactc

SEQ ID NO: 31468 - DNA, 25 bp, Homo sapien
tgacactggcctgcgagctaagccc

SEQ ID NO: 31469 - DNA, 25 bp, Homo sapien
tgatgaccacaccagtgcgcagctc

SEQ ID NO: 31470 - DNA, 25 bp, Homo sapien
tgagagccgtgatgaccacaccagt

SEQ ID NO: 31471 - DNA, 25 bp, Homo sapien
tacgtgtgtgagagccgtgatgacc

SEQ ID NO: 31472 - DNA, 25 bp, Homo sapien
caagcgcttccagatggtggccgag

SEQ ID NO: 31473 - DNA, 25 bp, Homo sapien
caacacgcagcttcgggtgggcaag

SEQ ID NO: 31474 - DNA, 25 bp, Homo sapien
gcgctgcggcaacacgcagcttcgg

SEQ ID NO: 31475 - DNA, 25 bp, Homo sapien
gcgagctaagcccagcgtgtgcaga

SEQ ID NO: 31476 - DNA, 25 bp, Homo sapien
ccagaggcgcctgtgctgttcaaaa

SEQ ID NO: 31477 - DNA, 25 bp, Homo sapien
cgccgggaaagaacgtggagatcca

SEQ ID NO: 31478 - DNA, 25 bp, Homo sapien
accgcctggttctgcacaacgtagg

SEQ ID NO: 31479 - DNA, 25 bp, Homo sapien
cacaacgtaggttttgccgaccgtg

SEQ ID NO: 31480 - DNA, 25 bp, Homo sapien
tgcgagacgccggatgacaagacac

SEQ ID NO: 31481 - DNA, 25 bp, Homo sapien
acacaggccaaactcaccgtggaga

SEQ ID NO: 31482 - DNA, 25 bp, Homo sapien
ccctctgtaccttggcttgtccgtg

SEQ ID NO: 31483 - DNA, 25 bp, Homo sapien
ttctaaaggcggtggtctcagagca

SEQ ID NO: 31484 - DNA, 25 bp, Homo sapien
gccctgcagtgtgaagtctctgacc

SEQ ID NO: 31485 - DNA, 25 bp, Homo sapien
atgagatctcacacaagggccggcg

SEQ ID NO: 31486 - DNA, 25 bp, Homo sapien
ccacacgctggtactgaagagcatc

SEQ ID NO: 31487 - DNA, 25 bp, Homo sapien
tcctccctgaaggtgtcgacctctg

SEQ ID NO: 31488 - DNA, 25 bp, Homo sapien
ttcctgaaggcgctggatgacctgt

SEQ ID NO: 31489 - DNA, 25 bp, Homo sapien
gtacaacgacagcttccatgagatc

SEQ ID NO: 31490 - DNA, 25 bp, Homo sapien
agtatgacttcctgcacacggcggg

SEQ ID NO: 31491 - DNA, 25 bp, Homo sapien
ggtgagtcatcccacgagtcttcgg

SEQ ID NO: 31492 - DNA, 25 bp, Homo sapien
ggggctaccacgtgctgaccctgcg

SEQ ID NO: 31493 - DNA, 25 bp, Homo sapien
acgtgctgaccctgcggcagctggc

SEQ ID NO: 31494 - DNA, 25 bp, Homo sapien
caccatctactttgaggcgggtgac

SEQ ID NO: 31495 - DNA, 25 bp, Homo sapien
agcctgtgcactggttcctggacaa

SEQ ID NO: 31496 - DNA, 25 bp, Homo sapien
ccctgcatgccaacgagctcaatga

SEQ ID NO: 31497 - DNA, 25 bp, Homo sapien
aggactcgggcaccatctactttga

SEQ ID NO: 31498 - DNA, 25 bp, Homo sapien
cggccaactacgagcctgtgcactg

SEQ ID NO: 31499 - DNA, 25 bp, Homo sapien
acgagctcaatgagatcgatgccca

SEQ ID NO: 31500 - DNA, 25 bp, Homo sapien
ccaagtgccgccgacagccttgggg

SEQ ID NO: 31501 - DNA, 25 bp, Homo sapien
cagggaaccagctgattaggggatc

SEQ ID NO: 31502 - DNA, 25 bp, Homo sapien
ccgagaaacagatgtgaggctgtgc

SEQ ID NO: 31503 - DNA, 25 bp, Homo sapien
atgggcttccgaatgccgagaaaca

SEQ ID NO: 31504 - DNA, 25 bp, Homo sapien
tggtgagaaatgaatgggcttccga

SEQ ID NO: 31505 - DNA, 25 bp, Homo sapien
aaggccgctagtgtctcccggcctg

SEQ ID NO: 31506 - DNA, 25 bp, Homo sapien
ttctgtggagactccgaacgtcgcc

SEQ ID NO: 31507 - DNA, 25 bp, Homo sapien
tgcctcctgcaaggccgctagtgtc

SEQ ID NO: 31508 - DNA, 25 bp, Homo sapien
gacgaacccgtgcacacctcggaga

SEQ ID NO: 31509 - DNA, 25 bp, Homo sapien
tgcttcacctgcacgctcagcgagg

SEQ ID NO: 31510 - DNA, 25 bp, Homo sapien
agaggcgtcctggtacatcaatggc

SEQ ID NO: 31511 - DNA, 25 bp, Homo sapien
tcctggagcctctgaaaaacgcggc

SEQ ID NO: 31512 - DNA, 25 bp, Homo sapien
agccacccgcttcgcagtgggtaga

SEQ ID NO: 31513 - DNA, 25 bp, Homo sapien
gatatggtgacgtccgcattcctca

SEQ ID NO: 31514 - DNA, 25 bp, Homo sapien
cacaagacagctgccgggtgacctt

SEQ ID NO: 31515 - DNA, 25 bp, Homo sapien
acctgctgctgctcaaaaacttgcg

SEQ ID NO: 31516 - DNA, 25 bp, Homo sapien
actgaggcccgccaggcggtaactc

SEQ ID NO: 31517 - DNA, 25 bp, Homo sapien
gcatccgttttgaggcgctcactga

SEQ ID NO: 31518 - DNA, 25 bp, Homo sapien
gagcatttcatctgcatccgttttg

SEQ ID NO: 31519 - DNA, 25 bp, Homo sapien
gacataccgcgaagatgagcatttc

SEQ ID NO: 31520 - DNA, 25 bp, Homo sapien
cgcaccaaaagtccggctgaagttt

SEQ ID NO: 31521 - DNA, 25 bp, Homo sapien
ctgaagtttcagatgaggagctctt

SEQ ID NO: 31522 - DNA, 25 bp, Homo sapien
aggagctcttcctgagtgcagacga

SEQ ID NO: 31523 - DNA, 25 bp, Homo sapien
agcccgcggactggcagacataccg

SEQ ID NO: 31524 - DNA, 25 bp, Homo sapien
gtaacagttcatgcatagcgactcg

SEQ ID NO: 31525 - DNA, 25 bp, Homo sapien
ctcggggaacaatgtcgtcaagggc

SEQ ID NO: 31526 - DNA, 25 bp, Homo sapien
atagcgactcgatctcggtgggctg

SEQ ID NO: 31527 - DNA, 25 bp, Homo sapien
gcgcaattcagacctcggcttccta

SEQ ID NO: 31528 - DNA, 25 bp, Homo sapien
aaaagccgcagactccgggcactcg

SEQ ID NO: 31529 - DNA, 25 bp, Homo sapien
ccgcctcacattgcagtaacagttc

SEQ ID NO: 31530 - DNA, 25 bp, Homo sapien
gggtttatatggctcgaaccttaca

SEQ ID NO: 31531 - DNA, 25 bp, Homo sapien
acaatgtcgtcaagggctcccggtt

SEQ ID NO: 31532 - DNA, 25 bp, Homo sapien
tccgtagccttgagggcacctcctt

SEQ ID NO: 31533 - DNA, 25 bp, Homo sapien
atccagagagagatcggggagccca

SEQ ID NO: 31534 - DNA, 25 bp, Homo sapien
gggcagcctgtgctgctcagcgtgg

SEQ ID NO: 31535 - DNA, 25 bp, Homo sapien
cccaggtccgtagccttgagggcac

SEQ ID NO: 31536 - DNA, 25 bp, Homo sapien
gggcacctccttcctcttgcgggag

SEQ ID NO: 31537 - DNA, 25 bp, Homo sapien
agtctttctgcacccgcatccggcg

SEQ ID NO: 31538 - DNA, 25 bp, Homo sapien
gcctctttaggcctgagccccgtgg

SEQ ID NO: 31539 - DNA, 25 bp, Homo sapien
tctcggtgatccagagagagatcgg

SEQ ID NO: 31540 - DNA, 25 bp, Homo sapien
caggcctgcgcgagccactgatgga

SEQ ID NO: 31541 - DNA, 25 bp, Homo sapien
ctgttctaccaccaggcgggtgaga

SEQ ID NO: 31542 - DNA, 25 bp, Homo sapien
gcagcctgttctaccaccaggcggg

SEQ ID NO: 31543 - DNA, 25 bp, Homo sapien
tgcatctcccgagggtgccgggcca

SEQ ID NO: 31544 - DNA, 25 bp, Homo sapien
aagccgaggccagtgagcgctccac

SEQ ID NO: 31545 - DNA, 25 bp, Homo sapien
gcgcgagccactgatggagcaccgc

SEQ ID NO: 31546 - DNA, 25 bp, Homo sapien
acctgctgaagggcgggtacattgc

SEQ ID NO: 31547 - DNA, 25 bp, Homo sapien
ggcacagcgtcatccgcagcctgtt

SEQ ID NO: 31548 - DNA, 25 bp, Homo sapien
cgtgctgagcctatgtccgtcccag

SEQ ID NO: 31549 - DNA, 25 bp, Homo sapien
gggtcgctgcagacgcgccaataaa

SEQ ID NO: 31550 - DNA, 25 bp, Homo sapien
agaagtcttccgtctcgttgcatta

SEQ ID NO: 31551 - DNA, 25 bp, Homo sapien
ttaggggtcgctccctcactccgat

SEQ ID NO: 31552 - DNA, 25 bp, Homo sapien
gtcctcacacccatgcgcgtttatt

SEQ ID NO: 31553 - DNA, 25 bp, Homo sapien
gggccagccgcttgtttccacaact

SEQ ID NO: 31554 - DNA, 25 bp, Homo sapien
gcaacccagtgtttgagattccatg

SEQ ID NO: 31555 - DNA, 25 bp, Homo sapien
gctgctgtacaagaggcacaacctg

SEQ ID NO: 31556 - DNA, 25 bp, Homo sapien
ccgttccgaggaattgtaatagctc

SEQ ID NO: 31557 - DNA, 25 bp, Homo sapien
gaagaccaggatccagaagccgttg

SEQ ID NO: 31558 - DNA, 25 bp, Homo sapien
tgacccatcggtggcactgtagaaa

SEQ ID NO: 31559 - DNA, 25 bp, Homo sapien
tctcgggaaagatgaatagcagtga

SEQ ID NO: 31560 - DNA, 25 bp, Homo sapien
tccagcctcgtagtccagaaagatc

SEQ ID NO: 31561 - DNA, 25 bp, Homo sapien
atccagaagccgttgcccgcggaca

SEQ ID NO: 31562 - DNA, 25 bp, Homo sapien
ctttcggccggcagatagtcatcgg

SEQ ID NO: 31563 - DNA, 25 bp, Homo sapien
tgtagaaagagagatgtccagcctc

SEQ ID NO: 31564 - DNA, 25 bp, Homo sapien
acggaattggagagctttcacttgc

SEQ ID NO: 31565 - DNA, 25 bp, Homo sapien
aggcgcagctcgtcgccacagaagg

SEQ ID NO: 31566 - DNA, 25 bp, Homo sapien
cggccatcttagcaagcgggcggtt

SEQ ID NO: 31567 - DNA, 25 bp, Homo sapien
gccggatgcactcgcggcagaagtt

SEQ ID NO: 31568 - DNA, 25 bp, Homo sapien
agttgtggccgcagtcggtcatcac

SEQ ID NO: 31569 - DNA, 25 bp, Homo sapien
cggtcatcaccggatccgtgaagta

SEQ ID NO: 31570 - DNA, 25 bp, Homo sapien
acaacccgcttttgcctccgattgg

SEQ ID NO: 31571 - DNA, 25 bp, Homo sapien
gcccaggagcaccttgaggtcttcg

SEQ ID NO: 31572 - DNA, 25 bp, Homo sapien
tgcagaaggagttgaaaatcgcgtc

SEQ ID NO: 31573 - DNA, 25 bp, Homo sapien
acagcgcctagtgcacctggccgag

SEQ ID NO: 31574 - DNA, 25 bp, Homo sapien
acgcagtggagatctacagactttc

SEQ ID NO: 31575 - DNA, 25 bp, Homo sapien
ttaccttgttgaagcgcgctagccc

SEQ ID NO: 31576 - DNA, 25 bp, Homo sapien
gtttctcggagctttctgcacgcca

SEQ ID NO: 31577 - DNA, 25 bp, Homo sapien
cgcgtctacactgcaagcacgattc

SEQ ID NO: 31578 - DNA, 25 bp, Homo sapien
ggcgtctaggggtctcagacttccc

SEQ ID NO: 31579 - DNA, 25 bp, Homo sapien
acagactttcgcctacgccacgggg

SEQ ID NO: 31580 - DNA, 25 bp, Homo sapien
tccttaggcatgatggtgacccgtt

SEQ ID NO: 31581 - DNA, 25 bp, Homo sapien
gacctcagcggattgctcgctttta

SEQ ID NO: 31582 - DNA, 25 bp, Homo sapien
ggtgacccgtttggcatggatgaca

SEQ ID NO: 31583 - DNA, 25 bp, Homo sapien
aggtgcgctcttgcgagccaccttg

SEQ ID NO: 31584 - DNA, 25 bp, Homo sapien
tgccacccgttgacttgcgcgcagt

SEQ ID NO: 31585 - DNA, 25 bp, Homo sapien
gcgcaacctctcaggtggcgagata

SEQ ID NO: 31586 - DNA, 25 bp, Homo sapien
tcgggccatgaatccgaaactgttg

SEQ ID NO: 31587 - DNA, 25 bp, Homo sapien
aagtcctgagcgatctcgcgcatca

SEQ ID NO: 31588 - DNA, 25 bp, Homo sapien
ggcttctctgcagctgtacaccctg

SEQ ID NO: 31589 - DNA, 25 bp, Homo sapien
gccgggagggtcattttcatgccta

SEQ ID NO: 31590 - DNA, 25 bp, Homo sapien
agcccatgtatctagggaacacgtg

SEQ ID NO: 31591 - DNA, 25 bp, Homo sapien
tcgcgcaggtctccaaaacgaatcc

SEQ ID NO: 31592 - DNA, 25 bp, Homo sapien
acctggcccagaggttttgaactga

SEQ ID NO: 31593 - DNA, 25 bp, Homo sapien
tagcgttttatgcagagtcgcaacc

SEQ ID NO: 31594 - DNA, 25 bp, Homo sapien
ttgcacgcaacctcgggtagccagc

SEQ ID NO: 31595 - DNA, 25 bp, Homo sapien
cccgagcttgaataagggcctcaaa

SEQ ID NO: 31596 - DNA, 25 bp, Homo sapien
ccagcatgttagaaaagcggctttg

SEQ ID NO: 31597 - DNA, 25 bp, Homo sapien
cacgagcgagactggcgttttaaac

SEQ ID NO: 31598 - DNA, 25 bp, Homo sapien
cggctttgggaagcgatcatttctt

SEQ ID NO: 31599 - DNA, 25 bp, Homo sapien
cacttttaatccaacatcggcagca

SEQ ID NO: 31600 - DNA, 25 bp, Homo sapien
acatcggcagcacccgaagtggtcc

SEQ ID NO: 31601 - DNA, 25 bp, Homo sapien
accgcgggctctggattttgacaaa

SEQ ID NO: 31602 - DNA, 25 bp, Homo sapien
ggcgacgcatctccctcggagaatg

SEQ ID NO: 31603 - DNA, 25 bp, Homo sapien
caggctggagttcccgcagtcagcc

SEQ ID NO: 31604 - DNA, 25 bp, Homo sapien
tcggcgtcctgaacccaaaggctct

SEQ ID NO: 31605 - DNA, 25 bp, Homo sapien
gctcctgcgcccaagaagggttcta

SEQ ID NO: 31606 - DNA, 25 bp, Homo sapien
attcctttcccagcgatgacgtaga

SEQ ID NO: 31607 - DNA, 25 bp, Homo sapien
ccagcgagcccttatgtatggtaca

SEQ ID NO: 31608 - DNA, 25 bp, Homo sapien
tgcttaccacgaccggacatttccg

SEQ ID NO: 31609 - DNA, 25 bp, Homo sapien
cgcgcgtttctgtttggagagactc

SEQ ID NO: 31610 - DNA, 25 bp, Homo sapien
agtcaagtactcgagcaccgcggcc

SEQ ID NO: 31611 - DNA, 25 bp, Homo sapien
acgcgctccgaatagttgcccttgc

SEQ ID NO: 31612 - DNA, 25 bp, Homo sapien
ggcagctatctgcaggtaggtgtcc

SEQ ID NO: 31613 - DNA, 25 bp, Homo sapien
ggagagcacctgcacgcagcgactg

SEQ ID NO: 31614 - DNA, 25 bp, Homo sapien
gccttggccttgagcgtgagcttcc

SEQ ID NO: 31615 - DNA, 25 bp, Homo sapien
cgcagctggtccaggttctgctgga

SEQ ID NO: 31616 - DNA, 25 bp, Homo sapien
aaggctctgctgagctcttcgcgca

SEQ ID NO: 31617 - DNA, 25 bp, Homo sapien
ccagtgcctgcaaaggctctgctga

SEQ ID NO: 31618 - DNA, 25 bp, Homo sapien
cgcacctcctcggagagcatctggg

SEQ ID NO: 31619 - DNA, 25 bp, Homo sapien
gaaagcctgaagtcgctggcgcacc

SEQ ID NO: 31620 - DNA, 25 bp, Homo sapien
agcagagtccggttcttctttccta

SEQ ID NO: 31621 - DNA, 25 bp, Homo sapien
ccgccactgggaggaatttctgtaa

SEQ ID NO: 31622 - DNA, 25 bp, Homo sapien
gccggcagggctatttgccatcttt

SEQ ID NO: 31623 - DNA, 25 bp, Homo sapien
cggctcagtctactttccctcatta

SEQ ID NO: 31624 - DNA, 25 bp, Homo sapien
tgtggccaacacaagacgaacgcag

SEQ ID NO: 31625 - DNA, 25 bp, Homo sapien
tggcacaagatcttcccggaggtga

SEQ ID NO: 31626 - DNA, 25 bp, Homo sapien
accagaccaggtggcacgctccttt

SEQ ID NO: 31627 - DNA, 25 bp, Homo sapien
agtgtctgattggacggcctgactc

SEQ ID NO: 31628 - DNA, 25 bp, Homo sapien
accaagtcgaggaggcacaccggct

SEQ ID NO: 31629 - DNA, 25 bp, Homo sapien
gaggcacaccggctgattcccagcg

SEQ ID NO: 31630 - DNA, 25 bp, Homo sapien
tctgaccaagtcgaggaggcacacc

SEQ ID NO: 31631 - DNA, 25 bp, Homo sapien
gcaggccctctgaccaagtcgagga

SEQ ID NO: 31632 - DNA, 25 bp, Homo sapien
tgcttaaaggcaccgggttgcgccg

SEQ ID NO: 31633 - DNA, 25 bp, Homo sapien
caccctgcttaaaggcaccgggttg

SEQ ID NO: 31634 - DNA, 25 bp, Homo sapien
tggggcgcctgagagcaacctcctc

SEQ ID NO: 31635 - DNA, 25 bp, Homo sapien
cgcgtttccatcaggggcgactcct

SEQ ID NO: 31636 - DNA, 25 bp, Homo sapien
ccttcgcgcaggaacccaagacgga

SEQ ID NO: 31637 - DNA, 25 bp, Homo sapien
ggcattcgtgaagcagagcaccctg

SEQ ID NO: 31638 - DNA, 25 bp, Homo sapien
gccagacccgcccagcacgtcacca

SEQ ID NO: 31639 - DNA, 25 bp, Homo sapien
aagacggaacccactcgcgttgcgc

SEQ ID NO: 31640 - DNA, 25 bp, Homo sapien
gcgcaggaacccaagacggaaccca

SEQ ID NO: 31641 - DNA, 25 bp, Homo sapien
cccggcattcgtgaagcagagcacc

SEQ ID NO: 31642 - DNA, 25 bp, Homo sapien
aacacacctaaggaagccggctccg

SEQ ID NO: 31643 - DNA, 25 bp, Homo sapien
agcacgtcaccaacacacctaagga

SEQ ID NO: 31644 - DNA, 25 bp, Homo sapien
ttccctctttcgcaggagttactga

SEQ ID NO: 31645 - DNA, 25 bp, Homo sapien
ccaggatcttatcggcagagcgctc

SEQ ID NO: 31646 - DNA, 25 bp, Homo sapien
gccaggatcttgtctgtggagcgca

SEQ ID NO: 31647 - DNA, 25 bp, Homo sapien
gcggccaggacctaaggatgcagta

SEQ ID NO: 31648 - DNA, 25 bp, Homo sapien
cttgcaggtggagagcatagttgcc

SEQ ID NO: 31649 - DNA, 25 bp, Homo sapien
ttcaggatacgacttgggccggtcc

SEQ ID NO: 31650 - DNA, 25 bp, Homo sapien
gcgcagctcagatcctagcagctta

SEQ ID NO: 31651 - DNA, 25 bp, Homo sapien
gggacagcccagtaagatttcagga

SEQ ID NO: 31652 - DNA, 25 bp, Homo sapien
gggccaaaccctgaaccgctatagc

SEQ ID NO: 31653 - DNA, 25 bp, Homo sapien
gtgacagctggaatccggccggcaa

SEQ ID NO: 31654 - DNA, 25 bp, Homo sapien
cctcgcaggatcttctgagcggcga

SEQ ID NO: 31655 - DNA, 25 bp, Homo sapien
caagatggggcctcgcaggatcttc

SEQ ID NO: 31656 - DNA, 25 bp, Homo sapien
cagccttgacggctctggttggttg

SEQ ID NO: 31657 - DNA, 25 bp, Homo sapien
ggctgttcgtccttgggccagcctt

SEQ ID NO: 31658 - DNA, 25 bp, Homo sapien
cctcttgccaatagaccgggtcttg

SEQ ID NO: 31659 - DNA, 25 bp, Homo sapien
tccaaaacgatacatccgcgacagg

SEQ ID NO: 31660 - DNA, 25 bp, Homo sapien
tgcgccgcccatcctgaatagttgt

SEQ ID NO: 31661 - DNA, 25 bp, Homo sapien
ggaatcctggcctgcaccttagtga

SEQ ID NO: 31662 - DNA, 25 bp, Homo sapien
tcctggttttctcaagtggcgtttc

SEQ ID NO: 31663 - DNA, 25 bp, Homo sapien
tgccatggggatcttatcgggaccc

SEQ ID NO: 31664 - DNA, 25 bp, Homo sapien
gcgccttctgttggcctcttagagc

SEQ ID NO: 31665 - DNA, 25 bp, Homo sapien
agccttccgtgattgcttgcgccta

SEQ ID NO: 31666 - DNA, 25 bp, Homo sapien
gagctccagagcttccatgactttg

SEQ ID NO: 31667 - DNA, 25 bp, Homo sapien
cccggtttataaggttgcgactgcg

SEQ ID NO: 31668 - DNA, 25 bp, Homo sapien
aggcgggcgttttcttggatgaatt

SEQ ID NO: 31669 - DNA, 25 bp, Homo sapien
gcggaggcagcgttttggatccctc

SEQ ID NO: 31670 - DNA, 25 bp, Homo sapien
aacgacaaaagtagcgcgaggtcca

SEQ ID NO: 31671 - DNA, 25 bp, Homo sapien
cttagagaggaagcgcccggctccg

SEQ ID NO: 31672 - DNA, 25 bp, Homo sapien
gctccgttaggcagcgccctcttga

SEQ ID NO: 31673 - DNA, 25 bp, Homo sapien
cgccctcttgagcaggccgggatag

SEQ ID NO: 31674 - DNA, 25 bp, Homo sapien
gtaggctcctgcctttcttggcacc

SEQ ID NO: 31675 - DNA, 25 bp, Homo sapien
attgcttgctttggaggtgggtttc

SEQ ID NO: 31676 - DNA, 25 bp, Homo sapien
aaagccaaagaaaaagcctacagca

SEQ ID NO: 31677 - DNA, 25 bp, Homo sapien
cagggctggccgaaggcgaacagcc

SEQ ID NO: 31678 - DNA, 25 bp, Homo sapien
gatccctcgccgcacaggggctcct

SEQ ID NO: 31679 - DNA, 25 bp, Homo sapien
gcggaggcagcgttttggatccctc

SEQ ID NO: 31680 - DNA, 25 bp, Homo sapien
attgcagccgacaccgccagcccgg

SEQ ID NO: 31681 - DNA, 25 bp, Homo sapien
cgtgcccgccggattgcagccgaca

SEQ ID NO: 31682 - DNA, 25 bp, Homo sapien
tatggccgtagacgctgaaggaggc

SEQ ID NO: 31683 - DNA, 25 bp, Homo sapien
tctcgggtgagagggcctgagagaa

SEQ ID NO: 31684 - DNA, 25 bp, Homo sapien
gcgccagtgtgcaagatgctccgca

SEQ ID NO: 31685 - DNA, 25 bp, Homo sapien
ctattcactggtgtgcgccagcccg

SEQ ID NO: 31686 - DNA, 25 bp, Homo sapien
ggctcactcaacatcaacctctatt

SEQ ID NO: 31687 - DNA, 25 bp, Homo sapien
aacctctattcactggtgtgcgcca

SEQ ID NO: 31688 - DNA, 25 bp, Homo sapien
agcgtgcctggctcactcaacatca

SEQ ID NO: 31689 - DNA, 25 bp, Homo sapien
tacctggcctttaccgccttgagcg

SEQ ID NO: 31690 - DNA, 25 bp, Homo sapien
tacttgctgccagatgcctcggagc

SEQ ID NO: 31691 - DNA, 25 bp, Homo sapien
ggggtcagcgtgctacttgctgcca

SEQ ID NO: 31692 - DNA, 25 bp, Homo sapien
tgtcctccaacagcgcagggcagag

SEQ ID NO: 31693 - DNA, 25 bp, Homo sapien
gcgcggagctaacacgaaaggacca

SEQ ID NO: 31694 - DNA, 25 bp, Homo sapien
acaaatgaggagtgcaggacgtttc

SEQ ID NO: 31695 - DNA, 25 bp, Homo sapien
tccagctgggaagccggacaaatga

SEQ ID NO: 31696 - DNA, 25 bp, Homo sapien
gccttcgacaacttctccggtgagc

SEQ ID NO: 31697 - DNA, 25 bp, Homo sapien
gagtacatccctactgccttcgaca

SEQ ID NO: 31698 - DNA, 25 bp, Homo sapien
ggtgagctacaccaccaacggctac

SEQ ID NO: 31699 - DNA, 25 bp, Homo sapien
caagacgagcctggtggtgagctac

SEQ ID NO: 31700 - DNA, 25 bp, Homo sapien
aggtccaggtagacaccgcctgccg

SEQ ID NO: 31701 - DNA, 25 bp, Homo sapien
aaatcgctctgagccagtctgctcc

SEQ ID NO: 31702 - DNA, 25 bp, Homo sapien
gggttaaaatcgctctgagccagtc

SEQ ID NO: 31703 - DNA, 25 bp, Homo sapien
tggctatgaggttttccgaggcccg

SEQ ID NO: 31704 - DNA, 25 bp, Homo sapien
cccagcctgtctgagggaggtccag

SEQ ID NO: 31705 - DNA, 25 bp, Homo sapien
ttgaagtttcttggcccgctcaccc

SEQ ID NO: 31706 - DNA, 25 bp, Homo sapien
agccagcgcgtgtgttgaagtttct

SEQ ID NO: 31707 - DNA, 25 bp, Homo sapien
atcctgcgtggctatgaggttttcc

SEQ ID NO: 31708 - DNA, 25 bp, Homo sapien
tcacctgcggcgtcatccaaaggcg

SEQ ID NO: 31709 - DNA, 25 bp, Homo sapien
aaagcacagggatcctcctcacctg

SEQ ID NO: 31710 - DNA, 25 bp, Homo sapien
catccaaaggcgtgtggcacccaga

SEQ ID NO: 31711 - DNA, 25 bp, Homo sapien
tggcacccagacgttgagcagagtc

SEQ ID NO: 31712 - DNA, 25 bp, Homo sapien
gctgccactgccgtgtatgttccca

SEQ ID NO: 31713 - DNA, 25 bp, Homo sapien
cgtgtatgttcccagtgtgcggacc

SEQ ID NO: 31714 - DNA, 25 bp, Homo sapien
gcaacggaacgcctgggattcccaa

SEQ ID NO: 31715 - DNA, 25 bp, Homo sapien
gccgtcgaacgggatgcacaaaagc

SEQ ID NO: 31716 - DNA, 25 bp, Homo sapien
tctcctgcgtgtcctgagcataggg

SEQ ID NO: 31717 - DNA, 25 bp, Homo sapien
gcactctctccatgcgctgtgcgta

SEQ ID NO: 31718 - DNA, 25 bp, Homo sapien
cctcaagctggtggttgagcttctc

SEQ ID NO: 31719 - DNA, 25 bp, Homo sapien
ctccacggtctggtcaatcttgact

SEQ ID NO: 31720 - DNA, 25 bp, Homo sapien
tttgaattcgtcagcgtagggcgta

SEQ ID NO: 31721 - DNA, 25 bp, Homo sapien
cctccacgttctggtcgatcttggc

SEQ ID NO: 31722 - DNA, 25 bp, Homo sapien
cgatcttggccttgagctcgtcggc

SEQ ID NO: 31723 - DNA, 25 bp, Homo sapien
cctcggcgttcttcttcatctggaa

SEQ ID NO: 31724 - DNA, 25 bp, Homo sapien
ctgacgacgccgagtcctccgagga

SEQ ID NO: 31725 - DNA, 25 bp, Homo sapien
tcctcctgagcaagatgtcgccgcg

SEQ ID NO: 31726 - DNA, 25 bp, Homo sapien
cgcgcgctttcctcctgagcaagat

SEQ ID NO: 31727 - DNA, 25 bp, Homo sapien
cgcgtggcgcagcagctaaagcgca

SEQ ID NO: 31728 - DNA, 25 bp, Homo sapien
tacgggacccggtacacgacacaga

SEQ ID NO: 31729 - DNA, 25 bp, Homo sapien
agcgcttcatgtactcgctcttcac

SEQ ID NO: 31730 - DNA, 25 bp, Homo sapien
cggctcctggtagcgcttcatgtac

SEQ ID NO: 31731 - DNA, 25 bp, Homo sapien
agctcgcggtagcacggcccgtact

SEQ ID NO: 31732 - DNA, 25 bp, Homo sapien
ggcgccctgtttagcgttacctctg

SEQ ID NO: 31733 - DNA, 25 bp, Homo sapien
atctgcttcctaagcctggccaggg

SEQ ID NO: 31734 - DNA, 25 bp, Homo sapien
cagggcaatcagctcttcgcacaaa

SEQ ID NO: 31735 - DNA, 25 bp, Homo sapien
tcgggaattcgcctccagggcaatc

SEQ ID NO: 31736 - DNA, 25 bp, Homo sapien
gaccctggaagcgattaacgtgccc

SEQ ID NO: 31737 - DNA, 25 bp, Homo sapien
agcgcgtcctctgggatttgaaggc

SEQ ID NO: 31738 - DNA, 25 bp, Homo sapien
cccgagttaactctgctgcataggc

SEQ ID NO: 31739 - DNA, 25 bp, Homo sapien
aaatacgacgtgaacagctcctgca

SEQ ID NO: 31740 - DNA, 25 bp, Homo sapien
ccaggggttctcttctcgacctttg

SEQ ID NO: 31741 - DNA, 25 bp, Homo sapien
ggtctcgtcttcgtcgcacattgtg

SEQ ID NO: 31742 - DNA, 25 bp, Homo sapien
ggtgcatcagcgcagaagtctcagc

SEQ ID NO: 31743 - DNA, 25 bp, Homo sapien
cggagccactcaaattctgccaggg

SEQ ID NO: 31744 - DNA, 25 bp, Homo sapien
tccacatagccaggggaacatgttc

SEQ ID NO: 31745 - DNA, 25 bp, Homo sapien
ctgtcacctagggagataaggcctc

SEQ ID NO: 31746 - DNA, 25 bp, Homo sapien
ccatccagggaagagtggcctgtta

SEQ ID NO: 31747 - DNA, 25 bp, Homo sapien
gaacctagggacatctcctgccgga

SEQ ID NO: 31748 - DNA, 25 bp, Homo sapien
tgacgtcaaacgcaatggctcccgc

SEQ ID NO: 31749 - DNA, 25 bp, Homo sapien
gttgccagacccaaccagggagatc

SEQ ID NO: 31750 - DNA, 25 bp, Homo sapien
agggagatcacttaccgcgagctta

SEQ ID NO: 31751 - DNA, 25 bp, Homo sapien
gcggctgggaacatgactccaagga

SEQ ID NO: 31752 - DNA, 25 bp, Homo sapien
atggcgcgcgatgatgacgtcaaac

SEQ ID NO: 31753 - DNA, 25 bp, Homo sapien
cccagatctagaaccgctgcagtgc

SEQ ID NO: 31754 - DNA, 25 bp, Homo sapien
aagccaggcgcccttcttgactgcg

SEQ ID NO: 31755 - DNA, 25 bp, Homo sapien
cctgcgcgcggaacttaaacaccta

SEQ ID NO: 31756 - DNA, 25 bp, Homo sapien
gcctcaggccagtgaacggcgatag

SEQ ID NO: 31757 - DNA, 25 bp, Homo sapien
tcgcatggcgctgcgtgcgacccgt

SEQ ID NO: 31758 - DNA, 25 bp, Homo sapien
ttatcgtgcctgcaccctcgggctg

SEQ ID NO: 31759 - DNA, 25 bp, Homo sapien
ggactgcagctacccggaccttgca

SEQ ID NO: 31760 - DNA, 25 bp, Homo sapien
cagggaactttttcgcgcttcgccg

SEQ ID NO: 31761 - DNA, 25 bp, Homo sapien
acgagctctttctcacgccggcaga

SEQ ID NO: 31762 - DNA, 25 bp, Homo sapien
cgaccacacgatggccggcacaaag

SEQ ID NO: 31763 - DNA, 25 bp, Homo sapien
ctgaacttgggaacgacacgagctc

SEQ ID NO: 31764 - DNA, 25 bp, Homo sapien
agcagacgccaagtacttaccgttg

SEQ ID NO: 31765 - DNA, 25 bp, Homo sapien
tccgatcaaatgaccacagcctggc

SEQ ID NO: 31766 - DNA, 25 bp, Homo sapien
tcctcagcgggtacgtccgatcaaa

SEQ ID NO: 31767 - DNA, 25 bp, Homo sapien
gccaggtgtcctgcatatatcctca

SEQ ID NO: 31768 - DNA, 25 bp, Homo sapien
tgacacagtccacatctgccaggtg

SEQ ID NO: 31769 - DNA, 25 bp, Homo sapien
gcccgtggccaagtagtttgaatta

SEQ ID NO: 31770 - DNA, 25 bp, Homo sapien
tccacagccggacggtcttgtcggt

SEQ ID NO: 31771 - DNA, 25 bp, Homo sapien
ccacggtggcctgtgaaaagcctca

SEQ ID NO: 31772 - DNA, 25 bp, Homo sapien
agccgtgctccctgcttggctgtcg

SEQ ID NO: 31773 - DNA, 25 bp, Homo sapien
cctacatgcaaaggagctgtggagc

SEQ ID NO: 31774 - DNA, 25 bp, Homo sapien
ctgtcgggcactgggataccttccc

SEQ ID NO: 31775 - DNA, 25 bp, Homo sapien
agtccaggtgtagccgccgactgca

SEQ ID NO: 31776 - DNA, 25 bp, Homo sapien
ctccgggatcgggttgcttccgcct

SEQ ID NO: 31777 - DNA, 25 bp, Homo sapien
ggccgctccatgactgactgacacg

SEQ ID NO: 31778 - DNA, 25 bp, Homo sapien
cctgtctacccggagctgtctcgag

SEQ ID NO: 31779 - DNA, 25 bp, Homo sapien
gcaggaacgcgacgccagtccaggt

SEQ ID NO: 31780 - DNA, 25 bp, Homo sapien
cctctctctgctcgtcgtaattcga

SEQ ID NO: 31781 - DNA, 25 bp, Homo sapien
agcggctgcaaatcctcgtcccttt

SEQ ID NO: 31782 - DNA, 25 bp, Homo sapien
gccctttgataccagcggctgcaaa

SEQ ID NO: 31783 - DNA, 25 bp, Homo sapien
ccaacgcgtcatgtacagcaggaga

SEQ ID NO: 31784 - DNA, 25 bp, Homo sapien
aggcgaccgcttttccaacgcgtca

SEQ ID NO: 31785 - DNA, 25 bp, Homo sapien
tgggcatcgcctactacatgtactc

SEQ ID NO: 31786 - DNA, 25 bp, Homo sapien
ttccgtgtttctgccaccttctttg

SEQ ID NO: 31787 - DNA, 25 bp, Homo sapien
gtaattcgagtcttgtccggccgcc

SEQ ID NO: 31788 - DNA, 25 bp, Homo sapien
gggagcgaggagaactcttgaaatc

SEQ ID NO: 31789 - DNA, 25 bp, Homo sapien
agtcgtgtcacgtggcaggtttacg

SEQ ID NO: 31790 - DNA, 25 bp, Homo sapien
tcccttcgaaatcacgtatggtttc

SEQ ID NO: 31791 - DNA, 25 bp, Homo sapien
aactgaacggatgcgtgcgagctga

SEQ ID NO: 31792 - DNA, 25 bp, Homo sapien
tgagtgacacccagcgacaaccgac

SEQ ID NO: 31793 - DNA, 25 bp, Homo sapien
tgccggctccgcaactgagtgacac

SEQ ID NO: 31794 - DNA, 25 bp, Homo sapien
gcggcaagaagcgagaactgccctc

SEQ ID NO: 31795 - DNA, 25 bp, Homo sapien
ggtttccacaaagccgagtcgtgtc

SEQ ID NO: 31796 - DNA, 25 bp, Homo sapien
gagcttcttagtgtactcctcgaga

SEQ ID NO: 31797 - DNA, 25 bp, Homo sapien
cgtttattctgagcaccgggaaggg

SEQ ID NO: 31798 - DNA, 25 bp, Homo sapien
gcctcactgggtgttgagcttctta

SEQ ID NO: 31799 - DNA, 25 bp, Homo sapien
cagcttctcttgcagctcgtgcagc

SEQ ID NO: 31800 - DNA, 25 bp, Homo sapien
cgccgttctccttgagagcctcaag

SEQ ID NO: 31801 - DNA, 25 bp, Homo sapien
ttgaagctctccagcacgggcagca

SEQ ID NO: 31802 - DNA, 25 bp, Homo sapien
caggaagctgaccttgaagctctcc

SEQ ID NO: 31803 - DNA, 25 bp, Homo sapien
gtgtactcctcgagagcgctcagga

SEQ ID NO: 31804 - DNA, 25 bp, Homo sapien
cccgctcctgaaaaatgagatcatt

SEQ ID NO: 31805 - DNA, 25 bp, Homo sapien
gatacagcagcgttgccgcgtctca

SEQ ID NO: 31806 - DNA, 25 bp, Homo sapien
ttcgcccgattagcatggtctccgc

SEQ ID NO: 31807 - DNA, 25 bp, Homo sapien
tgcggtgttattgccctgttatctg

SEQ ID NO: 31808 - DNA, 25 bp, Homo sapien
ttgcaccgtggtgttctctgaggga

SEQ ID NO: 31809 - DNA, 25 bp, Homo sapien
tccattgttcccgaggcacttgctc

SEQ ID NO: 31810 - DNA, 25 bp, Homo sapien
gaggcacttgctcctgcgaccagca

SEQ ID NO: 31811 - DNA, 25 bp, Homo sapien
tcgctgtacacagatttgcaccgtg

SEQ ID NO: 31812 - DNA, 25 bp, Homo sapien
tgggctcggccaagctcaaccaatc

SEQ ID NO: 31813 - DNA, 25 bp, Homo sapien
ggaaggatcgcacactcaccaccat

SEQ ID NO: 31814 - DNA, 25 bp, Homo sapien
gcaagccgcagcagtaaatccctga

SEQ ID NO: 31815 - DNA, 25 bp, Homo sapien
cttcatcttgatttggtactggccc

SEQ ID NO: 31816 - DNA, 25 bp, Homo sapien
gtgtcctttgttgtaccagcagatc

SEQ ID NO: 31817 - DNA, 25 bp, Homo sapien
actcaccctgctgcaccggggagta

SEQ ID NO: 31818 - DNA, 25 bp, Homo sapien
cactgtgtcaatggcggacccgcac

SEQ ID NO: 31819 - DNA, 25 bp, Homo sapien
tcaccaccatcggagatgccggcgg

SEQ ID NO: 31820 - DNA, 25 bp, Homo sapien
cggaaggccacgacgtggaagtact

SEQ ID NO: 31821 - DNA, 25 bp, Homo sapien
agatgctggtggagatcatgtagcc

SEQ ID NO: 31822 - DNA, 25 bp, Homo sapien
cagatgctgaggacggactcgcagt

SEQ ID NO: 31823 - DNA, 25 bp, Homo sapien
cgtggaagtacttgaggatcttctc

SEQ ID NO: 31824 - DNA, 25 bp, Homo sapien
aagcctccgctccagatgctgagga

SEQ ID NO: 31825 - DNA, 25 bp, Homo sapien
ggatcttctcgaagcgggcctggct

SEQ ID NO: 31826 - DNA, 25 bp, Homo sapien
ggagatcatgtagcccaggaacgcc

SEQ ID NO: 31827 - DNA, 25 bp, Homo sapien
ggctgcggttgctgtagaagcctcc

SEQ ID NO: 31828 - DNA, 25 bp, Homo sapien
tgctgtagaaggggttcccgccgct

SEQ ID NO: 31829 - DNA, 25 bp, Homo sapien
agtgccggtctcctcctacagggac

SEQ ID NO: 31830 - DNA, 25 bp, Homo sapien
agatgtgcaggctctcgtagcgcgc

SEQ ID NO: 31831 - DNA, 25 bp, Homo sapien
cgtccgagatgtgcaggctctcgta

SEQ ID NO: 31832 - DNA, 25 bp, Homo sapien
acgtcgtccgagatgtgcaggctct

SEQ ID NO: 31833 - DNA, 25 bp, Homo sapien
ccgaacacgtcgtccgagatgtgca

SEQ ID NO: 31834 - DNA, 25 bp, Homo sapien
tcgccgaacacgtcgtccgagatgt

SEQ ID NO: 31835 - DNA, 25 bp, Homo sapien
ctgtccgggccggactcgccgaaca

SEQ ID NO: 31836 - DNA, 25 bp, Homo sapien
cgcttggatcttggcactgagaggc

SEQ ID NO: 31837 - DNA, 25 bp, Homo sapien
gagacctcgctgcacttcgcaatga

SEQ ID NO: 31838 - DNA, 25 bp, Homo sapien
caaggacgagttcatgaaggtgcgc

SEQ ID NO: 31839 - DNA, 25 bp, Homo sapien
aaaagtaggatgaacctgcccaagg

SEQ ID NO: 31840 - DNA, 25 bp, Homo sapien
agcctcctgcgttttctcgcttgga

SEQ ID NO: 31841 - DNA, 25 bp, Homo sapien
gccacatgagggcagcacggcctac

SEQ ID NO: 31842 - DNA, 25 bp, Homo sapien
cgcaatgagtcttttggcgtcaggt

SEQ ID NO: 31843 - DNA, 25 bp, Homo sapien
cgctctgcttcgacaaggacgagtt

SEQ ID NO: 31844 - DNA, 25 bp, Homo sapien
atcaggtctagatggaggttcttta

SEQ ID NO: 31845 - DNA, 25 bp, Homo sapien
cgacgagaagtaagtgaagcgcttt

SEQ ID NO: 31846 - DNA, 25 bp, Homo sapien
catgatcttcctggccatggggctc

SEQ ID NO: 31847 - DNA, 25 bp, Homo sapien
agaagtctctggagtccgtgcgagc

SEQ ID NO: 31848 - DNA, 25 bp, Homo sapien
cttctccttgtcctgcatgatcttc

SEQ ID NO: 31849 - DNA, 25 bp, Homo sapien
gggcccgtacttctcgcggatcttc

SEQ ID NO: 31850 - DNA, 25 bp, Homo sapien
tccatagtggattaccgcggtgccc

SEQ ID NO: 31851 - DNA, 25 bp, Homo sapien
caccaggcaccggtcgatgatctcg

SEQ ID NO: 31852 - DNA, 25 bp, Homo sapien
ttccaacagttgcttcagactcagg

SEQ ID NO: 31853 - DNA, 25 bp, Homo sapien
gccgcactcggcagagtactggtcc

SEQ ID NO: 31854 - DNA, 25 bp, Homo sapien
gtgccatcttccctcaaggcgcatg

SEQ ID NO: 31855 - DNA, 25 bp, Homo sapien
tacgaatcccaataagcccgcgcgg

SEQ ID NO: 31856 - DNA, 25 bp, Homo sapien
caagtcttccggtctggcgtctgac

SEQ ID NO: 31857 - DNA, 25 bp, Homo sapien
gacgtcttaccctccacagaatcgg

SEQ ID NO: 31858 - DNA, 25 bp, Homo sapien
atcggaagttctggactgcagttga

SEQ ID NO: 31859 - DNA, 25 bp, Homo sapien
caggagcatgctgtcagctcatttc

SEQ ID NO: 31860 - DNA, 25 bp, Homo sapien
gggctgttccaatctgctgtctaca

SEQ ID NO: 31861 - DNA, 25 bp, Homo sapien
tcaccatctctttgcggagcagcgc

SEQ ID NO: 31862 - DNA, 25 bp, Homo sapien
ccgggcataagaaagccgccctctg

SEQ ID NO: 31863 - DNA, 25 bp, Homo sapien
ccaccgggaaggtctgtttcactcg

SEQ ID NO: 31864 - DNA, 25 bp, Homo sapien
cgcaatcgcgttaatccgttgggcc

SEQ ID NO: 31865 - DNA, 25 bp, Homo sapien
ctcttcgtggtaggaaaacgcaatc

SEQ ID NO: 31866 - DNA, 25 bp, Homo sapien
gctgtctacactggcggcggacaaa

SEQ ID NO: 31867 - DNA, 25 bp, Homo sapien
gcagcagcccgctcaagctctttgg

SEQ ID NO: 31868 - DNA, 25 bp, Homo sapien
ggctctggctcacaaccggcaggac

SEQ ID NO: 31869 - DNA, 25 bp, Homo sapien
gcaggacgtcgagggcaggaggcct

SEQ ID NO: 31870 - DNA, 25 bp, Homo sapien
cacaaccggcaggacgtcgagggca

SEQ ID NO: 31871 - DNA, 25 bp, Homo sapien
ctcacaaccggcaggacgtcgaggg

SEQ ID NO: 31872 - DNA, 25 bp, Homo sapien
gctcacaaccggcaggacgtcgagg

SEQ ID NO: 31873 - DNA, 25 bp, Homo sapien
tctggctcacaaccggcaggacgtc

SEQ ID NO: 31874 - DNA, 25 bp, Homo sapien
ccgggcgcgctggccttctcagcac

SEQ ID NO: 31875 - DNA, 25 bp, Homo sapien
ctctggctcacaaccggcaggacgt

SEQ ID NO: 31876 - DNA, 25 bp, Homo sapien
taaaaggaacgtctccgcttgccgc

SEQ ID NO: 31877 - DNA, 25 bp, Homo sapien
tgcgctgccagcactttcttctgct

SEQ ID NO: 31878 - DNA, 25 bp, Homo sapien
ttgtatctgtttcatgccagcgtga

SEQ ID NO: 31879 - DNA, 25 bp, Homo sapien
cggagggaggcatgacttcaatatt

SEQ ID NO: 31880 - DNA, 25 bp, Homo sapien
tctttgtttggagcacgggagaacc

SEQ ID NO: 31881 - DNA, 25 bp, Homo sapien
ctggcgctacgactccggtctttag

SEQ ID NO: 31882 - DNA, 25 bp, Homo sapien
tcctcacccggggactagcagaagc

SEQ ID NO: 31883 - DNA, 25 bp, Homo sapien
ccagcgtgaaacttctgtaggcaga

SEQ ID NO: 31884 - DNA, 25 bp, Homo sapien
cccttgccgatggtgcggtcgatct

SEQ ID NO: 31885 - DNA, 25 bp, Homo sapien
actgcccggagccatggcaaccgtg

SEQ ID NO: 31886 - DNA, 25 bp, Homo sapien
gcggtcgatctcgtagtagccgata

SEQ ID NO: 31887 - DNA, 25 bp, Homo sapien
cgatctcgtagtagccgatacgggc

SEQ ID NO: 31888 - DNA, 25 bp, Homo sapien
cgccatcttgttgtgcagtgaaacc

SEQ ID NO: 31889 - DNA, 25 bp, Homo sapien
ggtcacgtgccgacgcgcgtcactg

SEQ ID NO: 31890 - DNA, 25 bp, Homo sapien
atggcaaccgtgacctcaccggcgg

SEQ ID NO: 31891 - DNA, 25 bp, Homo sapien
tgtgcagtgaaacctccggggccgc

SEQ ID NO: 31892 - DNA, 25 bp, Homo sapien
ctcaatcatcttagggcggtggcta

SEQ ID NO: 31893 - DNA, 25 bp, Homo sapien
acagacagcggctacgggtcctaca

SEQ ID NO: 31894 - DNA, 25 bp, Homo sapien
ggcgctggtgctgattcatcaccta

SEQ ID NO: 31895 - DNA, 25 bp, Homo sapien
tctctgtttcgggagcctatcatcc

SEQ ID NO: 31896 - DNA, 25 bp, Homo sapien
tgcgctcgcaccatcgcggtgcaga

SEQ ID NO: 31897 - DNA, 25 bp, Homo sapien
agaccacgcggacaagctcagcttg

SEQ ID NO: 31898 - DNA, 25 bp, Homo sapien
gttcccacaatgtctgcctgccttg

SEQ ID NO: 31899 - DNA, 25 bp, Homo sapien
ctcagcttgtacagcgagacagaca

SEQ ID NO: 31900 - DNA, 25 bp, Homo sapien
acccagggtttctgtgcggaagctt

SEQ ID NO: 31901 - DNA, 25 bp, Homo sapien
aaacagggctgtggttattttcgtg

SEQ ID NO: 31902 - DNA, 25 bp, Homo sapien
gcacgttggtcctttccgcactcgg

SEQ ID NO: 31903 - DNA, 25 bp, Homo sapien
aggcagatggcagactcagcagtca

SEQ ID NO: 31904 - DNA, 25 bp, Homo sapien
gcagtcacgtaagagaaccgaatta

SEQ ID NO: 31905 - DNA, 25 bp, Homo sapien
tttttatttcgaatgccgctgcggg

SEQ ID NO: 31906 - DNA, 25 bp, Homo sapien
gtggcctgggtggacaaaagccttc

SEQ ID NO: 31907 - DNA, 25 bp, Homo sapien
ctttttggggagcttttctgagcca

SEQ ID NO: 31908 - DNA, 25 bp, Homo sapien
tgcacttaacaggagaacccagcgg

SEQ ID NO: 31909 - DNA, 25 bp, Homo sapien
ctgcctggtaactcggtggtcgaca

SEQ ID NO: 31910 - DNA, 25 bp, Homo sapien
ggcacgggcagctctgcacttaaca

SEQ ID NO: 31911 - DNA, 25 bp, Homo sapien
gcaccgggaagattctgggcactca

SEQ ID NO: 31912 - DNA, 25 bp, Homo sapien
accgcagagcgaggcaaacccaacg

SEQ ID NO: 31913 - DNA, 25 bp, Homo sapien
ggggcgctcccaaagtcaactcttc

SEQ ID NO: 31914 - DNA, 25 bp, Homo sapien
tctctgctacagtctcggcaaaggc

SEQ ID NO: 31915 - DNA, 25 bp, Homo sapien
ggacgttgagcttcccacctgagcc

SEQ ID NO: 31916 - DNA, 25 bp, Homo sapien
tcacggtcatctccaggatgtccgc

SEQ ID NO: 31917 - DNA, 25 bp, Homo sapien
gccgcttctccatgaccggcttgga

SEQ ID NO: 31918 - DNA, 25 bp, Homo sapien
aggtccaggtcagctgcgacccaga

SEQ ID NO: 31919 - DNA, 25 bp, Homo sapien
ggctccgcaggtgtctcacggtcat

SEQ ID NO: 31920 - DNA, 25 bp, Homo sapien
ccgacttacctcttttctgagggcg

SEQ ID NO: 31921 - DNA, 25 bp, Homo sapien
tttgagctgagcgaggctctcgtta

SEQ ID NO: 31922 - DNA, 25 bp, Homo sapien
aggctctcgttaatacgcgctcggc

SEQ ID NO: 31923 - DNA, 25 bp, Homo sapien
tgtgaacccggctccgcattctttc

SEQ ID NO: 31924 - DNA, 25 bp, Homo sapien
tcccataagcaatccgaaggcattg

SEQ ID NO: 31925 - DNA, 25 bp, Homo sapien
ttcaaattggaaacctgcacccggc

SEQ ID NO: 31926 - DNA, 25 bp, Homo sapien
ttgctgagcggacagaaaactttcc

SEQ ID NO: 31927 - DNA, 25 bp, Homo sapien
ccgctcggtgtctctggaaaccatg

SEQ ID NO: 31928 - DNA, 25 bp, Homo sapien
ggacggcttccagtcttcaaattgg

SEQ ID NO: 31929 - DNA, 25 bp, Homo sapien
ccacgtacagaaagaggacggcttc

SEQ ID NO: 31930 - DNA, 25 bp, Homo sapien
ggattgctcactaaacgcggacggc

SEQ ID NO: 31931 - DNA, 25 bp, Homo sapien
tgggaacgatttcccagctcgctcg

SEQ ID NO: 31932 - DNA, 25 bp, Homo sapien
tcttatttctccgttggcccaacca

SEQ ID NO: 31933 - DNA, 25 bp, Homo sapien
tagggccgtcctgagcgaaagaacc

SEQ ID NO: 31934 - DNA, 25 bp, Homo sapien
ccttgctcctgcgacattgtggggt

SEQ ID NO: 31935 - DNA, 25 bp, Homo sapien
aggaatcaaccctcattctgccgcg

SEQ ID NO: 31936 - DNA, 25 bp, Homo sapien
aggagcaccaccacggcttagcaaa

SEQ ID NO: 31937 - DNA, 25 bp, Homo sapien
cggcttagcaaagaatcccagaccc

SEQ ID NO: 31938 - DNA, 25 bp, Homo sapien
gcaccatggagtcttccagttcatc

SEQ ID NO: 31939 - DNA, 25 bp, Homo sapien
gtggggtcagccgaggaatcaaccc

SEQ ID NO: 31940 - DNA, 25 bp, Homo sapien
tggtacatctcgctctccaggtagg

SEQ ID NO: 31941 - DNA, 25 bp, Homo sapien
agccggcatctcctaggagctagtc

SEQ ID NO: 31942 - DNA, 25 bp, Homo sapien
gggtaagctccgttctcgttctcaa

SEQ ID NO: 31943 - DNA, 25 bp, Homo sapien
cgcccactaggaggtgtcatgctga

SEQ ID NO: 31944 - DNA, 25 bp, Homo sapien
cctgaaagcttcgtagggcccgagc

SEQ ID NO: 31945 - DNA, 25 bp, Homo sapien
cctgcgcagcaatgccatcggttaa

SEQ ID NO: 31946 - DNA, 25 bp, Homo sapien
gggtctcacgcactcactgtcacta

SEQ ID NO: 31947 - DNA, 25 bp, Homo sapien
gggccgtctctatgaactgccggta

SEQ ID NO: 31948 - DNA, 25 bp, Homo sapien
cgccttctcctggaacagcgatgag

SEQ ID NO: 31949 - DNA, 25 bp, Homo sapien
agcgcagggcatacgggcgccactc

SEQ ID NO: 31950 - DNA, 25 bp, Homo sapien
cgaatggcaacctgggctcaggcgc

SEQ ID NO: 31951 - DNA, 25 bp, Homo sapien
tgcggcgaatggcaacctgggctca

SEQ ID NO: 31952 - DNA, 25 bp, Homo sapien
gacgctggtgctccttgcagcagta

SEQ ID NO: 31953 - DNA, 25 bp, Homo sapien
tctcctggaacagcgatgagcgggc

SEQ ID NO: 31954 - DNA, 25 bp, Homo sapien
tacaggttcgccttctcctggaaca

SEQ ID NO: 31955 - DNA, 25 bp, Homo sapien
gaatgctggtgtgggcccactccgt

SEQ ID NO: 31956 - DNA, 25 bp, Homo sapien
tccaggaggacgcatcgtcttttta

SEQ ID NO: 31957 - DNA, 25 bp, Homo sapien
caccgtaggctgtgacgacatgagc

SEQ ID NO: 31958 - DNA, 25 bp, Homo sapien
tctgcaggctgttttcccaggttcc

SEQ ID NO: 31959 - DNA, 25 bp, Homo sapien
ggcccggctgcaaagcgtttttctg

SEQ ID NO: 31960 - DNA, 25 bp, Homo sapien
agacttccggccactgcgttgtagt

SEQ ID NO: 31961 - DNA, 25 bp, Homo sapien
cagtgcatgctgtgaggcttgtaga

SEQ ID NO: 31962 - DNA, 25 bp, Homo sapien
cgagggctcgcttctttctcacatc

SEQ ID NO: 31963 - DNA, 25 bp, Homo sapien
tcacacagatctcaggtccaggagg

SEQ ID NO: 31964 - DNA, 25 bp, Homo sapien
aggtccctgacccaggactgtgcag

SEQ ID NO: 31965 - DNA, 25 bp, Homo sapien
tggaaaggaaacagcggactcgctg

SEQ ID NO: 31966 - DNA, 25 bp, Homo sapien
tgccacagagtcctagcacgtcctg

SEQ ID NO: 31967 - DNA, 25 bp, Homo sapien
cgagtcttgggctgccagcccggca

SEQ ID NO: 31968 - DNA, 25 bp, Homo sapien
tgacccaggactgtgcagcgatccc

SEQ ID NO: 31969 - DNA, 25 bp, Homo sapien
gacccgcagtttgcgaaactgtagg

SEQ ID NO: 31970 - DNA, 25 bp, Homo sapien
aaactgtaggagtctgacccgcgcc

SEQ ID NO: 31971 - DNA, 25 bp, Homo sapien
tcagggcgtgcctctgttaacaacc

SEQ ID NO: 31972 - DNA, 25 bp, Homo sapien
tcagccgatcgataacttggagaga

SEQ ID NO: 31973 - DNA, 25 bp, Homo sapien
tcgccgagacgggaataacctttca

SEQ ID NO: 31974 - DNA, 25 bp, Homo sapien
aaccgcgagtctggttctgagccgc

SEQ ID NO: 31975 - DNA, 25 bp, Homo sapien
cgccgtccttgtcgagactcgcttt

SEQ ID NO: 31976 - DNA, 25 bp, Homo sapien
ggcttctagagagccgtcgccgtcc

SEQ ID NO: 31977 - DNA, 25 bp, Homo sapien
cggaacctgctacagcctgtgcgcg

SEQ ID NO: 31978 - DNA, 25 bp, Homo sapien
ggcgcatctgcgtctacaagccgga

SEQ ID NO: 31979 - DNA, 25 bp, Homo sapien
aagttctgggcacctggagaagacc

SEQ ID NO: 31980 - DNA, 25 bp, Homo sapien
ccacgctgttggtttaccctcctga

SEQ ID NO: 31981 - DNA, 25 bp, Homo sapien
gcttgccaccttgctgctgcagctg

SEQ ID NO: 31982 - DNA, 25 bp, Homo sapien
gagcgcttccgcaaatctcgcgaga

SEQ ID NO: 31983 - DNA, 25 bp, Homo sapien
tcgcgagatagcaggcagcgatgcc

SEQ ID NO: 31984 - DNA, 25 bp, Homo sapien
cagcgatgccttttgctccggtttc

SEQ ID NO: 31985 - DNA, 25 bp, Homo sapien
tgcgacatttcgctggccaccgcag

SEQ ID NO: 31986 - DNA, 25 bp, Homo sapien
ttcagcttctcgtttgcggagcccg

SEQ ID NO: 31987 - DNA, 25 bp, Homo sapien
ccctgcataatcgagtgggcgagcg

SEQ ID NO: 31988 - DNA, 25 bp, Homo sapien
attccataccgaaagctggcgtttc

SEQ ID NO: 31989 - DNA, 25 bp, Homo sapien
agagaagcccatgtccctcagacgc

SEQ ID NO: 31990 - DNA, 25 bp, Homo sapien
ggacttccggaagccatttggctga

SEQ ID NO: 31991 - DNA, 25 bp, Homo sapien
gcacggaccctctacttcagtgagt

SEQ ID NO: 31992 - DNA, 25 bp, Homo sapien
ttcagtgagtgcatccagggtcgca

SEQ ID NO: 31993 - DNA, 25 bp, Homo sapien
tgttattgtgagaggcccgcgacct

SEQ ID NO: 31994 - DNA, 25 bp, Homo sapien
gctctgagagccctttcccgatatt

SEQ ID NO: 31995 - DNA, 25 bp, Homo sapien
ggcgcagctagttttcgctctgaga

SEQ ID NO: 31996 - DNA, 25 bp, Homo sapien
gtacaacccgctccgcctataggaa

SEQ ID NO: 31997 - DNA, 25 bp, Homo sapien
cgccaatgccgagggctgaatgcgc

SEQ ID NO: 31998 - DNA, 25 bp, Homo sapien
cacaggcgccaatgccgagggctga

SEQ ID NO: 31999 - DNA, 25 bp, Homo sapien
cgcctataggaactgccgcggcaca

SEQ ID NO: 32000 - DNA, 25 bp, Homo sapien
tccggacctgacctgaattgcgacc

SEQ ID NO: 32001 - DNA, 25 bp, Homo sapien
agtatggcccggcacgtgttcctaa

SEQ ID NO: 32002 - DNA, 25 bp, Homo sapien
tcctgagtcgcgaccctggtccgga

SEQ ID NO: 32003 - DNA, 25 bp, Homo sapien
tgcttccggtcaaagcaccgcttgg

SEQ ID NO: 32004 - DNA, 25 bp, Homo sapien
gctcacggacactcaggtggccggt

SEQ ID NO: 32005 - DNA, 25 bp, Homo sapien
agcccaggctggacctgatgagcgc

SEQ ID NO: 32006 - DNA, 25 bp, Homo sapien
tggacctgatgagcgcctcggcccg

SEQ ID NO: 32007 - DNA, 25 bp, Homo sapien
cgcagcagagagtccggaaatgacg

SEQ ID NO: 32008 - DNA, 25 bp, Homo sapien
tccggaaatgacgagcgcgctggaa

SEQ ID NO: 32009 - DNA, 25 bp, Homo sapien
agcgcgctggaaaagctcctcttgc

SEQ ID NO: 32010 - DNA, 25 bp, Homo sapien
ctggaaaagctcctcttgccgaaga

SEQ ID NO: 32011 - DNA, 25 bp, Homo sapien
cctcttgccgaagaggaagctcagg

SEQ ID NO: 32012 - DNA, 25 bp, Homo sapien
gaaggattttcccatcgtgctcaga

SEQ ID NO: 32013 - DNA, 25 bp, Homo sapien
ggattttcccatcgtgctcagaggc

SEQ ID NO: 32014 - DNA, 25 bp, Homo sapien
ctgctcagaggttgcttccgaggct

SEQ ID NO: 32015 - DNA, 25 bp, Homo sapien
catgtccgagggaggaaggattttc

SEQ ID NO: 32016 - DNA, 25 bp, Homo sapien
tcagaggttgcttccgaggctcctc

SEQ ID NO: 32017 - DNA, 25 bp, Homo sapien
tttgaagctggagctgctcttccgc

SEQ ID NO: 32018 - DNA, 25 bp, Homo sapien
cccacgtttgaagctggagctgctc

SEQ ID NO: 32019 - DNA, 25 bp, Homo sapien
agcacctgggacaccatgccggctg

SEQ ID NO: 32020 - DNA, 25 bp, Homo sapien
ccagcagacttcgagctccgagagt

SEQ ID NO: 32021 - DNA, 25 bp, Homo sapien
acgctgcgttgtctcctttaggtga

SEQ ID NO: 32022 - DNA, 25 bp, Homo sapien
tcagaaagcatcagaggtcctcgtg

SEQ ID NO: 32023 - DNA, 25 bp, Homo sapien
acggccatttatcttgtgttcaatc

SEQ ID NO: 32024 - DNA, 25 bp, Homo sapien
agcgatcgcgcctgagtatgattga

SEQ ID NO: 32025 - DNA, 25 bp, Homo sapien
cggccagagagagcgttcaaatgtc

SEQ ID NO: 32026 - DNA, 25 bp, Homo sapien
tgaagacattccgatcccagcagac

SEQ ID NO: 32027 - DNA, 25 bp, Homo sapien
ttatcctgcagctcgcctgatgcga

SEQ ID NO: 32028 - DNA, 25 bp, Homo sapien
aggctggaccctttgggcagctagc

SEQ ID NO: 32029 - DNA, 25 bp, Homo sapien
agctagcccgtgatctctgccgtca

SEQ ID NO: 32030 - DNA, 25 bp, Homo sapien
gggccgcgctctatgactacgaggc

SEQ ID NO: 32031 - DNA, 25 bp, Homo sapien
tctatgactacgaggctcgcggcga

SEQ ID NO: 32032 - DNA, 25 bp, Homo sapien
tacacgtcgccttcgagcggctgga

SEQ ID NO: 32033 - DNA, 25 bp, Homo sapien
ttcgggcaggtgtaccgcgccacct

SEQ ID NO: 32034 - DNA, 25 bp, Homo sapien
ccaacatcatcgagctgcgcggcgt

SEQ ID NO: 32035 - DNA, 25 bp, Homo sapien
atctctgccgtcaccgatcgcgatt

SEQ ID NO: 32036 - DNA, 25 bp, Homo sapien
attccggtgggtgtgaatctgtgtc

SEQ ID NO: 32037 - DNA, 25 bp, Homo sapien
aggagctgctaaagcggcgtgagca

SEQ ID NO: 32038 - DNA, 25 bp, Homo sapien
ctctgcagcagaagtctcaggagga

SEQ ID NO: 32039 - DNA, 25 bp, Homo sapien
tgtgaatctgtgtcgcaggagctgc

SEQ ID NO: 32040 - DNA, 25 bp, Homo sapien
cttcctgctgggaatgattccggtg

SEQ ID NO: 32041 - DNA, 25 bp, Homo sapien
tagtgtaatagacggaattcccttc

SEQ ID NO: 32042 - DNA, 25 bp, Homo sapien
gggtcgccagtgtagtgtaatagac

SEQ ID NO: 32043 - DNA, 25 bp, Homo sapien
tctgtgtcgcaggagctgcgatccc

SEQ ID NO: 32044 - DNA, 25 bp, Homo sapien
ctcagcaacgcctcgggcaactgga

SEQ ID NO: 32045 - DNA, 25 bp, Homo sapien
tagagtttggctactggacccagga

SEQ ID NO: 32046 - DNA, 25 bp, Homo sapien
ctccgctgactctcgggttacctga

SEQ ID NO: 32047 - DNA, 25 bp, Homo sapien
cgccacatcatctgggctttttata

SEQ ID NO: 32048 - DNA, 25 bp, Homo sapien
gggctacttgctctacctggtcttc

SEQ ID NO: 32049 - DNA, 25 bp, Homo sapien
agcacgagtgcctgtctgagcagca

SEQ ID NO: 32050 - DNA, 25 bp, Homo sapien
tggaactgggacttcacctccgcgc

SEQ ID NO: 32051 - DNA, 25 bp, Homo sapien
agcgacgcttcttggaggagcacga

SEQ ID NO: 32052 - DNA, 25 bp, Homo sapien
aagagcattgccgtgtgagtagcgc

SEQ ID NO: 32053 - DNA, 25 bp, Homo sapien
ctcgggaagtttcagtcattctttc

SEQ ID NO: 32054 - DNA, 25 bp, Homo sapien
gagactcacgcctgcggtgtgctag

SEQ ID NO: 32055 - DNA, 25 bp, Homo sapien
ctctgtctttgcctatggggattcg

SEQ ID NO: 32056 - DNA, 25 bp, Homo sapien
attcgagagtttcccagcggcgcac

SEQ ID NO: 32057 - DNA, 25 bp, Homo sapien
cgcacccaggggcaagagcattgcc

SEQ ID NO: 32058 - DNA, 25 bp, Homo sapien
tagccctttgcagctgggacactgg

SEQ ID NO: 32059 - DNA, 25 bp, Homo sapien
gctccggcagctcaagtacttggtg

SEQ ID NO: 32060 - DNA, 25 bp, Homo sapien
gtccctgcaccctagccggggaatg

SEQ ID NO: 32061 - DNA, 25 bp, Homo sapien
tagccggggaatgctgccaccctga

SEQ ID NO: 32062 - DNA, 25 bp, Homo sapien
agcgcctgcaacagtccggtcctga

SEQ ID NO: 32063 - DNA, 25 bp, Homo sapien
gcggccggctcatcatgaagaagca

SEQ ID NO: 32064 - DNA, 25 bp, Homo sapien
cgcagtgagcaacgcggcaaccgga

SEQ ID NO: 32065 - DNA, 25 bp, Homo sapien
agcaacctccaagtaggaggctgtg

SEQ ID NO: 32066 - DNA, 25 bp, Homo sapien
cgtgacgttggagtttgcagcaacc

SEQ ID NO: 32067 - DNA, 25 bp, Homo sapien
agcagggagtgcacttgtacgtgac

SEQ ID NO: 32068 - DNA, 25 bp, Homo sapien
tggggcacgtctgcaagtccacaga

SEQ ID NO: 32069 - DNA, 25 bp, Homo sapien
cttcaggaagttcgacgcgcccttc

SEQ ID NO: 32070 - DNA, 25 bp, Homo sapien
cgtggtttgccaccaactggaactt

SEQ ID NO: 32071 - DNA, 25 bp, Homo sapien
agctcgccaagctgaccttcaggaa

SEQ ID NO: 32072 - DNA, 25 bp, Homo sapien
cccgggcgcaactcaagaagatctt

SEQ ID NO: 32073 - DNA, 25 bp, Homo sapien
ctgtgaagcagcgatacaggtaggc

SEQ ID NO: 32074 - DNA, 25 bp, Homo sapien
tccacagagaagcagtctgtgaagc

SEQ ID NO: 32075 - DNA, 25 bp, Homo sapien
tcttcccgttgtactacgtggggca

SEQ ID NO: 32076 - DNA, 25 bp, Homo sapien
cagcggcgcagctcacttttcagtg

SEQ ID NO: 32077 - DNA, 25 bp, Homo sapien
aacagcgagctggtcaacatctaca

SEQ ID NO: 32078 - DNA, 25 bp, Homo sapien
agtttgagcgcacctacgtggacga

SEQ ID NO: 32079 - DNA, 25 bp, Homo sapien
tggggcccaagaacgtctcgcagaa

SEQ ID NO: 32080 - DNA, 25 bp, Homo sapien
catttcctaatctcaggccggggtt

SEQ ID NO: 32081 - DNA, 25 bp, Homo sapien
ggcgtcgggtagctaccacctatca

SEQ ID NO: 32082 - DNA, 25 bp, Homo sapien
cttttcagtgttcgtgcgtcgggac

SEQ ID NO: 32083 - DNA, 25 bp, Homo sapien
agcagccctgctgtttatcgcccag

SEQ ID NO: 32084 - DNA, 25 bp, Homo sapien
atgccggaccggcattgctttacgg

SEQ ID NO: 32085 - DNA, 25 bp, Homo sapien
tgccggaccggcattgctttacggg

SEQ ID NO: 32086 - DNA, 25 bp, Homo sapien
cgccgatgccggaccggcattgctt

SEQ ID NO: 32087 - DNA, 25 bp, Homo sapien
gccggaccggcattgctttacgggc

SEQ ID NO: 32088 - DNA, 25 bp, Homo sapien
gccgatgccggaccggcattgcttt

SEQ ID NO: 32089 - DNA, 25 bp, Homo sapien
ccggaccggcattgctttacgggct

SEQ ID NO: 32090 - DNA, 25 bp, Homo sapien
cggaccggcattgctttacgggctt

SEQ ID NO: 32091 - DNA, 25 bp, Homo sapien
ggaccggcattgctttacgggcttg

SEQ ID NO: 32092 - DNA, 25 bp, Homo sapien
gtcccgcgggactagcatatcaagc

SEQ ID NO: 32093 - DNA, 25 bp, Homo sapien
gccggaagtcggtcttacagataaa

SEQ ID NO: 32094 - DNA, 25 bp, Homo sapien
ctcttgcccttgaaggccggaagtc

SEQ ID NO: 32095 - DNA, 25 bp, Homo sapien
ccgggacacaccgtgcgatgatata

SEQ ID NO: 32096 - DNA, 25 bp, Homo sapien
tagctcggaagggtcaaaagagtcc

SEQ ID NO: 32097 - DNA, 25 bp, Homo sapien
ggaggtctacgcttctagagcttga

SEQ ID NO: 32098 - DNA, 25 bp, Homo sapien
gcgtgacagtttcctcccgtcgaca

SEQ ID NO: 32099 - DNA, 25 bp, Homo sapien
tcgacatcgaaaggaagccggacgt

SEQ ID NO: 32100 - DNA, 25 bp, Homo sapien
gacggctgctagcacttccacggca

SEQ ID NO: 32101 - DNA, 25 bp, Homo sapien
gcctgcaccgtcctccagaagcgcc

SEQ ID NO: 32102 - DNA, 25 bp, Homo sapien
tcgcggggccgcaaacatggcccga

SEQ ID NO: 32103 - DNA, 25 bp, Homo sapien
cattggaccagcactggcagcagtc

SEQ ID NO: 32104 - DNA, 25 bp, Homo sapien
agtggcacgaggtaccctgcagcca

SEQ ID NO: 32105 - DNA, 25 bp, Homo sapien
cagcttctcctctacgcggccggac

SEQ ID NO: 32106 - DNA, 25 bp, Homo sapien
agggcgctcaggaccagcagcttct

SEQ ID NO: 32107 - DNA, 25 bp, Homo sapien
gagcacccactccatttgccgagcg

SEQ ID NO: 32108 - DNA, 25 bp, Homo sapien
ccacggctgctgctgacgcgcgttt

SEQ ID NO: 32109 - DNA, 25 bp, Homo sapien
ttctagaatagaggcgcggcgcaag

SEQ ID NO: 32110 - DNA, 25 bp, Homo sapien
cagcccgggaaaagttctagaatag

SEQ ID NO: 32111 - DNA, 25 bp, Homo sapien
ccctctaattatagcccggcagctg

SEQ ID NO: 32112 - DNA, 25 bp, Homo sapien
atttggttcaccacgcggtctctgc

SEQ ID NO: 32113 - DNA, 25 bp, Homo sapien
agcaggagccagaccttttacttta

SEQ ID NO: 32114 - DNA, 25 bp, Homo sapien
ttgatcttttctgggccaccgaggg

SEQ ID NO: 32115 - DNA, 25 bp, Homo sapien
gctgacgcgcgtttgatcttttctg

SEQ ID NO: 32116 - DNA, 25 bp, Homo sapien
tcctgccggcgcttagaaatattta

SEQ ID NO: 32117 - DNA, 25 bp, Homo sapien
ttccacggtggccacctgacagata

SEQ ID NO: 32118 - DNA, 25 bp, Homo sapien
cgtttctgcggagggctttgttcca

SEQ ID NO: 32119 - DNA, 25 bp, Homo sapien
tgagggaacgcgctctcctcacggc

SEQ ID NO: 32120 - DNA, 25 bp, Homo sapien
tgactttgtggtgtgtttatcccgg

SEQ ID NO: 32121 - DNA, 25 bp, Homo sapien
gtatcaccatgtccgcgtggtgcca

SEQ ID NO: 32122 - DNA, 25 bp, Homo sapien
cttgttttccttgcgagttcgggca

SEQ ID NO: 32123 - DNA, 25 bp, Homo sapien
aggatctcgcctgaccttgttttcc

SEQ ID NO: 32124 - DNA, 25 bp, Homo sapien
ccgcgcaaagtgatcgagtgctttt

SEQ ID NO: 32125 - DNA, 25 bp, Homo sapien
gtcacacaggtagcacgactgccgc

SEQ ID NO: 32126 - DNA, 25 bp, Homo sapien
gaccgctccacttctacagacttga

SEQ ID NO: 32127 - DNA, 25 bp, Homo sapien
ctacagacttgattcttcgacagtc

SEQ ID NO: 32128 - DNA, 25 bp, Homo sapien
attcttcgacagtctcgcacggcgc

SEQ ID NO: 32129 - DNA, 25 bp, Homo sapien
tcccttcggaacaccgcgcaaagtg

SEQ ID NO: 32130 - DNA, 25 bp, Homo sapien
gtgatcgagtgcttttcctccactt

SEQ ID NO: 32131 - DNA, 25 bp, Homo sapien
cagcgccggtgttcccttcggaaca

SEQ ID NO: 32132 - DNA, 25 bp, Homo sapien
gtcgaagtagatgcagtacccaatg

SEQ ID NO: 32133 - DNA, 25 bp, Homo sapien
atcttctctacaacgctgagcgtgg

SEQ ID NO: 32134 - DNA, 25 bp, Homo sapien
gcagccagcgccatcgcctattgag

SEQ ID NO: 32135 - DNA, 25 bp, Homo sapien
cacgttctcgaagcctgttcttgaa

SEQ ID NO: 32136 - DNA, 25 bp, Homo sapien
cacttccggtcccagtcaactaagg

SEQ ID NO: 32137 - DNA, 25 bp, Homo sapien
tggggtcacttcgtcttttgcggtc

SEQ ID NO: 32138 - DNA, 25 bp, Homo sapien
tcgggaatttgcacgtgaccacgga

SEQ ID NO: 32139 - DNA, 25 bp, Homo sapien
tatccgccgaccatgctgtaacgag

SEQ ID NO: 32140 - DNA, 25 bp, Homo sapien
cgccgtcgtcaggattctctctaga

SEQ ID NO: 32141 - DNA, 25 bp, Homo sapien
ctctagaaatggacgacagaaactc

SEQ ID NO: 32142 - DNA, 25 bp, Homo sapien
cttcgccagcacgagggaacgtaca

SEQ ID NO: 32143 - DNA, 25 bp, Homo sapien
aagactcccagactgcagctgcgcg

SEQ ID NO: 32144 - DNA, 25 bp, Homo sapien
tccaaggccattcttactccaaaga

SEQ ID NO: 32145 - DNA, 25 bp, Homo sapien
ccggtgccacctctggaatggtgtt

SEQ ID NO: 32146 - DNA, 25 bp, Homo sapien
tgttcgccgcgaaataagctactgg

SEQ ID NO: 32147 - DNA, 25 bp, Homo sapien
gcgacctgtccaagcctgtagtctt

SEQ ID NO: 32148 - DNA, 25 bp, Homo sapien
cacgcggtacagacggagcaaatcc

SEQ ID NO: 32149 - DNA, 25 bp, Homo sapien
ggagcattttcatttcgctatgatg

SEQ ID NO: 32150 - DNA, 25 bp, Homo sapien
cgctatgatgatcgctgtaattggc

SEQ ID NO: 32151 - DNA, 25 bp, Homo sapien
gtaattggcagaatcacagtcgcgc

SEQ ID NO: 32152 - DNA, 25 bp, Homo sapien
tgctgctgccctgatgaaaacgctc

SEQ ID NO: 32153 - DNA, 25 bp, Homo sapien
agcaaatcctatgaacttctccagc

SEQ ID NO: 32154 - DNA, 25 bp, Homo sapien
tctccagcccagtttagaacaaggg

SEQ ID NO: 32155 - DNA, 25 bp, Homo sapien
gcacggcgcggacgcaccctaggat

SEQ ID NO: 32156 - DNA, 25 bp, Homo sapien
ccgctgggtgtcagttcggacactg

SEQ ID NO: 32157 - DNA, 25 bp, Homo sapien
atgaagacctcaggcgaccgaccgc

SEQ ID NO: 32158 - DNA, 25 bp, Homo sapien
cttcacaggaaacacggaggccggg

SEQ ID NO: 32159 - DNA, 25 bp, Homo sapien
ggtctccgtcctccttcacaggaaa

SEQ ID NO: 32160 - DNA, 25 bp, Homo sapien
atggacgactccgagctgaagtgca

SEQ ID NO: 32161 - DNA, 25 bp, Homo sapien
agggcccagctgtgcatggacgact

SEQ ID NO: 32162 - DNA, 25 bp, Homo sapien
gtcagcacccttctccgctgggtgt

SEQ ID NO: 32163 - DNA, 25 bp, Homo sapien
acgcagagatggaaagatggccgca

SEQ ID NO: 32164 - DNA, 25 bp, Homo sapien
tcggggcatcttccacatggtccct

SEQ ID NO: 32165 - DNA, 25 bp, Homo sapien
tggcgtcctctgtaaagggcatttc

SEQ ID NO: 32166 - DNA, 25 bp, Homo sapien
cgacctttaaaagccactcgttgct

SEQ ID NO: 32167 - DNA, 25 bp, Homo sapien
cgactgtccctgtaatcttcccaga

SEQ ID NO: 32168 - DNA, 25 bp, Homo sapien
taatcttcccagaggggatcctgcc

SEQ ID NO: 32169 - DNA, 25 bp, Homo sapien
gtccacttgtatctcaggggtctcc

SEQ ID NO: 32170 - DNA, 25 bp, Homo sapien
agaaggctctccttcatggcgtcct

SEQ ID NO: 32171 - DNA, 25 bp, Homo sapien
cacatggtccctcttcagaaggctc

SEQ ID NO: 32172 - DNA, 25 bp, Homo sapien
acgccattttcccaccagttctatg

SEQ ID NO: 32173 - DNA, 25 bp, Homo sapien
cccgacaagtgggagcgagatcaac

SEQ ID NO: 32174 - DNA, 25 bp, Homo sapien
tcgactgacgggcaaacatcgcttc

SEQ ID NO: 32175 - DNA, 25 bp, Homo sapien
cctctttcccggatggcctcttaga

SEQ ID NO: 32176 - DNA, 25 bp, Homo sapien
tggcctcttagacgaccttggattg

SEQ ID NO: 32177 - DNA, 25 bp, Homo sapien
tggtccctggatacaaacaacgacg

SEQ ID NO: 32178 - DNA, 25 bp, Homo sapien
cggcaagatgaagctcaagagtctc

SEQ ID NO: 32179 - DNA, 25 bp, Homo sapien
atacactgttcctattggtccctgg

SEQ ID NO: 32180 - DNA, 25 bp, Homo sapien
tccgagtggctcttgtgtgaaatca

SEQ ID NO: 32181 - DNA, 25 bp, Homo sapien
agcagcaccagccagtttcgcattg

SEQ ID NO: 32182 - DNA, 25 bp, Homo sapien
ttcccatgagcctaagcacgcgctt

SEQ ID NO: 32183 - DNA, 25 bp, Homo sapien
ttgcccggttctgtgctctgggaac

SEQ ID NO: 32184 - DNA, 25 bp, Homo sapien
gcggtgactcatcagggattagctc

SEQ ID NO: 32185 - DNA, 25 bp, Homo sapien
tgtgaaatcacgcagagctcctctg

SEQ ID NO: 32186 - DNA, 25 bp, Homo sapien
aatgcgctttgcctcagatttgaag

SEQ ID NO: 32187 - DNA, 25 bp, Homo sapien
ctgacgtctccttggcccgtagagt

SEQ ID NO: 32188 - DNA, 25 bp, Homo sapien
taagctgccgcggttactgtgaagc

SEQ ID NO: 32189 - DNA, 25 bp, Homo sapien
tgcctgcgttttcgtagccctagag

SEQ ID NO: 32190 - DNA, 25 bp, Homo sapien
cccacgcacggaaggatgatacact

SEQ ID NO: 32191 - DNA, 25 bp, Homo sapien
ttcacagctaaccacagcggtccga

SEQ ID NO: 32192 - DNA, 25 bp, Homo sapien
agaccgcaggggcatttcacagcta

SEQ ID NO: 32193 - DNA, 25 bp, Homo sapien
gccctagagcttccaacgtacagtg

SEQ ID NO: 32194 - DNA, 25 bp, Homo sapien
cctgcagcaagagacgggtgctaac

SEQ ID NO: 32195 - DNA, 25 bp, Homo sapien
ggtgctaacagcgtccgagccaatc

SEQ ID NO: 32196 - DNA, 25 bp, Homo sapien
agggcttcctcaggcactcgccaga

SEQ ID NO: 32197 - DNA, 25 bp, Homo sapien
cccgctgggaaaacagcaaacgctc

SEQ ID NO: 32198 - DNA, 25 bp, Homo sapien
cgctctgtgacctacaaatggaaga

SEQ ID NO: 32199 - DNA, 25 bp, Homo sapien
cacaggtctttgtgtcgcgtgcagc

SEQ ID NO: 32200 - DNA, 25 bp, Homo sapien
agagccgtctccctaggtccggaga

SEQ ID NO: 32201 - DNA, 25 bp, Homo sapien
cacttacccggagcgggatcacgcg

SEQ ID NO: 32202 - DNA, 25 bp, Homo sapien
atctcctgccactgaggtccttttc

SEQ ID NO: 32203 - DNA, 25 bp, Homo sapien
cgacgtcactgctgcgtcaccgggg

SEQ ID NO: 32204 - DNA, 25 bp, Homo sapien
tctaaaaccgtgagcgcaccggcca

SEQ ID NO: 32205 - DNA, 25 bp, Homo sapien
atgctctgaggagtgttcccgtgga

SEQ ID NO: 32206 - DNA, 25 bp, Homo sapien
tgcagagaaacccatgggcctcggc

SEQ ID NO: 32207 - DNA, 25 bp, Homo sapien
ggagtcacagcacaggcttcccatg

SEQ ID NO: 32208 - DNA, 25 bp, Homo sapien
ggcaccgtgacatcagccctagacg

SEQ ID NO: 32209 - DNA, 25 bp, Homo sapien
cctagacgtttttagcccaagaatg

SEQ ID NO: 32210 - DNA, 25 bp, Homo sapien
gcccaagaatgccatgaaatcctgc

SEQ ID NO: 32211 - DNA, 25 bp, Homo sapien
cgcaccggccagtggatgctctgag

SEQ ID NO: 32212 - DNA, 25 bp, Homo sapien
gcgcttgttgctcagatccctggcc

SEQ ID NO: 32213 - DNA, 25 bp, Homo sapien
cggagatcacaaaggcccgtaaaca

SEQ ID NO: 32214 - DNA, 25 bp, Homo sapien
cccaagggccagattggatgcgaac

SEQ ID NO: 32215 - DNA, 25 bp, Homo sapien
ttggaccttgccctacacacacgtg

SEQ ID NO: 32216 - DNA, 25 bp, Homo sapien
ccacaaaggacacagggcgcgcttg

SEQ ID NO: 32217 - DNA, 25 bp, Homo sapien
aatatttcgggaagatctgggcgcc

SEQ ID NO: 32218 - DNA, 25 bp, Homo sapien
acacgtgtaccttctcggagcccaa

SEQ ID NO: 32219 - DNA, 25 bp, Homo sapien
attggatgcgaacgcggagatcaca

SEQ ID NO: 32220 - DNA, 25 bp, Homo sapien
tcgtcaacctgacagcttgggccca

SEQ ID NO: 32221 - DNA, 25 bp, Homo sapien
tgcagcggcacaggatcaaaaaata

SEQ ID NO: 32222 - DNA, 25 bp, Homo sapien
cgctgcgaaataaagttagtgccca

SEQ ID NO: 32223 - DNA, 25 bp, Homo sapien
gtggcgcggaaaccgtcaactccca

SEQ ID NO: 32224 - DNA, 25 bp, Homo sapien
cctttacctggtttgtggcagctgc

SEQ ID NO: 32225 - DNA, 25 bp, Homo sapien
gtgcgagcaccgtttgagaagcacc

SEQ ID NO: 32226 - DNA, 25 bp, Homo sapien
acgcgtggaactgccgagccaatag

SEQ ID NO: 32227 - DNA, 25 bp, Homo sapien
cgcgagaagtcccagagcccagaag

SEQ ID NO: 32228 - DNA, 25 bp, Homo sapien
tccacctctatcagagaaacaggca

SEQ ID NO: 32229 - DNA, 25 bp, Homo sapien
gatccacgcaccagcagtagccggt

SEQ ID NO: 32230 - DNA, 25 bp, Homo sapien
gcgtagtgcccgtgcgcatcgcact

SEQ ID NO: 32231 - DNA, 25 bp, Homo sapien
tgcgcatcgcactcaggaacgaaca

SEQ ID NO: 32232 - DNA, 25 bp, Homo sapien
agaatgtgttctcgctcgtgctggc

SEQ ID NO: 32233 - DNA, 25 bp, Homo sapien
caggcaacaagaaagctgtcaggtg

SEQ ID NO: 32234 - DNA, 25 bp, Homo sapien
ccgggttttctccacctctatcaga

SEQ ID NO: 32235 - DNA, 25 bp, Homo sapien
aaagctgtcaggtgcgtcatccgtc

SEQ ID NO: 32236 - DNA, 25 bp, Homo sapien
ccggtgcctgcgattctcgaaacca

SEQ ID NO: 32237 - DNA, 25 bp, Homo sapien
ctgctcgaggccaacatgttcccga

SEQ ID NO: 32238 - DNA, 25 bp, Homo sapien
ggggctcactcacgtagactgcgtc

SEQ ID NO: 32239 - DNA, 25 bp, Homo sapien
tcgatgtcggatctgtcgtagaagc

SEQ ID NO: 32240 - DNA, 25 bp, Homo sapien
cgcgacccgctcttcggatagcagg

SEQ ID NO: 32241 - DNA, 25 bp, Homo sapien
gactgacctccctgcggcgatgcag

SEQ ID NO: 32242 - DNA, 25 bp, Homo sapien
gacccgcaccgtggtcctctgatta

SEQ ID NO: 32243 - DNA, 25 bp, Homo sapien
atgttcccgaactgcggtcccgcaa

SEQ ID NO: 32244 - DNA, 25 bp, Homo sapien
ctctagccacggagttgcatgcatg

SEQ ID NO: 32245 - DNA, 25 bp, Homo sapien
gccacggagttgcatgcatggccct

SEQ ID NO: 32246 - DNA, 25 bp, Homo sapien
tgttctcgcccgaggacccgtggct

SEQ ID NO: 32247 - DNA, 25 bp, Homo sapien
gccacgggctctctagccacggagt

SEQ ID NO: 32248 - DNA, 25 bp, Homo sapien
agccagctgttcctacccgcgccac

SEQ ID NO: 32249 - DNA, 25 bp, Homo sapien
tggtacactcgaccctccagccagc

SEQ ID NO: 32250 - DNA, 25 bp, Homo sapien
ggctctctagccacggagttgcatg

SEQ ID NO: 32251 - DNA, 25 bp, Homo sapien
ttgcggagttctttttggtacactc

SEQ ID NO: 32252 - DNA, 25 bp, Homo sapien
ccggggcaaagactaagtcgctgta

SEQ ID NO: 32253 - DNA, 25 bp, Homo sapien
gggacagaccctccttcggcatggg

SEQ ID NO: 32254 - DNA, 25 bp, Homo sapien
cttcggcatgggttggatcggacaa

SEQ ID NO: 32255 - DNA, 25 bp, Homo sapien
cacttctctctgaagcccagtgggc

SEQ ID NO: 32256 - DNA, 25 bp, Homo sapien
aagcccagtgggctccatccactga

SEQ ID NO: 32257 - DNA, 25 bp, Homo sapien
caccggctacatcgctgggaggtga

SEQ ID NO: 32258 - DNA, 25 bp, Homo sapien
gagcgagctgctcagcaaaagcaaa

SEQ ID NO: 32259 - DNA, 25 bp, Homo sapien
ctgtacagcctcgaggagcgagctg

SEQ ID NO: 32260 - DNA, 25 bp, Homo sapien
gcggcttgttttctttcctccagtc

SEQ ID NO: 32261 - DNA, 25 bp, Homo sapien
acgcgctgctcttcgtgttcatcta

SEQ ID NO: 32262 - DNA, 25 bp, Homo sapien
tcaaagacttcgtggcggccaattc

SEQ ID NO: 32263 - DNA, 25 bp, Homo sapien
tcaccctcacgctgatgaacttgta

SEQ ID NO: 32264 - DNA, 25 bp, Homo sapien
gtcgtccgaaccctgtcctgtttgc

SEQ ID NO: 32265 - DNA, 25 bp, Homo sapien
ttgcgggcatttgtcataggaaacc

SEQ ID NO: 32266 - DNA, 25 bp, Homo sapien
aaaggccgtcccagtgaatcatgtg

SEQ ID NO: 32267 - DNA, 25 bp, Homo sapien
gtgttcatctacgtgcagctctggc

SEQ ID NO: 32268 - DNA, 25 bp, Homo sapien
gccaggctctaggattcacccagta

SEQ ID NO: 32269 - DNA, 25 bp, Homo sapien
cagccgcttaacacatccgagagga

SEQ ID NO: 32270 - DNA, 25 bp, Homo sapien
tttgactgccattacccggagtgtc

SEQ ID NO: 32271 - DNA, 25 bp, Homo sapien
ggttcgcagatgtttcccgcactgg

SEQ ID NO: 32272 - DNA, 25 bp, Homo sapien
tctgctcgccagaaatcacctcttt

SEQ ID NO: 32273 - DNA, 25 bp, Homo sapien
aggtctgcactccagtccggaggca

SEQ ID NO: 32274 - DNA, 25 bp, Homo sapien
ctcgggaactacaactgcgaaggcc

SEQ ID NO: 32275 - DNA, 25 bp, Homo sapien
cctcttctccgggaaaccaggctga

SEQ ID NO: 32276 - DNA, 25 bp, Homo sapien
actcgtgaacagcaactgcggtggc

SEQ ID NO: 32277 - DNA, 25 bp, Homo sapien
aaacaccctgaggtgcctgccgggc

SEQ ID NO: 32278 - DNA, 25 bp, Homo sapien
agccagttggggaaactcgtgaaca

SEQ ID NO: 32279 - DNA, 25 bp, Homo sapien
tagggccctacagactgactgggga

SEQ ID NO: 32280 - DNA, 25 bp, Homo sapien
cccgagcgcgaagccttctgggagt

SEQ ID NO: 32281 - DNA, 25 bp, Homo sapien
cgcggcgacttcatttgcgtctctg

SEQ ID NO: 32282 - DNA, 25 bp, Homo sapien
cctggaagcccaccgagggcaggca

SEQ ID NO: 32283 - DNA, 25 bp, Homo sapien
tcgagcagtggtccgaggtgacctt

SEQ ID NO: 32284 - DNA, 25 bp, Homo sapien
ttgccaaagcaggaagtgagctcgt

SEQ ID NO: 32285 - DNA, 25 bp, Homo sapien
aacctctggcagaaatgggcgcaag

SEQ ID NO: 32286 - DNA, 25 bp, Homo sapien
cctctgcgcgcaggtaaagggacac

SEQ ID NO: 32287 - DNA, 25 bp, Homo sapien
cgaaggggctttgctaattgccaaa

SEQ ID NO: 32288 - DNA, 25 bp, Homo sapien
taaggccagtccttcgctcgcagtc

SEQ ID NO: 32289 - DNA, 25 bp, Homo sapien
ctgcagccgtttcttaaggccagtc

SEQ ID NO: 32290 - DNA, 25 bp, Homo sapien
tgagacacgtcctgcaaacctctgg

SEQ ID NO: 32291 - DNA, 25 bp, Homo sapien
cttttgttctggactcgggatgcca

SEQ ID NO: 32292 - DNA, 25 bp, Homo sapien
tggcattcggatgtcacggctccta

SEQ ID NO: 32293 - DNA, 25 bp, Homo sapien
tctcgccagtggaggatggcattcg

SEQ ID NO: 32294 - DNA, 25 bp, Homo sapien
ggagcgcctgaaacaccagtctttg

SEQ ID NO: 32295 - DNA, 25 bp, Homo sapien
tgctgacaaacaacctgctccgtgg

SEQ ID NO: 32296 - DNA, 25 bp, Homo sapien
gaaccctgacggcacttagctgctg

SEQ ID NO: 32297 - DNA, 25 bp, Homo sapien
cgctccggggcataagggattatca

SEQ ID NO: 32298 - DNA, 25 bp, Homo sapien
gtcacggctcctaaatcaccatttg

SEQ ID NO: 32299 - DNA, 25 bp, Homo sapien
acgaggactgactcctgtcgcttcc

SEQ ID NO: 32300 - DNA, 25 bp, Homo sapien
ggtggttacgtcttgagcgccatca

SEQ ID NO: 32301 - DNA, 25 bp, Homo sapien
cgccatcacgatttgtgtgcacatg

SEQ ID NO: 32302 - DNA, 25 bp, Homo sapien
tgtgcacatgccgaaaataggtgag

SEQ ID NO: 32303 - DNA, 25 bp, Homo sapien
gtcttgagcgccatcacgatttgtg

SEQ ID NO: 32304 - DNA, 25 bp, Homo sapien
gtcgtcatggacagcggtcaaggcc

SEQ ID NO: 32305 - DNA, 25 bp, Homo sapien
ccttctccgtcgtcagggacagcgg

SEQ ID NO: 32306 - DNA, 25 bp, Homo sapien
cccgcttcacagatgagggcgtcga

SEQ ID NO: 32307 - DNA, 25 bp, Homo sapien
gccaggcagcgttgctgtttgcatc

SEQ ID NO: 32308 - DNA, 25 bp, Homo sapien
ccgcttacctggaactgggaatttg

SEQ ID NO: 32309 - DNA, 25 bp, Homo sapien
tgctgggctaaggacgtcatctttc

SEQ ID NO: 32310 - DNA, 25 bp, Homo sapien
tcacgccagcggagttttaatgaca

SEQ ID NO: 32311 - DNA, 25 bp, Homo sapien
tggcagcagcgttaacaactaatta

SEQ ID NO: 32312 - DNA, 25 bp, Homo sapien
agcgcttcccacatggtaccaagga

SEQ ID NO: 32313 - DNA, 25 bp, Homo sapien
acccggaaacctaaggcatgctgta

SEQ ID NO: 32314 - DNA, 25 bp, Homo sapien
ccgccggactcaggctcaagtctga

SEQ ID NO: 32315 - DNA, 25 bp, Homo sapien
ggcgcctcgtaaacaaacaattctc

SEQ ID NO: 32316 - DNA, 25 bp, Homo sapien
tgctgtgctgtcctgtgccctcgca

SEQ ID NO: 32317 - DNA, 25 bp, Homo sapien
atgagtacatgatccaggaggagga

SEQ ID NO: 32318 - DNA, 25 bp, Homo sapien
actacgtgtacgacgaggatgagta

SEQ ID NO: 32319 - DNA, 25 bp, Homo sapien
ccggcgtgcagtacaactacgtgta

SEQ ID NO: 32320 - DNA, 25 bp, Homo sapien
tgaaccagatagagcccggcgtgca

SEQ ID NO: 32321 - DNA, 25 bp, Homo sapien
ccaaccgagcgccatgaaccagata

SEQ ID NO: 32322 - DNA, 25 bp, Homo sapien
cgcggctattaagccgcgcggcagc

SEQ ID NO: 32323 - DNA, 25 bp, Homo sapien
tccgtttgccagtcagcccgtgcgt

SEQ ID NO: 32324 - DNA, 25 bp, Homo sapien
tggcctcctaatccctggggcgatt

SEQ ID NO: 32325 - DNA, 25 bp, Homo sapien
cccggggctaaacagcaggtgattg

SEQ ID NO: 32326 - DNA, 25 bp, Homo sapien
cttggcgctgtgacttttccttaga

SEQ ID NO: 32327 - DNA, 25 bp, Homo sapien
ggccacttaggcttacacttccgga

SEQ ID NO: 32328 - DNA, 25 bp, Homo sapien
cacttccggatcctgggcacacaga

SEQ ID NO: 32329 - DNA, 25 bp, Homo sapien
accgcgctctgaaaggttctaaatg

SEQ ID NO: 32330 - DNA, 25 bp, Homo sapien
tcgtcacctgtggagagcacgtctt

SEQ ID NO: 32331 - DNA, 25 bp, Homo sapien
gtacccgggaagaaagcacgtgctc

SEQ ID NO: 32332 - DNA, 25 bp, Homo sapien
ttcgggccctctgggctcgcactgg

SEQ ID NO: 32333 - DNA, 25 bp, Homo sapien
ctcgcactggcccacgtccgtccct

SEQ ID NO: 32334 - DNA, 25 bp, Homo sapien
cggtcaggggagatccgcagagcac

SEQ ID NO: 32335 - DNA, 25 bp, Homo sapien
tggtgctggtggcttctcaggagag

SEQ ID NO: 32336 - DNA, 25 bp, Homo sapien
atccggagcccgctacatcggcacg

SEQ ID NO: 32337 - DNA, 25 bp, Homo sapien
gctgctcaggccaccataatccagc

SEQ ID NO: 32338 - DNA, 25 bp, Homo sapien
ccaccataatccagctcgcggctcg

SEQ ID NO: 32339 - DNA, 25 bp, Homo sapien
ggctcttcgtcggtctcccggggca

SEQ ID NO: 32340 - DNA, 25 bp, Homo sapien
agacgagatccagttcctgcgaact

SEQ ID NO: 32341 - DNA, 25 bp, Homo sapien
tggctccgcgcacttgctcggagga

SEQ ID NO: 32342 - DNA, 25 bp, Homo sapien
tgtcacggagcgaagacgttggttc

SEQ ID NO: 32343 - DNA, 25 bp, Homo sapien
ctcgggctgtttctgggaataccgc

SEQ ID NO: 32344 - DNA, 25 bp, Homo sapien
gagcgggcatcaccaagtgtgtgca

SEQ ID NO: 32345 - DNA, 25 bp, Homo sapien
gtcagggcatccactagcggggtcc

SEQ ID NO: 32346 - DNA, 25 bp, Homo sapien
ctgcgaactgtaagcgccgtgcgtc

SEQ ID NO: 32347 - DNA, 25 bp, Homo sapien
gacccgcgcgttgtcacggagcgaa

SEQ ID NO: 32348 - DNA, 25 bp, Homo sapien
gcagagagcgtcctgaattatttcc

SEQ ID NO: 32349 - DNA, 25 bp, Homo sapien
cgatacccgacttcagacttttctg

SEQ ID NO: 32350 - DNA, 25 bp, Homo sapien
tgagcacatgcccaacgatacccga

SEQ ID NO: 32351 - DNA, 25 bp, Homo sapien
tttctgggccgcatcgaaatcatgg

SEQ ID NO: 32352 - DNA, 25 bp, Homo sapien
cgtccttctgacaaacctctctgag

SEQ ID NO: 32353 - DNA, 25 bp, Homo sapien
ttccacgaacctgcgaaggacatcg

SEQ ID NO: 32354 - DNA, 25 bp, Homo sapien
cggatgagaatgaaaccctcgacta

SEQ ID NO: 32355 - DNA, 25 bp, Homo sapien
cggaatttcttttgtcttgtgcgga

SEQ ID NO: 32356 - DNA, 25 bp, Homo sapien
gcgcatctttactgacccggggaga

SEQ ID NO: 32357 - DNA, 25 bp, Homo sapien
gtacctagcctagtgcgcatcttta

SEQ ID NO: 32358 - DNA, 25 bp, Homo sapien
ttggcacttcgagtaacacttgggc

SEQ ID NO: 32359 - DNA, 25 bp, Homo sapien
cactcgtgtgttgagcgtttgtctc

SEQ ID NO: 32360 - DNA, 25 bp, Homo sapien
ctgccggatctgaggctccaaagtg

SEQ ID NO: 32361 - DNA, 25 bp, Homo sapien
gggcacttgaattccgacagcgcga

SEQ ID NO: 32362 - DNA, 25 bp, Homo sapien
aggacagtcgctccctgaacgcgga

SEQ ID NO: 32363 - DNA, 25 bp, Homo sapien
gactgcaccggttctcctctttgga

SEQ ID NO: 32364 - DNA, 25 bp, Homo sapien
ctccgagggagcaagacatttaaac

SEQ ID NO: 32365 - DNA, 25 bp, Homo sapien
gctgatgtcagcgttccgccgtgac

SEQ ID NO: 32366 - DNA, 25 bp, Homo sapien
gaggttgcggccctgctccgaatcc

SEQ ID NO: 32367 - DNA, 25 bp, Homo sapien
agtctacgcggatgtcacggtcgcc

SEQ ID NO: 32368 - DNA, 25 bp, Homo sapien
ggcggtgtcagacgcccaacgacca

SEQ ID NO: 32369 - DNA, 25 bp, Homo sapien
taatttggcggcgtcttctgggaag

SEQ ID NO: 32370 - DNA, 25 bp, Homo sapien
gggctcgcgccctctaatttggcgg

SEQ ID NO: 32371 - DNA, 25 bp, Homo sapien
taaagggcgagtctacgcggatgtc

SEQ ID NO: 32372 - DNA, 25 bp, Homo sapien
agagcctcggtgttttccaacctgc

SEQ ID NO: 32373 - DNA, 25 bp, Homo sapien
cccgcgaagatgtactggattccca

SEQ ID NO: 32374 - DNA, 25 bp, Homo sapien
cggataccgagtgtgcggacccttt

SEQ ID NO: 32375 - DNA, 25 bp, Homo sapien
gccgatcgccgaggatgtggaaact

SEQ ID NO: 32376 - DNA, 25 bp, Homo sapien
ctcggacacggacatctatagcttc

SEQ ID NO: 32377 - DNA, 25 bp, Homo sapien
gcttccattcggctacggagcaaga

SEQ ID NO: 32378 - DNA, 25 bp, Homo sapien
ctttcagacatccagcaggcgatcc

SEQ ID NO: 32379 - DNA, 25 bp, Homo sapien
cctgcggatcaggaagaatctgtcc

SEQ ID NO: 32380 - DNA, 25 bp, Homo sapien
tggagtgggaatacctcctccgccc

SEQ ID NO: 32381 - DNA, 25 bp, Homo sapien
tacctggagtgggaatacctcctcc

SEQ ID NO: 32382 - DNA, 25 bp, Homo sapien
tcccggagcgggcatacctcctcca

SEQ ID NO: 32383 - DNA, 25 bp, Homo sapien
cccggagcgggcatacctcctccac

SEQ ID NO: 32384 - DNA, 25 bp, Homo sapien
cggagcgggcatacctcctccaccc

SEQ ID NO: 32385 - DNA, 25 bp, Homo sapien
ttcccggagcgggcatacctcctcc

SEQ ID NO: 32386 - DNA, 25 bp, Homo sapien
cctggagtgggaatacctcctccgc

SEQ ID NO: 32387 - DNA, 25 bp, Homo sapien
acctggagtgggaatacctcctccg

SEQ ID NO: 32388 - DNA, 25 bp, Homo sapien
acagtgcctactctgcccagtacag

SEQ ID NO: 32389 - DNA, 25 bp, Homo sapien
tactctgcccagtacagccattccc

SEQ ID NO: 32390 - DNA, 25 bp, Homo sapien
tctccctggcatgacagtgcctact

SEQ ID NO: 32391 - DNA, 25 bp, Homo sapien
cccggagcaggcatactccctctgc

SEQ ID NO: 32392 - DNA, 25 bp, Homo sapien
ccctggcatgacagtgcctactctg

SEQ ID NO: 32393 - DNA, 25 bp, Homo sapien
gcatgacagtgcctactctgcccag

SEQ ID NO: 32394 - DNA, 25 bp, Homo sapien
cgcctctacccggagcaggcatact

SEQ ID NO: 32395 - DNA, 25 bp, Homo sapien
tgacagtgcctactctgcccagtac

SEQ ID NO: 32396 - DNA, 25 bp, Homo sapien
cacgcccaaaggcatttctcagagg

SEQ ID NO: 32397 - DNA, 25 bp, Homo sapien
ctctgagaaacaacgctggcattca

SEQ ID NO: 32398 - DNA, 25 bp, Homo sapien
cctctgttaagatcgcgctctgaga

SEQ ID NO: 32399 - DNA, 25 bp, Homo sapien
ggcggcgtctagtgcctctgttaag

SEQ ID NO: 32400 - DNA, 25 bp, Homo sapien
ggaatgggtcagatgcaagcacaga

SEQ ID NO: 32401 - DNA, 25 bp, Homo sapien
agaggcctccagaatcccatgcaaa

SEQ ID NO: 32402 - DNA, 25 bp, Homo sapien
gggctcatttgcctacaagttacaa

SEQ ID NO: 32403 - DNA, 25 bp, Homo sapien
cccatgcaaagggaagcagcctcag

SEQ ID NO: 32404 - DNA, 25 bp, Homo sapien
caacgggaagccgcccagctttgct

SEQ ID NO: 32405 - DNA, 25 bp, Homo sapien
gcggccggcgactaaccgcctttca

SEQ ID NO: 32406 - DNA, 25 bp, Homo sapien
ctaaccgcctttcacggttcttgcg

SEQ ID NO: 32407 - DNA, 25 bp, Homo sapien
gcctttcacggttcttgcgggagct

SEQ ID NO: 32408 - DNA, 25 bp, Homo sapien
ttcttgcgggagctgccaacgggaa

SEQ ID NO: 32409 - DNA, 25 bp, Homo sapien
agggcctggcgtgtgtcttcttcct

SEQ ID NO: 32410 - DNA, 25 bp, Homo sapien
agctttgctggagcccacacggccg

SEQ ID NO: 32411 - DNA, 25 bp, Homo sapien
ttcaggtgcaagtcccgggtggaag

SEQ ID NO: 32412 - DNA, 25 bp, Homo sapien
gttcacggacatgcaccggcactgc

SEQ ID NO: 32413 - DNA, 25 bp, Homo sapien
gcgctcactgcttgtccgagtcgct

SEQ ID NO: 32414 - DNA, 25 bp, Homo sapien
ccgagtcgctcaggttcacggacat

SEQ ID NO: 32415 - DNA, 25 bp, Homo sapien
cggcactgcttcaccttctggattt

SEQ ID NO: 32416 - DNA, 25 bp, Homo sapien
cactggccgtagcagaagcggttga

SEQ ID NO: 32417 - DNA, 25 bp, Homo sapien
tgcgtcttgcaccagtcactcttga

SEQ ID NO: 32418 - DNA, 25 bp, Homo sapien
ctcttgaggtacttgcgctcggtga

SEQ ID NO: 32419 - DNA, 25 bp, Homo sapien
ggcactcgagctccacgaggacgga

SEQ ID NO: 32420 - DNA, 25 bp, Homo sapien
caggggcctggcgacaagacgacac

SEQ ID NO: 32421 - DNA, 25 bp, Homo sapien
gcgcgttctacggagccgccatcga

SEQ ID NO: 32422 - DNA, 25 bp, Homo sapien
tacggagccgccatcgacgcggtgc

SEQ ID NO: 32423 - DNA, 25 bp, Homo sapien
tgcctcacgttatagtccagtccgc

SEQ ID NO: 32424 - DNA, 25 bp, Homo sapien
tgcccggaccctggatcagcaaggg

SEQ ID NO: 32425 - DNA, 25 bp, Homo sapien
tccagtccgctcaggacacgggctg

SEQ ID NO: 32426 - DNA, 25 bp, Homo sapien
acgttatagtccagtccgctcagga

SEQ ID NO: 32427 - DNA, 25 bp, Homo sapien
agggcagatgcctcacgttatagtc

SEQ ID NO: 32428 - DNA, 25 bp, Homo sapien
cacggtgtgtctcctttccctgcat

SEQ ID NO: 32429 - DNA, 25 bp, Homo sapien
ttccctgcatttctacgaaagcctg

SEQ ID NO: 32430 - DNA, 25 bp, Homo sapien
cgtggctcacagtgtgtctcctttc

SEQ ID NO: 32431 - DNA, 25 bp, Homo sapien
ctgcatttctacgaaagcccgcgtg

SEQ ID NO: 32432 - DNA, 25 bp, Homo sapien
gcatttctacgaaagcccgcgtggc

SEQ ID NO: 32433 - DNA, 25 bp, Homo sapien
acgaaagcctgcgtggctcacagtg

SEQ ID NO: 32434 - DNA, 25 bp, Homo sapien
tgcatttctacgaaagcccgcgtgg

SEQ ID NO: 32435 - DNA, 25 bp, Homo sapien
acggtgtgtctcctttccctgcatt

SEQ ID NO: 32436 - DNA, 25 bp, Homo sapien
agaagttctgtttgcccgcttagga

SEQ ID NO: 32437 - DNA, 25 bp, Homo sapien
cacttgagttatgtttggtagaacc

SEQ ID NO: 32438 - DNA, 25 bp, Homo sapien
cccggggtcaatgccaatatctttc

SEQ ID NO: 32439 - DNA, 25 bp, Homo sapien
tccttgggcgtactcaagcctggtg

SEQ ID NO: 32440 - DNA, 25 bp, Homo sapien
tcgttttcaacatcacacaggtttc

SEQ ID NO: 32441 - DNA, 25 bp, Homo sapien
tcctgcagtcttacagacggttttc

SEQ ID NO: 32442 - DNA, 25 bp, Homo sapien
tgccgattttggctttcacttgaaa

SEQ ID NO: 32443 - DNA, 25 bp, Homo sapien
tttcgtgtgatcaaaatcggcgttc

SEQ ID NO: 32444 - DNA, 25 bp, Homo sapien
ctatttacctcctccgccaaggtca

SEQ ID NO: 32445 - DNA, 25 bp, Homo sapien
agagaccggagtttaacgcccagtg

SEQ ID NO: 32446 - DNA, 25 bp, Homo sapien
tggagagaccggagtttaacgccca

SEQ ID NO: 32447 - DNA, 25 bp, Homo sapien
gctgctcaggcgaccgccaccctcg

SEQ ID NO: 32448 - DNA, 25 bp, Homo sapien
cactcgcggcggatgcggattccgc

SEQ ID NO: 32449 - DNA, 25 bp, Homo sapien
gtagcttcatcacactcgcggcgga

SEQ ID NO: 32450 - DNA, 25 bp, Homo sapien
aggcagggtagcttcatcacactcg

SEQ ID NO: 32451 - DNA, 25 bp, Homo sapien
cagcgaggcagggtagcttcatcac

SEQ ID NO: 32452 - DNA, 25 bp, Homo sapien
cctgacgctctcgaaggctgggcct

SEQ ID NO: 32453 - DNA, 25 bp, Homo sapien
atggcaccgtgttcctgcgcctcgg

SEQ ID NO: 32454 - DNA, 25 bp, Homo sapien
ctctgcgcgggactgcaggttctgc

SEQ ID NO: 32455 - DNA, 25 bp, Homo sapien
tgatcgctgagcctgacgctctcga

SEQ ID NO: 32456 - DNA, 25 bp, Homo sapien
ctggggcccgcaatctactccggag

SEQ ID NO: 32457 - DNA, 25 bp, Homo sapien
ctactccggaggctttcccactggg

SEQ ID NO: 32458 - DNA, 25 bp, Homo sapien
ttcccactgggcagggtcgctagca

SEQ ID NO: 32459 - DNA, 25 bp, Homo sapien
cccgcatcggagtgatcgctgagcc

SEQ ID NO: 32460 - DNA, 25 bp, Homo sapien
gccagcagcagcgaagttacctcaa

SEQ ID NO: 32461 - DNA, 25 bp, Homo sapien
gcagcgaagttacctcaaaacgccc

SEQ ID NO: 32462 - DNA, 25 bp, Homo sapien
ctgagggagcttgggtagaatttct

SEQ ID NO: 32463 - DNA, 25 bp, Homo sapien
ggatggcggcctgcgctcaccattc

SEQ ID NO: 32464 - DNA, 25 bp, Homo sapien
cgaagtgctcggtacatggtgctga

SEQ ID NO: 32465 - DNA, 25 bp, Homo sapien
ctccacgccggttgtcagaaaccgt

SEQ ID NO: 32466 - DNA, 25 bp, Homo sapien
gctcaccattcgagccgcgttcgga

SEQ ID NO: 32467 - DNA, 25 bp, Homo sapien
ggcccagtaggaccctctctgacag

SEQ ID NO: 32468 - DNA, 25 bp, Homo sapien
aggacgagcaccagcaggttgttgc

SEQ ID NO: 32469 - DNA, 25 bp, Homo sapien
ctggaacttgtagtagaggacgagc

SEQ ID NO: 32470 - DNA, 25 bp, Homo sapien
tcgctgaggctgatgttgaccagga

SEQ ID NO: 32471 - DNA, 25 bp, Homo sapien
gcaggacacgaaggtaaaggtgacc

SEQ ID NO: 32472 - DNA, 25 bp, Homo sapien
accgaagaggctgccgctaaacccg

SEQ ID NO: 32473 - DNA, 25 bp, Homo sapien
ccagtccaactcaccgaagaggctg

SEQ ID NO: 32474 - DNA, 25 bp, Homo sapien
cagccgttcctcaggcaggacacga

SEQ ID NO: 32475 - DNA, 25 bp, Homo sapien
aggttgttgccgacgcccagcagcc

SEQ ID NO: 32476 - DNA, 25 bp, Homo sapien
ccgcgcaaattgaaaggtcagcctt

SEQ ID NO: 32477 - DNA, 25 bp, Homo sapien
gcgggatacgcgttgacgtcacatc

SEQ ID NO: 32478 - DNA, 25 bp, Homo sapien
gagagctcaggacgcaaccctatga

SEQ ID NO: 32479 - DNA, 25 bp, Homo sapien
tctacccagcgagacggagagctca

SEQ ID NO: 32480 - DNA, 25 bp, Homo sapien
cgccctcaagaagccgcacggagtt

SEQ ID NO: 32481 - DNA, 25 bp, Homo sapien
aggcggtgctcaccatcggccatca

SEQ ID NO: 32482 - DNA, 25 bp, Homo sapien
cgcgacggcgctctttcaacatcag

SEQ ID NO: 32483 - DNA, 25 bp, Homo sapien
ctgtgtaggcaagttacccgtgttc

SEQ ID NO: 32484 - DNA, 25 bp, Homo sapien
cttgagggtccagcgcggacctgcc

SEQ ID NO: 32485 - DNA, 25 bp, Homo sapien
tttcagcgttggtggagcgcgggcc

SEQ ID NO: 32486 - DNA, 25 bp, Homo sapien
gcgggccctgtcattgcgcgtctgt

SEQ ID NO: 32487 - DNA, 25 bp, Homo sapien
gggccctgtcattgcgcgtctgtct

SEQ ID NO: 32488 - DNA, 25 bp, Homo sapien
ggccctgtcattgcgcgtctgtctg

SEQ ID NO: 32489 - DNA, 25 bp, Homo sapien
ctgtcattgcgcgtctgtctgctcc

SEQ ID NO: 32490 - DNA, 25 bp, Homo sapien
gcccttgagggtccagcgcggacct

SEQ ID NO: 32491 - DNA, 25 bp, Homo sapien
tgtcattgcgcgtctgtctgctcct

SEQ ID NO: 32492 - DNA, 25 bp, Homo sapien
acagggacctgctgctgaagcgtat

SEQ ID NO: 32493 - DNA, 25 bp, Homo sapien
cgcgctgtgctaactgatctggagc

SEQ ID NO: 32494 - DNA, 25 bp, Homo sapien
cccgctcaggtagcaggtatgtgcc

SEQ ID NO: 32495 - DNA, 25 bp, Homo sapien
tgctgaagcgtatcaacgtatacta

SEQ ID NO: 32496 - DNA, 25 bp, Homo sapien
tgctgctgaagcgtatcaacgtata

SEQ ID NO: 32497 - DNA, 25 bp, Homo sapien
cctgctgctgaagcgtatcaacgta

SEQ ID NO: 32498 - DNA, 25 bp, Homo sapien
gggacctgctgctgaagcgtatcaa

SEQ ID NO: 32499 - DNA, 25 bp, Homo sapien
ctgtgctaactgatctggagccggg

SEQ ID NO: 32500 - DNA, 25 bp, Homo sapien
ccgcagcccggtcattaaggcaaga

SEQ ID NO: 32501 - DNA, 25 bp, Homo sapien
atccgacctaggacgtcggcgcctg

SEQ ID NO: 32502 - DNA, 25 bp, Homo sapien
ccaagagcctgaaagggaacctgcc

SEQ ID NO: 32503 - DNA, 25 bp, Homo sapien
cgtgcaaatgaaccctaccgggaga

SEQ ID NO: 32504 - DNA, 25 bp, Homo sapien
tgcaacgccaggttgctcggagcca

SEQ ID NO: 32505 - DNA, 25 bp, Homo sapien
tagcggcgccaactttactcattcg

SEQ ID NO: 32506 - DNA, 25 bp, Homo sapien
tctttcctccgaagccagacgctgg

SEQ ID NO: 32507 - DNA, 25 bp, Homo sapien
agcgagtcgcccttacgtgctccag

SEQ ID NO: 32508 - DNA, 25 bp, Homo sapien
tcagtgcgtcgcatgtaacgccttc

SEQ ID NO: 32509 - DNA, 25 bp, Homo sapien
ctgagggcccagctagcaaaataaa

SEQ ID NO: 32510 - DNA, 25 bp, Homo sapien
cgccatttttccagccgaggtcagc

SEQ ID NO: 32511 - DNA, 25 bp, Homo sapien
ctcctgacgccacacggtatgactg

SEQ ID NO: 32512 - DNA, 25 bp, Homo sapien
acgccttcaactattggggccggtg

SEQ ID NO: 32513 - DNA, 25 bp, Homo sapien
acctgatgacaagctccggggagca

SEQ ID NO: 32514 - DNA, 25 bp, Homo sapien
gtcagactccgccagaaaggcaaga

SEQ ID NO: 32515 - DNA, 25 bp, Homo sapien
agtccgtggtgttcccaactgccca

SEQ ID NO: 32516 - DNA, 25 bp, Homo sapien
tctttactggaaagccggcaggcga

SEQ ID NO: 32517 - DNA, 25 bp, Homo sapien
cgtacacgctactttcatccgatgg

SEQ ID NO: 32518 - DNA, 25 bp, Homo sapien
agggagacactcaggaaaccacctc

SEQ ID NO: 32519 - DNA, 25 bp, Homo sapien
ctctccctggcgcatctttactgga

SEQ ID NO: 32520 - DNA, 25 bp, Homo sapien
tcggtgtccacctagaaccgggctc

SEQ ID NO: 32521 - DNA, 25 bp, Homo sapien
atccgatggtgtggcgatgcaaata

SEQ ID NO: 32522 - DNA, 25 bp, Homo sapien
ccattccgatcctgggagggtgatc

SEQ ID NO: 32523 - DNA, 25 bp, Homo sapien
gacatgtgttttctggagccgtaca

SEQ ID NO: 32524 - DNA, 25 bp, Homo sapien
tgcaacggaaaacggacagagctcc

SEQ ID NO: 32525 - DNA, 25 bp, Homo sapien
aacggacagagctcctgcgtgcacc

SEQ ID NO: 32526 - DNA, 25 bp, Homo sapien
gggacttcgagccaatccattgtca

SEQ ID NO: 32527 - DNA, 25 bp, Homo sapien
tcagccggcgacctattggctcctg

SEQ ID NO: 32528 - DNA, 25 bp, Homo sapien
tttccggaagtgtttgttgcgcgct

SEQ ID NO: 32529 - DNA, 25 bp, Homo sapien
tctcgagccaacgagcgtgatgcgc

SEQ ID NO: 32530 - DNA, 25 bp, Homo sapien
aaatcggactgccaggcgacagttc

SEQ ID NO: 32531 - DNA, 25 bp, Homo sapien
ggcgacagttcctccgtttgaaatc

SEQ ID NO: 32532 - DNA, 25 bp, Homo sapien
tgggactgcgaagaaccagcccggc

SEQ ID NO: 32533 - DNA, 25 bp, Homo sapien
tcctgggactgcgaagaaccagccc

SEQ ID NO: 32534 - DNA, 25 bp, Homo sapien
ccacccggcctatgggcgcgaactc

SEQ ID NO: 32535 - DNA, 25 bp, Homo sapien
cctgacatcgtggtgtctgttgccc

SEQ ID NO: 32536 - DNA, 25 bp, Homo sapien
ttgcctgacatcgtggtgtctgttg

SEQ ID NO: 32537 - DNA, 25 bp, Homo sapien
gcgttgcctgacatcgtggtgtctg

SEQ ID NO: 32538 - DNA, 25 bp, Homo sapien
aggcgttgcctgacatcgtggtgtc

SEQ ID NO: 32539 - DNA, 25 bp, Homo sapien
ccggtcctgggactgcgaagaacca

SEQ ID NO: 32540 - DNA, 25 bp, Homo sapien
tttaggccatcgaactgtatacctg

SEQ ID NO: 32541 - DNA, 25 bp, Homo sapien
gtatacctgaaattagcaaatttta

SEQ ID NO: 32542 - DNA, 25 bp, Homo sapien
ggccatcgaactgtatacctgaaat

SEQ ID NO: 32543 - DNA, 25 bp, Homo sapien
ttattttaggccatcgaactgtata

SEQ ID NO: 32544 - DNA, 25 bp, Homo sapien
acggaagcgcaagaaccgcttgaac

SEQ ID NO: 32545 - DNA, 25 bp, Homo sapien
gtgacgtcacggaagcgcaagaacc

SEQ ID NO: 32546 - DNA, 25 bp, Homo sapien
gtcacggaagcgcaagaaccgcttg

SEQ ID NO: 32547 - DNA, 25 bp, Homo sapien
tcgaactgtatacctgaaattagca

SEQ ID NO: 32548 - DNA, 25 bp, Homo sapien
agggtgcatgacaccgcgtcttcca

SEQ ID NO: 32549 - DNA, 25 bp, Homo sapien
cgcgtccaaaaggttgctcgcctga

SEQ ID NO: 32550 - DNA, 25 bp, Homo sapien
gccagtcgaaagctgaaaatgattc

SEQ ID NO: 32551 - DNA, 25 bp, Homo sapien
accgagcagccgatcgcatcactta

SEQ ID NO: 32552 - DNA, 25 bp, Homo sapien
ccacacatagcggtaacggcaaaga

SEQ ID NO: 32553 - DNA, 25 bp, Homo sapien
ttccaacgatcccttactgcgcagg

SEQ ID NO: 32554 - DNA, 25 bp, Homo sapien
gcgagggtctcacccacacgctttt

SEQ ID NO: 32555 - DNA, 25 bp, Homo sapien
gctccgctgggcaataacgttattc

SEQ ID NO: 32556 - DNA, 25 bp, Homo sapien
aggaggctcgtcctgaacgtgcaca

SEQ ID NO: 32557 - DNA, 25 bp, Homo sapien
agtcgcctgagccagatgctccgca

SEQ ID NO: 32558 - DNA, 25 bp, Homo sapien
cccgggcctagtatccagagtcgaa

SEQ ID NO: 32559 - DNA, 25 bp, Homo sapien
gtatccagagtcgaagcagccgccg

SEQ ID NO: 32560 - DNA, 25 bp, Homo sapien
tggagccctgcggtctgttccacct

SEQ ID NO: 32561 - DNA, 25 bp, Homo sapien
agggctcggctagatgcgctcctcc

SEQ ID NO: 32562 - DNA, 25 bp, Homo sapien
tgaacgtgcacagccgctcctaact

SEQ ID NO: 32563 - DNA, 25 bp, Homo sapien
cgctcctcctcggactggttgagta

SEQ ID NO: 32564 - DNA, 25 bp, Homo sapien
ccgtcctctgccgtgaagattgccc

SEQ ID NO: 32565 - DNA, 25 bp, Homo sapien
gcaaacagcggtgccctctacgtgg

SEQ ID NO: 32566 - DNA, 25 bp, Homo sapien
ttctcgcaaacagcggtgccctcta

SEQ ID NO: 32567 - DNA, 25 bp, Homo sapien
tcgtcgcctttctcgcaaacagcgg

SEQ ID NO: 32568 - DNA, 25 bp, Homo sapien
aacggacgctggaagaggtttccag

SEQ ID NO: 32569 - DNA, 25 bp, Homo sapien
cgccctgaaacggacgctggaagag

SEQ ID NO: 32570 - DNA, 25 bp, Homo sapien
cgacagtcgccctgaaacggacgct

SEQ ID NO: 32571 - DNA, 25 bp, Homo sapien
tcagtcttctgcctaaggcgccctc

SEQ ID NO: 32572 - DNA, 25 bp, Homo sapien
ctggaccaaagactctagccaaatc

SEQ ID NO: 32573 - DNA, 25 bp, Homo sapien
cagagggcagtggtacctgtgccca

SEQ ID NO: 32574 - DNA, 25 bp, Homo sapien
aaacagggagtcatggtgcgttctg

SEQ ID NO: 32575 - DNA, 25 bp, Homo sapien
ccaaatccatcggaggctgagcagg

SEQ ID NO: 32576 - DNA, 25 bp, Homo sapien
gtgcccacatgtgcggccttttttg

SEQ ID NO: 32577 - DNA, 25 bp, Homo sapien
gaaggcccaaacgtgtggccgtgta

SEQ ID NO: 32578 - DNA, 25 bp, Homo sapien
tgtaagtttagttgtgcccggagtc

SEQ ID NO: 32579 - DNA, 25 bp, Homo sapien
gacaacgctgggtgtggctgaaaac

SEQ ID NO: 32580 - DNA, 25 bp, Homo sapien
ggcgtctacaggtggatcttttatg

SEQ ID NO: 32581 - DNA, 25 bp, Homo sapien
ggccggctttctcacggatcacatc

SEQ ID NO: 32582 - DNA, 25 bp, Homo sapien
gcgaatcaacgaaccacaccgagtg

SEQ ID NO: 32583 - DNA, 25 bp, Homo sapien
acaccgagtgccaagttgcgccgtg

SEQ ID NO: 32584 - DNA, 25 bp, Homo sapien
taaagtccgtgcaggtgaacagacc

SEQ ID NO: 32585 - DNA, 25 bp, Homo sapien
ggcacagtgcaggacccagagaagc

SEQ ID NO: 32586 - DNA, 25 bp, Homo sapien
cggatcacatcggttagcagtaagc

SEQ ID NO: 32587 - DNA, 25 bp, Homo sapien
tatgcacctcaacaggccggctttc

SEQ ID NO: 32588 - DNA, 25 bp, Homo sapien
aggagcgagagttgcgcagacagca

SEQ ID NO: 32589 - DNA, 25 bp, Homo sapien
cggcgcggtgacaacccagaagccc

SEQ ID NO: 32590 - DNA, 25 bp, Homo sapien
tgtcggtgtcaaccgcgctgggcat

SEQ ID NO: 32591 - DNA, 25 bp, Homo sapien
gcccagacacagacggtaccgctag

SEQ ID NO: 32592 - DNA, 25 bp, Homo sapien
acaccggcgctccacgcgttatata

SEQ ID NO: 32593 - DNA, 25 bp, Homo sapien
ggggacgcctgtgcatcctcgcctt

SEQ ID NO: 32594 - DNA, 25 bp, Homo sapien
acacagacggtaccgctaggccggg

SEQ ID NO: 32595 - DNA, 25 bp, Homo sapien
ggcgctccacgcgttatataacctc

SEQ ID NO: 32596 - DNA, 25 bp, Homo sapien
ttgttgactttgaggaaaactcctg

SEQ ID NO: 32597 - DNA, 25 bp, Homo sapien
acggtacacagattgcgggcggatc

SEQ ID NO: 32598 - DNA, 25 bp, Homo sapien
tgcaagcattcgtccacacacggta

SEQ ID NO: 32599 - DNA, 25 bp, Homo sapien
tcccaggagaccacggcagaccaaa

SEQ ID NO: 32600 - DNA, 25 bp, Homo sapien
aagaatcattcctgactatcccagg

SEQ ID NO: 32601 - DNA, 25 bp, Homo sapien
ggtcagcccgtagcaagaatcattc

SEQ ID NO: 32602 - DNA, 25 bp, Homo sapien
agcgcggagcagtccagaagccgac

SEQ ID NO: 32603 - DNA, 25 bp, Homo sapien
agcccacgaagtgggcggtgcccaa

SEQ ID NO: 32604 - DNA, 25 bp, Homo sapien
agttgtccatccatcactccgggcg

SEQ ID NO: 32605 - DNA, 25 bp, Homo sapien
attcgaactcaggactgtggcgcgg

SEQ ID NO: 32606 - DNA, 25 bp, Homo sapien
ggcgctacagaggtgcctcccgtta

SEQ ID NO: 32607 - DNA, 25 bp, Homo sapien
gcttcccaaaaagtcacattggctg

SEQ ID NO: 32608 - DNA, 25 bp, Homo sapien
ccctccagcggactctctatttagt

SEQ ID NO: 32609 - DNA, 25 bp, Homo sapien
tctctgtttacttagagggaaagcc

SEQ ID NO: 32610 - DNA, 25 bp, Homo sapien
cgggagataatctagcgagttgtcc

SEQ ID NO: 32611 - DNA, 25 bp, Homo sapien
ggctcctggagagcaaacatctgcg

SEQ ID NO: 32612 - DNA, 25 bp, Homo sapien
gctcatctcgagaagcgagtccctg

SEQ ID NO: 32613 - DNA, 25 bp, Homo sapien
ctcgagaagcgagtccctggagccc

SEQ ID NO: 32614 - DNA, 25 bp, Homo sapien
cggtccaggcgtggctgctcttcct

SEQ ID NO: 32615 - DNA, 25 bp, Homo sapien
ccaggcgtggctgctcttcctgcgg

SEQ ID NO: 32616 - DNA, 25 bp, Homo sapien
ttcctgcgggccctacaccagggtg

SEQ ID NO: 32617 - DNA, 25 bp, Homo sapien
acaccagggtgtaggatttggagta

SEQ ID NO: 32618 - DNA, 25 bp, Homo sapien
ccctgcttctgagacctccctaccc

SEQ ID NO: 32619 - DNA, 25 bp, Homo sapien
cccgatgtgctcatctcgagaagcg

SEQ ID NO: 32620 - DNA, 25 bp, Homo sapien
gagctttcctcggactgcttcagtc

SEQ ID NO: 32621 - DNA, 25 bp, Homo sapien
ggcagcgttgcctcccatttattca

SEQ ID NO: 32622 - DNA, 25 bp, Homo sapien
agcatcacgacgcaggcattcctga

SEQ ID NO: 32623 - DNA, 25 bp, Homo sapien
cgcgtaggcagcgagacttaagctc

SEQ ID NO: 32624 - DNA, 25 bp, Homo sapien
ctgctcaggatgcaaggtaaccaga

SEQ ID NO: 32625 - DNA, 25 bp, Homo sapien
gcccgaatctgggacatctgtcatc

SEQ ID NO: 32626 - DNA, 25 bp, Homo sapien
gccgtgctttcccatgagccacaaa

SEQ ID NO: 32627 - DNA, 25 bp, Homo sapien
gctctgcgtcggtcaataagcatca

SEQ ID NO: 32628 - DNA, 25 bp, Homo sapien
tggcaggcctcacctgtagccgctg

SEQ ID NO: 32629 - DNA, 25 bp, Homo sapien
tctttctgattgcttaccgcccggg

SEQ ID NO: 32630 - DNA, 25 bp, Homo sapien
gcggtgcccattccttgtttctttc

SEQ ID NO: 32631 - DNA, 25 bp, Homo sapien
cagccagtggcgcaggaacacaacc

SEQ ID NO: 32632 - DNA, 25 bp, Homo sapien
agcgagccggctgataatgcactgc

SEQ ID NO: 32633 - DNA, 25 bp, Homo sapien
ttccgctcatgcctttgaagatttc

SEQ ID NO: 32634 - DNA, 25 bp, Homo sapien
ctttgaagatttccctgcagccagt

SEQ ID NO: 32635 - DNA, 25 bp, Homo sapien
ctcgtgattccaaatagaggggagc

SEQ ID NO: 32636 - DNA, 25 bp, Homo sapien
tgccagagctcttcgaacaaaaaca

SEQ ID NO: 32637 - DNA, 25 bp, Homo sapien
cggagcttgctttctagtggtgaga

SEQ ID NO: 32638 - DNA, 25 bp, Homo sapien
atgagcatgctttccacggagcttg

SEQ ID NO: 32639 - DNA, 25 bp, Homo sapien
ttccggataaggcagatgacaggca

SEQ ID NO: 32640 - DNA, 25 bp, Homo sapien
gggcagatgctaggcattccggata

SEQ ID NO: 32641 - DNA, 25 bp, Homo sapien
agtttccagcccgtagctgccttgg

SEQ ID NO: 32642 - DNA, 25 bp, Homo sapien
tggggattcccagctgaacgggcct

SEQ ID NO: 32643 - DNA, 25 bp, Homo sapien
ctcattctcattttgtggggattcc

SEQ ID NO: 32644 - DNA, 25 bp, Homo sapien
agaaactgcctgagtcgcctgcgtc

SEQ ID NO: 32645 - DNA, 25 bp, Homo sapien
agtgcacaccgaaaagctcgctccg

SEQ ID NO: 32646 - DNA, 25 bp, Homo sapien
cgtaagaacgactcccagaaactgc

SEQ ID NO: 32647 - DNA, 25 bp, Homo sapien
aagtcggcctcgagtcatccgtgtc

SEQ ID NO: 32648 - DNA, 25 bp, Homo sapien
gaagagccgccttcccattggagga

SEQ ID NO: 32649 - DNA, 25 bp, Homo sapien
ctgcccgtgacatgatgacgtaaga

SEQ ID NO: 32650 - DNA, 25 bp, Homo sapien
tcggtcaatcgcagaagcccaacgc

SEQ ID NO: 32651 - DNA, 25 bp, Homo sapien
aacagttgctgcctgcgattggaac

SEQ ID NO: 32652 - DNA, 25 bp, Homo sapien
aacgaagtggttatcaccagggctg

SEQ ID NO: 32653 - DNA, 25 bp, Homo sapien
tgttactctttaactctccgccacg

SEQ ID NO: 32654 - DNA, 25 bp, Homo sapien
cggctttctaatgggaacgaagtgg

SEQ ID NO: 32655 - DNA, 25 bp, Homo sapien
tggttatcaccagggctgggacgct

SEQ ID NO: 32656 - DNA, 25 bp, Homo sapien
tgaggagatgtatttgacattcaga

SEQ ID NO: 32657 - DNA, 25 bp, Homo sapien
cattcagagatgtcgcagcaccctg

SEQ ID NO: 32658 - DNA, 25 bp, Homo sapien
agatgtcgcagcaccctgcccggta

SEQ ID NO: 32659 - DNA, 25 bp, Homo sapien
cgccacggctttctaatgggaacga

SEQ ID NO: 32660 - DNA, 25 bp, Homo sapien
tgtacaccctcaagcgccacgagag

SEQ ID NO: 32661 - DNA, 25 bp, Homo sapien
cgcacttccgcgagcaggacggcat

SEQ ID NO: 32662 - DNA, 25 bp, Homo sapien
gccgatgtcaacgtgcccacgtgct

SEQ ID NO: 32663 - DNA, 25 bp, Homo sapien
gggaagactttctcttgcatgtaca

SEQ ID NO: 32664 - DNA, 25 bp, Homo sapien
gcggcaagagcttccagtactcgca

SEQ ID NO: 32665 - DNA, 25 bp, Homo sapien
aacctgagccgccatgccgtggtgc

SEQ ID NO: 32666 - DNA, 25 bp, Homo sapien
ccacgtgctcgctgtgtgggaagac

SEQ ID NO: 32667 - DNA, 25 bp, Homo sapien
agaagccctacacatgcacccagtg

SEQ ID NO: 32668 - DNA, 25 bp, Homo sapien
aggtgacacctcattttggccagtg

SEQ ID NO: 32669 - DNA, 25 bp, Homo sapien
aagtttcacccgacgctccaggtca

SEQ ID NO: 32670 - DNA, 25 bp, Homo sapien
ggcatcgcgcatctctcaaaggctc

SEQ ID NO: 32671 - DNA, 25 bp, Homo sapien
ctcgccagacgcaaaactgcaactg

SEQ ID NO: 32672 - DNA, 25 bp, Homo sapien
cgggcggtagctcctcaaactcgga

SEQ ID NO: 32673 - DNA, 25 bp, Homo sapien
cccgtgcaaacctcgcgagcggaaa

SEQ ID NO: 32674 - DNA, 25 bp, Homo sapien
tctcgctttcaaactggagaggcgc

SEQ ID NO: 32675 - DNA, 25 bp, Homo sapien
cggcgaacgccatggctccagtgac

SEQ ID NO: 32676 - DNA, 25 bp, Homo sapien
caggcgggagggtcctgctctccac

SEQ ID NO: 32677 - DNA, 25 bp, Homo sapien
gacgccagtcgcaggcgagcgacta

SEQ ID NO: 32678 - DNA, 25 bp, Homo sapien
ccggctactttcaggcctctaggga

SEQ ID NO: 32679 - DNA, 25 bp, Homo sapien
gccgacgtcccacgggaatgcgcga

SEQ ID NO: 32680 - DNA, 25 bp, Homo sapien
caggcgccatgtcagcccgggaagt

SEQ ID NO: 32681 - DNA, 25 bp, Homo sapien
ctgagctgctatggctccgcccttt

SEQ ID NO: 32682 - DNA, 25 bp, Homo sapien
tccgccctttggaggtagagagacg

SEQ ID NO: 32683 - DNA, 25 bp, Homo sapien
gtgcaggttcgcactccggctactt

SEQ ID NO: 32684 - DNA, 25 bp, Homo sapien
ccaaagctcgggtgggcttgaacct

SEQ ID NO: 32685 - DNA, 25 bp, Homo sapien
ggtgctcaacgtgtacgacatggtg

SEQ ID NO: 32686 - DNA, 25 bp, Homo sapien
tattttttaatcctcgcactcgtcg

SEQ ID NO: 32687 - DNA, 25 bp, Homo sapien
tcgcactcgtcgacgctccggtgaa

SEQ ID NO: 32688 - DNA, 25 bp, Homo sapien
tccggtgaacccagtcagcccgagg

SEQ ID NO: 32689 - DNA, 25 bp, Homo sapien
cgacgtgcagtgtcctttcggcaaa

SEQ ID NO: 32690 - DNA, 25 bp, Homo sapien
tgccgccattttaggtcccgaggtg

SEQ ID NO: 32691 - DNA, 25 bp, Homo sapien
ttcggcaaagcttccgttgcgtttc

SEQ ID NO: 32692 - DNA, 25 bp, Homo sapien
tttagttactgctccgaggccctcg

SEQ ID NO: 32693 - DNA, 25 bp, Homo sapien
gcgcgtgagcttgcctgagcttctt

SEQ ID NO: 32694 - DNA, 25 bp, Homo sapien
cggtgctggggttactttcatttat

SEQ ID NO: 32695 - DNA, 25 bp, Homo sapien
tgtgctttcattcctacggtgctgg

SEQ ID NO: 32696 - DNA, 25 bp, Homo sapien
aaccgtcgggctggacaacaacgct

SEQ ID NO: 32697 - DNA, 25 bp, Homo sapien
gctcgctgcgaacctcaagataacc

SEQ ID NO: 32698 - DNA, 25 bp, Homo sapien
ggcacccgcaggctttagttactgc

SEQ ID NO: 32699 - DNA, 25 bp, Homo sapien
taacccttggtttccatgcacatcc

SEQ ID NO: 32700 - DNA, 25 bp, Homo sapien
gtgccgtgcagtttagctccttcgc

SEQ ID NO: 32701 - DNA, 25 bp, Homo sapien
gacctcgtcgccgttgtccttggtg

SEQ ID NO: 32702 - DNA, 25 bp, Homo sapien
ccttggtggcgatggcataccgcat

SEQ ID NO: 32703 - DNA, 25 bp, Homo sapien
cataccgcatgacgcggtcagggtc

SEQ ID NO: 32704 - DNA, 25 bp, Homo sapien
cggtcagggtcgatgactgtgtccc

SEQ ID NO: 32705 - DNA, 25 bp, Homo sapien
cttctcccagcggatgatgatgggc

SEQ ID NO: 32706 - DNA, 25 bp, Homo sapien
gcggatgatgatgggccgctcaccc

SEQ ID NO: 32707 - DNA, 25 bp, Homo sapien
agctccttcgcatggcccttgatgg

SEQ ID NO: 32708 - DNA, 25 bp, Homo sapien
aacttccacggatcgggcgggcctg

SEQ ID NO: 32709 - DNA, 25 bp, Homo sapien
atctcagacccgcttgtctcgcagg

SEQ ID NO: 32710 - DNA, 25 bp, Homo sapien
ttggaggcattgctgctccgctcct

SEQ ID NO: 32711 - DNA, 25 bp, Homo sapien
tgcaaagctcttaatcagtgaactg

SEQ ID NO: 32712 - DNA, 25 bp, Homo sapien
ggaccgagcggttcgcatttgcaaa

SEQ ID NO: 32713 - DNA, 25 bp, Homo sapien
tacctcagtagacgcgaattaattc

SEQ ID NO: 32714 - DNA, 25 bp, Homo sapien
accagagaacaatgcgcgccggagc

SEQ ID NO: 32715 - DNA, 25 bp, Homo sapien
cgagcacccgtaatccaccagagaa

SEQ ID NO: 32716 - DNA, 25 bp, Homo sapien
acattccctaaaatggcggccggcg

SEQ ID NO: 32717 - DNA, 25 bp, Homo sapien
tcgccaggaatctaggagtcggttt

SEQ ID NO: 32718 - DNA, 25 bp, Homo sapien
tggccggaaggacaaaggacactta

SEQ ID NO: 32719 - DNA, 25 bp, Homo sapien
cgcggttctatgttaaagccactta

SEQ ID NO: 32720 - DNA, 25 bp, Homo sapien
ccaacgtgctgacgcatgttcatta

SEQ ID NO: 32721 - DNA, 25 bp, Homo sapien
cagaggcatttttccttcggggacg

SEQ ID NO: 32722 - DNA, 25 bp, Homo sapien
ccgagcttggaagaaagtgtgaccc

SEQ ID NO: 32723 - DNA, 25 bp, Homo sapien
ccactgcggagcgttaggaacattc

SEQ ID NO: 32724 - DNA, 25 bp, Homo sapien
gctcggccttgagacccttgtcaga

SEQ ID NO: 32725 - DNA, 25 bp, Homo sapien
ttcctggaaaccctgatcgtcgccg

SEQ ID NO: 32726 - DNA, 25 bp, Homo sapien
atcgtcgccgttctcgtcttccgag

SEQ ID NO: 32727 - DNA, 25 bp, Homo sapien
tagctccatctggtcgccgtccaga

SEQ ID NO: 32728 - DNA, 25 bp, Homo sapien
cgtccagagcggagattccttcctc

SEQ ID NO: 32729 - DNA, 25 bp, Homo sapien
cccttgtcagaaaggcgtcgcttct

SEQ ID NO: 32730 - DNA, 25 bp, Homo sapien
ggcctctcggctaatctgggattcc

SEQ ID NO: 32731 - DNA, 25 bp, Homo sapien
cgtcgcttcttgagctcctctttca

SEQ ID NO: 32732 - DNA, 25 bp, Homo sapien
gccgcctgaatctgacgggatcctc

SEQ ID NO: 32733 - DNA, 25 bp, Homo sapien
ggtgctgataatggcgtcgttgttc

SEQ ID NO: 32734 - DNA, 25 bp, Homo sapien
tgggccctcgtccatctggagttcc

SEQ ID NO: 32735 - DNA, 25 bp, Homo sapien
gttatcgttaggcatctcccaggcg

SEQ ID NO: 32736 - DNA, 25 bp, Homo sapien
acaccgcggccgaggttatcgttag

SEQ ID NO: 32737 - DNA, 25 bp, Homo sapien
agcaacatgctaggcccgggacaag

SEQ ID NO: 32738 - DNA, 25 bp, Homo sapien
gggaccgtgtgatgaagcaacatgc

SEQ ID NO: 32739 - DNA, 25 bp, Homo sapien
cgggatcctctgtttgcgccgaaac

SEQ ID NO: 32740 - DNA, 25 bp, Homo sapien
cgagcgccgccacataaaatggatc

SEQ ID NO: 32741 - DNA, 25 bp, Homo sapien
cggagacgcgttaccagacccatct

SEQ ID NO: 32742 - DNA, 25 bp, Homo sapien
ctctcctctggaaaagccaccatga

SEQ ID NO: 32743 - DNA, 25 bp, Homo sapien
gcacggactgacttggctgaagaaa

SEQ ID NO: 32744 - DNA, 25 bp, Homo sapien
gccaccatgaattcggtagctggga

SEQ ID NO: 32745 - DNA, 25 bp, Homo sapien
gagccctgattgtatccctcgcttt

SEQ ID NO: 32746 - DNA, 25 bp, Homo sapien
caccgctgaagaaaccttgccctga

SEQ ID NO: 32747 - DNA, 25 bp, Homo sapien
cccgagtctggatctttatattttg

SEQ ID NO: 32748 - DNA, 25 bp, Homo sapien
gcggagaaggaggagtcccacgaag

SEQ ID NO: 32749 - DNA, 25 bp, Homo sapien
gtcccacgcgggaaaaggagagtgc

SEQ ID NO: 32750 - DNA, 25 bp, Homo sapien
gctgcccatcaacgcctgcagggaa

SEQ ID NO: 32751 - DNA, 25 bp, Homo sapien
gatgtgctgcccatcaacgcctgca

SEQ ID NO: 32752 - DNA, 25 bp, Homo sapien
gtcaggatgggatgtgctgcccatc

SEQ ID NO: 32753 - DNA, 25 bp, Homo sapien
agcctgagaatctgcatcatctgaa

SEQ ID NO: 32754 - DNA, 25 bp, Homo sapien
tgcatcatctgaatgaggtagaatc

SEQ ID NO: 32755 - DNA, 25 bp, Homo sapien
tagaatctggaggagtctggactgt

SEQ ID NO: 32756 - DNA, 25 bp, Homo sapien
ggcgatgcatctcctcaccggaaga

SEQ ID NO: 32757 - DNA, 25 bp, Homo sapien
tctcctcaccggaagagctttgtgg

SEQ ID NO: 32758 - DNA, 25 bp, Homo sapien
tcaccggaagagctttgtggaactc

SEQ ID NO: 32759 - DNA, 25 bp, Homo sapien
gaactccgggcgatgcatctcctca

SEQ ID NO: 32760 - DNA, 25 bp, Homo sapien
ctcctcaccggaagagctttgtgga

SEQ ID NO: 32761 - DNA, 25 bp, Homo sapien
ctttgtggaactccgggcgatgcat

SEQ ID NO: 32762 - DNA, 25 bp, Homo sapien
ccctcaccggaagagctttgtggaa

SEQ ID NO: 32763 - DNA, 25 bp, Homo sapien
cgggcgatgcatctcctcaccggaa

SEQ ID NO: 32764 - DNA, 25 bp, Homo sapien
ccgaggcgccggtggaagcacaaac

SEQ ID NO: 32765 - DNA, 25 bp, Homo sapien
aagcacaaaccacccggcgagtcag

SEQ ID NO: 32766 - DNA, 25 bp, Homo sapien
gaagcacaaaccacccggcgagtca

SEQ ID NO: 32767 - DNA, 25 bp, Homo sapien
ggaagcacaaaccacccggcgagtc

SEQ ID NO: 32768 - DNA, 25 bp, Homo sapien
tggaagcacaaaccacccggcgagt

SEQ ID NO: 32769 - DNA, 25 bp, Homo sapien
ggcgccggtggaagcacaaaccacc

SEQ ID NO: 32770 - DNA, 25 bp, Homo sapien
aaaccacccggcgagtcagagcagg

SEQ ID NO: 32771 - DNA, 25 bp, Homo sapien
aggcgccggtggaagcacaaaccac

SEQ ID NO: 32772 - DNA, 25 bp, Homo sapien
tgcgcgctgccatcttaggcccagt

SEQ ID NO: 32773 - DNA, 25 bp, Homo sapien
ccgctgcgcgctgccatcttaggcc

SEQ ID NO: 32774 - DNA, 25 bp, Homo sapien
gcgcgctgccatcttaggcccagtc

SEQ ID NO: 32775 - DNA, 25 bp, Homo sapien
tgggcgctgccatcttaggcccagt

SEQ ID NO: 32776 - DNA, 25 bp, Homo sapien
gctgcgcgctgccatcttaggccca

SEQ ID NO: 32777 - DNA, 25 bp, Homo sapien
cgctgcgcgctgccatcttaggccc

SEQ ID NO: 32778 - DNA, 25 bp, Homo sapien
ctgggcgctgccatcttaggcccag

SEQ ID NO: 32779 - DNA, 25 bp, Homo sapien
gggcgctgccatcttaggcccagtc

SEQ ID NO: 32780 - DNA, 25 bp, Homo sapien
cagactttgtccctatcgtgccagc

SEQ ID NO: 32781 - DNA, 25 bp, Homo sapien
gactgcctgaagtgcaacacgtttg

SEQ ID NO: 32782 - DNA, 25 bp, Homo sapien
agctcctgcgaagaaggccgcatgc

SEQ ID NO: 32783 - DNA, 25 bp, Homo sapien
acggccctctctgacaaggagctca

SEQ ID NO: 32784 - DNA, 25 bp, Homo sapien
tgcgacaccgtcatctacatcgggc

SEQ ID NO: 32785 - DNA, 25 bp, Homo sapien
acggaaaggccaccacattaactgc

SEQ ID NO: 32786 - DNA, 25 bp, Homo sapien
agtacacatccagctcgtccggcgg

SEQ ID NO: 32787 - DNA, 25 bp, Homo sapien
aacacgtttgccgagctgcaggaga

SEQ ID NO: 32788 - DNA, 25 bp, Homo sapien
tggccgcacacatcagtgagaactg

SEQ ID NO: 32789 - DNA, 25 bp, Homo sapien
gtttattcgcgcctgatattcagca

SEQ ID NO: 32790 - DNA, 25 bp, Homo sapien
cacgatgggctcatcgtcgagggcc

SEQ ID NO: 32791 - DNA, 25 bp, Homo sapien
tgcggtggctgccatcccgcacgat

SEQ ID NO: 32792 - DNA, 25 bp, Homo sapien
tccgacatggtgtactggttggtgc

SEQ ID NO: 32793 - DNA, 25 bp, Homo sapien
ggggttgaccaccttctcgctgaag

SEQ ID NO: 32794 - DNA, 25 bp, Homo sapien
gcctgtgacgttcatgtggctgatg

SEQ ID NO: 32795 - DNA, 25 bp, Homo sapien
gatattcagcactgcccaccaagtt

SEQ ID NO: 32796 - DNA, 25 bp, Homo sapien
caggactccacgagcgagaacagca

SEQ ID NO: 32797 - DNA, 25 bp, Homo sapien
agtccaagatctccgccgtgagcag

SEQ ID NO: 32798 - DNA, 25 bp, Homo sapien
cccggtgggaagcacacgccctggt

SEQ ID NO: 32799 - DNA, 25 bp, Homo sapien
ggtccacgcagtccctcagcaggaa

SEQ ID NO: 32800 - DNA, 25 bp, Homo sapien
tcagcgggcgcatctcggagctgct

SEQ ID NO: 32801 - DNA, 25 bp, Homo sapien
gggaagacggccctgttctaccaca

SEQ ID NO: 32802 - DNA, 25 bp, Homo sapien
ccgaagaaacgctccaatccaggta

SEQ ID NO: 32803 - DNA, 25 bp, Homo sapien
tctccttgcaggtgggcgaactgcc

SEQ ID NO: 32804 - DNA, 25 bp, Homo sapien
cgtacggtgagcaggtcctagactt

SEQ ID NO: 32805 - DNA, 25 bp, Homo sapien
cgtggaagtgtgtttgtctccgcta

SEQ ID NO: 32806 - DNA, 25 bp, Homo sapien
aagggcccgacgctcctgctgcggt

SEQ ID NO: 32807 - DNA, 25 bp, Homo sapien
cctagacttcggctggcccactggt

SEQ ID NO: 32808 - DNA, 25 bp, Homo sapien
ccgtttgcacacacgtgggagcgta

SEQ ID NO: 32809 - DNA, 25 bp, Homo sapien
ccgaatctaacagggtgcccgtttg

SEQ ID NO: 32810 - DNA, 25 bp, Homo sapien
cgttcgcaagcaacgcgggtgcaaa

SEQ ID NO: 32811 - DNA, 25 bp, Homo sapien
cactggtctcaggagaagggcccga

SEQ ID NO: 32812 - DNA, 25 bp, Homo sapien
ggaaagccatcgtctctagcctagg

SEQ ID NO: 32813 - DNA, 25 bp, Homo sapien
gggaaagccatcgtctctagcctag

SEQ ID NO: 32814 - DNA, 25 bp, Homo sapien
aaagccatcgtctccggcctaggga

SEQ ID NO: 32815 - DNA, 25 bp, Homo sapien
aagccatcgtctctagcctagggaa

SEQ ID NO: 32816 - DNA, 25 bp, Homo sapien
aaagccatcgtctctagcctaggga

SEQ ID NO: 32817 - DNA, 25 bp, Homo sapien
aaagccatcgtctgtagcctaggga

SEQ ID NO: 32818 - DNA, 25 bp, Homo sapien
cccagggaaagccatcgtctctagc

SEQ ID NO: 32819 - DNA, 25 bp, Homo sapien
ggaaagccatcgtctgtagcctagg

SEQ ID NO: 32820 - DNA, 25 bp, Homo sapien
ctcggacactgtgcccggctttagt

SEQ ID NO: 32821 - DNA, 25 bp, Homo sapien
ggctttagtaggtgcctcggacact

SEQ ID NO: 32822 - DNA, 25 bp, Homo sapien
cctcggacactgtgcccggctttag

SEQ ID NO: 32823 - DNA, 25 bp, Homo sapien
ccggctttagtaggtgccgcggaca

SEQ ID NO: 32824 - DNA, 25 bp, Homo sapien
cggctttagtaggtgcctcggacac

SEQ ID NO: 32825 - DNA, 25 bp, Homo sapien
gctttagtaggtgcctcggacactg

SEQ ID NO: 32826 - DNA, 25 bp, Homo sapien
ccggctttagtaggtgcctcggaca

SEQ ID NO: 32827 - DNA, 25 bp, Homo sapien
tgtgcccggctttagtaggtgcctc

SEQ ID NO: 32828 - DNA, 25 bp, Homo sapien
gcccatggcgactgcgcagaagaca

SEQ ID NO: 32829 - DNA, 25 bp, Homo sapien
gatccgagcggaagagtagctctcc

SEQ ID NO: 32830 - DNA, 25 bp, Homo sapien
cacacagctcgcgactcaggtaggc

SEQ ID NO: 32831 - DNA, 25 bp, Homo sapien
agggcgctccttacgcacccgagaa

SEQ ID NO: 32832 - DNA, 25 bp, Homo sapien
tgcacaccgtgtacgccaagggatc

SEQ ID NO: 32833 - DNA, 25 bp, Homo sapien
tgcgaacttttccaccttcagcggc

SEQ ID NO: 32834 - DNA, 25 bp, Homo sapien
acctgaaggtggtcgtaaggctccg

SEQ ID NO: 32835 - DNA, 25 bp, Homo sapien
agcggtcgcagacgacgccacgact

SEQ ID NO: 32836 - DNA, 25 bp, Homo sapien
tgtccggactcgtactctatggttg

SEQ ID NO: 32837 - DNA, 25 bp, Homo sapien
ctcagctactgtgggtctcctattg

SEQ ID NO: 32838 - DNA, 25 bp, Homo sapien
gacgccttccttggcggattcctga

SEQ ID NO: 32839 - DNA, 25 bp, Homo sapien
gggccaggtcaagcggaagtaaaca

SEQ ID NO: 32840 - DNA, 25 bp, Homo sapien
acactagagcctgcgcatgcgaaca

SEQ ID NO: 32841 - DNA, 25 bp, Homo sapien
gttcctcgccggcaaatgctttcgc

SEQ ID NO: 32842 - DNA, 25 bp, Homo sapien
cgcagggtatcccacgtggaacatt

SEQ ID NO: 32843 - DNA, 25 bp, Homo sapien
ggcccgctccaagaatcacctagtg

SEQ ID NO: 32844 - DNA, 25 bp, Homo sapien
gaggacggcttcagtcgtgcataca

SEQ ID NO: 32845 - DNA, 25 bp, Homo sapien
ggacggcttcatcgtggtgcataca

SEQ ID NO: 32846 - DNA, 25 bp, Homo sapien
cactacagggaggacggcttcagtc

SEQ ID NO: 32847 - DNA, 25 bp, Homo sapien
ggacggcttcagtcgtgcatacaca

SEQ ID NO: 32848 - DNA, 25 bp, Homo sapien
tggtgcatacacacgatgggctctg

SEQ ID NO: 32849 - DNA, 25 bp, Homo sapien
acactctacagggaggacggcttca

SEQ ID NO: 32850 - DNA, 25 bp, Homo sapien
aggacggcttcagtcgtgcatacac

SEQ ID NO: 32851 - DNA, 25 bp, Homo sapien
gacggcttcatcgtggtgcatacac

SEQ ID NO: 32852 - DNA, 25 bp, Homo sapien
gaggccatccgcagattttctcgca

SEQ ID NO: 32853 - DNA, 25 bp, Homo sapien
ccaaacgagcgtttctcccgcaggg

SEQ ID NO: 32854 - DNA, 25 bp, Homo sapien
gcgcgtctggcttcaccggccagtt

SEQ ID NO: 32855 - DNA, 25 bp, Homo sapien
ccgagcagaggcctttccacctggt

SEQ ID NO: 32856 - DNA, 25 bp, Homo sapien
actcgtcatggcgaccgagcagagg

SEQ ID NO: 32857 - DNA, 25 bp, Homo sapien
cgcctgccaggcttggaagcggact

SEQ ID NO: 32858 - DNA, 25 bp, Homo sapien
ggccagagccctgcagaacaaaccg

SEQ ID NO: 32859 - DNA, 25 bp, Homo sapien
tccagcagggctagaagatgcgctg

SEQ ID NO: 32860 - DNA, 25 bp, Homo sapien
gcagagtcccggtgccgagcaaagc

SEQ ID NO: 32861 - DNA, 25 bp, Homo sapien
ttactgcgagttcaggcagagtccc

SEQ ID NO: 32862 - DNA, 25 bp, Homo sapien
cggtttcattactgcgagttcaggc

SEQ ID NO: 32863 - DNA, 25 bp, Homo sapien
tcactcagatcgcagcgggctccgg

SEQ ID NO: 32864 - DNA, 25 bp, Homo sapien
agcccgcaggtcactcagatcgcag

SEQ ID NO: 32865 - DNA, 25 bp, Homo sapien
cgggaagcccgcaggtcactcagat

SEQ ID NO: 32866 - DNA, 25 bp, Homo sapien
gggagattctgtctcagaggcctcg

SEQ ID NO: 32867 - DNA, 25 bp, Homo sapien
ggcctcgggctgcacgttcttccgg

SEQ ID NO: 32868 - DNA, 25 bp, Homo sapien
tgcgccgacaaaaccgagttccaca

SEQ ID NO: 32869 - DNA, 25 bp, Homo sapien
gactacgagtcccacagtgccttgc

SEQ ID NO: 32870 - DNA, 25 bp, Homo sapien
cgctcctccggtccgagattatgta

SEQ ID NO: 32871 - DNA, 25 bp, Homo sapien
attatgtaacgaagcccggcgcccg

SEQ ID NO: 32872 - DNA, 25 bp, Homo sapien
ggtccgtcacagcatctcccgggag

SEQ ID NO: 32873 - DNA, 25 bp, Homo sapien
accgctcagcggctaaaacgcagtc

SEQ ID NO: 32874 - DNA, 25 bp, Homo sapien
cctggaagggcggatcatttacaaa

SEQ ID NO: 32875 - DNA, 25 bp, Homo sapien
gttctcgcgatggttccgcgctcta

SEQ ID NO: 32876 - DNA, 25 bp, Homo sapien
tctccgcggtgcagaagtagtcatt

SEQ ID NO: 32877 - DNA, 25 bp, Homo sapien
atcttgccggcagcgttctccgcgg

SEQ ID NO: 32878 - DNA, 25 bp, Homo sapien
ccaggtaccatcgaagggccgcgct

SEQ ID NO: 32879 - DNA, 25 bp, Homo sapien
gctccggatcttgccggcagcgttc

SEQ ID NO: 32880 - DNA, 25 bp, Homo sapien
gcagaagtagtcattgtcgtggata

SEQ ID NO: 32881 - DNA, 25 bp, Homo sapien
tgtcgtggataaagctattgaaggc

SEQ ID NO: 32882 - DNA, 25 bp, Homo sapien
atgtgcggcacgtcgtagatgtcgt

SEQ ID NO: 32883 - DNA, 25 bp, Homo sapien
ccctgtggccaggtaccatcgaagg

SEQ ID NO: 32884 - DNA, 25 bp, Homo sapien
tcccgcaggatgtggaggattttcg

SEQ ID NO: 32885 - DNA, 25 bp, Homo sapien
atccggtggacgatcggctcctcac

SEQ ID NO: 32886 - DNA, 25 bp, Homo sapien
ggtgcacaggcccatcttgcacagg

SEQ ID NO: 32887 - DNA, 25 bp, Homo sapien
tctaagaagtcgaatgccaggcgga

SEQ ID NO: 32888 - DNA, 25 bp, Homo sapien
cgtgcccgcggttctaagaagtcga

SEQ ID NO: 32889 - DNA, 25 bp, Homo sapien
gtgaccggaagtggcctctgcagcc

SEQ ID NO: 32890 - DNA, 25 bp, Homo sapien
aggactcgggttcacagtcgctccc

SEQ ID NO: 32891 - DNA, 25 bp, Homo sapien
cttagctgggcggagcaattccggt

SEQ ID NO: 32892 - DNA, 25 bp, Homo sapien
tgtgctcaccagtgccttggcgtca

SEQ ID NO: 32893 - DNA, 25 bp, Homo sapien
gcagctcagagctctgggaagtgcc

SEQ ID NO: 32894 - DNA, 25 bp, Homo sapien
tcagagctctgggaagtgcctcttc

SEQ ID NO: 32895 - DNA, 25 bp, Homo sapien
cacactgtgctcaccagtgccttgg

SEQ ID NO: 32896 - DNA, 25 bp, Homo sapien
ccttggcgtcatcccctgagaggtg

SEQ ID NO: 32897 - DNA, 25 bp, Homo sapien
ctgagaggtgggcatatgtccctgt

SEQ ID NO: 32898 - DNA, 25 bp, Homo sapien
catatgtccctgtgggcgggtgaca

SEQ ID NO: 32899 - DNA, 25 bp, Homo sapien
agagctctgggaagtgcctcttccc

SEQ ID NO: 32900 - DNA, 25 bp, Homo sapien
gcatgcctcgggaaagggaaaccga

SEQ ID NO: 32901 - DNA, 25 bp, Homo sapien
gcttttccctgtctttcggtcattc

SEQ ID NO: 32902 - DNA, 25 bp, Homo sapien
cctgtctttcggtcattcggttttg

SEQ ID NO: 32903 - DNA, 25 bp, Homo sapien
cattcggttttgtttcttccgctca

SEQ ID NO: 32904 - DNA, 25 bp, Homo sapien
cgccacttttgcttttccctgtctt

SEQ ID NO: 32905 - DNA, 25 bp, Homo sapien
tcactctggggcatgcctcgggaaa

SEQ ID NO: 32906 - DNA, 25 bp, Homo sapien
gaagccaaatttggccaccagcgca

SEQ ID NO: 32907 - DNA, 25 bp, Homo sapien
tttcttccgctcactctggggcatg

SEQ ID NO: 32908 - DNA, 25 bp, Homo sapien
tcctgcagacactcagcgagccgtg

SEQ ID NO: 32909 - DNA, 25 bp, Homo sapien
tccgtgtctgtcatcgtcagccctg

SEQ ID NO: 32910 - DNA, 25 bp, Homo sapien
tctctccatgtcaactttgcaaagg

SEQ ID NO: 32911 - DNA, 25 bp, Homo sapien
agaagctgccaccaatagccacgtg

SEQ ID NO: 32912 - DNA, 25 bp, Homo sapien
tgcagttggtcatcaggagcctcga

SEQ ID NO: 32913 - DNA, 25 bp, Homo sapien
gaagcgtcgctcaccatgcctggaa

SEQ ID NO: 32914 - DNA, 25 bp, Homo sapien
ctcggctcagcagaagccctgcaga

SEQ ID NO: 32915 - DNA, 25 bp, Homo sapien
ccctggagatccgtggagccacacg

SEQ ID NO: 32916 - DNA, 25 bp, Homo sapien
ggtcacttcttcatccaggctgttc

SEQ ID NO: 32917 - DNA, 25 bp, Homo sapien
gctcttctgtgcagtacgggccatg

SEQ ID NO: 32918 - DNA, 25 bp, Homo sapien
ggcaccacaccggtaaggcttctgg

SEQ ID NO: 32919 - DNA, 25 bp, Homo sapien
gttcggacacacgtaggacttcttg

SEQ ID NO: 32920 - DNA, 25 bp, Homo sapien
tgttctctagagatcgcgggttgcc

SEQ ID NO: 32921 - DNA, 25 bp, Homo sapien
tgaagctcttgacgcagtaccggca

SEQ ID NO: 32922 - DNA, 25 bp, Homo sapien
cgcagatgccggatgaagttgaccc

SEQ ID NO: 32923 - DNA, 25 bp, Homo sapien
gttgaccctccagcggaagattttc

SEQ ID NO: 32924 - DNA, 25 bp, Homo sapien
tggaggcgcctgaaaaacaatggtg

SEQ ID NO: 32925 - DNA, 25 bp, Homo sapien
gaaaaacaatggtgttgctttctcc

SEQ ID NO: 32926 - DNA, 25 bp, Homo sapien
acacgcggccagtggacgcccggaa

SEQ ID NO: 32927 - DNA, 25 bp, Homo sapien
ggaggtctccgcatctcagtggttc

SEQ ID NO: 32928 - DNA, 25 bp, Homo sapien
agctcccagcctttcgcggaggagg

SEQ ID NO: 32929 - DNA, 25 bp, Homo sapien
gatcatccggaaagccacggctcgg

SEQ ID NO: 32930 - DNA, 25 bp, Homo sapien
gaagtccagggcagccgtcctcatc

SEQ ID NO: 32931 - DNA, 25 bp, Homo sapien
ctccgctctaggactggggaggtct

SEQ ID NO: 32932 - DNA, 25 bp, Homo sapien
ggtgtcagcacacgacagcttgatc

SEQ ID NO: 32933 - DNA, 25 bp, Homo sapien
gcacggtgcatgagaacggcatagt

SEQ ID NO: 32934 - DNA, 25 bp, Homo sapien
cctgcacgaaggagttgccgaagcc

SEQ ID NO: 32935 - DNA, 25 bp, Homo sapien
gcaattgcaccgtcaggaccacctg

SEQ ID NO: 32936 - DNA, 25 bp, Homo sapien
tgccgcccgcagaatggcaattgca

SEQ ID NO: 32937 - DNA, 25 bp, Homo sapien
aaaaagttgttcagcacctgccgcc

SEQ ID NO: 32938 - DNA, 25 bp, Homo sapien
cagagccacgagctgctgacagaga

SEQ ID NO: 32939 - DNA, 25 bp, Homo sapien
gccggcacctcacagaaaaagttgt

SEQ ID NO: 32940 - DNA, 25 bp, Homo sapien
ggtgacgccgtctgcactagcgccg

SEQ ID NO: 32941 - DNA, 25 bp, Homo sapien
tgacgtcgccgcgtacacgtacctg

SEQ ID NO: 32942 - DNA, 25 bp, Homo sapien
ggcggtgcagtcaccgctgcctctg

SEQ ID NO: 32943 - DNA, 25 bp, Homo sapien
accgctgcctctgccagttcgtgtg

SEQ ID NO: 32944 - DNA, 25 bp, Homo sapien
tctgccagttcgtgtgtgggacgcc

SEQ ID NO: 32945 - DNA, 25 bp, Homo sapien
tgggacgccggccatcaccgcattt

SEQ ID NO: 32946 - DNA, 25 bp, Homo sapien
tttccacggtgacgccgtctgcact

SEQ ID NO: 32947 - DNA, 25 bp, Homo sapien
tcaggcaaatccatggcccgcgtgg

SEQ ID NO: 32948 - DNA, 25 bp, Homo sapien
tccgggcgcatttgggcggcgccat

SEQ ID NO: 32949 - DNA, 25 bp, Homo sapien
cacccgaaggcgctgagtcccggcg

SEQ ID NO: 32950 - DNA, 25 bp, Homo sapien
acagcgagggttccggagcctgcaa

SEQ ID NO: 32951 - DNA, 25 bp, Homo sapien
cacagcctaacggcctccgggcgca

SEQ ID NO: 32952 - DNA, 25 bp, Homo sapien
gcctctggaccgccttcctcgccct

SEQ ID NO: 32953 - DNA, 25 bp, Homo sapien
agagcggtcgcccaggacgtggacc

SEQ ID NO: 32954 - DNA, 25 bp, Homo sapien
cggcgccatgtttcctccccgctta

SEQ ID NO: 32955 - DNA, 25 bp, Homo sapien
gcttaccgccgccacccgaaggcgc

SEQ ID NO: 32956 - DNA, 25 bp, Homo sapien
ggggttcgctcgagcctcacgacgc

SEQ ID NO: 32957 - DNA, 25 bp, Homo sapien
gcctgccaccattcgtgattttccg

SEQ ID NO: 32958 - DNA, 25 bp, Homo sapien
ggcgcctgccaccattcgtgatttt

SEQ ID NO: 32959 - DNA, 25 bp, Homo sapien
cccgcgactggggactcggaacctg

SEQ ID NO: 32960 - DNA, 25 bp, Homo sapien
tgcgtcctgaggatcccgcccttgg

SEQ ID NO: 32961 - DNA, 25 bp, Homo sapien
actaacggttactggtcgctgctgc

SEQ ID NO: 32962 - DNA, 25 bp, Homo sapien
gggctgctccactaacggttactgg

SEQ ID NO: 32963 - DNA, 25 bp, Homo sapien
agcccaaccgcccttgtcctggacg

SEQ ID NO: 32964 - DNA, 25 bp, Homo sapien
ggaaagttaccagccacatgccata

SEQ ID NO: 32965 - DNA, 25 bp, Homo sapien
gaacaaacttgctatccgagggacc

SEQ ID NO: 32966 - DNA, 25 bp, Homo sapien
agcgccatgcggtgcgccaacattc

SEQ ID NO: 32967 - DNA, 25 bp, Homo sapien
tccgaggcctgaataagcaaggact

SEQ ID NO: 32968 - DNA, 25 bp, Homo sapien
ctcctaggtcaagagtcacggcctg

SEQ ID NO: 32969 - DNA, 25 bp, Homo sapien
cccgcgcaggtctcacctttgtgta

SEQ ID NO: 32970 - DNA, 25 bp, Homo sapien
cctttgtgtaaagagtccaggagca

SEQ ID NO: 32971 - DNA, 25 bp, Homo sapien
agcggagaatctcgcatcttggggc

SEQ ID NO: 32972 - DNA, 25 bp, Homo sapien
ctcactcagtgtgggtctctttgcc

SEQ ID NO: 32973 - DNA, 25 bp, Homo sapien
ttgaactgaagccagcggacaccac

SEQ ID NO: 32974 - DNA, 25 bp, Homo sapien
aagcactctcctgtcgtcgaactcg

SEQ ID NO: 32975 - DNA, 25 bp, Homo sapien
ggctcgtctgagctcttgaactgaa

SEQ ID NO: 32976 - DNA, 25 bp, Homo sapien
acagcttctgcctcaggtgcatctc

SEQ ID NO: 32977 - DNA, 25 bp, Homo sapien
aggtgcatctccgagttctgcgaga

SEQ ID NO: 32978 - DNA, 25 bp, Homo sapien
tttgcgacacacacccattatttta

SEQ ID NO: 32979 - DNA, 25 bp, Homo sapien
agcgcctgagtggtggcttttcacc

SEQ ID NO: 32980 - DNA, 25 bp, Homo sapien
ctgctctacacactggtgtctcctg

SEQ ID NO: 32981 - DNA, 25 bp, Homo sapien
gaccgaggtatcagacgagaggccc

SEQ ID NO: 32982 - DNA, 25 bp, Homo sapien
ccgccgaccacgatgagagcgtgaa

SEQ ID NO: 32983 - DNA, 25 bp, Homo sapien
agggctctgctctacacactggtgt

SEQ ID NO: 32984 - DNA, 25 bp, Homo sapien
tctcgaaaggaagggctctgctcta

SEQ ID NO: 32985 - DNA, 25 bp, Homo sapien
ggcacgccttccagaccgaggtatc

SEQ ID NO: 32986 - DNA, 25 bp, Homo sapien
agagcgtgaagaccctctcgaaagg

SEQ ID NO: 32987 - DNA, 25 bp, Homo sapien
tgtttatcatcttccgcacctgcgc

SEQ ID NO: 32988 - DNA, 25 bp, Homo sapien
ggaactgagctcactggctcctctc

SEQ ID NO: 32989 - DNA, 25 bp, Homo sapien
ccctttcgcggaactgagctcactg

SEQ ID NO: 32990 - DNA, 25 bp, Homo sapien
ctgggcgtgtccctttcgcggaact

SEQ ID NO: 32991 - DNA, 25 bp, Homo sapien
gctaggcagtgtttccgagtcccag

SEQ ID NO: 32992 - DNA, 25 bp, Homo sapien
cctacaagtctctaggctaggcagt

SEQ ID NO: 32993 - DNA, 25 bp, Homo sapien
gctctctcgggcctacaagtctcta

SEQ ID NO: 32994 - DNA, 25 bp, Homo sapien
cgtcaggtacgggttcaccaagcca

SEQ ID NO: 32995 - DNA, 25 bp, Homo sapien
tcaggacgcagctgccggtccagct

SEQ ID NO: 32996 - DNA, 25 bp, Homo sapien
ccgtgcgtgaatctgctcgctgatc

SEQ ID NO: 32997 - DNA, 25 bp, Homo sapien
tccagactgacgtggtccgagaggc

SEQ ID NO: 32998 - DNA, 25 bp, Homo sapien
tccgagaggcctcgcaagtgctcca

SEQ ID NO: 32999 - DNA, 25 bp, Homo sapien
tgctccacggagtcgcacttctgca

SEQ ID NO: 33000 - DNA, 25 bp, Homo sapien
gtcgcacttctgcaggtctgaagcc

SEQ ID NO: 33001 - DNA, 25 bp, Homo sapien
cagctcttggccgtccagactgacg

SEQ ID NO: 33002 - DNA, 25 bp, Homo sapien
agccaccgtgcgcaggctcagcaga

SEQ ID NO: 33003 - DNA, 25 bp, Homo sapien
atctgctccaggttacgaagggcca

SEQ ID NO: 33004 - DNA, 25 bp, Homo sapien
acgcgggcatccaggattgcattta

SEQ ID NO: 33005 - DNA, 25 bp, Homo sapien
acgtgggcatccaggattgcattta

SEQ ID NO: 33006 - DNA, 25 bp, Homo sapien
cgggcatcgaggattgcatttaccg

SEQ ID NO: 33007 - DNA, 25 bp, Homo sapien
ccacgcgggcatccaggattgcatt

SEQ ID NO: 33008 - DNA, 25 bp, Homo sapien
cacgcgggcatccaggattgcattt

SEQ ID NO: 33009 - DNA, 25 bp, Homo sapien
gcatccaggattgcatttaccgggg

SEQ ID NO: 33010 - DNA, 25 bp, Homo sapien
cgcgggcatccaggattgcatttac

SEQ ID NO: 33011 - DNA, 25 bp, Homo sapien
ccacgtgggcatccaggattgcatt

SEQ ID NO: 33012 - DNA, 25 bp, Homo sapien
tgtgtaaatcccactcctcgaggcc

SEQ ID NO: 33013 - DNA, 25 bp, Homo sapien
cggacggctccgatgtgtaaatccc

SEQ ID NO: 33014 - DNA, 25 bp, Homo sapien
ggaaccctccactaacggcgtctga

SEQ ID NO: 33015 - DNA, 25 bp, Homo sapien
gcctctggaccttgcaccttgaacg

SEQ ID NO: 33016 - DNA, 25 bp, Homo sapien
tcactcccgtgaagtcggcggaacc

SEQ ID NO: 33017 - DNA, 25 bp, Homo sapien
ggcgaaggcaaagtcgatttccaaa

SEQ ID NO: 33018 - DNA, 25 bp, Homo sapien
cgcgacgccgaaagtgagctggtaa

SEQ ID NO: 33019 - DNA, 25 bp, Homo sapien
gctggtaaacttccggcagtggctc

SEQ ID NO: 33020 - DNA, 25 bp, Homo sapien
gctgtggctagtcttctcccatctg

SEQ ID NO: 33021 - DNA, 25 bp, Homo sapien
aggggctcgctcaaagaaagtttgc

SEQ ID NO: 33022 - DNA, 25 bp, Homo sapien
gtcttcccagcaaccggtgacactg

SEQ ID NO: 33023 - DNA, 25 bp, Homo sapien
cagactgaccactagccgacgcggg

SEQ ID NO: 33024 - DNA, 25 bp, Homo sapien
gggcagcagtcctcagctgtggcta

SEQ ID NO: 33025 - DNA, 25 bp, Homo sapien
ggctggcgtcaccacgacaaacgtc

SEQ ID NO: 33026 - DNA, 25 bp, Homo sapien
gacaaacgtcgccaggctgagccga

SEQ ID NO: 33027 - DNA, 25 bp, Homo sapien
gccaccgggttctggcagcgttaaa

SEQ ID NO: 33028 - DNA, 25 bp, Homo sapien
ctcaacgtgcatcggcgcaaccatg

SEQ ID NO: 33029 - DNA, 25 bp, Homo sapien
tgctttggcaagagctctacgctga

SEQ ID NO: 33030 - DNA, 25 bp, Homo sapien
tacgctgacgcgacacctgcagacg

SEQ ID NO: 33031 - DNA, 25 bp, Homo sapien
tctgcagtgagtgcggacaaagctt

SEQ ID NO: 33032 - DNA, 25 bp, Homo sapien
ttggggacaacctctgaccctgctg

SEQ ID NO: 33033 - DNA, 25 bp, Homo sapien
cgctgcttcagcgagagttccacgc

SEQ ID NO: 33034 - DNA, 25 bp, Homo sapien
cgtgcgtgtccaatctcaacgtgca

SEQ ID NO: 33035 - DNA, 25 bp, Homo sapien
agcggccgtcttgacctacacttgg

SEQ ID NO: 33036 - DNA, 25 bp, Homo sapien
tacagggtgttgaagctcagcgcta

SEQ ID NO: 33037 - DNA, 25 bp, Homo sapien
ggggcggtccacacatttcatcttg

SEQ ID NO: 33038 - DNA, 25 bp, Homo sapien
tttcatcttgaatagggcagcggcc

SEQ ID NO: 33039 - DNA, 25 bp, Homo sapien
gcagcggcctttactggtttctagg

SEQ ID NO: 33040 - DNA, 25 bp, Homo sapien
gagcggactaatcccaatggcagtt

SEQ ID NO: 33041 - DNA, 25 bp, Homo sapien
cgcgcgcagcgtttctcttttaaga

SEQ ID NO: 33042 - DNA, 25 bp, Homo sapien
ccgggaatcgtggttgcccgactca

SEQ ID NO: 33043 - DNA, 25 bp, Homo sapien
tcagcgctaccatgtgagtgtcgtc

SEQ ID NO: 33044 - DNA, 25 bp, Homo sapien
ggccgttatcgccaaccgtatctgt

SEQ ID NO: 33045 - DNA, 25 bp, Homo sapien
tggtcgttagcttcgattcccggcc

SEQ ID NO: 33046 - DNA, 25 bp, Homo sapien
ttccgagtagtaactgcttgccaga

SEQ ID NO: 33047 - DNA, 25 bp, Homo sapien
gtcacttagtggcaagcgtttttcc

SEQ ID NO: 33048 - DNA, 25 bp, Homo sapien
agggtacgcgcaggcacaataaagc

SEQ ID NO: 33049 - DNA, 25 bp, Homo sapien
tggacgctaaggcactcgttaactg

SEQ ID NO: 33050 - DNA, 25 bp, Homo sapien
ccgggccttcccattggacgctaag

SEQ ID NO: 33051 - DNA, 25 bp, Homo sapien
acgtcgcgaccagtcagtagggttc

SEQ ID NO: 33052 - DNA, 25 bp, Homo sapien
agcaactcatggtgcctccgctttg

SEQ ID NO: 33053 - DNA, 25 bp, Homo sapien
gaggtcactttctaggcagcccagc

SEQ ID NO: 33054 - DNA, 25 bp, Homo sapien
cagaaccctccgcagagtaaaggta

SEQ ID NO: 33055 - DNA, 25 bp, Homo sapien
gtctaccagatcaacgtcctccggg

SEQ ID NO: 33056 - DNA, 25 bp, Homo sapien
tttttgagccttacggagccgtcta

SEQ ID NO: 33057 - DNA, 25 bp, Homo sapien
acggagctttggatcactcagacca

SEQ ID NO: 33058 - DNA, 25 bp, Homo sapien
ctacgactcattaggcactttgcca

SEQ ID NO: 33059 - DNA, 25 bp, Homo sapien
gcctccgctttgttttagttcatca

SEQ ID NO: 33060 - DNA, 25 bp, Homo sapien
agaagcaacaggagactgccgccga

SEQ ID NO: 33061 - DNA, 25 bp, Homo sapien
agatttttccaaagggcagtcaagc

SEQ ID NO: 33062 - DNA, 25 bp, Homo sapien
cctctctcctctcgaggggcggaga

SEQ ID NO: 33063 - DNA, 25 bp, Homo sapien
tgaggcttgagctgctttcccgcct

SEQ ID NO: 33064 - DNA, 25 bp, Homo sapien
agactcccaggaggacccgccgagt

SEQ ID NO: 33065 - DNA, 25 bp, Homo sapien
agctgaccgcggaggaccgcacaca

SEQ ID NO: 33066 - DNA, 25 bp, Homo sapien
cgacgccgatctccttgtttacatc

SEQ ID NO: 33067 - DNA, 25 bp, Homo sapien
ggcagtcaagctccgagaagcaaca

SEQ ID NO: 33068 - DNA, 25 bp, Homo sapien
gttggcgttgatgttgcgttttctc

SEQ ID NO: 33069 - DNA, 25 bp, Homo sapien
gcgttttctcaacggcggcatccga

SEQ ID NO: 33070 - DNA, 25 bp, Homo sapien
taggcctcagtgtgctcgcgctgca

SEQ ID NO: 33071 - DNA, 25 bp, Homo sapien
tccgaggagttcgtcctcaccactg

SEQ ID NO: 33072 - DNA, 25 bp, Homo sapien
cagcgagccctctggtgccggacgt

SEQ ID NO: 33073 - DNA, 25 bp, Homo sapien
aggtcctggagtctcgatggtcgct

SEQ ID NO: 33074 - DNA, 25 bp, Homo sapien
gcgttttcgggatccctctaggcgc

SEQ ID NO: 33075 - DNA, 25 bp, Homo sapien
ttatttcggccgttctggcctcgca

SEQ ID NO: 33076 - DNA, 25 bp, Homo sapien
gggcggcatttgcagtctcacctcc

SEQ ID NO: 33077 - DNA, 25 bp, Homo sapien
cagaagcgatgagcggaagctgttc

SEQ ID NO: 33078 - DNA, 25 bp, Homo sapien
tgttccaggcgccaacagaagctgc

SEQ ID NO: 33079 - DNA, 25 bp, Homo sapien
tcaggaaagcgtcttcctcccacag

SEQ ID NO: 33080 - DNA, 25 bp, Homo sapien
acctccgcagtgtgtgccgccagaa

SEQ ID NO: 33081 - DNA, 25 bp, Homo sapien
gtcataaaaagcaccgacaaaggcg

SEQ ID NO: 33082 - DNA, 25 bp, Homo sapien
ctggaaacccacgtgtgcagtcata

SEQ ID NO: 33083 - DNA, 25 bp, Homo sapien
cacagcaggcgtggacggctctcct

SEQ ID NO: 33084 - DNA, 25 bp, Homo sapien
gagctcagaaacatctccgattgga

SEQ ID NO: 33085 - DNA, 25 bp, Homo sapien
gtgaacaaatatcgccacgtgtgcg

SEQ ID NO: 33086 - DNA, 25 bp, Homo sapien
ctggggctcccgtgaacaaatatcg

SEQ ID NO: 33087 - DNA, 25 bp, Homo sapien
ctccgattggaacacgacacagacc

SEQ ID NO: 33088 - DNA, 25 bp, Homo sapien
ctctccgaagagctcagaaacatct

SEQ ID NO: 33089 - DNA, 25 bp, Homo sapien
cggcttcggatgcagctggaataag

SEQ ID NO: 33090 - DNA, 25 bp, Homo sapien
gctggaataaggttccagtgttccc

SEQ ID NO: 33091 - DNA, 25 bp, Homo sapien
tggaacacgacacagaccatccttc

SEQ ID NO: 33092 - DNA, 25 bp, Homo sapien
cattgtgttagaagagtggccgccg

SEQ ID NO: 33093 - DNA, 25 bp, Homo sapien
tccgcgcaggcattgtgttagaaga

SEQ ID NO: 33094 - DNA, 25 bp, Homo sapien
gcagcaccgcgtggacaagagcccg

SEQ ID NO: 33095 - DNA, 25 bp, Homo sapien
ccgcgcgggttgttcatgagaacca

SEQ ID NO: 33096 - DNA, 25 bp, Homo sapien
tgagaaccaggtgtctctcgggtcg

SEQ ID NO: 33097 - DNA, 25 bp, Homo sapien
cggcggagggcatttctcttttgct

SEQ ID NO: 33098 - DNA, 25 bp, Homo sapien
tcttttgctttgctgtcctgggctc

SEQ ID NO: 33099 - DNA, 25 bp, Homo sapien
tccacagagtgttccgcgcaggcat

SEQ ID NO: 33100 - DNA, 25 bp, Homo sapien
atgcccgaggtctcacgtcaggacc

SEQ ID NO: 33101 - DNA, 25 bp, Homo sapien
aaggcctttgtgacaccggggacag

SEQ ID NO: 33102 - DNA, 25 bp, Homo sapien
gctgtaaaaacgcagccagcttttg

SEQ ID NO: 33103 - DNA, 25 bp, Homo sapien
gcgattaattccgactgtggctcca

SEQ ID NO: 33104 - DNA, 25 bp, Homo sapien
gtggctccaagtcccatggccaagg

SEQ ID NO: 33105 - DNA, 25 bp, Homo sapien
cgcaatttgtgacgctctcgagcca

SEQ ID NO: 33106 - DNA, 25 bp, Homo sapien
cgcgtctggctgataaggcctttgt

SEQ ID NO: 33107 - DNA, 25 bp, Homo sapien
cccaggagatctggctcggtgtgta

SEQ ID NO: 33108 - DNA, 25 bp, Homo sapien
atgcgaccagtgtcccaaggccttc

SEQ ID NO: 33109 - DNA, 25 bp, Homo sapien
cgcagcctcagttcaggaattgttc

SEQ ID NO: 33110 - DNA, 25 bp, Homo sapien
cagcgggtccttgctacacagagac

SEQ ID NO: 33111 - DNA, 25 bp, Homo sapien
ccggcctgcttggtgcagactgcaa

SEQ ID NO: 33112 - DNA, 25 bp, Homo sapien
tccggcctcaagcagcacaagcata

SEQ ID NO: 33113 - DNA, 25 bp, Homo sapien
ccacagcacggtgaagcctttcata

SEQ ID NO: 33114 - DNA, 25 bp, Homo sapien
tttcatatgtgagtggtcgcccagc

SEQ ID NO: 33115 - DNA, 25 bp, Homo sapien
tcgggcccttccgtgtgactaggaa

SEQ ID NO: 33116 - DNA, 25 bp, Homo sapien
tgaagaccaggagcagcgacatgtc

SEQ ID NO: 33117 - DNA, 25 bp, Homo sapien
cccacaacttgctggtcaaggccga

SEQ ID NO: 33118 - DNA, 25 bp, Homo sapien
gggactccatcaaggccatcgcatc

SEQ ID NO: 33119 - DNA, 25 bp, Homo sapien
ttgaggacgtcaacaccaccacggg

SEQ ID NO: 33120 - DNA, 25 bp, Homo sapien
tcctgtgtggagaagctgaagacca

SEQ ID NO: 33121 - DNA, 25 bp, Homo sapien
gcatccattgccgagaagtactttg

SEQ ID NO: 33122 - DNA, 25 bp, Homo sapien
tgggcttcaacgagtactttccctc

SEQ ID NO: 33123 - DNA, 25 bp, Homo sapien
aggtgcctgtcttctattcccagca

SEQ ID NO: 33124 - DNA, 25 bp, Homo sapien
cccaggtacgtcctcagtgcaggtc

SEQ ID NO: 33125 - DNA, 25 bp, Homo sapien
cagggtagaaaagcggaaggtcaca

SEQ ID NO: 33126 - DNA, 25 bp, Homo sapien
ctgttgtccagcagggtagaaaagc

SEQ ID NO: 33127 - DNA, 25 bp, Homo sapien
ctctgtgctgttgtccagcagggta

SEQ ID NO: 33128 - DNA, 25 bp, Homo sapien
acgtaaccctctgtgctgttgtcca

SEQ ID NO: 33129 - DNA, 25 bp, Homo sapien
gtcagggcgccctgtaacccacacg

SEQ ID NO: 33130 - DNA, 25 bp, Homo sapien
acgtcctcagtgcaggtcagggcgc

SEQ ID NO: 33131 - DNA, 25 bp, Homo sapien
tggggtacgtaaccctctgtgctgt

SEQ ID NO: 33132 - DNA, 25 bp, Homo sapien
aatatctgatcgggcggagcaagcc

SEQ ID NO: 33133 - DNA, 25 bp, Homo sapien
caggcgcatcctgcgtttgtttgtg

SEQ ID NO: 33134 - DNA, 25 bp, Homo sapien
ccctgattttcctcgggatgggctg

SEQ ID NO: 33135 - DNA, 25 bp, Homo sapien
taaacttagcgcctcccattgtttc

SEQ ID NO: 33136 - DNA, 25 bp, Homo sapien
ggctgagttcacagctaaacttagc

SEQ ID NO: 33137 - DNA, 25 bp, Homo sapien
gcgcccaggctgagttcacagctaa

SEQ ID NO: 33138 - DNA, 25 bp, Homo sapien
tttgtgaaacctgcgcccaggctga

SEQ ID NO: 33139 - DNA, 25 bp, Homo sapien
ccacctggtttgtgaaacctgcgcc

SEQ ID NO: 33140 - DNA, 25 bp, Homo sapien
ccgtggcccacctgaagcagcaagt

SEQ ID NO: 33141 - DNA, 25 bp, Homo sapien
ggcaacgaattccaggtgtccctga

SEQ ID NO: 33142 - DNA, 25 bp, Homo sapien
cctgagcagctccatgtcggtgtca

SEQ ID NO: 33143 - DNA, 25 bp, Homo sapien
ctgaaggcgcagatcacccagaaga

SEQ ID NO: 33144 - DNA, 25 bp, Homo sapien
gcacctacgaggtacggctgacgca

SEQ ID NO: 33145 - DNA, 25 bp, Homo sapien
accgtgttcatgaatctgcgcctgc

SEQ ID NO: 33146 - DNA, 25 bp, Homo sapien
acgacctgttctggctgaccttcga

SEQ ID NO: 33147 - DNA, 25 bp, Homo sapien
gtggacaaatgcgacgaacctctga

SEQ ID NO: 33148 - DNA, 25 bp, Homo sapien
gccaagccggcacgccaggcaaaag

SEQ ID NO: 33149 - DNA, 25 bp, Homo sapien
ggctacccggaccactttgatccga

SEQ ID NO: 33150 - DNA, 25 bp, Homo sapien
ctttgatccgaaggcactggaggcc

SEQ ID NO: 33151 - DNA, 25 bp, Homo sapien
gtagccctgtgggacagtggttccc

SEQ ID NO: 33152 - DNA, 25 bp, Homo sapien
aggcaaaagcggctcggacgccctc

SEQ ID NO: 33153 - DNA, 25 bp, Homo sapien
ttggctcagacgctcatggtaaggc

SEQ ID NO: 33154 - DNA, 25 bp, Homo sapien
gcccaggatgctgccgtgcctcgta

SEQ ID NO: 33155 - DNA, 25 bp, Homo sapien
agtcccagcccaagggtagctggag

SEQ ID NO: 33156 - DNA, 25 bp, Homo sapien
agtgccacctgtgcaaccgctgctt

SEQ ID NO: 33157 - DNA, 25 bp, Homo sapien
agagtcggacaaccacgcactttta

SEQ ID NO: 33158 - DNA, 25 bp, Homo sapien
tctccggtgtccctaagaaacctgc

SEQ ID NO: 33159 - DNA, 25 bp, Homo sapien
agagaacctcgtgctctccggtgtc

SEQ ID NO: 33160 - DNA, 25 bp, Homo sapien
gcacgagcacgagaacgcaccaggt

SEQ ID NO: 33161 - DNA, 25 bp, Homo sapien
cttcgggcagcagaccaacctggac

SEQ ID NO: 33162 - DNA, 25 bp, Homo sapien
ggtgtaagtactgcgaccgctcctt

SEQ ID NO: 33163 - DNA, 25 bp, Homo sapien
tggaccggcacctcaagaagcacga

SEQ ID NO: 33164 - DNA, 25 bp, Homo sapien
ctcttcctgcgggttcttggcgaga

SEQ ID NO: 33165 - DNA, 25 bp, Homo sapien
cacgtcgctcttcctgcgggttctt

SEQ ID NO: 33166 - DNA, 25 bp, Homo sapien
acgacacagtcgtcacgtcgctctt

SEQ ID NO: 33167 - DNA, 25 bp, Homo sapien
actccggatggacgacacagtcgtc

SEQ ID NO: 33168 - DNA, 25 bp, Homo sapien
acctgtgcctgagactccggatgga

SEQ ID NO: 33169 - DNA, 25 bp, Homo sapien
gtgtcctccacgtggctgccctggg

SEQ ID NO: 33170 - DNA, 25 bp, Homo sapien
cttggcgagacacagcttgagaaca

SEQ ID NO: 33171 - DNA, 25 bp, Homo sapien
ccctggggagcaatcccagcggatc

SEQ ID NO: 33172 - DNA, 25 bp, Homo sapien
agccggatgcgactttggacccgcc

SEQ ID NO: 33173 - DNA, 25 bp, Homo sapien
gccctccagccagaccgcgcaggaa

SEQ ID NO: 33174 - DNA, 25 bp, Homo sapien
agtccgggcgatcacgtgggctcca

SEQ ID NO: 33175 - DNA, 25 bp, Homo sapien
aggcgcgatccagtccgggcgatca

SEQ ID NO: 33176 - DNA, 25 bp, Homo sapien
ccacgcctggcaggcgactcccggg

SEQ ID NO: 33177 - DNA, 25 bp, Homo sapien
ccggcagccgcaacaacttcgcgac

SEQ ID NO: 33178 - DNA, 25 bp, Homo sapien
agcgaagcggctgcaggacaggaca

SEQ ID NO: 33179 - DNA, 25 bp, Homo sapien
gctgagccggatgcgactttggacc

SEQ ID NO: 33180 - DNA, 25 bp, Homo sapien
gctctcctcggactccgcgtaagtg

SEQ ID NO: 33181 - DNA, 25 bp, Homo sapien
aggtgaccctgcttcgcaacagcga

SEQ ID NO: 33182 - DNA, 25 bp, Homo sapien
tccaggtggagaagatagagccgtc

SEQ ID NO: 33183 - DNA, 25 bp, Homo sapien
cgcccagatgaaccacatccaggtg

SEQ ID NO: 33184 - DNA, 25 bp, Homo sapien
atggtccaggactacgcccagatga

SEQ ID NO: 33185 - DNA, 25 bp, Homo sapien
ccacagcgaggagagctacatggtc

SEQ ID NO: 33186 - DNA, 25 bp, Homo sapien
ggactcgaaagccatggcctctgtt

SEQ ID NO: 33187 - DNA, 25 bp, Homo sapien
ggcacatgctctacgtgacactcgg

SEQ ID NO: 33188 - DNA, 25 bp, Homo sapien
agctcgtcctggagcacggcaatgt

SEQ ID NO: 33189 - DNA, 25 bp, Homo sapien
cgcgctcaccaaacttctctgtgag

SEQ ID NO: 33190 - DNA, 25 bp, Homo sapien
cccgacgtcgtcatcctggaagagt

SEQ ID NO: 33191 - DNA, 25 bp, Homo sapien
gcacgaaaggcagctcgccgtccag

SEQ ID NO: 33192 - DNA, 25 bp, Homo sapien
agctcgccgtccaggtccaccatcg

SEQ ID NO: 33193 - DNA, 25 bp, Homo sapien
ctggaagagttgcggcagctcgtcc

SEQ ID NO: 33194 - DNA, 25 bp, Homo sapien
acttctctgtgagcgtgtgttcgcc

SEQ ID NO: 33195 - DNA, 25 bp, Homo sapien
ggccgcacgaaaggcagctcgccgt

SEQ ID NO: 33196 - DNA, 25 bp, Homo sapien
cagctggggcaaactcgagaaggca

SEQ ID NO: 33197 - DNA, 25 bp, Homo sapien
aggcgcactcatccacatctgcggg

SEQ ID NO: 33198 - DNA, 25 bp, Homo sapien
cggctggaggcgcactcatccacat

SEQ ID NO: 33199 - DNA, 25 bp, Homo sapien
agtggtgctcgcagccgccacggct

SEQ ID NO: 33200 - DNA, 25 bp, Homo sapien
gtgcagtggtgctcgcagccgccac

SEQ ID NO: 33201 - DNA, 25 bp, Homo sapien
agcactggaaggagccggccaggtt

SEQ ID NO: 33202 - DNA, 25 bp, Homo sapien
cctacggtcctcgtgcagccggtag

SEQ ID NO: 33203 - DNA, 25 bp, Homo sapien
ggcgggagactcacggctgcagccc

SEQ ID NO: 33204 - DNA, 25 bp, Homo sapien
cacgtgtgcacaccgacattcatgg

SEQ ID NO: 33205 - DNA, 25 bp, Homo sapien
ctggtaccaggcacctgcacgtgca

SEQ ID NO: 33206 - DNA, 25 bp, Homo sapien
cggtagccggcgtagcagccgcact

SEQ ID NO: 33207 - DNA, 25 bp, Homo sapien
ccagggttgttggtgcacacctgct

SEQ ID NO: 33208 - DNA, 25 bp, Homo sapien
ggcagcacgggctgtctgcacagtc

SEQ ID NO: 33209 - DNA, 25 bp, Homo sapien
cagtcgtcgacatctgtggagcaca

SEQ ID NO: 33210 - DNA, 25 bp, Homo sapien
ttcatggcacctgcagacaatcgca

SEQ ID NO: 33211 - DNA, 25 bp, Homo sapien
cgcagccatcggcactgagccggta

SEQ ID NO: 33212 - DNA, 25 bp, Homo sapien
acgggttcagcttctccagagcgtt

SEQ ID NO: 33213 - DNA, 25 bp, Homo sapien
tgggcacccaatgcccgcagtgctt

SEQ ID NO: 33214 - DNA, 25 bp, Homo sapien
gctgcgtgagcatcacacgggttca

SEQ ID NO: 33215 - DNA, 25 bp, Homo sapien
ccagagcgtttaggaaggcgcctta

SEQ ID NO: 33216 - DNA, 25 bp, Homo sapien
aggcgccttacttgtcaccagagtc

SEQ ID NO: 33217 - DNA, 25 bp, Homo sapien
gggcaggcctggtctatatcgacag

SEQ ID NO: 33218 - DNA, 25 bp, Homo sapien
atatcgacagggcagcaacccactg

SEQ ID NO: 33219 - DNA, 25 bp, Homo sapien
gcctactcgctgctgagcgtcagct

SEQ ID NO: 33220 - DNA, 25 bp, Homo sapien
caggtgacatgggtagcagcccctc

SEQ ID NO: 33221 - DNA, 25 bp, Homo sapien
ggtgaccgactcctcagcgcccacg

SEQ ID NO: 33222 - DNA, 25 bp, Homo sapien
tcagcgcccacggaccctgtcccag

SEQ ID NO: 33223 - DNA, 25 bp, Homo sapien
ccctgtcccagaagcaggcgcgcct

SEQ ID NO: 33224 - DNA, 25 bp, Homo sapien
aggcagcgccctggcgcaaacttta

SEQ ID NO: 33225 - DNA, 25 bp, Homo sapien
agcccaaggcaccagagcgcggcca

SEQ ID NO: 33226 - DNA, 25 bp, Homo sapien
ccctccagaggtagcggtagtgcgt

SEQ ID NO: 33227 - DNA, 25 bp, Homo sapien
ggaccaaccgcgctgcgccctaagc

SEQ ID NO: 33228 - DNA, 25 bp, Homo sapien
agatgccgtctagcctcctggctgg

SEQ ID NO: 33229 - DNA, 25 bp, Homo sapien
tgcgttcgtgctcactctcggctgc

SEQ ID NO: 33230 - DNA, 25 bp, Homo sapien
ctcgctcggcaagactacatttttg

SEQ ID NO: 33231 - DNA, 25 bp, Homo sapien
agagaaaacacagcaggctcctggc

SEQ ID NO: 33232 - DNA, 25 bp, Homo sapien
cacggtgactcggagccctagccat

SEQ ID NO: 33233 - DNA, 25 bp, Homo sapien
agccatcccaaacacgcagagctgg

SEQ ID NO: 33234 - DNA, 25 bp, Homo sapien
cggtccctggccgagatgccgtcta

SEQ ID NO: 33235 - DNA, 25 bp, Homo sapien
gggtgaccaagcaacgcggcccttc

SEQ ID NO: 33236 - DNA, 25 bp, Homo sapien
ccaggcttctttctcacgcttcgaa

SEQ ID NO: 33237 - DNA, 25 bp, Homo sapien
tctcgccaggttttcaggactgacg

SEQ ID NO: 33238 - DNA, 25 bp, Homo sapien
tgggaaagtcagtggcagaagacac

SEQ ID NO: 33239 - DNA, 25 bp, Homo sapien
agaaggacacgttcgggctggacct

SEQ ID NO: 33240 - DNA, 25 bp, Homo sapien
cagtacgcgcctctcgccaggtttt

SEQ ID NO: 33241 - DNA, 25 bp, Homo sapien
tcccttctgtttgcaggggaattcc

SEQ ID NO: 33242 - DNA, 25 bp, Homo sapien
cgggctcccttctgtttgcagggga

SEQ ID NO: 33243 - DNA, 25 bp, Homo sapien
gattccgggccagcccgagtgcacg

SEQ ID NO: 33244 - DNA, 25 bp, Homo sapien
tggacccggtgcagcacacgtactc

SEQ ID NO: 33245 - DNA, 25 bp, Homo sapien
gagacaagtgcacctcgcccacgga

SEQ ID NO: 33246 - DNA, 25 bp, Homo sapien
gattaggcattaactcgggtgcagc

SEQ ID NO: 33247 - DNA, 25 bp, Homo sapien
ttaactcgggtgcagccgcacttcc

SEQ ID NO: 33248 - DNA, 25 bp, Homo sapien
ggagatcctcaacgtggacccggtg

SEQ ID NO: 33249 - DNA, 25 bp, Homo sapien
cgtcacgtctcctccagattaggca

SEQ ID NO: 33250 - DNA, 25 bp, Homo sapien
tcctcgcggagacaagtgcacctcg

SEQ ID NO: 33251 - DNA, 25 bp, Homo sapien
gcacacgtactcctgcaaggtgcgc

SEQ ID NO: 33252 - DNA, 25 bp, Homo sapien
acagccaccagacaacgcgcagcca

SEQ ID NO: 33253 - DNA, 25 bp, Homo sapien
aacgcgcagccaccagacaacccac

SEQ ID NO: 33254 - DNA, 25 bp, Homo sapien
ccagacaacgcgcagccaccagaca

SEQ ID NO: 33255 - DNA, 25 bp, Homo sapien
cgcgcagccaccagacaacccacag

SEQ ID NO: 33256 - DNA, 25 bp, Homo sapien
caacgcgcagccaccagacaaccca

SEQ ID NO: 33257 - DNA, 25 bp, Homo sapien
acgcgcagccaccagacaacccaca

SEQ ID NO: 33258 - DNA, 25 bp, Homo sapien
gcacagccaccagacaacgcgcagc

SEQ ID NO: 33259 - DNA, 25 bp, Homo sapien
cagacaacgcgcagccaccagacaa

SEQ ID NO: 33260 - DNA, 25 bp, Homo sapien
cctccgtggtatacacctgcctgta

SEQ ID NO: 33261 - DNA, 25 bp, Homo sapien
actgactctgcgtcagccgggttcc

SEQ ID NO: 33262 - DNA, 25 bp, Homo sapien
agcctttggcaaacggcgttgctga

SEQ ID NO: 33263 - DNA, 25 bp, Homo sapien
ttcatggctctgctgagtcctctgg

SEQ ID NO: 33264 - DNA, 25 bp, Homo sapien
ctgcctgtagcccatgtagtagacg

SEQ ID NO: 33265 - DNA, 25 bp, Homo sapien
actggctgtattcggctctcactgc

SEQ ID NO: 33266 - DNA, 25 bp, Homo sapien
cagcctcgctgacgtcgcttttgca

SEQ ID NO: 33267 - DNA, 25 bp, Homo sapien
agtgttccctgagtctctcgtgttg

SEQ ID NO: 33268 - DNA, 25 bp, Homo sapien
ctcttcaaggaacgacatcgtgcgc

SEQ ID NO: 33269 - DNA, 25 bp, Homo sapien
tgctactcacatgccgggctgcagc

SEQ ID NO: 33270 - DNA, 25 bp, Homo sapien
gaacgacatcgtgcgcgccggtgcc

SEQ ID NO: 33271 - DNA, 25 bp, Homo sapien
ttcaaggaacgacatcgtgcgcgcc

SEQ ID NO: 33272 - DNA, 25 bp, Homo sapien
cgcctcttcaaggaacgacatcgtg

SEQ ID NO: 33273 - DNA, 25 bp, Homo sapien
ctcgcctcttcaaggaacgacatcg

SEQ ID NO: 33274 - DNA, 25 bp, Homo sapien
gagctcggtccaccacgggcctcca

SEQ ID NO: 33275 - DNA, 25 bp, Homo sapien
aaggaacgacatcgtgcgcgccggt

SEQ ID NO: 33276 - DNA, 25 bp, Homo sapien
tccaccttcgccctgacacctcacc

SEQ ID NO: 33277 - DNA, 25 bp, Homo sapien
tcctgcccgtggacgctccgtccac

SEQ ID NO: 33278 - DNA, 25 bp, Homo sapien
ggacgctccgtccaccttcgccctg

SEQ ID NO: 33279 - DNA, 25 bp, Homo sapien
gacgctccgtccaccttcgccctga

SEQ ID NO: 33280 - DNA, 25 bp, Homo sapien
tgcccgtggacgctccgtccacctt

SEQ ID NO: 33281 - DNA, 25 bp, Homo sapien
cctcacccacttcccgcagggcagg

SEQ ID NO: 33282 - DNA, 25 bp, Homo sapien
ttcgccctgacacctcacccacttc

SEQ ID NO: 33283 - DNA, 25 bp, Homo sapien
cgctccgtccaccttcgccctgaca

SEQ ID NO: 33284 - DNA, 25 bp, Homo sapien
tccagtgaccaatccaggaggggcc

SEQ ID NO: 33285 - DNA, 25 bp, Homo sapien
caaaggcagctctctgggatcccgg

SEQ ID NO: 33286 - DNA, 25 bp, Homo sapien
gctccctgctcgtctcatgcggaaa

SEQ ID NO: 33287 - DNA, 25 bp, Homo sapien
gtccaagtcctaaccgactccagtg

SEQ ID NO: 33288 - DNA, 25 bp, Homo sapien
cgtctcatgcggaaagtccaagtcc

SEQ ID NO: 33289 - DNA, 25 bp, Homo sapien
cccagacctcgatctcaggagacag

SEQ ID NO: 33290 - DNA, 25 bp, Homo sapien
ctcacttctcaagtcccacggggaa

SEQ ID NO: 33291 - DNA, 25 bp, Homo sapien
aagtcccacggggaagccagcctcg

SEQ ID NO: 33292 - DNA, 25 bp, Homo sapien
gcattgctctgtggatccgtcacga

SEQ ID NO: 33293 - DNA, 25 bp, Homo sapien
ccgcgtcaaggagtacttcgtgttc

SEQ ID NO: 33294 - DNA, 25 bp, Homo sapien
cggggcagagccaatcgcggaaaac

SEQ ID NO: 33295 - DNA, 25 bp, Homo sapien
gccaaggggctccaagattcccagc

SEQ ID NO: 33296 - DNA, 25 bp, Homo sapien
gcatcccacttgcagggcgggtcac

SEQ ID NO: 33297 - DNA, 25 bp, Homo sapien
ccaggtcccggcagaagatcgctgc

SEQ ID NO: 33298 - DNA, 25 bp, Homo sapien
atccgtcacgaataagccgtgtgtg

SEQ ID NO: 33299 - DNA, 25 bp, Homo sapien
gagcgagctgtgacctgtgatcttt

SEQ ID NO: 33300 - DNA, 25 bp, Homo sapien
gcccgagcatctcagcatcagcagg

SEQ ID NO: 33301 - DNA, 25 bp, Homo sapien
ctctgagcatcagcagggcggggtg

SEQ ID NO: 33302 - DNA, 25 bp, Homo sapien
catctcagcatcagcagggcggggt

SEQ ID NO: 33303 - DNA, 25 bp, Homo sapien
ccgagcatctcagcatcagcagggc

SEQ ID NO: 33304 - DNA, 25 bp, Homo sapien
gagcatctcagcatcagcagggcgg

SEQ ID NO: 33305 - DNA, 25 bp, Homo sapien
cccgagcatctcagcatcagcaggg

SEQ ID NO: 33306 - DNA, 25 bp, Homo sapien
ctgagcatcagcagggcggggtgca

SEQ ID NO: 33307 - DNA, 25 bp, Homo sapien
agcatctcagcatcagcagggcggg

SEQ ID NO: 33308 - DNA, 25 bp, Homo sapien
aggcagggacgtctcccatgctcca

SEQ ID NO: 33309 - DNA, 25 bp, Homo sapien
aatgcaagaggcagggacgtctccc

SEQ ID NO: 33310 - DNA, 25 bp, Homo sapien
ttgatgactcactgaacctcgtcta

SEQ ID NO: 33311 - DNA, 25 bp, Homo sapien
tccacagcaccctcacgtggggtgg

SEQ ID NO: 33312 - DNA, 25 bp, Homo sapien
ttcacgttaaaatgcaagaggcagg

SEQ ID NO: 33313 - DNA, 25 bp, Homo sapien
tcactgaacctcgtctaatgggcgc

SEQ ID NO: 33314 - DNA, 25 bp, Homo sapien
acctcgtctaatgggcgcaagcttg

SEQ ID NO: 33315 - DNA, 25 bp, Homo sapien
cgcaagcttgccttttcacgttaaa

SEQ ID NO: 33316 - DNA, 25 bp, Homo sapien
acctctgcatgggattcgtctttgg

SEQ ID NO: 33317 - DNA, 25 bp, Homo sapien
tgcttggcggaaagcagccgttccc

SEQ ID NO: 33318 - DNA, 25 bp, Homo sapien
tctggtgcgcgcagagaacaactcc

SEQ ID NO: 33319 - DNA, 25 bp, Homo sapien
tcggaactcgcccagcatgtcgggt

SEQ ID NO: 33320 - DNA, 25 bp, Homo sapien
aggacatcggttcggagccagatca

SEQ ID NO: 33321 - DNA, 25 bp, Homo sapien
gggcttcactgacgcgactttccaa

SEQ ID NO: 33322 - DNA, 25 bp, Homo sapien
agccatgaagatgtgcgagtcagcc

SEQ ID NO: 33323 - DNA, 25 bp, Homo sapien
ccagcaaacagtgggtgagccatga

SEQ ID NO: 33324 - DNA, 25 bp, Homo sapien
cccggacttggatgaatactcatga

SEQ ID NO: 33325 - DNA, 25 bp, Homo sapien
ggtgtgacgcgccattcataggatc

SEQ ID NO: 33326 - DNA, 25 bp, Homo sapien
gtccaacacatcaccgggcaagctg

SEQ ID NO: 33327 - DNA, 25 bp, Homo sapien
ccgcgggttttgttgttggattcag

SEQ ID NO: 33328 - DNA, 25 bp, Homo sapien
ttggattcagccagttgacagaact

SEQ ID NO: 33329 - DNA, 25 bp, Homo sapien
acgggacaccagttccctggcgtgt

SEQ ID NO: 33330 - DNA, 25 bp, Homo sapien
cgcctaccatgctgtacgtcggtga

SEQ ID NO: 33331 - DNA, 25 bp, Homo sapien
agcctccttggtgcggtccaacaca

SEQ ID NO: 33332 - DNA, 25 bp, Homo sapien
cgctgagctgccaattaggagcata

SEQ ID NO: 33333 - DNA, 25 bp, Homo sapien
gcgcctcctcggtggcgtgcgacat

SEQ ID NO: 33334 - DNA, 25 bp, Homo sapien
atcccatgcgctgagctgccaatta

SEQ ID NO: 33335 - DNA, 25 bp, Homo sapien
tggagcttttcggttgctggaagac

SEQ ID NO: 33336 - DNA, 25 bp, Homo sapien
gctggaagactgttttgctttgctt

SEQ ID NO: 33337 - DNA, 25 bp, Homo sapien
aggttagcggctccctctcccagga

SEQ ID NO: 33338 - DNA, 25 bp, Homo sapien
agggaccgctttaaagtccgcagcg

SEQ ID NO: 33339 - DNA, 25 bp, Homo sapien
ggcatagtcctgttctctccggagc

SEQ ID NO: 33340 - DNA, 25 bp, Homo sapien
ggagcggcctttccagtcggggtga

SEQ ID NO: 33341 - DNA, 25 bp, Homo sapien
gacacacccacaggggttcctgttc

SEQ ID NO: 33342 - DNA, 25 bp, Homo sapien
cctgagcgtggagcggcctttccag

SEQ ID NO: 33343 - DNA, 25 bp, Homo sapien
ccctgagcgtggagcggcctttcca

SEQ ID NO: 33344 - DNA, 25 bp, Homo sapien
cagcaggggtgaggctttgccggcc

SEQ ID NO: 33345 - DNA, 25 bp, Homo sapien
aggccgttcaccgagagatgaggcc

SEQ ID NO: 33346 - DNA, 25 bp, Homo sapien
ccagtcggggtgaggccgttcaccg

SEQ ID NO: 33347 - DNA, 25 bp, Homo sapien
acagacggtggcgcaggggacacac

SEQ ID NO: 33348 - DNA, 25 bp, Homo sapien
ggaccggaagtcagcgtctgcattc

SEQ ID NO: 33349 - DNA, 25 bp, Homo sapien
cggaagtcagcgtctgcattcgagc

SEQ ID NO: 33350 - DNA, 25 bp, Homo sapien
cattcgagcctgtgtgcggtgcatg

SEQ ID NO: 33351 - DNA, 25 bp, Homo sapien
aagtcagcgtctgcattcgagcctg

SEQ ID NO: 33352 - DNA, 25 bp, Homo sapien
gtcagcgtctgcattcgagcctgtg

SEQ ID NO: 33353 - DNA, 25 bp, Homo sapien
agcgtctgcattcgagcctgtgtgc

SEQ ID NO: 33354 - DNA, 25 bp, Homo sapien
ggtgcatgggccaagggcgcccaca

SEQ ID NO: 33355 - DNA, 25 bp, Homo sapien
gtctgcattcgagcctgtgtgcggt

SEQ ID NO: 33356 - DNA, 25 bp, Homo sapien
agtccctcagacagtgcagagacgg

SEQ ID NO: 33357 - DNA, 25 bp, Homo sapien
acctcttgcagacgggagtccctca

SEQ ID NO: 33358 - DNA, 25 bp, Homo sapien
cttccagagcaaggatcgccacttc

SEQ ID NO: 33359 - DNA, 25 bp, Homo sapien
aggccgctgcctaggtctgcgaaat

SEQ ID NO: 33360 - DNA, 25 bp, Homo sapien
ctgcgaaatgggagcactgctgacc

SEQ ID NO: 33361 - DNA, 25 bp, Homo sapien
tcaggctccgcagaggactatggcc

SEQ ID NO: 33362 - DNA, 25 bp, Homo sapien
aagacctgtccgttctaggccgctc

SEQ ID NO: 33363 - DNA, 25 bp, Homo sapien
tgcaccgagtaccagggacagctcc

SEQ ID NO: 33364 - DNA, 25 bp, Homo sapien
tgaagcagggccacgactacagcac

SEQ ID NO: 33365 - DNA, 25 bp, Homo sapien
ccgcatgaccatctggcggggcctg

SEQ ID NO: 33366 - DNA, 25 bp, Homo sapien
ccaccatctccatcggcggctcagg

SEQ ID NO: 33367 - DNA, 25 bp, Homo sapien
tcatggaggccgtgcacttccgcgt

SEQ ID NO: 33368 - DNA, 25 bp, Homo sapien
aggcccgcaagcagcccatcaagga

SEQ ID NO: 33369 - DNA, 25 bp, Homo sapien
aggagttcacggaggccgagatcca

SEQ ID NO: 33370 - DNA, 25 bp, Homo sapien
ttcacggaggccgagatccactgag

SEQ ID NO: 33371 - DNA, 25 bp, Homo sapien
cgagcagtaccgcatgaccatctgg

SEQ ID NO: 33372 - DNA, 25 bp, Homo sapien
gcccgctgggatgactcctgaaaca

SEQ ID NO: 33373 - DNA, 25 bp, Homo sapien
ccgcggtttaaagcctgtgagatcc

SEQ ID NO: 33374 - DNA, 25 bp, Homo sapien
gccgcgtagtcgtgtaaagccttct

SEQ ID NO: 33375 - DNA, 25 bp, Homo sapien
caggtgcttcaccaccaggtcggtg

SEQ ID NO: 33376 - DNA, 25 bp, Homo sapien
gtcactgtgctcaatcaggtgcttc

SEQ ID NO: 33377 - DNA, 25 bp, Homo sapien
cggtccctggttgtcccacaggaga

SEQ ID NO: 33378 - DNA, 25 bp, Homo sapien
aaagggtctccaccacagacgtgtc

SEQ ID NO: 33379 - DNA, 25 bp, Homo sapien
agcgttggcactgacatttacatga

SEQ ID NO: 33380 - DNA, 25 bp, Homo sapien
cggcccttagcaagatcggcttctc

SEQ ID NO: 33381 - DNA, 25 bp, Homo sapien
cgagcaccgagcgtgggccacgtgc

SEQ ID NO: 33382 - DNA, 25 bp, Homo sapien
agagcctcccgcagtctcgtcggcg

SEQ ID NO: 33383 - DNA, 25 bp, Homo sapien
cgccaccttccggaccagacacctc

SEQ ID NO: 33384 - DNA, 25 bp, Homo sapien
ttcccggcccttagcaagatcggct

SEQ ID NO: 33385 - DNA, 25 bp, Homo sapien
agcaagatcggcttctccggtcacc

SEQ ID NO: 33386 - DNA, 25 bp, Homo sapien
agatcggcttctccggtcaccttta

SEQ ID NO: 33387 - DNA, 25 bp, Homo sapien
cggcctcgctggctgagaactggcg

SEQ ID NO: 33388 - DNA, 25 bp, Homo sapien
ccaggatggatctggtctggcagcc

SEQ ID NO: 33389 - DNA, 25 bp, Homo sapien
ctccgacgcgcaggtactccaggat

SEQ ID NO: 33390 - DNA, 25 bp, Homo sapien
gctgaccatcttctccaggcgcttg

SEQ ID NO: 33391 - DNA, 25 bp, Homo sapien
aggcgcttgtccctcagcttgttcc

SEQ ID NO: 33392 - DNA, 25 bp, Homo sapien
gttcccacggaaattgatctccttg

SEQ ID NO: 33393 - DNA, 25 bp, Homo sapien
agggatctcgctcagctggttgttc

SEQ ID NO: 33394 - DNA, 25 bp, Homo sapien
ttgttcgagaggtccaacgtctgca

SEQ ID NO: 33395 - DNA, 25 bp, Homo sapien
gagaaacatggacgcgtcagacgcc

SEQ ID NO: 33396 - DNA, 25 bp, Homo sapien
aagccacctggctgctagagtgccg

SEQ ID NO: 33397 - DNA, 25 bp, Homo sapien
agcagccgccagttcactgagcagg

SEQ ID NO: 33398 - DNA, 25 bp, Homo sapien
cgggaaaggagtctaggcaattgcc

SEQ ID NO: 33399 - DNA, 25 bp, Homo sapien
ttgcccgacaggtcgagcacccgaa

SEQ ID NO: 33400 - DNA, 25 bp, Homo sapien
cgcagccgctcacttccaagtagtg

SEQ ID NO: 33401 - DNA, 25 bp, Homo sapien
gccacttccgacctgtgccggaaaa

SEQ ID NO: 33402 - DNA, 25 bp, Homo sapien
gccggaaaagcccatagagaagcca

SEQ ID NO: 33403 - DNA, 25 bp, Homo sapien
tgagttctcggaggcagttgtcagc

SEQ ID NO: 33404 - DNA, 25 bp, Homo sapien
tggctctctccaaacaggacgcttc

SEQ ID NO: 33405 - DNA, 25 bp, Homo sapien
ctgcggaaattctactgcgtgtggc

SEQ ID NO: 33406 - DNA, 25 bp, Homo sapien
aggacgcttccttctctgattctaa

SEQ ID NO: 33407 - DNA, 25 bp, Homo sapien
gcttaatgtacagtgcggccaggtc

SEQ ID NO: 33408 - DNA, 25 bp, Homo sapien
actgcacgcaggatctttggttagc

SEQ ID NO: 33409 - DNA, 25 bp, Homo sapien
tggttagctgcatccatatcgtttg

SEQ ID NO: 33410 - DNA, 25 bp, Homo sapien
atcgtttgcacgagagctgacggca

SEQ ID NO: 33411 - DNA, 25 bp, Homo sapien
tggggccaccaaggccagagagttc

SEQ ID NO: 33412 - DNA, 25 bp, Homo sapien
aggcttcgtacccagctcccaggtg

SEQ ID NO: 33413 - DNA, 25 bp, Homo sapien
ctggccctcagggttgtgtagtttc

SEQ ID NO: 33414 - DNA, 25 bp, Homo sapien
cccagagggcttgaggacatctgca

SEQ ID NO: 33415 - DNA, 25 bp, Homo sapien
cagcttgcagagctcaccaggtgca

SEQ ID NO: 33416 - DNA, 25 bp, Homo sapien
ggtaatgtagtttccgggatcggca

SEQ ID NO: 33417 - DNA, 25 bp, Homo sapien
acaagaccgcgtcgggcctcacttt

SEQ ID NO: 33418 - DNA, 25 bp, Homo sapien
cttctgagtaaggtaatgtggtgtc

SEQ ID NO: 33419 - DNA, 25 bp, Homo sapien
tccagaagcccaagagcgtgaagct

SEQ ID NO: 33420 - DNA, 25 bp, Homo sapien
cagcgaatgttctgcgggtgctgtc

SEQ ID NO: 33421 - DNA, 25 bp, Homo sapien
ccacaggcccacactggagggagtc

SEQ ID NO: 33422 - DNA, 25 bp, Homo sapien
ctcatcctggctgactcggggcagt

SEQ ID NO: 33423 - DNA, 25 bp, Homo sapien
ctgccacaggcccacactggaggga

SEQ ID NO: 33424 - DNA, 25 bp, Homo sapien
gtttggaaggcggagcaagaaccta

SEQ ID NO: 33425 - DNA, 25 bp, Homo sapien
cgttcgttaccaccgcacagcctgg

SEQ ID NO: 33426 - DNA, 25 bp, Homo sapien
ggcggagcaagaacctaataaatgt

SEQ ID NO: 33427 - DNA, 25 bp, Homo sapien
acctaataaatgtgagccctggact

SEQ ID NO: 33428 - DNA, 25 bp, Homo sapien
actgtggcatacaggcggcagcctg

SEQ ID NO: 33429 - DNA, 25 bp, Homo sapien
aagcacagctcattccggtcgtttg

SEQ ID NO: 33430 - DNA, 25 bp, Homo sapien
gcctgagcctgcttctttaagcaca

SEQ ID NO: 33431 - DNA, 25 bp, Homo sapien
ttgtgaggcctgcagatgcaaagcc

SEQ ID NO: 33432 - DNA, 25 bp, Homo sapien
tgcaaagccctcgtcttgagaccct

SEQ ID NO: 33433 - DNA, 25 bp, Homo sapien
gcacggagctgacggaagattactt

SEQ ID NO: 33434 - DNA, 25 bp, Homo sapien
cctcatccttgcctgggcgttggag

SEQ ID NO: 33435 - DNA, 25 bp, Homo sapien
cgtattttagaacggcccgcagtca

SEQ ID NO: 33436 - DNA, 25 bp, Homo sapien
cgcgtgtgggtttaacatgcacata

SEQ ID NO: 33437 - DNA, 25 bp, Homo sapien
gcagagccgtgtagctgcaccttta

SEQ ID NO: 33438 - DNA, 25 bp, Homo sapien
cagagccgtgtagctgcacctttac

SEQ ID NO: 33439 - DNA, 25 bp, Homo sapien
cacacgcgtgtgagtttaacatgca

SEQ ID NO: 33440 - DNA, 25 bp, Homo sapien
ccacacgcgtgtgggtttaacatgc

SEQ ID NO: 33441 - DNA, 25 bp, Homo sapien
gccgtgtagctgcacctttaccaca

SEQ ID NO: 33442 - DNA, 25 bp, Homo sapien
gctgcacctttaccacacgcgtgtg

SEQ ID NO: 33443 - DNA, 25 bp, Homo sapien
agagccgtgtagctgcacctttacc

SEQ ID NO: 33444 - DNA, 25 bp, Homo sapien
cgcatccgcccgatcctctggaact

SEQ ID NO: 33445 - DNA, 25 bp, Homo sapien
gcgctttcttctcgctcccgacgcg

SEQ ID NO: 33446 - DNA, 25 bp, Homo sapien
ctgcccggcgttcccttttgtgcgg

SEQ ID NO: 33447 - DNA, 25 bp, Homo sapien
atcccagttgaacgcccgcagcctc

SEQ ID NO: 33448 - DNA, 25 bp, Homo sapien
caccgctgccctcgactcaatccca

SEQ ID NO: 33449 - DNA, 25 bp, Homo sapien
acgacgacgcgcacacgcggtcgca

SEQ ID NO: 33450 - DNA, 25 bp, Homo sapien
gaggcgatttctgggccgctcacct

SEQ ID NO: 33451 - DNA, 25 bp, Homo sapien
ggcgcagacactcgcgggcacacgc

SEQ ID NO: 33452 - DNA, 25 bp, Homo sapien
atcagagcccgggtctagacacaca

SEQ ID NO: 33453 - DNA, 25 bp, Homo sapien
tcagggcccgggtctagacacacac

SEQ ID NO: 33454 - DNA, 25 bp, Homo sapien
ctaggatcagggcccgggtctagac

SEQ ID NO: 33455 - DNA, 25 bp, Homo sapien
cagggcccgggtctagacacacaca

SEQ ID NO: 33456 - DNA, 25 bp, Homo sapien
gtgctaggatcagagcccgggtcta

SEQ ID NO: 33457 - DNA, 25 bp, Homo sapien
cagagcccgggtctagacacacaca

SEQ ID NO: 33458 - DNA, 25 bp, Homo sapien
tgctaggatcagagcccgggtctag

SEQ ID NO: 33459 - DNA, 25 bp, Homo sapien
atcagggcccgggtctagacacaca

SEQ ID NO: 33460 - DNA, 25 bp, Homo sapien
ccgtggcaggcctgagagattatgt

SEQ ID NO: 33461 - DNA, 25 bp, Homo sapien
tgaagcctctttggcgccatgtatg

SEQ ID NO: 33462 - DNA, 25 bp, Homo sapien
gccatgtttgtaaggggcgcttctc

SEQ ID NO: 33463 - DNA, 25 bp, Homo sapien
gtagcttctgtgttcgccatatttg

SEQ ID NO: 33464 - DNA, 25 bp, Homo sapien
gtgcagcaccctcgtcatgtgattc

SEQ ID NO: 33465 - DNA, 25 bp, Homo sapien
accttccggctcctcatgagtgtga

SEQ ID NO: 33466 - DNA, 25 bp, Homo sapien
gcgaggtgggcaactatgttcttga

SEQ ID NO: 33467 - DNA, 25 bp, Homo sapien
gccatgttcatgagggcgcgtccct

SEQ ID NO: 33468 - DNA, 25 bp, Homo sapien
gtccacggcttccaggcaccatttt

SEQ ID NO: 33469 - DNA, 25 bp, Homo sapien
tctttgatttaggagctgacacttc

SEQ ID NO: 33470 - DNA, 25 bp, Homo sapien
cggctccataaaacgtgttcatttg

SEQ ID NO: 33471 - DNA, 25 bp, Homo sapien
ggcggctgcctaacctgattcataa

SEQ ID NO: 33472 - DNA, 25 bp, Homo sapien
ctgtatcgccgctcaatcgaaagca

SEQ ID NO: 33473 - DNA, 25 bp, Homo sapien
cctcgttttatgtggggaaagcagc

SEQ ID NO: 33474 - DNA, 25 bp, Homo sapien
gccgggcctcatgagtcactcacag

SEQ ID NO: 33475 - DNA, 25 bp, Homo sapien
ctcttttgttgtcagggttcggcta

SEQ ID NO: 33476 - DNA, 25 bp, Homo sapien
gggagcctctcctgcggaaacggcc

SEQ ID NO: 33477 - DNA, 25 bp, Homo sapien
aattggaattctgcccggagccgtc

SEQ ID NO: 33478 - DNA, 25 bp, Homo sapien
atgaggctgcacgtgtttctttccg

SEQ ID NO: 33479 - DNA, 25 bp, Homo sapien
cgttactgacaagaaaccggaattg

SEQ ID NO: 33480 - DNA, 25 bp, Homo sapien
gggtttctctcgctcgttactgaca

SEQ ID NO: 33481 - DNA, 25 bp, Homo sapien
ggatctgcgcgggtttctctcgctc

SEQ ID NO: 33482 - DNA, 25 bp, Homo sapien
ccctggacgtttcggctgcaggagc

SEQ ID NO: 33483 - DNA, 25 bp, Homo sapien
cccagaggaagtagagcaagcccgg

SEQ ID NO: 33484 - DNA, 25 bp, Homo sapien
ctctatgttgcaaatcaagggaccc

SEQ ID NO: 33485 - DNA, 25 bp, Homo sapien
cccgaaacgtgaccatgtggattca

SEQ ID NO: 33486 - DNA, 25 bp, Homo sapien
ttcaacagcttttaggactcaggtg

SEQ ID NO: 33487 - DNA, 25 bp, Homo sapien
ccagccctttgctgcgccgcgacag

SEQ ID NO: 33488 - DNA, 25 bp, Homo sapien
agacacgcaccgtgagcggcagcgc

SEQ ID NO: 33489 - DNA, 25 bp, Homo sapien
cccgggcaacttgagtggcgccgat

SEQ ID NO: 33490 - DNA, 25 bp, Homo sapien
tttaggactcaggtgagcgacccgg

SEQ ID NO: 33491 - DNA, 25 bp, Homo sapien
gaccatgtggattcaacagctttta

SEQ ID NO: 33492 - DNA, 25 bp, Homo sapien
agagagaggcccaagaatcgcggga

SEQ ID NO: 33493 - DNA, 25 bp, Homo sapien
cggagagcgggcctgtgattcacca

SEQ ID NO: 33494 - DNA, 25 bp, Homo sapien
gcctgtgattcaccagagggttgca

SEQ ID NO: 33495 - DNA, 25 bp, Homo sapien
agagcgggcctgtgattcaccagag

SEQ ID NO: 33496 - DNA, 25 bp, Homo sapien
cgggcctgtgattcaccagagggtt

SEQ ID NO: 33497 - DNA, 25 bp, Homo sapien
tgattcaccagagggttgcagagag

SEQ ID NO: 33498 - DNA, 25 bp, Homo sapien
ctgtgattcaccagagggttgcaga

SEQ ID NO: 33499 - DNA, 25 bp, Homo sapien
aggcccaagaatcgcgggaggggtg

SEQ ID NO: 33500 - DNA, 25 bp, Homo sapien
tagccatgtttcagctcgccgtgga

SEQ ID NO: 33501 - DNA, 25 bp, Homo sapien
ttcgctcgcgtgaaatggactattc

SEQ ID NO: 33502 - DNA, 25 bp, Homo sapien
cgctgttcttgcacgtgagtgagcc

SEQ ID NO: 33503 - DNA, 25 bp, Homo sapien
cggaagccatgcctggatactgata

SEQ ID NO: 33504 - DNA, 25 bp, Homo sapien
tcagcagcttcgactccagaggcag

SEQ ID NO: 33505 - DNA, 25 bp, Homo sapien
gccggcccaccacagagactgagtt

SEQ ID NO: 33506 - DNA, 25 bp, Homo sapien
ggccctggagtccaacacatttccg

SEQ ID NO: 33507 - DNA, 25 bp, Homo sapien
ctttccagaagaagagagcgtcctt

SEQ ID NO: 33508 - DNA, 25 bp, Homo sapien
tcctcggtcctctgtcgagtggcga

SEQ ID NO: 33509 - DNA, 25 bp, Homo sapien
agcctgcgacggagacagttgtcac

SEQ ID NO: 33510 - DNA, 25 bp, Homo sapien
aggaagggcctttctgtttcacagg

SEQ ID NO: 33511 - DNA, 25 bp, Homo sapien
tgtggcccgcaacaaagcagtgaca

SEQ ID NO: 33512 - DNA, 25 bp, Homo sapien
gccgtttgcgcatgcccagtcatga

SEQ ID NO: 33513 - DNA, 25 bp, Homo sapien
cagctgagcagtagccctgacccaa

SEQ ID NO: 33514 - DNA, 25 bp, Homo sapien
cgctgccagaagagcccgagctcga

SEQ ID NO: 33515 - DNA, 25 bp, Homo sapien
ctgcagggcgatctttccctcagct

SEQ ID NO: 33516 - DNA, 25 bp, Homo sapien
cggaagaccaaccagcaggaggaga

SEQ ID NO: 33517 - DNA, 25 bp, Homo sapien
tcggaacagccaccagcggaagacc

SEQ ID NO: 33518 - DNA, 25 bp, Homo sapien
gagctgccagaacctcacggacttc

SEQ ID NO: 33519 - DNA, 25 bp, Homo sapien
gcagcctggacatattcacggccta

SEQ ID NO: 33520 - DNA, 25 bp, Homo sapien
cggcctataacgagaccctgcagtg

SEQ ID NO: 33521 - DNA, 25 bp, Homo sapien
gttctcacgagtgcgtcagggcatc

SEQ ID NO: 33522 - DNA, 25 bp, Homo sapien
tctgtgcccgtgtacaccgatgaga

SEQ ID NO: 33523 - DNA, 25 bp, Homo sapien
cgggaacactcgtcggaacagccac

SEQ ID NO: 33524 - DNA, 25 bp, Homo sapien
cagccggtcataaagcgggtgtctg

SEQ ID NO: 33525 - DNA, 25 bp, Homo sapien
gccaggaaaggcaccatcacagctc

SEQ ID NO: 33526 - DNA, 25 bp, Homo sapien
tccgccaggaaaggcaccatcacag

SEQ ID NO: 33527 - DNA, 25 bp, Homo sapien
gaaaggcaccatcacagctcctgca

SEQ ID NO: 33528 - DNA, 25 bp, Homo sapien
acagcttccgcacagccggtcataa

SEQ ID NO: 33529 - DNA, 25 bp, Homo sapien
tccgcacagccggtcataaagcggg

SEQ ID NO: 33530 - DNA, 25 bp, Homo sapien
cacagccggtcataaagcgggtgtc

SEQ ID NO: 33531 - DNA, 25 bp, Homo sapien
tgtcctccgccaggaaaggcaccat

SEQ ID NO: 33532 - DNA, 25 bp, Homo sapien
tcccccatcagtccacgcacagctt

SEQ ID NO: 33533 - DNA, 25 bp, Homo sapien
cccatcagtccacgcacagcttccg

SEQ ID NO: 33534 - DNA, 25 bp, Homo sapien
catcagtccacgcacagcttccgtc

SEQ ID NO: 33535 - DNA, 25 bp, Homo sapien
cccatcagtccacgcacagcttctg

SEQ ID NO: 33536 - DNA, 25 bp, Homo sapien
agtccacgcacagcttctgtctccc

SEQ ID NO: 33537 - DNA, 25 bp, Homo sapien
ctcccatcagtccacgcacagcttc

SEQ ID NO: 33538 - DNA, 25 bp, Homo sapien
atcagtccacgcacagcttctgtct

SEQ ID NO: 33539 - DNA, 25 bp, Homo sapien
gtctcccatcagtccacgcacagct

SEQ ID NO: 33540 - DNA, 25 bp, Homo sapien
tttctcgatttgcaaggaagctcgc

SEQ ID NO: 33541 - DNA, 25 bp, Homo sapien
acgctggcgaaaactgctgggctct

SEQ ID NO: 33542 - DNA, 25 bp, Homo sapien
cgtgtgtctgtgacttcagctgcca

SEQ ID NO: 33543 - DNA, 25 bp, Homo sapien
caccgagtgtgagctgaagaaggcc

SEQ ID NO: 33544 - DNA, 25 bp, Homo sapien
tgagtcacagcgagggctctacgta

SEQ ID NO: 33545 - DNA, 25 bp, Homo sapien
tgtaagtgagcatcgtccagtgttg

SEQ ID NO: 33546 - DNA, 25 bp, Homo sapien
tctgcatacgtccatccggtcgatg

SEQ ID NO: 33547 - DNA, 25 bp, Homo sapien
tccatcagtcagtgggcgtgcacca

SEQ ID NO: 33548 - DNA, 25 bp, Homo sapien
tgctccaacgtgacctgcagcttcg

SEQ ID NO: 33549 - DNA, 25 bp, Homo sapien
tccacctacagcaacgaatgcgagc

SEQ ID NO: 33550 - DNA, 25 bp, Homo sapien
gtcctgcgtctgcaagaagagcccg

SEQ ID NO: 33551 - DNA, 25 bp, Homo sapien
agcacggcaaggtctctcaggcttg

SEQ ID NO: 33552 - DNA, 25 bp, Homo sapien
ctcgcccgtcgcagaaacagagtcg

SEQ ID NO: 33553 - DNA, 25 bp, Homo sapien
gtctctgcttttcgctggaggccca

SEQ ID NO: 33554 - DNA, 25 bp, Homo sapien
ccgatgtggaaggagctcctgagca

SEQ ID NO: 33555 - DNA, 25 bp, Homo sapien
agttggtttcgaggcgtctctgctt

SEQ ID NO: 33556 - DNA, 25 bp, Homo sapien
tcttggtcagttcgcccatcttctg

SEQ ID NO: 33557 - DNA, 25 bp, Homo sapien
ccatcatgttcctcttggggtcctg

SEQ ID NO: 33558 - DNA, 25 bp, Homo sapien
tgtccgcatgtctccacgctgtaag

SEQ ID NO: 33559 - DNA, 25 bp, Homo sapien
tcccgtcgtgttcgtcttggtcagt

SEQ ID NO: 33560 - DNA, 25 bp, Homo sapien
ctgcgtctgtctcttctctttggtc

SEQ ID NO: 33561 - DNA, 25 bp, Homo sapien
tcccatagcctgctgtggacaatca

SEQ ID NO: 33562 - DNA, 25 bp, Homo sapien
cctcactcttgggacatgggcagcc

SEQ ID NO: 33563 - DNA, 25 bp, Homo sapien
tgcctggacatcacatgccatcttc

SEQ ID NO: 33564 - DNA, 25 bp, Homo sapien
gccagcttctgtgcttgcaccacgt

SEQ ID NO: 33565 - DNA, 25 bp, Homo sapien
tgcaccacgtgttttcctgcgaaag

SEQ ID NO: 33566 - DNA, 25 bp, Homo sapien
atggcagccagctcactgtccacgt

SEQ ID NO: 33567 - DNA, 25 bp, Homo sapien
tgggtcagtagcatggcagccagct

SEQ ID NO: 33568 - DNA, 25 bp, Homo sapien
cctgccgggcatgggtcagtagcat

SEQ ID NO: 33569 - DNA, 25 bp, Homo sapien
tggcatccgactcgcggctgacgtc

SEQ ID NO: 33570 - DNA, 25 bp, Homo sapien
ccagcttacgcctgcgggtggcatc

SEQ ID NO: 33571 - DNA, 25 bp, Homo sapien
tttcctgcgaaagggtcagagcgcg

SEQ ID NO: 33572 - DNA, 25 bp, Homo sapien
acggcagcagatccgatgagcagca

SEQ ID NO: 33573 - DNA, 25 bp, Homo sapien
cagggagtctccgtcccagacgtca

SEQ ID NO: 33574 - DNA, 25 bp, Homo sapien
ctaccttcatctggacggcagcaga

SEQ ID NO: 33575 - DNA, 25 bp, Homo sapien
tccagagagccgctaccttcatctg

SEQ ID NO: 33576 - DNA, 25 bp, Homo sapien
gaagcgtgactcgtcccatgaggga

SEQ ID NO: 33577 - DNA, 25 bp, Homo sapien
cagacagacgctggaagcgtgactc

SEQ ID NO: 33578 - DNA, 25 bp, Homo sapien
gctccttccaagcagacagacgctg

SEQ ID NO: 33579 - DNA, 25 bp, Homo sapien
tcccagacgtcaatctgcagggtct

SEQ ID NO: 33580 - DNA, 25 bp, Homo sapien
ctcaaccaatggtaatgtgactggc

SEQ ID NO: 33581 - DNA, 25 bp, Homo sapien
cggagcccacgcttttcagagagtc

SEQ ID NO: 33582 - DNA, 25 bp, Homo sapien
agtctccactcgacggacccagagg

SEQ ID NO: 33583 - DNA, 25 bp, Homo sapien
gtgctcaacggagccacaagcctga

SEQ ID NO: 33584 - DNA, 25 bp, Homo sapien
tgcgctttgcgagcgccagccaatc

SEQ ID NO: 33585 - DNA, 25 bp, Homo sapien
tgactggcgtgaacaatagccaatc

SEQ ID NO: 33586 - DNA, 25 bp, Homo sapien
agccaaggcccagaacatcggtacc

SEQ ID NO: 33587 - DNA, 25 bp, Homo sapien
gcgggcccatcctgatttgcatgtc

SEQ ID NO: 33588 - DNA, 25 bp, Homo sapien
atagctctggcacgcgctgcaccaa

SEQ ID NO: 33589 - DNA, 25 bp, Homo sapien
caccaacttcctgttgggtgctgtg

SEQ ID NO: 33590 - DNA, 25 bp, Homo sapien
atggccttgtctccggtcgttcccg

SEQ ID NO: 33591 - DNA, 25 bp, Homo sapien
ccaaggcgcgtgctttgcagcagat

SEQ ID NO: 33592 - DNA, 25 bp, Homo sapien
cagcagatgtgtgacctggcgttcc

SEQ ID NO: 33593 - DNA, 25 bp, Homo sapien
cggcggcagtgcatagctctggcac

SEQ ID NO: 33594 - DNA, 25 bp, Homo sapien
cctgagtgctcggaaaatggccttg

SEQ ID NO: 33595 - DNA, 25 bp, Homo sapien
cacgcgctaggcatgcctgagagca

SEQ ID NO: 33596 - DNA, 25 bp, Homo sapien
acaggcatgaagtatcggtaagggc

SEQ ID NO: 33597 - DNA, 25 bp, Homo sapien
agcagcaggtgccactctgaatggg

SEQ ID NO: 33598 - DNA, 25 bp, Homo sapien
atgcacggcctttccctggacggct

SEQ ID NO: 33599 - DNA, 25 bp, Homo sapien
ggagagcttcctccgcatgcacggc

SEQ ID NO: 33600 - DNA, 25 bp, Homo sapien
agacggacacgctggaactgcagcg

SEQ ID NO: 33601 - DNA, 25 bp, Homo sapien
ccgcccagcgcacaggcatgaagta

SEQ ID NO: 33602 - DNA, 25 bp, Homo sapien
ggtgccactctgaatgggccctgca

SEQ ID NO: 33603 - DNA, 25 bp, Homo sapien
ccaggccaggaacatggagagcttc

SEQ ID NO: 33604 - DNA, 25 bp, Homo sapien
gcaggtatcgtaacgtgggaatcga

SEQ ID NO: 33605 - DNA, 25 bp, Homo sapien
ccgcatagggctctgctgcgtagga

SEQ ID NO: 33606 - DNA, 25 bp, Homo sapien
gtagggctctgctgcgtaggactcc

SEQ ID NO: 33607 - DNA, 25 bp, Homo sapien
cttaggactcctgccaccgcgtagg

SEQ ID NO: 33608 - DNA, 25 bp, Homo sapien
cgtagggcacctgccgcttaggact

SEQ ID NO: 33609 - DNA, 25 bp, Homo sapien
caaggcgcctgctgcgtagggcacc

SEQ ID NO: 33610 - DNA, 25 bp, Homo sapien
agggctcctcctgccgcgtagggct

SEQ ID NO: 33611 - DNA, 25 bp, Homo sapien
gatgtcacgacaagcaaggcgcctg

SEQ ID NO: 33612 - DNA, 25 bp, Homo sapien
cccggcgcttgttgatgacgtaact

SEQ ID NO: 33613 - DNA, 25 bp, Homo sapien
agcgcatgcgctgtaggactatttg

SEQ ID NO: 33614 - DNA, 25 bp, Homo sapien
tgtaggactatttgcgcgccgttcc

SEQ ID NO: 33615 - DNA, 25 bp, Homo sapien
ctgagtcggaagtgggaacccttcg

SEQ ID NO: 33616 - DNA, 25 bp, Homo sapien
gtgagcctgcacaccgtgcttccgg

SEQ ID NO: 33617 - DNA, 25 bp, Homo sapien
cggcgcggagatgaacttccacatg

SEQ ID NO: 33618 - DNA, 25 bp, Homo sapien
gccgctgagattctgtcgtgtcgtc

SEQ ID NO: 33619 - DNA, 25 bp, Homo sapien
ccctaacaagctagcgcatgcgctg

SEQ ID NO: 33620 - DNA, 25 bp, Homo sapien
cgttcatgttctgtagctccgtgtc

SEQ ID NO: 33621 - DNA, 25 bp, Homo sapien
ccttccctcactgttgtgtctctag

SEQ ID NO: 33622 - DNA, 25 bp, Homo sapien
gttgtgtctctagtcctgagcccgc

SEQ ID NO: 33623 - DNA, 25 bp, Homo sapien
cacgtactgcgccaccttgaaggag

SEQ ID NO: 33624 - DNA, 25 bp, Homo sapien
cttgaaggagctcaggtactcgttc

SEQ ID NO: 33625 - DNA, 25 bp, Homo sapien
ctccgtgtcatctgtagcgtcctgg

SEQ ID NO: 33626 - DNA, 25 bp, Homo sapien
gcccatgtggctgtactgccctcag

SEQ ID NO: 33627 - DNA, 25 bp, Homo sapien
tccggtccagcagcttggagatggc

SEQ ID NO: 33628 - DNA, 25 bp, Homo sapien
ccctccacgtcgtccttgaagagtt

SEQ ID NO: 33629 - DNA, 25 bp, Homo sapien
gcggtagatcatcaccttcttgttc

SEQ ID NO: 33630 - DNA, 25 bp, Homo sapien
accttcttgttctggccgatgcggt

SEQ ID NO: 33631 - DNA, 25 bp, Homo sapien
ttggccacctgcgtgatgcgctcct

SEQ ID NO: 33632 - DNA, 25 bp, Homo sapien
gagcatcatcttgcgcttggccacc

SEQ ID NO: 33633 - DNA, 25 bp, Homo sapien
ccgtgccgaacttgaggatgtcgtc

SEQ ID NO: 33634 - DNA, 25 bp, Homo sapien
ccgagtcacgaagcggtagatcatc

SEQ ID NO: 33635 - DNA, 25 bp, Homo sapien
ccttgaagagttcctccgtgccgaa

SEQ ID NO: 33636 - DNA, 25 bp, Homo sapien
ccacgtagaagtcgggcgcccacat

SEQ ID NO: 33637 - DNA, 25 bp, Homo sapien
cccgtgtaggtgaccacgtagaagt

SEQ ID NO: 33638 - DNA, 25 bp, Homo sapien
tgtcctcaaaggaaaactcgttctc

SEQ ID NO: 33639 - DNA, 25 bp, Homo sapien
ttcccactccgaatggcgttgtcct

SEQ ID NO: 33640 - DNA, 25 bp, Homo sapien
caccttcatacggaataccttcttc

SEQ ID NO: 33641 - DNA, 25 bp, Homo sapien
agcgagccctcaccttcatacggaa

SEQ ID NO: 33642 - DNA, 25 bp, Homo sapien
aactcgcgttcccagttgatgatgg

SEQ ID NO: 33643 - DNA, 25 bp, Homo sapien
tccttccaaggatagcgagccctca

SEQ ID NO: 33644 - DNA, 25 bp, Homo sapien
aagctttgcgggatcggctaccgag

SEQ ID NO: 33645 - DNA, 25 bp, Homo sapien
gcgggcggaacactcacagtacagc

SEQ ID NO: 33646 - DNA, 25 bp, Homo sapien
acactcacagtacagcgcgggcaga

SEQ ID NO: 33647 - DNA, 25 bp, Homo sapien
tacagcgcgggcagagccattcacc

SEQ ID NO: 33648 - DNA, 25 bp, Homo sapien
gaagctattgtggacggggtctcga

SEQ ID NO: 33649 - DNA, 25 bp, Homo sapien
gggcagagccattcaccgtttggga

SEQ ID NO: 33650 - DNA, 25 bp, Homo sapien
agccattcaccgtttgggatctcgg

SEQ ID NO: 33651 - DNA, 25 bp, Homo sapien
ttcaccgtttgggatctcgggcagc

SEQ ID NO: 33652 - DNA, 25 bp, Homo sapien
cgtccaggtgcggacatcacgttcc

SEQ ID NO: 33653 - DNA, 25 bp, Homo sapien
ccacagaggtttcccatgcccgtgc

SEQ ID NO: 33654 - DNA, 25 bp, Homo sapien
gccagcgctaccctggggcttcatg

SEQ ID NO: 33655 - DNA, 25 bp, Homo sapien
ggcagtgtccagacggccgtgccct

SEQ ID NO: 33656 - DNA, 25 bp, Homo sapien
gacggggctgtgctcgtgtaagccc

SEQ ID NO: 33657 - DNA, 25 bp, Homo sapien
tgcgggatgactgtgagcagatgac

SEQ ID NO: 33658 - DNA, 25 bp, Homo sapien
agacgcttctgcgcctgcgacctgt

SEQ ID NO: 33659 - DNA, 25 bp, Homo sapien
tgcagctgtgatccccaaggcgccg

SEQ ID NO: 33660 - DNA, 25 bp, Homo sapien
acgtccagtctggttgctgtggcaa

SEQ ID NO: 33661 - DNA, 25 bp, Homo sapien
ggtgccagccttaacccgtgcgctg

SEQ ID NO: 33662 - DNA, 25 bp, Homo sapien
catgcccggattgtgacgtccagtc

SEQ ID NO: 33663 - DNA, 25 bp, Homo sapien
ccatcgttccggcagcgcgactagt

SEQ ID NO: 33664 - DNA, 25 bp, Homo sapien
gttaacagcagagaacaagttgggg

SEQ ID NO: 33665 - DNA, 25 bp, Homo sapien
caagttgggggactagtcctgagcc

SEQ ID NO: 33666 - DNA, 25 bp, Homo sapien
gctccgggagctagcgcgattcccg

SEQ ID NO: 33667 - DNA, 25 bp, Homo sapien
ccggcagcgcgactagttaacagca

SEQ ID NO: 33668 - DNA, 25 bp, Homo sapien
cggatctgcgatgtctgtgcccaaa

SEQ ID NO: 33669 - DNA, 25 bp, Homo sapien
gaacgcaaaagttccaggggctggc

SEQ ID NO: 33670 - DNA, 25 bp, Homo sapien
ccgcggcggcaagtcttaaagctac

SEQ ID NO: 33671 - DNA, 25 bp, Homo sapien
gaattttaaatgagcgcctccagtc

SEQ ID NO: 33672 - DNA, 25 bp, Homo sapien
ccctcgggagcaagactggaatttt

SEQ ID NO: 33673 - DNA, 25 bp, Homo sapien
ccctcggtcgttaaaggtgaagatg

SEQ ID NO: 33674 - DNA, 25 bp, Homo sapien
agcgacacctgtcgcagagcaggaa

SEQ ID NO: 33675 - DNA, 25 bp, Homo sapien
tgtgcccaaaactcccgctcagaag

SEQ ID NO: 33676 - DNA, 25 bp, Homo sapien
cgccaccttttctcttggttatgta

SEQ ID NO: 33677 - DNA, 25 bp, Homo sapien
tacgcagacgcaaagagcccgcagc

SEQ ID NO: 33678 - DNA, 25 bp, Homo sapien
cctacaacgtgctgggatcggcagg

SEQ ID NO: 33679 - DNA, 25 bp, Homo sapien
tcctgaatgcaaaacgcgtcctctc

SEQ ID NO: 33680 - DNA, 25 bp, Homo sapien
tactaaccacaggagccatggcggc

SEQ ID NO: 33681 - DNA, 25 bp, Homo sapien
ggtccaggccgcactaatcactttg

SEQ ID NO: 33682 - DNA, 25 bp, Homo sapien
ggagcgattggtttttcctgaatgc

SEQ ID NO: 33683 - DNA, 25 bp, Homo sapien
aggcctcacgcggagccatactaac

SEQ ID NO: 33684 - DNA, 25 bp, Homo sapien
tccggactctgtcatgccgggcagg

SEQ ID NO: 33685 - DNA, 25 bp, Homo sapien
aggaccggtagctcccagcaaagcg

SEQ ID NO: 33686 - DNA, 25 bp, Homo sapien
gcctgaacttccagggccggctact

SEQ ID NO: 33687 - DNA, 25 bp, Homo sapien
ggccggaaccagtgcgcaaagcaga

SEQ ID NO: 33688 - DNA, 25 bp, Homo sapien
tcgctgcagatgtcgggagctatct

SEQ ID NO: 33689 - DNA, 25 bp, Homo sapien
cccgctgtgccacgtgcagtacgag

SEQ ID NO: 33690 - DNA, 25 bp, Homo sapien
agcgcccgtgtcttctggactgttt

SEQ ID NO: 33691 - DNA, 25 bp, Homo sapien
tggactgtttccacgacttctgtgc

SEQ ID NO: 33692 - DNA, 25 bp, Homo sapien
cctgcgatggcctgagaggaagaag

SEQ ID NO: 33693 - DNA, 25 bp, Homo sapien
tgtccgtaaccttgtggagaagacc

SEQ ID NO: 33694 - DNA, 25 bp, Homo sapien
atggcccaatttgtccgtaaccttg

SEQ ID NO: 33695 - DNA, 25 bp, Homo sapien
ttccagaaccatggcccaatttgtc

SEQ ID NO: 33696 - DNA, 25 bp, Homo sapien
acggactctccattccagaaccatg

SEQ ID NO: 33697 - DNA, 25 bp, Homo sapien
gggcgacggactctccattccagaa

SEQ ID NO: 33698 - DNA, 25 bp, Homo sapien
aaagaggcggcctgaccttggaagt

SEQ ID NO: 33699 - DNA, 25 bp, Homo sapien
ccttccggcgggtgacattcagccg

SEQ ID NO: 33700 - DNA, 25 bp, Homo sapien
tggacctggaatcggcttacgtgca

SEQ ID NO: 33701 - DNA, 25 bp, Homo sapien
aggaggacgctatccacgccctctt

SEQ ID NO: 33702 - DNA, 25 bp, Homo sapien
cgtacttctgcaacacgtgcggaca

SEQ ID NO: 33703 - DNA, 25 bp, Homo sapien
acgagacgcaccgagcacgcatgtt

SEQ ID NO: 33704 - DNA, 25 bp, Homo sapien
tctccaccgacaagaagttgctgtt

SEQ ID NO: 33705 - DNA, 25 bp, Homo sapien
ttgtgcatccgctgcttccgcgaca

SEQ ID NO: 33706 - DNA, 25 bp, Homo sapien
tccgcgacatgcagaagtgcgtaca

SEQ ID NO: 33707 - DNA, 25 bp, Homo sapien
gctgggacaaacacgcgcagtgaca

SEQ ID NO: 33708 - DNA, 25 bp, Homo sapien
cccgccctgttgctgtccggaattt

SEQ ID NO: 33709 - DNA, 25 bp, Homo sapien
taacaacccactcctcgggtgcagg

SEQ ID NO: 33710 - DNA, 25 bp, Homo sapien
acctgctgagctgcacaagctgcaa

SEQ ID NO: 33711 - DNA, 25 bp, Homo sapien
gcacaagctgcaatttaacaaccca

SEQ ID NO: 33712 - DNA, 25 bp, Homo sapien
ctgaactcgcggatgaagagcgcgc

SEQ ID NO: 33713 - DNA, 25 bp, Homo sapien
tgcgacctgaactcgcggatgaaga

SEQ ID NO: 33714 - DNA, 25 bp, Homo sapien
tgagcccggccacgtagagcgccag

SEQ ID NO: 33715 - DNA, 25 bp, Homo sapien
agcagcgcgttgagcccggccacgt

SEQ ID NO: 33716 - DNA, 25 bp, Homo sapien
gagcgacgcctgagaattccgccca

SEQ ID NO: 33717 - DNA, 25 bp, Homo sapien
ctcccgcagccaaagcagaacattg

SEQ ID NO: 33718 - DNA, 25 bp, Homo sapien
gcggtcaattttccactgcttaaga

SEQ ID NO: 33719 - DNA, 25 bp, Homo sapien
acactaagctatccacgtgagcgtc

SEQ ID NO: 33720 - DNA, 25 bp, Homo sapien
tggtttgctaatgccctcgagttga

SEQ ID NO: 33721 - DNA, 25 bp, Homo sapien
cctctgtgcagatgtgcagcagctg

SEQ ID NO: 33722 - DNA, 25 bp, Homo sapien
tgtggggcccgcacaatgcccttaa

SEQ ID NO: 33723 - DNA, 25 bp, Homo sapien
ggtcctggcgcttcaaagctgcccg

SEQ ID NO: 33724 - DNA, 25 bp, Homo sapien
tctcgcgacacagggactattttca

SEQ ID NO: 33725 - DNA, 25 bp, Homo sapien
tgacctgaactgaaggcgctcccta

SEQ ID NO: 33726 - DNA, 25 bp, Homo sapien
gcgctccctatttggtctcgcgaca

SEQ ID NO: 33727 - DNA, 25 bp, Homo sapien
gtctgcgcgtctgggcataatccac

SEQ ID NO: 33728 - DNA, 25 bp, Homo sapien
ccgggatcctcttgacttccaagga

SEQ ID NO: 33729 - DNA, 25 bp, Homo sapien
gctgcaaaagtgaacccggtgcctc

SEQ ID NO: 33730 - DNA, 25 bp, Homo sapien
agggacccattgcttggtggcacca

SEQ ID NO: 33731 - DNA, 25 bp, Homo sapien
caaggacctccttcgcaagcggtgc

SEQ ID NO: 33732 - DNA, 25 bp, Homo sapien
cagggcctgtggctcgcactcgaag

SEQ ID NO: 33733 - DNA, 25 bp, Homo sapien
agccggaagacaaacgctgaggcca

SEQ ID NO: 33734 - DNA, 25 bp, Homo sapien
agcccagcgagtccgagtgcagcgt

SEQ ID NO: 33735 - DNA, 25 bp, Homo sapien
tgtggctcgcactcgaaggcggtca

SEQ ID NO: 33736 - DNA, 25 bp, Homo sapien
cacacgtccgcatcgtcgtgggaga

SEQ ID NO: 33737 - DNA, 25 bp, Homo sapien
acgtccgcatcgtcgtgggagaagc

SEQ ID NO: 33738 - DNA, 25 bp, Homo sapien
gtcaggacgcggctggcttttaccc

SEQ ID NO: 33739 - DNA, 25 bp, Homo sapien
aagacaaacgctgaggccaacgccc

SEQ ID NO: 33740 - DNA, 25 bp, Homo sapien
tccgagccatcgatggaggagcgcc

SEQ ID NO: 33741 - DNA, 25 bp, Homo sapien
agccatgggtgtagaagcgctcgct

SEQ ID NO: 33742 - DNA, 25 bp, Homo sapien
aggccgatctcagccacgatgaagc

SEQ ID NO: 33743 - DNA, 25 bp, Homo sapien
agcaggaagcagacgccaaagccca

SEQ ID NO: 33744 - DNA, 25 bp, Homo sapien
gatggctgtgcagatcacgcccatg

SEQ ID NO: 33745 - DNA, 25 bp, Homo sapien
acctgcacggccagcgtctggaaga

SEQ ID NO: 33746 - DNA, 25 bp, Homo sapien
tgcgcgtcctccaccacgatggtgg

SEQ ID NO: 33747 - DNA, 25 bp, Homo sapien
aagcccatgaggcagtcgtagatga

SEQ ID NO: 33748 - DNA, 25 bp, Homo sapien
taacccgtctctctcgttgcaagcc

SEQ ID NO: 33749 - DNA, 25 bp, Homo sapien
ctacaactccgcgttgggctgctgc

SEQ ID NO: 33750 - DNA, 25 bp, Homo sapien
ctccgcgttgggctgctgctctgat

SEQ ID NO: 33751 - DNA, 25 bp, Homo sapien
ctgctctgatgggaagacgccctcg

SEQ ID NO: 33752 - DNA, 25 bp, Homo sapien
aagacgccctcgctggacgcagagg

SEQ ID NO: 33753 - DNA, 25 bp, Homo sapien
tggacgcagagggctccaactgccc

SEQ ID NO: 33754 - DNA, 25 bp, Homo sapien
gccacctgtcgagagggcttcctgc

SEQ ID NO: 33755 - DNA, 25 bp, Homo sapien
ggcttcctgctacaactccgcgttg

SEQ ID NO: 33756 - DNA, 25 bp, Homo sapien
gactcgcgtgctctcgcctgctggt

SEQ ID NO: 33757 - DNA, 25 bp, Homo sapien
agggcggcgacgctcaccctgcatt

SEQ ID NO: 33758 - DNA, 25 bp, Homo sapien
gacgtcacagctccgggccaatgag

SEQ ID NO: 33759 - DNA, 25 bp, Homo sapien
cccattgcgcaacaaagagaaccca

SEQ ID NO: 33760 - DNA, 25 bp, Homo sapien
gagaacccagaacttgaaaggattc

SEQ ID NO: 33761 - DNA, 25 bp, Homo sapien
cgcgctgcagccgatgtgttccacg

SEQ ID NO: 33762 - DNA, 25 bp, Homo sapien
gtgccagcgctaagcgccgctcgtg

SEQ ID NO: 33763 - DNA, 25 bp, Homo sapien
cgtccgagcgacaggctgggaaacc

SEQ ID NO: 33764 - DNA, 25 bp, Homo sapien
ggggcctcgagaacctctggaatca

SEQ ID NO: 33765 - DNA, 25 bp, Homo sapien
ctcgagaacctctggaatcaggggt

SEQ ID NO: 33766 - DNA, 25 bp, Homo sapien
ccagagatttcagtgcacgctcctc

SEQ ID NO: 33767 - DNA, 25 bp, Homo sapien
atgggttttcagtgcatgttcgccc

SEQ ID NO: 33768 - DNA, 25 bp, Homo sapien
gctctgagaggaatgggttttcagt

SEQ ID NO: 33769 - DNA, 25 bp, Homo sapien
tcctcagccatgtggggaagcgaca

SEQ ID NO: 33770 - DNA, 25 bp, Homo sapien
ggccacttccatgagaacgccagct

SEQ ID NO: 33771 - DNA, 25 bp, Homo sapien
tgcctgcctggccacttccatgaga

SEQ ID NO: 33772 - DNA, 25 bp, Homo sapien
catggacttattgctcgtgaaggtc

SEQ ID NO: 33773 - DNA, 25 bp, Homo sapien
tcccgagatggtgatgacgcagcct

SEQ ID NO: 33774 - DNA, 25 bp, Homo sapien
tcgtgaaggtcatgcgtcccgagat

SEQ ID NO: 33775 - DNA, 25 bp, Homo sapien
ggggcacaggcagcgacctgccttc

SEQ ID NO: 33776 - DNA, 25 bp, Homo sapien
cctggctcagcgacacgtaggtgaa

SEQ ID NO: 33777 - DNA, 25 bp, Homo sapien
gcccggtagcgcttctgagagctgt

SEQ ID NO: 33778 - DNA, 25 bp, Homo sapien
caacacctcgatctccatggactta

SEQ ID NO: 33779 - DNA, 25 bp, Homo sapien
ctgtccacaacagggtcggcgtcca

SEQ ID NO: 33780 - DNA, 25 bp, Homo sapien
gggctaacccatcttgtatccgtgc

SEQ ID NO: 33781 - DNA, 25 bp, Homo sapien
ttaatcagaaacgtgctcgcgagcc

SEQ ID NO: 33782 - DNA, 25 bp, Homo sapien
cctccctctgcgtgcatacattagg

SEQ ID NO: 33783 - DNA, 25 bp, Homo sapien
tgcccgggctggagaaacacaaccc

SEQ ID NO: 33784 - DNA, 25 bp, Homo sapien
ccgcgttatactggaagctgctctc

SEQ ID NO: 33785 - DNA, 25 bp, Homo sapien
gaacgtgtgtaatcggcctctcggc

SEQ ID NO: 33786 - DNA, 25 bp, Homo sapien
gcccgaggccgctatacagattgcg

SEQ ID NO: 33787 - DNA, 25 bp, Homo sapien
gcttcgttgtaacaccgcgtcgtta

SEQ ID NO: 33788 - DNA, 25 bp, Homo sapien
tggagctgtgcattgacctccgccc

SEQ ID NO: 33789 - DNA, 25 bp, Homo sapien
tgcctggctttctcgcccaaacggc

SEQ ID NO: 33790 - DNA, 25 bp, Homo sapien
cttgtgcggcatcgcgagtcgcatc

SEQ ID NO: 33791 - DNA, 25 bp, Homo sapien
accacagagccaagcggggcaggcc

SEQ ID NO: 33792 - DNA, 25 bp, Homo sapien
gggccctctcttaccggcagatctg

SEQ ID NO: 33793 - DNA, 25 bp, Homo sapien
gcgtctcgacgtctgggcccgacat

SEQ ID NO: 33794 - DNA, 25 bp, Homo sapien
ctccgcgcggcggtaaatatttgtg

SEQ ID NO: 33795 - DNA, 25 bp, Homo sapien
gtaaatatttgtgctgggcgttccc

SEQ ID NO: 33796 - DNA, 25 bp, Homo sapien
gcctttgcgtcctgtctaccgcggg

SEQ ID NO: 33797 - DNA, 25 bp, Homo sapien
ttgcctgactggagctacggtccct

SEQ ID NO: 33798 - DNA, 25 bp, Homo sapien
tgcctttgttcctgcgcagggtgga

SEQ ID NO: 33799 - DNA, 25 bp, Homo sapien
ctcgggttcagcgtcttctctgagc

SEQ ID NO: 33800 - DNA, 25 bp, Homo sapien
acccagcggttacgggagctcccat

SEQ ID NO: 33801 - DNA, 25 bp, Homo sapien
tgagctggacgggaaatccgagttc

SEQ ID NO: 33802 - DNA, 25 bp, Homo sapien
tccgagttccggagaaaggtcgtga

SEQ ID NO: 33803 - DNA, 25 bp, Homo sapien
ccagctgctttatcgggtgaagggc

SEQ ID NO: 33804 - DNA, 25 bp, Homo sapien
ctgggaagctgcactgtctgcgctt

SEQ ID NO: 33805 - DNA, 25 bp, Homo sapien
atgaatttgtctgtgcctggacggc

SEQ ID NO: 33806 - DNA, 25 bp, Homo sapien
gctctccaattcgaacccagttttg

SEQ ID NO: 33807 - DNA, 25 bp, Homo sapien
ccctctggggtctcaactgttacgt

SEQ ID NO: 33808 - DNA, 25 bp, Homo sapien
cccgcaagaacacgtgcatggcgtc

SEQ ID NO: 33809 - DNA, 25 bp, Homo sapien
cctggaaccgcagttagcgggcact

SEQ ID NO: 33810 - DNA, 25 bp, Homo sapien
atcacctctggaattgcgtcgccgg

SEQ ID NO: 33811 - DNA, 25 bp, Homo sapien
caactgttacgtgaggcaaattagg

SEQ ID NO: 33812 - DNA, 25 bp, Homo sapien
tgcccaaaccaagaacggtgccacg

SEQ ID NO: 33813 - DNA, 25 bp, Homo sapien
caggtgagctgcaccgacgtgagcc

SEQ ID NO: 33814 - DNA, 25 bp, Homo sapien
cagtgctgccagatcctggtagtga

SEQ ID NO: 33815 - DNA, 25 bp, Homo sapien
ccagatcctggtagtgaacggcgcg

SEQ ID NO: 33816 - DNA, 25 bp, Homo sapien
gacctgtcggacttcaacggccaca

SEQ ID NO: 33817 - DNA, 25 bp, Homo sapien
tgtcggacttcaacggccacagcca

SEQ ID NO: 33818 - DNA, 25 bp, Homo sapien
ctgcgcacggtggagaacctggtac

SEQ ID NO: 33819 - DNA, 25 bp, Homo sapien
caggggagtgaatgcccaaaccaag

SEQ ID NO: 33820 - DNA, 25 bp, Homo sapien
ccgtggcaggtaggagcagcccccg

SEQ ID NO: 33821 - DNA, 25 bp, Homo sapien
ctgtgcgcgggtggctgtaacctga

SEQ ID NO: 33822 - DNA, 25 bp, Homo sapien
cataggctggctgtgcgcgggtggc

SEQ ID NO: 33823 - DNA, 25 bp, Homo sapien
ataggctggctgtgcgcgggtggct

SEQ ID NO: 33824 - DNA, 25 bp, Homo sapien
ggctgtgcgcgggtggctgtaacct

SEQ ID NO: 33825 - DNA, 25 bp, Homo sapien
gctgtgcgcgggtggctgtaacctg

SEQ ID NO: 33826 - DNA, 25 bp, Homo sapien
ccgctgcccactgtgagaaccaggg

SEQ ID NO: 33827 - DNA, 25 bp, Homo sapien
cgtggcaggtaggagcagcccccgg

SEQ ID NO: 33828 - DNA, 25 bp, Homo sapien
cttctgacagccgagagcggagtgc

SEQ ID NO: 33829 - DNA, 25 bp, Homo sapien
cctgaaatccgaggcttgagcgcgg

SEQ ID NO: 33830 - DNA, 25 bp, Homo sapien
atggcgatggtttccagatgcagga

SEQ ID NO: 33831 - DNA, 25 bp, Homo sapien
tgatgtcaggccgtcggagcccata

SEQ ID NO: 33832 - DNA, 25 bp, Homo sapien
tcaggccgtcggagcccataggctg

SEQ ID NO: 33833 - DNA, 25 bp, Homo sapien
tggggacccgcagtccttctgacag

SEQ ID NO: 33834 - DNA, 25 bp, Homo sapien
cgcagtccttctgacagccgagagc

SEQ ID NO: 33835 - DNA, 25 bp, Homo sapien
tcgctttcgtggatggcgatggttt

SEQ ID NO: 33836 - DNA, 25 bp, Homo sapien
ctcggagctactggctgagattaag

SEQ ID NO: 33837 - DNA, 25 bp, Homo sapien
ggcgacaactcggagctactggctg

SEQ ID NO: 33838 - DNA, 25 bp, Homo sapien
ctgcggggtttcagccgctgctcaa

SEQ ID NO: 33839 - DNA, 25 bp, Homo sapien
ggggctgaccacagtgttctcaggc

SEQ ID NO: 33840 - DNA, 25 bp, Homo sapien
caaggggctgaccacagtgttctca

SEQ ID NO: 33841 - DNA, 25 bp, Homo sapien
cagagcaaggggctgaccacagtgt

SEQ ID NO: 33842 - DNA, 25 bp, Homo sapien
tgagattaaggcaggcaagagcctg

SEQ ID NO: 33843 - DNA, 25 bp, Homo sapien
tgccgcccactactcctgcgccggg

SEQ ID NO: 33844 - DNA, 25 bp, Homo sapien
cgcccgaggtacaggatcgccaggc

SEQ ID NO: 33845 - DNA, 25 bp, Homo sapien
ctacgcggactgctgccccgcgtgg

SEQ ID NO: 33846 - DNA, 25 bp, Homo sapien
ccgaggtacaggatcgccaggcggc

SEQ ID NO: 33847 - DNA, 25 bp, Homo sapien
ctgctgcgtcgcgtgccggcaagcc

SEQ ID NO: 33848 - DNA, 25 bp, Homo sapien
ccgcccgaggtacaggatcgccagg

SEQ ID NO: 33849 - DNA, 25 bp, Homo sapien
ctgggcccgcccgaggtacaggatc

SEQ ID NO: 33850 - DNA, 25 bp, Homo sapien
gcctgggtcgctcgcactcgctcag

SEQ ID NO: 33851 - DNA, 25 bp, Homo sapien
cccaggcgcgcctacgcggactgct

SEQ ID NO: 33852 - DNA, 25 bp, Homo sapien
tcgtttacctcttcctggagcactg

SEQ ID NO: 33853 - DNA, 25 bp, Homo sapien
agcgcatcgtttacctcttcctgga

SEQ ID NO: 33854 - DNA, 25 bp, Homo sapien
aggactacctcgacctgcgcaagga

SEQ ID NO: 33855 - DNA, 25 bp, Homo sapien
tgcgcggcgtccaggactacctcga

SEQ ID NO: 33856 - DNA, 25 bp, Homo sapien
gagtgcggcgtctccgtgcagcatc

SEQ ID NO: 33857 - DNA, 25 bp, Homo sapien
cgagatcctcgagtgcggcgtctcc

SEQ ID NO: 33858 - DNA, 25 bp, Homo sapien
gcaaggagcgcatcgtttacctctt

SEQ ID NO: 33859 - DNA, 25 bp, Homo sapien
cgcctggtgcagcaagatctccacg

SEQ ID NO: 33860 - DNA, 25 bp, Homo sapien
tccctgtgccggcagactggtttcc

SEQ ID NO: 33861 - DNA, 25 bp, Homo sapien
gccctgctccggcagatccaggtgt

SEQ ID NO: 33862 - DNA, 25 bp, Homo sapien
atccaggtgtccaggcgccggtcct

SEQ ID NO: 33863 - DNA, 25 bp, Homo sapien
ggagcacgtgcgatttatggacttt

SEQ ID NO: 33864 - DNA, 25 bp, Homo sapien
agactggtttcctgcgtttatcacg

SEQ ID NO: 33865 - DNA, 25 bp, Homo sapien
ttatggactttggtgagcgccaggc

SEQ ID NO: 33866 - DNA, 25 bp, Homo sapien
acaagccagcccgttgccaagacca

SEQ ID NO: 33867 - DNA, 25 bp, Homo sapien
aggccacgagccacagcttacctgc

SEQ ID NO: 33868 - DNA, 25 bp, Homo sapien
gacttgctctctccttctcggggta

SEQ ID NO: 33869 - DNA, 25 bp, Homo sapien
ccagatcccggggtgacaagattcc

SEQ ID NO: 33870 - DNA, 25 bp, Homo sapien
ttaaagcgctctcatctgggctccg

SEQ ID NO: 33871 - DNA, 25 bp, Homo sapien
cgaatccctcgagaaaagtccagtc

SEQ ID NO: 33872 - DNA, 25 bp, Homo sapien
tgaccctgtgtctccaactgctgca

SEQ ID NO: 33873 - DNA, 25 bp, Homo sapien
tccggccgagaagttgagaaatgtc

SEQ ID NO: 33874 - DNA, 25 bp, Homo sapien
gtaaccgtacttagggcttctgcaa

SEQ ID NO: 33875 - DNA, 25 bp, Homo sapien
gccagcgcttgagcatctcgtactg

SEQ ID NO: 33876 - DNA, 25 bp, Homo sapien
ccttcaccgaggctcttgggacagg

SEQ ID NO: 33877 - DNA, 25 bp, Homo sapien
tgctccatagccctccgacgggcgc

SEQ ID NO: 33878 - DNA, 25 bp, Homo sapien
tagcctcctgcgtctcaactcaccg

SEQ ID NO: 33879 - DNA, 25 bp, Homo sapien
gctcttgggacagggctcaaagctg

SEQ ID NO: 33880 - DNA, 25 bp, Homo sapien
cccagtgaggcttggagtggagacg

SEQ ID NO: 33881 - DNA, 25 bp, Homo sapien
gagatcggaaagggcggccaaccca

SEQ ID NO: 33882 - DNA, 25 bp, Homo sapien
tccgtgctctctgcccgtcgtggtt

SEQ ID NO: 33883 - DNA, 25 bp, Homo sapien
cttgggacagggctcaaagctgccc

SEQ ID NO: 33884 - DNA, 25 bp, Homo sapien
caataaagccgtcgggcctcaccga

SEQ ID NO: 33885 - DNA, 25 bp, Homo sapien
ggactgggccctgaaccaataaagc

SEQ ID NO: 33886 - DNA, 25 bp, Homo sapien
ccggagccaccaacatcaggaaagg

SEQ ID NO: 33887 - DNA, 25 bp, Homo sapien
ggtgctcatcagacctgagcagttg

SEQ ID NO: 33888 - DNA, 25 bp, Homo sapien
tgcaaccgcatgctggccgacatga

SEQ ID NO: 33889 - DNA, 25 bp, Homo sapien
ccctgcagcggactgcggtgctcat

SEQ ID NO: 33890 - DNA, 25 bp, Homo sapien
agagctttgtgcagcgcggactcct

SEQ ID NO: 33891 - DNA, 25 bp, Homo sapien
gggagccgcaagaaccacggtgatc

SEQ ID NO: 33892 - DNA, 25 bp, Homo sapien
tcctcctccatgcagtagcggatgt

SEQ ID NO: 33893 - DNA, 25 bp, Homo sapien
gcccgtaccatcttgaagcctttga

SEQ ID NO: 33894 - DNA, 25 bp, Homo sapien
cttccttactgcacttgggcgacca

SEQ ID NO: 33895 - DNA, 25 bp, Homo sapien
tttggccagcatgtcgctcagcttc

SEQ ID NO: 33896 - DNA, 25 bp, Homo sapien
ctcaccgtgatgtaggcccggaaga

SEQ ID NO: 33897 - DNA, 25 bp, Homo sapien
tcccgctggccatcagggttaccat

SEQ ID NO: 33898 - DNA, 25 bp, Homo sapien
gcaagcttatgatccctgtttcctg

SEQ ID NO: 33899 - DNA, 25 bp, Homo sapien
ttaccatggcgacgacggcctcctt

SEQ ID NO: 33900 - DNA, 25 bp, Homo sapien
ctcggccgccatgggccgcatcctt

SEQ ID NO: 33901 - DNA, 25 bp, Homo sapien
cccgtcaccagggtgcagctgccca

SEQ ID NO: 33902 - DNA, 25 bp, Homo sapien
aagaattggcggggacatctcagcc

SEQ ID NO: 33903 - DNA, 25 bp, Homo sapien
cctggcctcccgcacaggactgggc

SEQ ID NO: 33904 - DNA, 25 bp, Homo sapien
cgtacctggctatcaccgtcgcggg

SEQ ID NO: 33905 - DNA, 25 bp, Homo sapien
tggctatcaccgtcgcgggcacgac

SEQ ID NO: 33906 - DNA, 25 bp, Homo sapien
aggctgctaggcgtccggagacacc

SEQ ID NO: 33907 - DNA, 25 bp, Homo sapien
ccgcggggcccatagtcacgggcac

SEQ ID NO: 33908 - DNA, 25 bp, Homo sapien
ccaggttcgcttccgctctattgta

SEQ ID NO: 33909 - DNA, 25 bp, Homo sapien
ccctggtcattaacttgggcttgaa

SEQ ID NO: 33910 - DNA, 25 bp, Homo sapien
ggccgagactgccaaagcctcatgg

SEQ ID NO: 33911 - DNA, 25 bp, Homo sapien
gggccagggtcccatagactcctca

SEQ ID NO: 33912 - DNA, 25 bp, Homo sapien
cccggtgtctaaggctctaaggctc

SEQ ID NO: 33913 - DNA, 25 bp, Homo sapien
gacccaccctagagacactgtgatg

SEQ ID NO: 33914 - DNA, 25 bp, Homo sapien
gcctggcactacgtgggaatctcga

SEQ ID NO: 33915 - DNA, 25 bp, Homo sapien
acgggctcagtcgactcagcgcaaa

SEQ ID NO: 33916 - DNA, 25 bp, Homo sapien
gaatcgctgtctccgaggtcagttt

SEQ ID NO: 33917 - DNA, 25 bp, Homo sapien
gcggctcaggaagcgcgcacggctc

SEQ ID NO: 33918 - DNA, 25 bp, Homo sapien
gccatccacgcggagggtgcctgtc

SEQ ID NO: 33919 - DNA, 25 bp, Homo sapien
cccggaatcgctgtctccgaggtca

SEQ ID NO: 33920 - DNA, 25 bp, Homo sapien
tttccatggcaacacggaggctgcc

SEQ ID NO: 33921 - DNA, 25 bp, Homo sapien
ggctgtcaccgggagagactcgcct

SEQ ID NO: 33922 - DNA, 25 bp, Homo sapien
gtcaccgggagagactcgcctgcca

SEQ ID NO: 33923 - DNA, 25 bp, Homo sapien
tgcctgtccgcaggaatgcaggccg

SEQ ID NO: 33924 - DNA, 25 bp, Homo sapien
ggcaacctccggaagcacactagga

SEQ ID NO: 33925 - DNA, 25 bp, Homo sapien
tgccctcccagctgccgaaaagagg

SEQ ID NO: 33926 - DNA, 25 bp, Homo sapien
taggaggttccagccgatctggtcg

SEQ ID NO: 33927 - DNA, 25 bp, Homo sapien
cggaggactccatttacgttacgca

SEQ ID NO: 33928 - DNA, 25 bp, Homo sapien
acgcctgggcttgcagtaaccgcca

SEQ ID NO: 33929 - DNA, 25 bp, Homo sapien
cagaaacctcgcgaccagccatggg

SEQ ID NO: 33930 - DNA, 25 bp, Homo sapien
gaatctcgcgagatcccgtcggtcc

SEQ ID NO: 33931 - DNA, 25 bp, Homo sapien
cagccaagtggaacggcaggaaccc

SEQ ID NO: 33932 - DNA, 25 bp, Homo sapien
gtctacgacggcaagtacctgcctg

SEQ ID NO: 33933 - DNA, 25 bp, Homo sapien
ggcctgcacgctttgacgtcacgtc

SEQ ID NO: 33934 - DNA, 25 bp, Homo sapien
ctgaccgcccagattgacgttgcta

SEQ ID NO: 33935 - DNA, 25 bp, Homo sapien
tgaaatgcgtatctggtctcctgtc

SEQ ID NO: 33936 - DNA, 25 bp, Homo sapien
ctccgggctgccaataaagaagtga

SEQ ID NO: 33937 - DNA, 25 bp, Homo sapien
tccattcaggactacacgaggcgct

SEQ ID NO: 33938 - DNA, 25 bp, Homo sapien
tctgcctaagtgctacgtgatcctc

SEQ ID NO: 33939 - DNA, 25 bp, Homo sapien
gcttcggtgggtattttctgcctaa

SEQ ID NO: 33940 - DNA, 25 bp, Homo sapien
aactggcggaagatgctgacactgc

SEQ ID NO: 33941 - DNA, 25 bp, Homo sapien
taggcctctaccacgtccgagagtt

SEQ ID NO: 33942 - DNA, 25 bp, Homo sapien
gatgctgacactgccatgccagaag

SEQ ID NO: 33943 - DNA, 25 bp, Homo sapien
cgtccgagagttcaaatgtattgtc

SEQ ID NO: 33944 - DNA, 25 bp, Homo sapien
cccgagaaggtctggggcatgaact

SEQ ID NO: 33945 - DNA, 25 bp, Homo sapien
ggtccatgtcatcgctgccactgtc

SEQ ID NO: 33946 - DNA, 25 bp, Homo sapien
ccagactggggctagtgcagctcat

SEQ ID NO: 33947 - DNA, 25 bp, Homo sapien
cgagtctctgggtcataggcctcta

SEQ ID NO: 33948 - DNA, 25 bp, Homo sapien
gtcggcggccaccacgtacagcagt

SEQ ID NO: 33949 - DNA, 25 bp, Homo sapien
gtacagcagtccgtccagcacagag

SEQ ID NO: 33950 - DNA, 25 bp, Homo sapien
cgcccactcattcacgcttgagttg

SEQ ID NO: 33951 - DNA, 25 bp, Homo sapien
ttgagttgtacctccacacgcagtc

SEQ ID NO: 33952 - DNA, 25 bp, Homo sapien
acacgcagtcatagagccgggagcc

SEQ ID NO: 33953 - DNA, 25 bp, Homo sapien
tcccaggagtcagtggtgtggtcat

SEQ ID NO: 33954 - DNA, 25 bp, Homo sapien
gcactgcatcaccatggtctccttg

SEQ ID NO: 33955 - DNA, 25 bp, Homo sapien
tccgggtcgtagcactgcatcacca

SEQ ID NO: 33956 - DNA, 25 bp, Homo sapien
aggacttcctggcattggcgctgct

SEQ ID NO: 33957 - DNA, 25 bp, Homo sapien
tgctgctgtacaatggcaacgcccg

SEQ ID NO: 33958 - DNA, 25 bp, Homo sapien
cctttgcagtgcttggcgcccctgt

SEQ ID NO: 33959 - DNA, 25 bp, Homo sapien
aggggctgctgctgtacaatggcaa

SEQ ID NO: 33960 - DNA, 25 bp, Homo sapien
cctggcactggaattccgggcgctg

SEQ ID NO: 33961 - DNA, 25 bp, Homo sapien
cgctgcgcctggcactggaattccg

SEQ ID NO: 33962 - DNA, 25 bp, Homo sapien
gctgtacaatggcaacgcccggggc

SEQ ID NO: 33963 - DNA, 25 bp, Homo sapien
cttcctggcattggcgctgctagat

SEQ ID NO: 33964 - DNA, 25 bp, Homo sapien
agcggctcagcgttgtcgccgctta

SEQ ID NO: 33965 - DNA, 25 bp, Homo sapien
gacagcgagtgacaagtgccaggtc

SEQ ID NO: 33966 - DNA, 25 bp, Homo sapien
cccgtgtagctgaagtccagcagca

SEQ ID NO: 33967 - DNA, 25 bp, Homo sapien
tccatggcgccttcgataggttgtc

SEQ ID NO: 33968 - DNA, 25 bp, Homo sapien
ctgctgaacccaacccgggagaggc

SEQ ID NO: 33969 - DNA, 25 bp, Homo sapien
gcgcgctaggcaccgctgctataaa

SEQ ID NO: 33970 - DNA, 25 bp, Homo sapien
gaaggcctcagcgaagtcctgcatg

SEQ ID NO: 33971 - DNA, 25 bp, Homo sapien
cacgtggcgcagaatgaaccgctgc

SEQ ID NO: 33972 - DNA, 25 bp, Homo sapien
acgcgcaggagagatggaagcctcc

SEQ ID NO: 33973 - DNA, 25 bp, Homo sapien
cagcggcgtgcagatcttgtgctgc

SEQ ID NO: 33974 - DNA, 25 bp, Homo sapien
ggtccatctccgtgtagtacatctc

SEQ ID NO: 33975 - DNA, 25 bp, Homo sapien
gcctccggtggacgtgaaatcttta

SEQ ID NO: 33976 - DNA, 25 bp, Homo sapien
ggcctcactcacaactggcggggtg

SEQ ID NO: 33977 - DNA, 25 bp, Homo sapien
ggggagcacaatgccggcctcactc

SEQ ID NO: 33978 - DNA, 25 bp, Homo sapien
gcacatcccggtggggcttggacaa

SEQ ID NO: 33979 - DNA, 25 bp, Homo sapien
ttacttagagaaaagcgacagagtc

SEQ ID NO: 33980 - DNA, 25 bp, Homo sapien
cctggagatccgatggagctgactc

SEQ ID NO: 33981 - DNA, 25 bp, Homo sapien
tcggaactgatgctgtcccgccggt

SEQ ID NO: 33982 - DNA, 25 bp, Homo sapien
ccgcttccggttgaagacgtggctt

SEQ ID NO: 33983 - DNA, 25 bp, Homo sapien
tgactccagtccatctgtcgtcgtg

SEQ ID NO: 33984 - DNA, 25 bp, Homo sapien
gtctagggcagagtgcttttgctcc

SEQ ID NO: 33985 - DNA, 25 bp, Homo sapien
tcaccatggtaagatccgagccagg

SEQ ID NO: 33986 - DNA, 25 bp, Homo sapien
ccatcttggcaagaggcgaagcggc

SEQ ID NO: 33987 - DNA, 25 bp, Homo sapien
cccggcgtttttgctctgcgagaac

SEQ ID NO: 33988 - DNA, 25 bp, Homo sapien
tcacagagcttgagaagcgacgcgc

SEQ ID NO: 33989 - DNA, 25 bp, Homo sapien
ctccggttgctctcgaggagtttta

SEQ ID NO: 33990 - DNA, 25 bp, Homo sapien
gtgaagctgtgcgtccgaatcgccc

SEQ ID NO: 33991 - DNA, 25 bp, Homo sapien
gcccggaacatggactctgactctt

SEQ ID NO: 33992 - DNA, 25 bp, Homo sapien
ggagctgcatcgtccactccggtcg

SEQ ID NO: 33993 - DNA, 25 bp, Homo sapien
tcccgagacacgagccgaactgggc

SEQ ID NO: 33994 - DNA, 25 bp, Homo sapien
atggactctgactcttgcgccgccg

SEQ ID NO: 33995 - DNA, 25 bp, Homo sapien
ggaaccgccagtccggggtcacaga

SEQ ID NO: 33996 - DNA, 25 bp, Homo sapien
cggcagtgctgcaaccgctacagca

SEQ ID NO: 33997 - DNA, 25 bp, Homo sapien
ttgctgtgtccctggtcgctgcagc

SEQ ID NO: 33998 - DNA, 25 bp, Homo sapien
ctgaacagactagcgggccgcggcc

SEQ ID NO: 33999 - DNA, 25 bp, Homo sapien
ctcaccttccaccggtaagaggcgg

SEQ ID NO: 34000 - DNA, 25 bp, Homo sapien
ctggctcgagatgccgaagtcgtgc

SEQ ID NO: 34001 - DNA, 25 bp, Homo sapien
agccaggcctggctcgagatgccga

SEQ ID NO: 34002 - DNA, 25 bp, Homo sapien
gatggcaggatgagcgcgccctgga

SEQ ID NO: 34003 - DNA, 25 bp, Homo sapien
cccgcggaccgactccgaggccttg

SEQ ID NO: 34004 - DNA, 25 bp, Homo sapien
acgttccctagtggccttgaccttg

SEQ ID NO: 34005 - DNA, 25 bp, Homo sapien
tcttcgtgctcccaatggacgcgtg

SEQ ID NO: 34006 - DNA, 25 bp, Homo sapien
gaccacgcgggtgtctcttcgtgct

SEQ ID NO: 34007 - DNA, 25 bp, Homo sapien
gccaaaccggcaaggccgtgctcaa

SEQ ID NO: 34008 - DNA, 25 bp, Homo sapien
cgagtaatagtcttcattgtccagc

SEQ ID NO: 34009 - DNA, 25 bp, Homo sapien
ccctgcgcacgttcagcaacgagta

SEQ ID NO: 34010 - DNA, 25 bp, Homo sapien
ctcagccaggacgagtatgtgggct

SEQ ID NO: 34011 - DNA, 25 bp, Homo sapien
tgagactcagttcgccatcctgctg

SEQ ID NO: 34012 - DNA, 25 bp, Homo sapien
gagcgccttcctcatgacggtcacg

SEQ ID NO: 34013 - DNA, 25 bp, Homo sapien
ccctttgattggtctggacggcctg

SEQ ID NO: 34014 - DNA, 25 bp, Homo sapien
cccgtcctgattggacagttctttc

SEQ ID NO: 34015 - DNA, 25 bp, Homo sapien
cgtctcggcctcgaggaaatattcc

SEQ ID NO: 34016 - DNA, 25 bp, Homo sapien
tgtagtgacgcccaatcaaaacgcc

SEQ ID NO: 34017 - DNA, 25 bp, Homo sapien
acggcctgggaaacactgtagtgac

SEQ ID NO: 34018 - DNA, 25 bp, Homo sapien
tctggccactaggaagctttgttta

SEQ ID NO: 34019 - DNA, 25 bp, Homo sapien
ctttcagtccgttgggtggtgacca

SEQ ID NO: 34020 - DNA, 25 bp, Homo sapien
cagtccagcgtcttccggtatggca

SEQ ID NO: 34021 - DNA, 25 bp, Homo sapien
tgctttgggcctcacgcctctgtct

SEQ ID NO: 34022 - DNA, 25 bp, Homo sapien
ccgatttattcaggacacacgtgtg

SEQ ID NO: 34023 - DNA, 25 bp, Homo sapien
gtgtgctccgagtgccagatacatg

SEQ ID NO: 34024 - DNA, 25 bp, Homo sapien
cccgacaaggcacgcaggtctcaga

SEQ ID NO: 34025 - DNA, 25 bp, Homo sapien
gtctcagacaacaggtgacgctgtg

SEQ ID NO: 34026 - DNA, 25 bp, Homo sapien
ttgccctgtcgggtcaaagccaagc

SEQ ID NO: 34027 - DNA, 25 bp, Homo sapien
cggtatggcagtcctttgccctgtc

SEQ ID NO: 34028 - DNA, 25 bp, Homo sapien
cggccggtgccaagaaggttgcaca

SEQ ID NO: 34029 - DNA, 25 bp, Homo sapien
caagaaggttgcacaatggctgggc

SEQ ID NO: 34030 - DNA, 25 bp, Homo sapien
ctgagggcttacacggacaggcaca

SEQ ID NO: 34031 - DNA, 25 bp, Homo sapien
cttacacggacaggcacaggctcca

SEQ ID NO: 34032 - DNA, 25 bp, Homo sapien
gcacaggctccaccgagcagccgcg

SEQ ID NO: 34033 - DNA, 25 bp, Homo sapien
agcagccgcgctaaggagctgtggg

SEQ ID NO: 34034 - DNA, 25 bp, Homo sapien
ggttgcagggcgttcgtttactgcc

SEQ ID NO: 34035 - DNA, 25 bp, Homo sapien
ccggtgccaagaaggttgcacaatg

SEQ ID NO: 34036 - DNA, 25 bp, Homo sapien
accaccctggagcagatggacttca

SEQ ID NO: 34037 - DNA, 25 bp, Homo sapien
ccaatgaggccgtgtacaccatgtc

SEQ ID NO: 34038 - DNA, 25 bp, Homo sapien
cgtgagctctgatggccacaagttc

SEQ ID NO: 34039 - DNA, 25 bp, Homo sapien
ggacacctccttcgagcagcagatg

SEQ ID NO: 34040 - DNA, 25 bp, Homo sapien
ttcagcgccatcgactccaacaagg

SEQ ID NO: 34041 - DNA, 25 bp, Homo sapien
agagcgccacggtgttcatgtcaga

SEQ ID NO: 34042 - DNA, 25 bp, Homo sapien
tgcccacggtgaaaacggaggcctc

SEQ ID NO: 34043 - DNA, 25 bp, Homo sapien
agccgagatggtcagctccaacatc

SEQ ID NO: 34044 - DNA, 25 bp, Homo sapien
ccgcggcgtagcttttgtttgcgca

SEQ ID NO: 34045 - DNA, 25 bp, Homo sapien
catgaactttgcgtccgggccaatg

SEQ ID NO: 34046 - DNA, 25 bp, Homo sapien
aatttgtttgcttggctaaaggccg

SEQ ID NO: 34047 - DNA, 25 bp, Homo sapien
tgccctcatttgatctaaaacatga

SEQ ID NO: 34048 - DNA, 25 bp, Homo sapien
agctgctgcggcgaagtctttgtcc

SEQ ID NO: 34049 - DNA, 25 bp, Homo sapien
ctctgctgcatgtgggatgcgccct

SEQ ID NO: 34050 - DNA, 25 bp, Homo sapien
cgtccgggccaatgctgcagtggcc

SEQ ID NO: 34051 - DNA, 25 bp, Homo sapien
gactgtctgccctcatttgatctaa

SEQ ID NO: 34052 - DNA, 25 bp, Homo sapien
acacgcgtgtccatgccgcgagggt

SEQ ID NO: 34053 - DNA, 25 bp, Homo sapien
cgcaagcctgacgagcaggagccga

SEQ ID NO: 34054 - DNA, 25 bp, Homo sapien
tggggcgctcggcttctcctcaaca

SEQ ID NO: 34055 - DNA, 25 bp, Homo sapien
ctcggcgcaagcctgacgagcagga

SEQ ID NO: 34056 - DNA, 25 bp, Homo sapien
ccgcgagtcgttccagctgcggcga

SEQ ID NO: 34057 - DNA, 25 bp, Homo sapien
agccgagctcagcaggtccgggtag

SEQ ID NO: 34058 - DNA, 25 bp, Homo sapien
ccacgcgtgtttctggcgcgagtgt

SEQ ID NO: 34059 - DNA, 25 bp, Homo sapien
tgggagacacgcgtgtccatgccgc

SEQ ID NO: 34060 - DNA, 25 bp, Homo sapien
ggctcctgaatcaccctcgctccgt

SEQ ID NO: 34061 - DNA, 25 bp, Homo sapien
ccgtgctgcagacagacctagtgcc

SEQ ID NO: 34062 - DNA, 25 bp, Homo sapien
tccgtccaggcagccgtgctgcaga

SEQ ID NO: 34063 - DNA, 25 bp, Homo sapien
tttgatatgattttcttgcctgagt

SEQ ID NO: 34064 - DNA, 25 bp, Homo sapien
gtaaacttgttgctttttgatatga

SEQ ID NO: 34065 - DNA, 25 bp, Homo sapien
aggacgccgtcaccaagccagagct

SEQ ID NO: 34066 - DNA, 25 bp, Homo sapien
cagacagacctagtgccgagggatg

SEQ ID NO: 34067 - DNA, 25 bp, Homo sapien
ccgcgcccgctgtaattattttcta

SEQ ID NO: 34068 - DNA, 25 bp, Homo sapien
acacacgtacccgtcacacatgagg

SEQ ID NO: 34069 - DNA, 25 bp, Homo sapien
ttacacagcccagctcatgcaagca

SEQ ID NO: 34070 - DNA, 25 bp, Homo sapien
ggccgcgcaaacaagcggctccttc

SEQ ID NO: 34071 - DNA, 25 bp, Homo sapien
gcaggcgcccaacactgcggccttg

SEQ ID NO: 34072 - DNA, 25 bp, Homo sapien
cggccttgtcccacgcgggcagcct

SEQ ID NO: 34073 - DNA, 25 bp, Homo sapien
gcaaggggccgctaccttgcggaaa

SEQ ID NO: 34074 - DNA, 25 bp, Homo sapien
gtcacacagcctacctcacacacgc

SEQ ID NO: 34075 - DNA, 25 bp, Homo sapien
cctcacacacattcagccgcccttc

SEQ ID NO: 34076 - DNA, 25 bp, Homo sapien
aaatgtgagtgacgctacgcgacgc

SEQ ID NO: 34077 - DNA, 25 bp, Homo sapien
gctgccaaaatgtgagtgacgctac

SEQ ID NO: 34078 - DNA, 25 bp, Homo sapien
acgacagccctggttcgggagcgcc

SEQ ID NO: 34079 - DNA, 25 bp, Homo sapien
ggcagctcgcgctgggaccgccata

SEQ ID NO: 34080 - DNA, 25 bp, Homo sapien
tgggaccgccatactgcccagttgc

SEQ ID NO: 34081 - DNA, 25 bp, Homo sapien
ggtcccaacttcgcttctctgctga

SEQ ID NO: 34082 - DNA, 25 bp, Homo sapien
ctagtccccgacgtccctgagagga

SEQ ID NO: 34083 - DNA, 25 bp, Homo sapien
cagaagttgcgaaagaaaggacctc

SEQ ID NO: 34084 - DNA, 25 bp, Homo sapien
cgggagccacctacaaactccagga

SEQ ID NO: 34085 - DNA, 25 bp, Homo sapien
gctcggtaggtcacgggcggtgaaa

SEQ ID NO: 34086 - DNA, 25 bp, Homo sapien
ggaacccagaaagacggccaaagca

SEQ ID NO: 34087 - DNA, 25 bp, Homo sapien
agacggccaaagcacgatgaggacc

SEQ ID NO: 34088 - DNA, 25 bp, Homo sapien
ccaaagcacgatgaggaccgctgcc

SEQ ID NO: 34089 - DNA, 25 bp, Homo sapien
agcacgatgaggaccgctgccggca

SEQ ID NO: 34090 - DNA, 25 bp, Homo sapien
ggagccacctacaaactccaggact

SEQ ID NO: 34091 - DNA, 25 bp, Homo sapien
cccacacccgctcgggcagccggga

SEQ ID NO: 34092 - DNA, 25 bp, Homo sapien
agtcgagcgagctccgggttttgaa

SEQ ID NO: 34093 - DNA, 25 bp, Homo sapien
actgactgcaaagtgagcgagaagc

SEQ ID NO: 34094 - DNA, 25 bp, Homo sapien
aaaccggtgtctgtcactgactgca

SEQ ID NO: 34095 - DNA, 25 bp, Homo sapien
cctgttctcactaacgccatggcgg

SEQ ID NO: 34096 - DNA, 25 bp, Homo sapien
ttccatttgtcccttgtcacccttg

SEQ ID NO: 34097 - DNA, 25 bp, Homo sapien
tggcttatataacccgggcgcaccg

SEQ ID NO: 34098 - DNA, 25 bp, Homo sapien
ggcgtcggactgtctgttccatttg

SEQ ID NO: 34099 - DNA, 25 bp, Homo sapien
taggccggagtcctgaaagtcgagc

SEQ ID NO: 34100 - DNA, 25 bp, Homo sapien
agcagcagctcgaacaccggctctg

SEQ ID NO: 34101 - DNA, 25 bp, Homo sapien
caggaaagggaagcacaagcggaag

SEQ ID NO: 34102 - DNA, 25 bp, Homo sapien
tgccggagccgccagacagcagcag

SEQ ID NO: 34103 - DNA, 25 bp, Homo sapien
gaagagaatacgcagcccccggaac

SEQ ID NO: 34104 - DNA, 25 bp, Homo sapien
tcctctccgcacacctcgagcccga

SEQ ID NO: 34105 - DNA, 25 bp, Homo sapien
agccgcgacctcacccggaagagaa

SEQ ID NO: 34106 - DNA, 25 bp, Homo sapien
gggagcgcatcagaacgcacagccc

SEQ ID NO: 34107 - DNA, 25 bp, Homo sapien
cgcaggggagcgcatcagaacgcac

SEQ ID NO: 34108 - DNA, 25 bp, Homo sapien
agaagaggaaaacgcggcgcgactc

SEQ ID NO: 34109 - DNA, 25 bp, Homo sapien
cgagagtagcttgggccgtcctcct

SEQ ID NO: 34110 - DNA, 25 bp, Homo sapien
gctctcccgacagaagaggaaaacg

SEQ ID NO: 34111 - DNA, 25 bp, Homo sapien
atgcggacagatgcggacgttctgc

SEQ ID NO: 34112 - DNA, 25 bp, Homo sapien
agatgcggacgttctgccgccgcct

SEQ ID NO: 34113 - DNA, 25 bp, Homo sapien
actcggagatcaggccgcagaagca

SEQ ID NO: 34114 - DNA, 25 bp, Homo sapien
aaaggagccttgtggcttcgtgtcc

SEQ ID NO: 34115 - DNA, 25 bp, Homo sapien
cagcacgagctctcccgacagaaga

SEQ ID NO: 34116 - DNA, 25 bp, Homo sapien
cgcgacgctctaaaggaagtgacct

SEQ ID NO: 34117 - DNA, 25 bp, Homo sapien
acctttaggggctgttactctcaga

SEQ ID NO: 34118 - DNA, 25 bp, Homo sapien
cccggcgcatttacgtcggatctga

SEQ ID NO: 34119 - DNA, 25 bp, Homo sapien
cctacgtcatgcaggtcagtcggta

SEQ ID NO: 34120 - DNA, 25 bp, Homo sapien
tcacagaactcggtgtcagaatttc

SEQ ID NO: 34121 - DNA, 25 bp, Homo sapien
accagcgccgcctcaaatgtcaggg

SEQ ID NO: 34122 - DNA, 25 bp, Homo sapien
ccggtctcgccgacataaccttttg

SEQ ID NO: 34123 - DNA, 25 bp, Homo sapien
ggctgcggtcaccagaacgaatctg

SEQ ID NO: 34124 - DNA, 25 bp, Homo sapien
tgcacggagcgcgaactaaggaacc

SEQ ID NO: 34125 - DNA, 25 bp, Homo sapien
tggaccagagtcctaacagaccaga

SEQ ID NO: 34126 - DNA, 25 bp, Homo sapien
gtgcgttcattttcagcctggtgtg

SEQ ID NO: 34127 - DNA, 25 bp, Homo sapien
ggcagttccagagaccggctcctca

SEQ ID NO: 34128 - DNA, 25 bp, Homo sapien
ttggatttgactgaccgccagcgtg

SEQ ID NO: 34129 - DNA, 25 bp, Homo sapien
acgctgaagcgtccagaatcttctg

SEQ ID NO: 34130 - DNA, 25 bp, Homo sapien
gacggtaaaccctccagataatctg

SEQ ID NO: 34131 - DNA, 25 bp, Homo sapien
tgctgtcgttggcagtgagaactcc

SEQ ID NO: 34132 - DNA, 25 bp, Homo sapien
tgggagcctctcaacgccgagcttt

SEQ ID NO: 34133 - DNA, 25 bp, Homo sapien
ggacgaggaccttcatgctcgccgc

SEQ ID NO: 34134 - DNA, 25 bp, Homo sapien
cacctcaatggggagaagcccgcga

SEQ ID NO: 34135 - DNA, 25 bp, Homo sapien
cgccgccgcctctatatatagcata

SEQ ID NO: 34136 - DNA, 25 bp, Homo sapien
caccgtggcgtatcgcggcgctgca

SEQ ID NO: 34137 - DNA, 25 bp, Homo sapien
ggccgctgttcctgcccgaactgag

SEQ ID NO: 34138 - DNA, 25 bp, Homo sapien
agctttcctcagaagcccgcggcga

SEQ ID NO: 34139 - DNA, 25 bp, Homo sapien
tatatatagcataggccgccgggcc

SEQ ID NO: 34140 - DNA, 25 bp, Homo sapien
ctctgtggtggatatgtcgaaagtt

SEQ ID NO: 34141 - DNA, 25 bp, Homo sapien
gagcgacgtgacattccttacctcg

SEQ ID NO: 34142 - DNA, 25 bp, Homo sapien
tcacgctcgctggactttctgccag

SEQ ID NO: 34143 - DNA, 25 bp, Homo sapien
agcctgccctctttagcgctggtcg

SEQ ID NO: 34144 - DNA, 25 bp, Homo sapien
agttaggggaacattgagtcatctc

SEQ ID NO: 34145 - DNA, 25 bp, Homo sapien
tgagtcatctcctccctttcagctg

SEQ ID NO: 34146 - DNA, 25 bp, Homo sapien
cagctgcggcatatttctgggaatg

SEQ ID NO: 34147 - DNA, 25 bp, Homo sapien
tgcgaagcacatttgagcgacgtga

SEQ ID NO: 34148 - DNA, 25 bp, Homo sapien
ggagctcgcgccctcaagagacttc

SEQ ID NO: 34149 - DNA, 25 bp, Homo sapien
gctttagcagtttcgggcgtgcacg

SEQ ID NO: 34150 - DNA, 25 bp, Homo sapien
gaggctcctgcctctgcggagctcg

SEQ ID NO: 34151 - DNA, 25 bp, Homo sapien
ggaaaaggaggatgctagtgaccca

SEQ ID NO: 34152 - DNA, 25 bp, Homo sapien
ctcaagagacttccaggagggtttg

SEQ ID NO: 34153 - DNA, 25 bp, Homo sapien
cgagtctgctccaagtgcgcatctg

SEQ ID NO: 34154 - DNA, 25 bp, Homo sapien
tcaagctcgcgcgtgggctttagca

SEQ ID NO: 34155 - DNA, 25 bp, Homo sapien
tagtgacccatcctttctcgccgtg

SEQ ID NO: 34156 - DNA, 25 bp, Homo sapien
ggccggagttgaggagtgtgtgttc

SEQ ID NO: 34157 - DNA, 25 bp, Homo sapien
ccctcccgccgaccaggagagggcg

SEQ ID NO: 34158 - DNA, 25 bp, Homo sapien
acggaggcacctggtaggcccgcca

SEQ ID NO: 34159 - DNA, 25 bp, Homo sapien
gccaggcgctctacgccgagctcca

SEQ ID NO: 34160 - DNA, 25 bp, Homo sapien
ccgagctccagacgcagctcgataa

SEQ ID NO: 34161 - DNA, 25 bp, Homo sapien
agctccagacgcagctcgataactg

SEQ ID NO: 34162 - DNA, 25 bp, Homo sapien
gcagctcgataactgccccgagtca

SEQ ID NO: 34163 - DNA, 25 bp, Homo sapien
gctccagacgcagctcgataactgc

SEQ ID NO: 34164 - DNA, 25 bp, Homo sapien
ggagcttccgcctgcagcccaaact

SEQ ID NO: 34165 - DNA, 25 bp, Homo sapien
tcacgcctcagacccggggtcctgg

SEQ ID NO: 34166 - DNA, 25 bp, Homo sapien
gcgctcccagctgggtcacgcctca

SEQ ID NO: 34167 - DNA, 25 bp, Homo sapien
ccaccgctgaaaaggatggcagctg

SEQ ID NO: 34168 - DNA, 25 bp, Homo sapien
gcacggcggcccagaatcctggacc

SEQ ID NO: 34169 - DNA, 25 bp, Homo sapien
tgggagctcgactccggaaaccggc

SEQ ID NO: 34170 - DNA, 25 bp, Homo sapien
acagaccgcggtgggagctcgactc

SEQ ID NO: 34171 - DNA, 25 bp, Homo sapien
aggagaagcgtctacggccccgaca

SEQ ID NO: 34172 - DNA, 25 bp, Homo sapien
cggcattcacgtatccgcgaacaca

SEQ ID NO: 34173 - DNA, 25 bp, Homo sapien
ccgcgaacacatgggtatctattta

SEQ ID NO: 34174 - DNA, 25 bp, Homo sapien
ggacagggatgcctgccgtctccac

SEQ ID NO: 34175 - DNA, 25 bp, Homo sapien
ccggcacggagacctttgttcctcg

SEQ ID NO: 34176 - DNA, 25 bp, Homo sapien
tcctcgtggaagtctcatgaattgc

SEQ ID NO: 34177 - DNA, 25 bp, Homo sapien
tcatgaattgcagagtccacggagc

SEQ ID NO: 34178 - DNA, 25 bp, Homo sapien
aggcttggcacacgcactgcggcat

SEQ ID NO: 34179 - DNA, 25 bp, Homo sapien
ccactgcgcacatgggcacaggctt

SEQ ID NO: 34180 - DNA, 25 bp, Homo sapien
acggctgcattctctttggcatcga

SEQ ID NO: 34181 - DNA, 25 bp, Homo sapien
acaggacttctggaggtcccaggtc

SEQ ID NO: 34182 - DNA, 25 bp, Homo sapien
ggtccgtgacacgacacctcagtca

SEQ ID NO: 34183 - DNA, 25 bp, Homo sapien
cagtcaccgggccaacaacttcaaa

SEQ ID NO: 34184 - DNA, 25 bp, Homo sapien
caagaggaggaagtgcattcgtccc

SEQ ID NO: 34185 - DNA, 25 bp, Homo sapien
ggagctgcttttcaacggctgcatt

SEQ ID NO: 34186 - DNA, 25 bp, Homo sapien
atcgagttcagctacgccatggaga

SEQ ID NO: 34187 - DNA, 25 bp, Homo sapien
ccagaggtccttccgggagctgctt

SEQ ID NO: 34188 - DNA, 25 bp, Homo sapien
ggacattggcatcgccctggctgac

SEQ ID NO: 34189 - DNA, 25 bp, Homo sapien
tgacgtgaccgggaaccacaagtgg

SEQ ID NO: 34190 - DNA, 25 bp, Homo sapien
ctgcaggcttcagacgtgtggcttt

SEQ ID NO: 34191 - DNA, 25 bp, Homo sapien
cagcagggccgaagctgaatctgcc

SEQ ID NO: 34192 - DNA, 25 bp, Homo sapien
atccacgccctcctggcaggtgagt

SEQ ID NO: 34193 - DNA, 25 bp, Homo sapien
aggaccgaggcctgaacatccacgc

SEQ ID NO: 34194 - DNA, 25 bp, Homo sapien
cctacatgatggacgtgtgcagccc

SEQ ID NO: 34195 - DNA, 25 bp, Homo sapien
gctgatggactttagcgccgactcg

SEQ ID NO: 34196 - DNA, 25 bp, Homo sapien
ggccaacatagacagcgtcctcatt

SEQ ID NO: 34197 - DNA, 25 bp, Homo sapien
agcgagttcgcctcatcctttggca

SEQ ID NO: 34198 - DNA, 25 bp, Homo sapien
ctccctgacgggcatcagcgagttc

SEQ ID NO: 34199 - DNA, 25 bp, Homo sapien
tacggcagcttcatcagcagggaca

SEQ ID NO: 34200 - DNA, 25 bp, Homo sapien
ttcactgcggtcaccctgagcgtca

SEQ ID NO: 34201 - DNA, 25 bp, Homo sapien
ggggacagctccgagtcatttacct

SEQ ID NO: 34202 - DNA, 25 bp, Homo sapien
atccactgggataaaacgggcttcg

SEQ ID NO: 34203 - DNA, 25 bp, Homo sapien
cctcattgactgcttcacgggcggc

SEQ ID NO: 34204 - DNA, 25 bp, Homo sapien
gacacggggctcatgccgtcagata

SEQ ID NO: 34205 - DNA, 25 bp, Homo sapien
catctgcaacatgcccaaggcgcta

SEQ ID NO: 34206 - DNA, 25 bp, Homo sapien
tatgagagcgagctgacgggctcca

SEQ ID NO: 34207 - DNA, 25 bp, Homo sapien
atatcctgctcaacggcgtgaagta

SEQ ID NO: 34208 - DNA, 25 bp, Homo sapien
ttcccaggtggccaatatcctgctc

SEQ ID NO: 34209 - DNA, 25 bp, Homo sapien
tgcggtgtttccgagagcgcattcc

SEQ ID NO: 34210 - DNA, 25 bp, Homo sapien
acccttgcagcctccgtgcggtgtt

SEQ ID NO: 34211 - DNA, 25 bp, Homo sapien
tgccgtcagataagaagacagaccc

SEQ ID NO: 34212 - DNA, 25 bp, Homo sapien
aacgtctgacatcgcggagcctcga

SEQ ID NO: 34213 - DNA, 25 bp, Homo sapien
actcctccctgtttgtcatttatga

SEQ ID NO: 34214 - DNA, 25 bp, Homo sapien
gccaacggggtgatgtacttctcca

SEQ ID NO: 34215 - DNA, 25 bp, Homo sapien
tcagattctggtctccctggtcctg

SEQ ID NO: 34216 - DNA, 25 bp, Homo sapien
gtacttcctggctcagattctggtc

SEQ ID NO: 34217 - DNA, 25 bp, Homo sapien
ctcgctgacacgtttcttcctctgg

SEQ ID NO: 34218 - DNA, 25 bp, Homo sapien
tcgcaggacacaccgagctcggtca

SEQ ID NO: 34219 - DNA, 25 bp, Homo sapien
ctcccagcgacgctgcagacgagga

SEQ ID NO: 34220 - DNA, 25 bp, Homo sapien
tcacgttgaacatctgcagtcgggc

SEQ ID NO: 34221 - DNA, 25 bp, Homo sapien
tcgacgttgtagaggccaggcatgt

SEQ ID NO: 34222 - DNA, 25 bp, Homo sapien
agtctctccctctccaaggggttca

SEQ ID NO: 34223 - DNA, 25 bp, Homo sapien
cagtctgtcagggtagctcatctcg

SEQ ID NO: 34224 - DNA, 25 bp, Homo sapien
cgtggatacgctcggctgccagtct

SEQ ID NO: 34225 - DNA, 25 bp, Homo sapien
gccatgcgctctgcgtggatacgct

SEQ ID NO: 34226 - DNA, 25 bp, Homo sapien
tcgctggtcagcgatgccatgcgct

SEQ ID NO: 34227 - DNA, 25 bp, Homo sapien
cgggcgtactcgctcagagtccgaa

SEQ ID NO: 34228 - DNA, 25 bp, Homo sapien
tccgagacaccagagaataaccagc

SEQ ID NO: 34229 - DNA, 25 bp, Homo sapien
ggcggtaaagcacagaaacttcctc

SEQ ID NO: 34230 - DNA, 25 bp, Homo sapien
cattttcgcagcagactcgtcccta

SEQ ID NO: 34231 - DNA, 25 bp, Homo sapien
cccagcccggagactttcactttgt

SEQ ID NO: 34232 - DNA, 25 bp, Homo sapien
ggcgctggaatctgtgtcctccttc

SEQ ID NO: 34233 - DNA, 25 bp, Homo sapien
cttccggacaggagaacatcaaggc

SEQ ID NO: 34234 - DNA, 25 bp, Homo sapien
gcccacgttccggatggacgaagtc

SEQ ID NO: 34235 - DNA, 25 bp, Homo sapien
cgtccgtcattaaaagccactccga

SEQ ID NO: 34236 - DNA, 25 bp, Homo sapien
cggctggaacactccgtgcacccac

SEQ ID NO: 34237 - DNA, 25 bp, Homo sapien
gcacttgtccaactttctggcccga

SEQ ID NO: 34238 - DNA, 25 bp, Homo sapien
tgtccaactttctggcccgagattc

SEQ ID NO: 34239 - DNA, 25 bp, Homo sapien
gcggcactcagctcgcactccttca

SEQ ID NO: 34240 - DNA, 25 bp, Homo sapien
cttgctaaaacaaaaggaggcctga

SEQ ID NO: 34241 - DNA, 25 bp, Homo sapien
actttctggcccgagattcgcgtcc

SEQ ID NO: 34242 - DNA, 25 bp, Homo sapien
acatgccggtgacccagacgccggg

SEQ ID NO: 34243 - DNA, 25 bp, Homo sapien
ccggggagtgaagtgcacttgctaa

SEQ ID NO: 34244 - DNA, 25 bp, Homo sapien
tctctcacaccgacgagaaaagttc

SEQ ID NO: 34245 - DNA, 25 bp, Homo sapien
tcctcctccactcaagatggcgaaa

SEQ ID NO: 34246 - DNA, 25 bp, Homo sapien
ggacaggacggctgcttttccacag

SEQ ID NO: 34247 - DNA, 25 bp, Homo sapien
acagccgcgacgtgattgagaaatg

SEQ ID NO: 34248 - DNA, 25 bp, Homo sapien
cgggagttgagaccagaggaacatc

SEQ ID NO: 34249 - DNA, 25 bp, Homo sapien
tgacctgacttctccagctggccgg

SEQ ID NO: 34250 - DNA, 25 bp, Homo sapien
cctccatgcaggaaggcgcggaact

SEQ ID NO: 34251 - DNA, 25 bp, Homo sapien
tggctgagctaactcggctcctctg

SEQ ID NO: 34252 - DNA, 25 bp, Homo sapien
aaagaaagcacacgacccggcgcgg

SEQ ID NO: 34253 - DNA, 25 bp, Homo sapien
cgcgggcaagttggacacttacctt

SEQ ID NO: 34254 - DNA, 25 bp, Homo sapien
cccgggcgagtgactgctttcacgg

SEQ ID NO: 34255 - DNA, 25 bp, Homo sapien
cacggccgaccctctctgaccacca

SEQ ID NO: 34256 - DNA, 25 bp, Homo sapien
atcaatagtgaggtgttcgcggccc

SEQ ID NO: 34257 - DNA, 25 bp, Homo sapien
tagtgaggtgttcgcggcccagctc

SEQ ID NO: 34258 - DNA, 25 bp, Homo sapien
agtgactgctttcacggccgaccct

SEQ ID NO: 34259 - DNA, 25 bp, Homo sapien
ctaaagcgctacaccatcaatagtg

SEQ ID NO: 34260 - DNA, 25 bp, Homo sapien
tgacgcaagggtgggacgaggcgca

SEQ ID NO: 34261 - DNA, 25 bp, Homo sapien
gagcgttttgacaccctcggagacc

SEQ ID NO: 34262 - DNA, 25 bp, Homo sapien
ggagcgttttgacaccctcggagac

SEQ ID NO: 34263 - DNA, 25 bp, Homo sapien
ccacggccggatgagaagtgggaga

SEQ ID NO: 34264 - DNA, 25 bp, Homo sapien
aggtcacgcacatcatgactcactc

SEQ ID NO: 34265 - DNA, 25 bp, Homo sapien
ccgctgtcagcgctgacgcaagggt

SEQ ID NO: 34266 - DNA, 25 bp, Homo sapien
cacaggtcacgcacatcatgactca

SEQ ID NO: 34267 - DNA, 25 bp, Homo sapien
cagccacaggtcacgcacatcatga

SEQ ID NO: 34268 - DNA, 25 bp, Homo sapien
cgcgtctttgtgagagtgcgaggcc

SEQ ID NO: 34269 - DNA, 25 bp, Homo sapien
gagccttgacaacgccgcggcccgg

SEQ ID NO: 34270 - DNA, 25 bp, Homo sapien
ccctccattggtacagcgcggtgtg

SEQ ID NO: 34271 - DNA, 25 bp, Homo sapien
ctccattggtacagcgcggtgtgac

SEQ ID NO: 34272 - DNA, 25 bp, Homo sapien
ttaataaaatgagcagagaagaagg

SEQ ID NO: 34273 - DNA, 25 bp, Homo sapien
cggagagaggccgagccttgacaac

SEQ ID NO: 34274 - DNA, 25 bp, Homo sapien
agaggccgagccttgacaacgccgc

SEQ ID NO: 34275 - DNA, 25 bp, Homo sapien
aggccgagccttgacaacgccgcgg

SEQ ID NO: 34276 - DNA, 25 bp, Homo sapien
gccctcgaccttgctgacaactttg

SEQ ID NO: 34277 - DNA, 25 bp, Homo sapien
gcgccgacttcctgcctagctaagg

SEQ ID NO: 34278 - DNA, 25 bp, Homo sapien
gctccgggtacccacagatactgtc

SEQ ID NO: 34279 - DNA, 25 bp, Homo sapien
taaagccggcgagatctccgtgctc

SEQ ID NO: 34280 - DNA, 25 bp, Homo sapien
ttacctagccactgggtctcgtcgc

SEQ ID NO: 34281 - DNA, 25 bp, Homo sapien
ctgtgctaagcagctcgcgtgtgca

SEQ ID NO: 34282 - DNA, 25 bp, Homo sapien
ttggctacgatggaaaagcaacttc

SEQ ID NO: 34283 - DNA, 25 bp, Homo sapien
cccgcagtcggtaatcacgtgttga

SEQ ID NO: 34284 - DNA, 25 bp, Homo sapien
actcacggcgcagaaggtcatgacc

SEQ ID NO: 34285 - DNA, 25 bp, Homo sapien
tcttctgaatcagcaggtacctggg

SEQ ID NO: 34286 - DNA, 25 bp, Homo sapien
ggccgcttcgtctttcttctgaatc

SEQ ID NO: 34287 - DNA, 25 bp, Homo sapien
gccagagccctcgttacctttcttg

SEQ ID NO: 34288 - DNA, 25 bp, Homo sapien
atacagcgttgacgcccgacagctg

SEQ ID NO: 34289 - DNA, 25 bp, Homo sapien
cgctcaggtagatctggtccgcgta

SEQ ID NO: 34290 - DNA, 25 bp, Homo sapien
gtttctgtagtagcggctggtcctc

SEQ ID NO: 34291 - DNA, 25 bp, Homo sapien
gtccgcgtagtagtagatctgcaag

SEQ ID NO: 34292 - DNA, 25 bp, Homo sapien
aggccgtcatgacgccaggctgcgg

SEQ ID NO: 34293 - DNA, 25 bp, Homo sapien
cagtacccggttcctgccagtgaca

SEQ ID NO: 34294 - DNA, 25 bp, Homo sapien
ctcgacccgtgcttccgccctggag

SEQ ID NO: 34295 - DNA, 25 bp, Homo sapien
tggcgtcaccaacgctcgacccgtg

SEQ ID NO: 34296 - DNA, 25 bp, Homo sapien
agggcgtcgcaagcacagccatggc

SEQ ID NO: 34297 - DNA, 25 bp, Homo sapien
cagtgacagggcgtcgcaagcacag

SEQ ID NO: 34298 - DNA, 25 bp, Homo sapien
aggccctcaggcccagaggggatca

SEQ ID NO: 34299 - DNA, 25 bp, Homo sapien
gccgctcagccagtccctctgcctg

SEQ ID NO: 34300 - DNA, 25 bp, Homo sapien
gcgaagttctgcagcactccgtaga

SEQ ID NO: 34301 - DNA, 25 bp, Homo sapien
gggctcctggaaaagcagcgccacc

SEQ ID NO: 34302 - DNA, 25 bp, Homo sapien
gccacccacctgacgacatggaagg

SEQ ID NO: 34303 - DNA, 25 bp, Homo sapien
cggacgatgctgaggtacaagtaga

SEQ ID NO: 34304 - DNA, 25 bp, Homo sapien
agagacctgggcctagagcctaacc

SEQ ID NO: 34305 - DNA, 25 bp, Homo sapien
agcgcaatggccacggtccagaaga

SEQ ID NO: 34306 - DNA, 25 bp, Homo sapien
aaggcccaaagcaggcgatctgtgc

SEQ ID NO: 34307 - DNA, 25 bp, Homo sapien
cccgcgttgagactgggacttagag

SEQ ID NO: 34308 - DNA, 25 bp, Homo sapien
cccggattcaacaagatgcgaaagg

SEQ ID NO: 34309 - DNA, 25 bp, Homo sapien
ttcccagagacgcaaagtcggacgc

SEQ ID NO: 34310 - DNA, 25 bp, Homo sapien
ggccttaaaggttcccagagacgca

SEQ ID NO: 34311 - DNA, 25 bp, Homo sapien
caagatgcgaaaggacttctaaagc

SEQ ID NO: 34312 - DNA, 25 bp, Homo sapien
gttgtctctgcgacgttgccagtcc

SEQ ID NO: 34313 - DNA, 25 bp, Homo sapien
ccgggtcaggacctgttgtctctgc

SEQ ID NO: 34314 - DNA, 25 bp, Homo sapien
cagtccgagggcctctcgcctggaa

SEQ ID NO: 34315 - DNA, 25 bp, Homo sapien
gacttctaaagccaggaaccggcac

SEQ ID NO: 34316 - DNA, 25 bp, Homo sapien
tcctggtcttccacggagtttccca

SEQ ID NO: 34317 - DNA, 25 bp, Homo sapien
atcccaggacgcacgaagccagttg

SEQ ID NO: 34318 - DNA, 25 bp, Homo sapien
aagccagttggtacgagcacctaga

SEQ ID NO: 34319 - DNA, 25 bp, Homo sapien
ccgagccctcaactccaatgaagta

SEQ ID NO: 34320 - DNA, 25 bp, Homo sapien
acagtcgtcaagaaacggtggtcta

SEQ ID NO: 34321 - DNA, 25 bp, Homo sapien
ggagactcactcactgcaccaatca

SEQ ID NO: 34322 - DNA, 25 bp, Homo sapien
aatcagcaccgtgcgtccgtctgga

SEQ ID NO: 34323 - DNA, 25 bp, Homo sapien
gagtttcccaaaagcgcgcgccaca

SEQ ID NO: 34324 - DNA, 25 bp, Homo sapien
ccagcgtgtgcgctccgacttctaa

SEQ ID NO: 34325 - DNA, 25 bp, Homo sapien
tccgacttctaaatccctactctgg

SEQ ID NO: 34326 - DNA, 25 bp, Homo sapien
cctactctggatattgaagacggga

SEQ ID NO: 34327 - DNA, 25 bp, Homo sapien
acgggaaagaccgagccgctcattc

SEQ ID NO: 34328 - DNA, 25 bp, Homo sapien
ccgagccgctcattctacagatggg

SEQ ID NO: 34329 - DNA, 25 bp, Homo sapien
tgccagatcgtagggagcagccagc

SEQ ID NO: 34330 - DNA, 25 bp, Homo sapien
tgacacgcgcacttgtcggagtgac

SEQ ID NO: 34331 - DNA, 25 bp, Homo sapien
aggacagctctaggacgcacggcca

SEQ ID NO: 34332 - DNA, 25 bp, Homo sapien
ctcacagctcacacgtggacaggga

SEQ ID NO: 34333 - DNA, 25 bp, Homo sapien
tggagaccagtaacgctggctcgga

SEQ ID NO: 34334 - DNA, 25 bp, Homo sapien
ccgaccgcaagaatgcaggagcctc

SEQ ID NO: 34335 - DNA, 25 bp, Homo sapien
gacaggactgcagcgtgcttctcca

SEQ ID NO: 34336 - DNA, 25 bp, Homo sapien
gacacacggacaagtcccgccaggg

SEQ ID NO: 34337 - DNA, 25 bp, Homo sapien
gacagggagacaagacacgcacgga

SEQ ID NO: 34338 - DNA, 25 bp, Homo sapien
ccagccggcaagagcttggcgagcc

SEQ ID NO: 34339 - DNA, 25 bp, Homo sapien
tgggctcttctggagaccagtaacg

SEQ ID NO: 34340 - DNA, 25 bp, Homo sapien
cctggtccgaggagctgatctctaa

SEQ ID NO: 34341 - DNA, 25 bp, Homo sapien
tctaagctggctaatgacatcgagg

SEQ ID NO: 34342 - DNA, 25 bp, Homo sapien
gttgacgagcgctgcgtcccactct

SEQ ID NO: 34343 - DNA, 25 bp, Homo sapien
gccagttccacctggcactgtcggg

SEQ ID NO: 34344 - DNA, 25 bp, Homo sapien
gggcccacacgcacctgtggctggt

SEQ ID NO: 34345 - DNA, 25 bp, Homo sapien
taatgacatcgaggccaccgctgtg

SEQ ID NO: 34346 - DNA, 25 bp, Homo sapien
cgtgcggcgctttggccagttccac

SEQ ID NO: 34347 - DNA, 25 bp, Homo sapien
gagctgatctctaagctggctaatg

SEQ ID NO: 34348 - DNA, 25 bp, Homo sapien
gcttcgctcctgtgctttccttcgc

SEQ ID NO: 34349 - DNA, 25 bp, Homo sapien
tgctttccttcgcccgtgtcttccc

SEQ ID NO: 34350 - DNA, 25 bp, Homo sapien
tgtgctttccttcgcccgtgtcttc

SEQ ID NO: 34351 - DNA, 25 bp, Homo sapien
ttcgctcctgtgctttccttcgccc

SEQ ID NO: 34352 - DNA, 25 bp, Homo sapien
ccgcttcgctcctgtgctttccttc

SEQ ID NO: 34353 - DNA, 25 bp, Homo sapien
gcccgcttcgctcctgtgctttcct

SEQ ID NO: 34354 - DNA, 25 bp, Homo sapien
ttgcccgcttcgctcctgtgctttc

SEQ ID NO: 34355 - DNA, 25 bp, Homo sapien
ctgtgctttccttcgcccgtgtctt

SEQ ID NO: 34356 - DNA, 25 bp, Homo sapien
cagctggtcgtgctgaccacgagcc

SEQ ID NO: 34357 - DNA, 25 bp, Homo sapien
gcaggatgaagcgtgagatcaccac

SEQ ID NO: 34358 - DNA, 25 bp, Homo sapien
cagtcctggtcatgggcaggatgaa

SEQ ID NO: 34359 - DNA, 25 bp, Homo sapien
caaccgcgccaagaaggtggcagtc

SEQ ID NO: 34360 - DNA, 25 bp, Homo sapien
gtggtacatggactacgacgccttc

SEQ ID NO: 34361 - DNA, 25 bp, Homo sapien
actccggccagctggtgtggtacat

SEQ ID NO: 34362 - DNA, 25 bp, Homo sapien
tgagccttagcctgcctctcatcaa

SEQ ID NO: 34363 - DNA, 25 bp, Homo sapien
tgagcccaagaagtggcccatctcg

SEQ ID NO: 34364 - DNA, 25 bp, Homo sapien
ctgcagctttggtctccgttgtata

SEQ ID NO: 34365 - DNA, 25 bp, Homo sapien
gacatcctggtggacgtcatccgca

SEQ ID NO: 34366 - DNA, 25 bp, Homo sapien
tgcattccaagcctggacaggggtc

SEQ ID NO: 34367 - DNA, 25 bp, Homo sapien
ggtcactgacgtggccacattctca

SEQ ID NO: 34368 - DNA, 25 bp, Homo sapien
ccgttgtataccagagacgcccatt

SEQ ID NO: 34369 - DNA, 25 bp, Homo sapien
aaggccgcctagtttgtcctcagtg

SEQ ID NO: 34370 - DNA, 25 bp, Homo sapien
ctgctccgggcagattacctcgtgt

SEQ ID NO: 34371 - DNA, 25 bp, Homo sapien
tgcacgggcaccatcatcgtgattg

SEQ ID NO: 34372 - DNA, 25 bp, Homo sapien
tctgtcgggtacacaaccctcgtgg

SEQ ID NO: 34373 - DNA, 25 bp, Homo sapien
tcgtggggaataaccacgagtcctg

SEQ ID NO: 34374 - DNA, 25 bp, Homo sapien
ggccatgagacagcggggcacacac

SEQ ID NO: 34375 - DNA, 25 bp, Homo sapien
tatcaggggcaaagtcgggtatacc

SEQ ID NO: 34376 - DNA, 25 bp, Homo sapien
tggcccagagcacggacgctatcag

SEQ ID NO: 34377 - DNA, 25 bp, Homo sapien
aagctcatctttcaccggcatccgg

SEQ ID NO: 34378 - DNA, 25 bp, Homo sapien
tgtgaaggaggacgacaagctcatc

SEQ ID NO: 34379 - DNA, 25 bp, Homo sapien
gaccgatcgctcaatgtctttgtga

SEQ ID NO: 34380 - DNA, 25 bp, Homo sapien
gtgacgttcgccatcataccgccag

SEQ ID NO: 34381 - DNA, 25 bp, Homo sapien
tctaccagtgacgttcgccatcata

SEQ ID NO: 34382 - DNA, 25 bp, Homo sapien
tcaaggcctacctcctctaccagtg

SEQ ID NO: 34383 - DNA, 25 bp, Homo sapien
ctgccggcttccctcaaggcctacc

SEQ ID NO: 34384 - DNA, 25 bp, Homo sapien
tcatggatttgtgccgtcgctcggt

SEQ ID NO: 34385 - DNA, 25 bp, Homo sapien
gagccgctgccgctcatggatttgt

SEQ ID NO: 34386 - DNA, 25 bp, Homo sapien
tggtgccaactcactgagccgcctg

SEQ ID NO: 34387 - DNA, 25 bp, Homo sapien
cagcgcgacagccacctggtgccaa

SEQ ID NO: 34388 - DNA, 25 bp, Homo sapien
acgcagagcccgaaaacctatttga

SEQ ID NO: 34389 - DNA, 25 bp, Homo sapien
ctggctaaggcgttgctgtagagac

SEQ ID NO: 34390 - DNA, 25 bp, Homo sapien
acgcgcggtcccgaaaacctgagca

SEQ ID NO: 34391 - DNA, 25 bp, Homo sapien
tgtgtgacgtcatctgagagcgcca

SEQ ID NO: 34392 - DNA, 25 bp, Homo sapien
cttcttactgagcagggcttacgtc

SEQ ID NO: 34393 - DNA, 25 bp, Homo sapien
tgccgacctgcggagccttcttact

SEQ ID NO: 34394 - DNA, 25 bp, Homo sapien
agtgtgcgaggtagtgctcttccta

SEQ ID NO: 34395 - DNA, 25 bp, Homo sapien
ggacagctgacaagggtgacgtttc

SEQ ID NO: 34396 - DNA, 25 bp, Homo sapien
gtgcccaccgcaagggtggccactg

SEQ ID NO: 34397 - DNA, 25 bp, Homo sapien
agagcggccactcctcgtgcggcca

SEQ ID NO: 34398 - DNA, 25 bp, Homo sapien
atggcctcggaagaggatgcgcccc

SEQ ID NO: 34399 - DNA, 25 bp, Homo sapien
cgccctgcgccatgcactgttaccc

SEQ ID NO: 34400 - DNA, 25 bp, Homo sapien
ccaccgcaagggtggccactgcgga

SEQ ID NO: 34401 - DNA, 25 bp, Homo sapien
cccagctggatagtgagggtgccgg

SEQ ID NO: 34402 - DNA, 25 bp, Homo sapien
gggtggcaactaccccagctggata

SEQ ID NO: 34403 - DNA, 25 bp, Homo sapien
ggtcctcacccgcactgcgggtgcg

SEQ ID NO: 34404 - DNA, 25 bp, Homo sapien
cctcagagcccgtggtaggatcgct

SEQ ID NO: 34405 - DNA, 25 bp, Homo sapien
tgaacggtgatgcttgcggccacac

SEQ ID NO: 34406 - DNA, 25 bp, Homo sapien
agccagggacccgaactcatatgag

SEQ ID NO: 34407 - DNA, 25 bp, Homo sapien
cgtcctaaccaatgagcgctcgaaa

SEQ ID NO: 34408 - DNA, 25 bp, Homo sapien
cccattctgaagagtcagtggccgg

SEQ ID NO: 34409 - DNA, 25 bp, Homo sapien
catccggacgggcaaaaaggtctgc

SEQ ID NO: 34410 - DNA, 25 bp, Homo sapien
aaaggtctgcggacgttggacgtca

SEQ ID NO: 34411 - DNA, 25 bp, Homo sapien
agcgctcgaaatttgggtccacacc

SEQ ID NO: 34412 - DNA, 25 bp, Homo sapien
ttgctgctcggcatgtgacgtcccg

SEQ ID NO: 34413 - DNA, 25 bp, Homo sapien
ctcgtcccgattggctgcgcgacgg

SEQ ID NO: 34414 - DNA, 25 bp, Homo sapien
tccttccacgcggagagccatggag

SEQ ID NO: 34415 - DNA, 25 bp, Homo sapien
cccgagaccgggttgagactgcagt

SEQ ID NO: 34416 - DNA, 25 bp, Homo sapien
ggcgtttttctacacgcctcgcatc

SEQ ID NO: 34417 - DNA, 25 bp, Homo sapien
tacaaagcggcgaaggtcacggcgc

SEQ ID NO: 34418 - DNA, 25 bp, Homo sapien
gggctttcctacagggctccgtgcc

SEQ ID NO: 34419 - DNA, 25 bp, Homo sapien
ccggcgtgttgctctaccggatcgc

SEQ ID NO: 34420 - DNA, 25 bp, Homo sapien
atgagcactcgcctcacaacggcag

SEQ ID NO: 34421 - DNA, 25 bp, Homo sapien
cctcatcagccctgcccggctcaac

SEQ ID NO: 34422 - DNA, 25 bp, Homo sapien
cggctcaacctgaagggacagaagc

SEQ ID NO: 34423 - DNA, 25 bp, Homo sapien
tcaacctgaagggacagaagctgct

SEQ ID NO: 34424 - DNA, 25 bp, Homo sapien
cccagcagctccgatgagcactcgc

SEQ ID NO: 34425 - DNA, 25 bp, Homo sapien
ctcgcctcacaacggcagcctcttc

SEQ ID NO: 34426 - DNA, 25 bp, Homo sapien
cctgcaggacgtgaagcacgccctg

SEQ ID NO: 34427 - DNA, 25 bp, Homo sapien
aggacgtgaagcacgccctgggtac

SEQ ID NO: 34428 - DNA, 25 bp, Homo sapien
tgatcttttgatcctggacgccttg

SEQ ID NO: 34429 - DNA, 25 bp, Homo sapien
cctgaataagcatcggggctctctg

SEQ ID NO: 34430 - DNA, 25 bp, Homo sapien
tggacgccttgatctcaataccagc

SEQ ID NO: 34431 - DNA, 25 bp, Homo sapien
gcgcttattgttggtcggactccga

SEQ ID NO: 34432 - DNA, 25 bp, Homo sapien
tccggggcatgtccagccactggct

SEQ ID NO: 34433 - DNA, 25 bp, Homo sapien
ttctgccttcataccagagcccgga

SEQ ID NO: 34434 - DNA, 25 bp, Homo sapien
ccatgaccaggtcagggtcgttgtg

SEQ ID NO: 34435 - DNA, 25 bp, Homo sapien
tcccagtggtctgactcggtaaggc

SEQ ID NO: 34436 - DNA, 25 bp, Homo sapien
agtcccgagagtgcggcggaaacca

SEQ ID NO: 34437 - DNA, 25 bp, Homo sapien
cccagtcccgagagtgcggcggaaa

SEQ ID NO: 34438 - DNA, 25 bp, Homo sapien
tgggcgacctaaggctccgggcacc

SEQ ID NO: 34439 - DNA, 25 bp, Homo sapien
agtgcggcggaaaccacgcggcgcc

SEQ ID NO: 34440 - DNA, 25 bp, Homo sapien
gccttggccaggcatcaccaccagg

SEQ ID NO: 34441 - DNA, 25 bp, Homo sapien
gggagacgccggctgggcgacctaa

SEQ ID NO: 34442 - DNA, 25 bp, Homo sapien
cgctttcccagtcccgagagtgcgg

SEQ ID NO: 34443 - DNA, 25 bp, Homo sapien
tttcccagtcccgagagtgcggcgg

SEQ ID NO: 34444 - DNA, 25 bp, Homo sapien
tcttacccgtaattcagcctgaatg

SEQ ID NO: 34445 - DNA, 25 bp, Homo sapien
cagcggggtttcagctgcgctcaca

SEQ ID NO: 34446 - DNA, 25 bp, Homo sapien
cgcgaggatactggaagcgctcagc

SEQ ID NO: 34447 - DNA, 25 bp, Homo sapien
ctccgagcgctgactagaggaccag

SEQ ID NO: 34448 - DNA, 25 bp, Homo sapien
cccagctttgcatttccggactttt

SEQ ID NO: 34449 - DNA, 25 bp, Homo sapien
tttgcacctcctcctttgaggtaga

SEQ ID NO: 34450 - DNA, 25 bp, Homo sapien
acgacctttcgtgggcaccaggatg

SEQ ID NO: 34451 - DNA, 25 bp, Homo sapien
agatcagctccggatctgcggccga

SEQ ID NO: 34452 - DNA, 25 bp, Homo sapien
ctgggcaactgtctccagggagatc

SEQ ID NO: 34453 - DNA, 25 bp, Homo sapien
gattctcagctatgggccgcgcgac

SEQ ID NO: 34454 - DNA, 25 bp, Homo sapien
acgctctcctctcctaatctggttg

SEQ ID NO: 34455 - DNA, 25 bp, Homo sapien
tgccgcccttgatgggatccgtgag

SEQ ID NO: 34456 - DNA, 25 bp, Homo sapien
cctgttcggggcaggctgtttactt

SEQ ID NO: 34457 - DNA, 25 bp, Homo sapien
ctgtttacttgtcggggacccagca

SEQ ID NO: 34458 - DNA, 25 bp, Homo sapien
aggatttgcagcgtccactcctctc

SEQ ID NO: 34459 - DNA, 25 bp, Homo sapien
gtgtgagaatttgccgacggtgccc

SEQ ID NO: 34460 - DNA, 25 bp, Homo sapien
gctgagtctatggggactccgtgcc

SEQ ID NO: 34461 - DNA, 25 bp, Homo sapien
ggctgaggctatggggactccgttg

SEQ ID NO: 34462 - DNA, 25 bp, Homo sapien
aggctgagtctatggggactccgtt

SEQ ID NO: 34463 - DNA, 25 bp, Homo sapien
gctgtgaggctacggggactccgtg

SEQ ID NO: 34464 - DNA, 25 bp, Homo sapien
aggctgagtctatggggactccgtg

SEQ ID NO: 34465 - DNA, 25 bp, Homo sapien
ggctgaggctatggggactccgtgc

SEQ ID NO: 34466 - DNA, 25 bp, Homo sapien
tgagtctatggggactccgtgcggg

SEQ ID NO: 34467 - DNA, 25 bp, Homo sapien
ggctgagtctatggggactccgtgc

SEQ ID NO: 34468 - DNA, 25 bp, Homo sapien
cgactttcgcgccaagatgtgccaa

SEQ ID NO: 34469 - DNA, 25 bp, Homo sapien
agcaacggcgtctgtgtgacgtgca

SEQ ID NO: 34470 - DNA, 25 bp, Homo sapien
gcgaccgcgtgaagaagctcatcaa

SEQ ID NO: 34471 - DNA, 25 bp, Homo sapien
tcctcatcggcaaaggtagctctgc

SEQ ID NO: 34472 - DNA, 25 bp, Homo sapien
agatgtgccaattctgcgaggaggc

SEQ ID NO: 34473 - DNA, 25 bp, Homo sapien
gcaggcctccacgagtttgactcct

SEQ ID NO: 34474 - DNA, 25 bp, Homo sapien
tgcgacccagaagtgaacgactttc

SEQ ID NO: 34475 - DNA, 25 bp, Homo sapien
agtttgactccttgtgcgacccaga

SEQ ID NO: 34476 - DNA, 25 bp, Homo sapien
tcagctcctcgtgggactgaagagc

SEQ ID NO: 34477 - DNA, 25 bp, Homo sapien
cagtagctgagggtggagtcatccc

SEQ ID NO: 34478 - DNA, 25 bp, Homo sapien
ttcgaaagcagaaaccgaggtggcc

SEQ ID NO: 34479 - DNA, 25 bp, Homo sapien
gatggcagcagagtcttcgaaagca

SEQ ID NO: 34480 - DNA, 25 bp, Homo sapien
tgactttgtacatcgtggacccttg

SEQ ID NO: 34481 - DNA, 25 bp, Homo sapien
tagggtcctacacaccaagcacagc

SEQ ID NO: 34482 - DNA, 25 bp, Homo sapien
ggccagagaggacgtgtcagctcct

SEQ ID NO: 34483 - DNA, 25 bp, Homo sapien
gtctgcacacctactggccgaaatg

SEQ ID NO: 34484 - DNA, 25 bp, Homo sapien
atcccgcatggtccgccgatgtgcg

SEQ ID NO: 34485 - DNA, 25 bp, Homo sapien
tcacaactgtcgcagtgctggggac

SEQ ID NO: 34486 - DNA, 25 bp, Homo sapien
tgacgcacaccacgatcacaactgt

SEQ ID NO: 34487 - DNA, 25 bp, Homo sapien
cccaggataatcatgaacaccagga

SEQ ID NO: 34488 - DNA, 25 bp, Homo sapien
ttcccggtgtcctgatcccgcatgg

SEQ ID NO: 34489 - DNA, 25 bp, Homo sapien
agagtcgtcccagtccatctcgttc

SEQ ID NO: 34490 - DNA, 25 bp, Homo sapien
cactcctacctccatggggttgacg

SEQ ID NO: 34491 - DNA, 25 bp, Homo sapien
gaacaccaggaagctgacgcacacc

SEQ ID NO: 34492 - DNA, 25 bp, Homo sapien
tggctttcttgccaagcagcgacta

SEQ ID NO: 34493 - DNA, 25 bp, Homo sapien
tgccaagcagcgactatccacttct

SEQ ID NO: 34494 - DNA, 25 bp, Homo sapien
ctgtccctgacgttgggtgacctct

SEQ ID NO: 34495 - DNA, 25 bp, Homo sapien
acgttgggtgacctctggctttctt

SEQ ID NO: 34496 - DNA, 25 bp, Homo sapien
ggtgacctctggctttcttgccaag

SEQ ID NO: 34497 - DNA, 25 bp, Homo sapien
ctttcttgccaagcagcgactatcc

SEQ ID NO: 34498 - DNA, 25 bp, Homo sapien
tcttgccaagcagcgactatccact

SEQ ID NO: 34499 - DNA, 25 bp, Homo sapien
acctctggctttcttgccaagcagc

SEQ ID NO: 34500 - DNA, 25 bp, Homo sapien
cgcgcgcctccgagcccgtcggccc

SEQ ID NO: 34501 - DNA, 25 bp, Homo sapien
tcgaatcccggcatccggccctact

SEQ ID NO: 34502 - DNA, 25 bp, Homo sapien
ccgcctcagagcagcgtcttgctga

SEQ ID NO: 34503 - DNA, 25 bp, Homo sapien
cgcctcagagcagcgtcttgctgaa

SEQ ID NO: 34504 - DNA, 25 bp, Homo sapien
aaggcagcggcagcaactaagatgg

SEQ ID NO: 34505 - DNA, 25 bp, Homo sapien
ccctggccgcagatggagagcctca

SEQ ID NO: 34506 - DNA, 25 bp, Homo sapien
ccgcatcccggctcgaatcccggca

SEQ ID NO: 34507 - DNA, 25 bp, Homo sapien
ggccgcagatggagagcctcaactc

SEQ ID NO: 34508 - DNA, 25 bp, Homo sapien
caatcaaactacagagggaggaagg

SEQ ID NO: 34509 - DNA, 25 bp, Homo sapien
ccagcgtttagtttggggaaatatg

SEQ ID NO: 34510 - DNA, 25 bp, Homo sapien
gggaaatatggagagtaagagtctc

SEQ ID NO: 34511 - DNA, 25 bp, Homo sapien
gacagttcaatcaaactacagaggg

SEQ ID NO: 34512 - DNA, 25 bp, Homo sapien
tcgggagacgacagttcaatcaaac

SEQ ID NO: 34513 - DNA, 25 bp, Homo sapien
gtggaatcgggagacgacagttcaa

SEQ ID NO: 34514 - DNA, 25 bp, Homo sapien
gacgggcgatgacaggcacccggac

SEQ ID NO: 34515 - DNA, 25 bp, Homo sapien
taagagtctcagagtgggcgcaggt

SEQ ID NO: 34516 - DNA, 25 bp, Homo sapien
cttctccaggaagaggtgtcgccgc

SEQ ID NO: 34517 - DNA, 25 bp, Homo sapien
tccgctcggcgtgttcggaagccac

SEQ ID NO: 34518 - DNA, 25 bp, Homo sapien
cttggagcctcagaaacgcggggca

SEQ ID NO: 34519 - DNA, 25 bp, Homo sapien
caagcgcgcttttcattccgcgtca

SEQ ID NO: 34520 - DNA, 25 bp, Homo sapien
gctagagcctcctcctgtgcgaaac

SEQ ID NO: 34521 - DNA, 25 bp, Homo sapien
tcctcctgtgcgaaacgcgtccgtg

SEQ ID NO: 34522 - DNA, 25 bp, Homo sapien
ccaggccctcaggtgtctcgagatg

SEQ ID NO: 34523 - DNA, 25 bp, Homo sapien
tccgcgtcatcttatctgacaaacg

SEQ ID NO: 34524 - DNA, 25 bp, Homo sapien
ggcgctgcggtaaagccactctgcg

SEQ ID NO: 34525 - DNA, 25 bp, Homo sapien
tggcgctgcggtaaagccactctgc

SEQ ID NO: 34526 - DNA, 25 bp, Homo sapien
gccggtagtgagtggccgagtccgc

SEQ ID NO: 34527 - DNA, 25 bp, Homo sapien
aacacggcgccggtagtgagtggcc

SEQ ID NO: 34528 - DNA, 25 bp, Homo sapien
accagcgacatagggacggggccat

SEQ ID NO: 34529 - DNA, 25 bp, Homo sapien
ccgagtccgcgctgagagcaaaggg

SEQ ID NO: 34530 - DNA, 25 bp, Homo sapien
agccgggtaaggctgaagctggcgc

SEQ ID NO: 34531 - DNA, 25 bp, Homo sapien
gctggcgctgcggtaaagccactct

SEQ ID NO: 34532 - DNA, 25 bp, Homo sapien
ccgccagtcccagagtttagggcca

SEQ ID NO: 34533 - DNA, 25 bp, Homo sapien
ccaattgccaccagaggtagccgta

SEQ ID NO: 34534 - DNA, 25 bp, Homo sapien
ggcctacctgacaaaaactgggaca

SEQ ID NO: 34535 - DNA, 25 bp, Homo sapien
ccctggaaccaatgagagtgcgacc

SEQ ID NO: 34536 - DNA, 25 bp, Homo sapien
ccgagatgttccactcgctggcgtc

SEQ ID NO: 34537 - DNA, 25 bp, Homo sapien
ccgctggtgatctccggtagcactc

SEQ ID NO: 34538 - DNA, 25 bp, Homo sapien
gcgggaacttgaagtccggcacgta

SEQ ID NO: 34539 - DNA, 25 bp, Homo sapien
cagaggtagccgtaaacccatggtc

SEQ ID NO: 34540 - DNA, 25 bp, Homo sapien
cgacctcagcggtacttggaccctg

SEQ ID NO: 34541 - DNA, 25 bp, Homo sapien
gagccagcggacgacccttcaggtc

SEQ ID NO: 34542 - DNA, 25 bp, Homo sapien
tgcagaatcctggagccagcggacg

SEQ ID NO: 34543 - DNA, 25 bp, Homo sapien
gcacacctgcggagactgcagactc

SEQ ID NO: 34544 - DNA, 25 bp, Homo sapien
ctgtaggtacgtcctctgtccgtgc

SEQ ID NO: 34545 - DNA, 25 bp, Homo sapien
acatgctggccctaggtaaggcgga

SEQ ID NO: 34546 - DNA, 25 bp, Homo sapien
gcgacaacttcgagggctacatgct

SEQ ID NO: 34547 - DNA, 25 bp, Homo sapien
agcggtacttggaccctgctcagca

SEQ ID NO: 34548 - DNA, 25 bp, Homo sapien
cgctcaatacggtagatcacgctcc

SEQ ID NO: 34549 - DNA, 25 bp, Homo sapien
tctgctgtaggaacgcagctaccgc

SEQ ID NO: 34550 - DNA, 25 bp, Homo sapien
agtcgaccagttcccgccaggagca

SEQ ID NO: 34551 - DNA, 25 bp, Homo sapien
ttacctcggggtatccactctgcag

SEQ ID NO: 34552 - DNA, 25 bp, Homo sapien
gcttcccttacagtgctgggctctg

SEQ ID NO: 34553 - DNA, 25 bp, Homo sapien
tcttccagcgagagctacgcgcatc

SEQ ID NO: 34554 - DNA, 25 bp, Homo sapien
ggggtcacgtgatccctttcaaaga

SEQ ID NO: 34555 - DNA, 25 bp, Homo sapien
agctaccgcgccactatcacgaaga

SEQ ID NO: 34556 - DNA, 25 bp, Homo sapien
ctgcacaggttgcatctggggaatg

SEQ ID NO: 34557 - DNA, 25 bp, Homo sapien
cccacagtggacttcgcaaaggagc

SEQ ID NO: 34558 - DNA, 25 bp, Homo sapien
gccgactttatatcagcacacccag

SEQ ID NO: 34559 - DNA, 25 bp, Homo sapien
cgcagcttgagtaatgccgacttta

SEQ ID NO: 34560 - DNA, 25 bp, Homo sapien
agcatcctacgggagagagcagctc

SEQ ID NO: 34561 - DNA, 25 bp, Homo sapien
cccgacctgcacttagagaacagag

SEQ ID NO: 34562 - DNA, 25 bp, Homo sapien
tcccatgctaaagcagacggtgccg

SEQ ID NO: 34563 - DNA, 25 bp, Homo sapien
gtcccggagaccatgatggcaccca

SEQ ID NO: 34564 - DNA, 25 bp, Homo sapien
gtgattggtcacagcccgtgtccgt

SEQ ID NO: 34565 - DNA, 25 bp, Homo sapien
gacaatgattccactctcggcgcct

SEQ ID NO: 34566 - DNA, 25 bp, Homo sapien
cgctccactcagtcaatcttttgtc

SEQ ID NO: 34567 - DNA, 25 bp, Homo sapien
cggctgattccgacgaatgcccttg

SEQ ID NO: 34568 - DNA, 25 bp, Homo sapien
ccgagctctgtgctgtgattggtca

SEQ ID NO: 34569 - DNA, 25 bp, Homo sapien
cacctcgatgcggtgccgggctgct

SEQ ID NO: 34570 - DNA, 25 bp, Homo sapien
ggctcaccctacgattggctggccg

SEQ ID NO: 34571 - DNA, 25 bp, Homo sapien
gttttccgacggacaatgattccac

SEQ ID NO: 34572 - DNA, 25 bp, Homo sapien
acatcactgagctggctgacgagca

SEQ ID NO: 34573 - DNA, 25 bp, Homo sapien
acggccgattccgacatcactgagc

SEQ ID NO: 34574 - DNA, 25 bp, Homo sapien
ctgacgagcagcaagatgagatgga

SEQ ID NO: 34575 - DNA, 25 bp, Homo sapien
atgatgaggcattcgtggatgacgc

SEQ ID NO: 34576 - DNA, 25 bp, Homo sapien
atgacgccggctctgacgcagggac

SEQ ID NO: 34577 - DNA, 25 bp, Homo sapien
agggatcagatctcttcagtgacgg

SEQ ID NO: 34578 - DNA, 25 bp, Homo sapien
tcagtgacgggcatgacccgtttta

SEQ ID NO: 34579 - DNA, 25 bp, Homo sapien
gtgaacgagcgccttgccgaccgca

SEQ ID NO: 34580 - DNA, 25 bp, Homo sapien
ctctagagctgacatcgcgctgatc

SEQ ID NO: 34581 - DNA, 25 bp, Homo sapien
gccgtcatgggccagaacttaattc

SEQ ID NO: 34582 - DNA, 25 bp, Homo sapien
cgagcggtgctgactctttcctttg

SEQ ID NO: 34583 - DNA, 25 bp, Homo sapien
ccgagtgcctggtaaactgtaaagc

SEQ ID NO: 34584 - DNA, 25 bp, Homo sapien
tcctgcgtgagttgctatggctaca

SEQ ID NO: 34585 - DNA, 25 bp, Homo sapien
aatgtcatctaggtgctcggcgctc

SEQ ID NO: 34586 - DNA, 25 bp, Homo sapien
ggcacgtttgcctcggatggtctaa

SEQ ID NO: 34587 - DNA, 25 bp, Homo sapien
agactcccagtcacggccaaatgtg

SEQ ID NO: 34588 - DNA, 25 bp, Homo sapien
cccttctcagatggggttttcgtga

SEQ ID NO: 34589 - DNA, 25 bp, Homo sapien
ccgactggaacacgctttgcaccta

SEQ ID NO: 34590 - DNA, 25 bp, Homo sapien
tcgtgagggtacaacgtcggcatta

SEQ ID NO: 34591 - DNA, 25 bp, Homo sapien
tgcacctatgcgcacacgtgtttcg

SEQ ID NO: 34592 - DNA, 25 bp, Homo sapien
ttagacattccaggtgacgcccgta

SEQ ID NO: 34593 - DNA, 25 bp, Homo sapien
gcagcgattctcttaccaacaggta

SEQ ID NO: 34594 - DNA, 25 bp, Homo sapien
ttctggccttgcgatgaatcctcgg

SEQ ID NO: 34595 - DNA, 25 bp, Homo sapien
gctgcgcatgcgttggcttaactgc

SEQ ID NO: 34596 - DNA, 25 bp, Homo sapien
ctgtaaatcgctatgcccactcgga

SEQ ID NO: 34597 - DNA, 25 bp, Homo sapien
tatcgcgcgattcagcctaggagtt

SEQ ID NO: 34598 - DNA, 25 bp, Homo sapien
gcgtcgaagcatgccggaaactgta

SEQ ID NO: 34599 - DNA, 25 bp, Homo sapien
ttctagttgccgctaatcacgtgtg

SEQ ID NO: 34600 - DNA, 25 bp, Homo sapien
gttccgcagcaaatcacacgtgaga

SEQ ID NO: 34601 - DNA, 25 bp, Homo sapien
ttagagtccggatctcgccagattc

SEQ ID NO: 34602 - DNA, 25 bp, Homo sapien
gcgcagcagacacggctttagagtc

SEQ ID NO: 34603 - DNA, 25 bp, Homo sapien
aagccgctttcgttctatcgcgcga

SEQ ID NO: 34604 - DNA, 25 bp, Homo sapien
cccgaaggtggacgtgaagctccaa

SEQ ID NO: 34605 - DNA, 25 bp, Homo sapien
tcggcgcggtcctgaagagattaaa

SEQ ID NO: 34606 - DNA, 25 bp, Homo sapien
aatggaccgctccacacctgagctg

SEQ ID NO: 34607 - DNA, 25 bp, Homo sapien
aactcaatccgagccggcgcatttg

SEQ ID NO: 34608 - DNA, 25 bp, Homo sapien
aagctccaacacctcgacttctggg

SEQ ID NO: 34609 - DNA, 25 bp, Homo sapien
gggaacgagctctttctggccttca

SEQ ID NO: 34610 - DNA, 25 bp, Homo sapien
ctcgcgaactctactcgggagtggt

SEQ ID NO: 34611 - DNA, 25 bp, Homo sapien
gagctgccgccaagctaactcaatc

SEQ ID NO: 34612 - DNA, 25 bp, Homo sapien
cggttgattagtcaggcctcagaaa

SEQ ID NO: 34613 - DNA, 25 bp, Homo sapien
gacaggctctgttccggctacctta

SEQ ID NO: 34614 - DNA, 25 bp, Homo sapien
gcctcagaaagatggcgtcctcgga

SEQ ID NO: 34615 - DNA, 25 bp, Homo sapien
ccagcggcggttgattagtcaggcc

SEQ ID NO: 34616 - DNA, 25 bp, Homo sapien
gggcgcctgggagaaacctcgccca

SEQ ID NO: 34617 - DNA, 25 bp, Homo sapien
tccggctaccttagtctgggcggga

SEQ ID NO: 34618 - DNA, 25 bp, Homo sapien
gctctgttccggctaccttagtctg

SEQ ID NO: 34619 - DNA, 25 bp, Homo sapien
tagggaccccgagtctccgaagctg

SEQ ID NO: 34620 - DNA, 25 bp, Homo sapien
ttctgtttccctgaagagacccggc

SEQ ID NO: 34621 - DNA, 25 bp, Homo sapien
gcccgtcccagtcctgagcaatggt

SEQ ID NO: 34622 - DNA, 25 bp, Homo sapien
ccagggagtcgccaaacagacccga

SEQ ID NO: 34623 - DNA, 25 bp, Homo sapien
ttcctccacggtccctgtagtgtca

SEQ ID NO: 34624 - DNA, 25 bp, Homo sapien
cgcggctgctactcccgtgaggctt

SEQ ID NO: 34625 - DNA, 25 bp, Homo sapien
tactctgggttttggacgcagcctc

SEQ ID NO: 34626 - DNA, 25 bp, Homo sapien
tgtcacccgtgctgactgccttctg

SEQ ID NO: 34627 - DNA, 25 bp, Homo sapien
cgcctctgtcctgagacggactcgg

SEQ ID NO: 34628 - DNA, 25 bp, Homo sapien
tccagcaccaggttgtccacgcggt

SEQ ID NO: 34629 - DNA, 25 bp, Homo sapien
gccttgaagcgcttgaagtcgtcca

SEQ ID NO: 34630 - DNA, 25 bp, Homo sapien
gcccgcagaacttgtagccgcagtt

SEQ ID NO: 34631 - DNA, 25 bp, Homo sapien
gctgcgtccttgcagtcctcgtaaa

SEQ ID NO: 34632 - DNA, 25 bp, Homo sapien
tcctcgtaaaggtcgaagcgccgga

SEQ ID NO: 34633 - DNA, 25 bp, Homo sapien
ccgaagggcgacatgtcctcgatga

SEQ ID NO: 34634 - DNA, 25 bp, Homo sapien
ctcgatgatccagaagcgctttttg

SEQ ID NO: 34635 - DNA, 25 bp, Homo sapien
cgcttgtgcgagtccatctgcgaca

SEQ ID NO: 34636 - DNA, 25 bp, Homo sapien
tgcgggcagcctcatcaccagcggc

SEQ ID NO: 34637 - DNA, 25 bp, Homo sapien
tggccggcgagaaggatggagtcgc

SEQ ID NO: 34638 - DNA, 25 bp, Homo sapien
cgggcagcctcatcaccagcggccg

SEQ ID NO: 34639 - DNA, 25 bp, Homo sapien
ccggctccgagagtggcactgagca

SEQ ID NO: 34640 - DNA, 25 bp, Homo sapien
ctccgagagtggcactgagcagaga

SEQ ID NO: 34641 - DNA, 25 bp, Homo sapien
gtgcgggcagcctcatcaccagcgg

SEQ ID NO: 34642 - DNA, 25 bp, Homo sapien
gaaggatggagtcgctggcggctgc

SEQ ID NO: 34643 - DNA, 25 bp, Homo sapien
cggcgagaaggatggagtcgctggc

SEQ ID NO: 34644 - DNA, 25 bp, Homo sapien
ggtatggtggaagccagctgcttcc

SEQ ID NO: 34645 - DNA, 25 bp, Homo sapien
ccggctcatcgagggactcacttct

SEQ ID NO: 34646 - DNA, 25 bp, Homo sapien
gagggactcacttctcctggaactg

SEQ ID NO: 34647 - DNA, 25 bp, Homo sapien
ttctcctggaactggaggaatccgg

SEQ ID NO: 34648 - DNA, 25 bp, Homo sapien
tttgacctggggcttggcgttctct

SEQ ID NO: 34649 - DNA, 25 bp, Homo sapien
gggcttggcgttctctagagaagtc

SEQ ID NO: 34650 - DNA, 25 bp, Homo sapien
ctctagagaagtcgttgccaagggc

SEQ ID NO: 34651 - DNA, 25 bp, Homo sapien
ggactcccggctcatcgagggactc

SEQ ID NO: 34652 - DNA, 25 bp, Homo sapien
gtttccacaccgtgagctgctgaga

SEQ ID NO: 34653 - DNA, 25 bp, Homo sapien
tcgcagtttccacaccgtgagctgc

SEQ ID NO: 34654 - DNA, 25 bp, Homo sapien
gcagtttccacaccgtgagctgctg

SEQ ID NO: 34655 - DNA, 25 bp, Homo sapien
agtttccacaccgtgagctgctgag

SEQ ID NO: 34656 - DNA, 25 bp, Homo sapien
ccgcgtgagtgtcgcagtttccaca

SEQ ID NO: 34657 - DNA, 25 bp, Homo sapien
cccgcgtgagtgtcgcagtttccac

SEQ ID NO: 34658 - DNA, 25 bp, Homo sapien
acccgcgtgagtgtcgcagtttcca

SEQ ID NO: 34659 - DNA, 25 bp, Homo sapien
ccgtgtgagtgtcgcagtttccaca

SEQ ID NO: 34660 - DNA, 25 bp, Homo sapien
cagacattgctgatacgggcctccc

SEQ ID NO: 34661 - DNA, 25 bp, Homo sapien
cagcgggatccgtggccctgtccag

SEQ ID NO: 34662 - DNA, 25 bp, Homo sapien
accctttggcgtccgtcgctgggag

SEQ ID NO: 34663 - DNA, 25 bp, Homo sapien
tctcggcctccaggtcagacattgc

SEQ ID NO: 34664 - DNA, 25 bp, Homo sapien
cactttgtgctggttcccgccaagg

SEQ ID NO: 34665 - DNA, 25 bp, Homo sapien
tccgtactgaaacgggtcagagaca

SEQ ID NO: 34666 - DNA, 25 bp, Homo sapien
cgatgccaacactttgtgctggttc

SEQ ID NO: 34667 - DNA, 25 bp, Homo sapien
acgtagcgcggcttccgtactgaaa

SEQ ID NO: 34668 - DNA, 25 bp, Homo sapien
cctcgtacttgtagaacttcttgaa

SEQ ID NO: 34669 - DNA, 25 bp, Homo sapien
ggactcctcgtgctccgtgtccttg

SEQ ID NO: 34670 - DNA, 25 bp, Homo sapien
ggcgctcatgcttgcgcttgtgaga

SEQ ID NO: 34671 - DNA, 25 bp, Homo sapien
aagtggttggtagccttgctgtaca

SEQ ID NO: 34672 - DNA, 25 bp, Homo sapien
ctcgtacttgcactcctcgtacttg

SEQ ID NO: 34673 - DNA, 25 bp, Homo sapien
cttgaagccgtccttggcgtaggca

SEQ ID NO: 34674 - DNA, 25 bp, Homo sapien
aacaaggtcgtcgttgctggactcc

SEQ ID NO: 34675 - DNA, 25 bp, Homo sapien
gctgtacacgcagccctcgtacttg

SEQ ID NO: 34676 - DNA, 25 bp, Homo sapien
ccacagtcttcggtggctcggaagc

SEQ ID NO: 34677 - DNA, 25 bp, Homo sapien
agacgtgctcgtgtacaccttgtta

SEQ ID NO: 34678 - DNA, 25 bp, Homo sapien
tcgtgggtcatcacgtcagacgtgc

SEQ ID NO: 34679 - DNA, 25 bp, Homo sapien
ctcccgcttacctgcagtggaagtg

SEQ ID NO: 34680 - DNA, 25 bp, Homo sapien
cttgtggaagttctcgtgggtcatc

SEQ ID NO: 34681 - DNA, 25 bp, Homo sapien
tgttacagcccacctgcacaggacg

SEQ ID NO: 34682 - DNA, 25 bp, Homo sapien
tcttctgtccgtagaactggcagtc

SEQ ID NO: 34683 - DNA, 25 bp, Homo sapien
gccgtcgttaatgagctgggtattc

SEQ ID NO: 34684 - DNA, 25 bp, Homo sapien
cgccagccttgagcttgcggatgta

SEQ ID NO: 34685 - DNA, 25 bp, Homo sapien
ccaggtcgtacttggatggcttctt

SEQ ID NO: 34686 - DNA, 25 bp, Homo sapien
gttctgcatctggacactgctgtgc

SEQ ID NO: 34687 - DNA, 25 bp, Homo sapien
tgcggatgtactcctcatacttaga

SEQ ID NO: 34688 - DNA, 25 bp, Homo sapien
gattctcgccggtcttcagtttttg

SEQ ID NO: 34689 - DNA, 25 bp, Homo sapien
gtcccgcgtgttctggtcatcatag

SEQ ID NO: 34690 - DNA, 25 bp, Homo sapien
cccgcttgctgagggtatcctcgga

SEQ ID NO: 34691 - DNA, 25 bp, Homo sapien
atacttagagaaccgcgcccgcttg

SEQ ID NO: 34692 - DNA, 25 bp, Homo sapien
acatctgcaggacggcgccatcctc

SEQ ID NO: 34693 - DNA, 25 bp, Homo sapien
ctgtgccgccagaccttcttctgtg

SEQ ID NO: 34694 - DNA, 25 bp, Homo sapien
agaccttcttctgtggtcgcgggca

SEQ ID NO: 34695 - DNA, 25 bp, Homo sapien
tttacagccgcaagcaccagcggca

SEQ ID NO: 34696 - DNA, 25 bp, Homo sapien
cctcggggttctacttggcctctct

SEQ ID NO: 34697 - DNA, 25 bp, Homo sapien
ggagcgctatgtgcccgaacacgag

SEQ ID NO: 34698 - DNA, 25 bp, Homo sapien
tgataccgggtacccgggctatggc

SEQ ID NO: 34699 - DNA, 25 bp, Homo sapien
gtcgcgggcacgtttacagccgcaa

SEQ ID NO: 34700 - DNA, 25 bp, Homo sapien
ctggggctgcaccatgtagacaccc

SEQ ID NO: 34701 - DNA, 25 bp, Homo sapien
accatgtagacaccctcgggaggca

SEQ ID NO: 34702 - DNA, 25 bp, Homo sapien
ttctcgatcactgcccgtctcttgt

SEQ ID NO: 34703 - DNA, 25 bp, Homo sapien
cgtctcttgtcttcctcgctgcggg

SEQ ID NO: 34704 - DNA, 25 bp, Homo sapien
cgcagatggcgttcagcttcaggcc

SEQ ID NO: 34705 - DNA, 25 bp, Homo sapien
agcttcaggccacccttgcgtttgg

SEQ ID NO: 34706 - DNA, 25 bp, Homo sapien
cacccttgcgtttgggcgccatggc

SEQ ID NO: 34707 - DNA, 25 bp, Homo sapien
gggagccggcgtcagctcgcttctc

SEQ ID NO: 34708 - DNA, 25 bp, Homo sapien
cgccgccacctcattgggctaaaaa

SEQ ID NO: 34709 - DNA, 25 bp, Homo sapien
gaggccgcggcggagaaactttctc

SEQ ID NO: 34710 - DNA, 25 bp, Homo sapien
agaaacacggggttagcgtctcgcg

SEQ ID NO: 34711 - DNA, 25 bp, Homo sapien
tcgcagaacgccaccaggggaagac

SEQ ID NO: 34712 - DNA, 25 bp, Homo sapien
ttggtcccaaactcttcgcagaacg

SEQ ID NO: 34713 - DNA, 25 bp, Homo sapien
aagatccattctcttctccttggtc

SEQ ID NO: 34714 - DNA, 25 bp, Homo sapien
gccggtacctgttccaagatccatt

SEQ ID NO: 34715 - DNA, 25 bp, Homo sapien
tcattgggctaaaaataagaacttc

SEQ ID NO: 34716 - DNA, 25 bp, Homo sapien
cagccagacgaatggagatcggcgc

SEQ ID NO: 34717 - DNA, 25 bp, Homo sapien
ttcctcggcgttgctttggttttgc

SEQ ID NO: 34718 - DNA, 25 bp, Homo sapien
ctcggcgttgctttggttttgccct

SEQ ID NO: 34719 - DNA, 25 bp, Homo sapien
cccgcagccagacgaatggagatcg

SEQ ID NO: 34720 - DNA, 25 bp, Homo sapien
ccgacccatgatcccggccatcact

SEQ ID NO: 34721 - DNA, 25 bp, Homo sapien
gagcgccggcctgggacacgcagtg

SEQ ID NO: 34722 - DNA, 25 bp, Homo sapien
cacgcagtggggtttcctcggcgtt

SEQ ID NO: 34723 - DNA, 25 bp, Homo sapien
aacgggtccaagtgtcctcccagag

SEQ ID NO: 34724 - DNA, 25 bp, Homo sapien
gtgtgtttgcgtgtgagcccgctcc

SEQ ID NO: 34725 - DNA, 25 bp, Homo sapien
cacctgcgagggagtccgtgtgttt

SEQ ID NO: 34726 - DNA, 25 bp, Homo sapien
gaacaagcatgttcgcacctgcgag

SEQ ID NO: 34727 - DNA, 25 bp, Homo sapien
ccgcgccgagtgtaaggcagacgca

SEQ ID NO: 34728 - DNA, 25 bp, Homo sapien
aggcaccacggcatggccacgggca

SEQ ID NO: 34729 - DNA, 25 bp, Homo sapien
agggcagagccaaggcaccacggca

SEQ ID NO: 34730 - DNA, 25 bp, Homo sapien
aaagctgtgagccagcgaagtggac

SEQ ID NO: 34731 - DNA, 25 bp, Homo sapien
cagacgcagggattgcattatggca

SEQ ID NO: 34732 - DNA, 25 bp, Homo sapien
gggccgcctctgatcacgttttcag

SEQ ID NO: 34733 - DNA, 25 bp, Homo sapien
cataacactggcgttccaccggtca

SEQ ID NO: 34734 - DNA, 25 bp, Homo sapien
ccaggcgcacggtgccgtgtctgtc

SEQ ID NO: 34735 - DNA, 25 bp, Homo sapien
gcccgaaacgcgagagacaaaggga

SEQ ID NO: 34736 - DNA, 25 bp, Homo sapien
ctttgaagtccgaaagggatgccgc

SEQ ID NO: 34737 - DNA, 25 bp, Homo sapien
cccgccagcgcagacaatgctgggg

SEQ ID NO: 34738 - DNA, 25 bp, Homo sapien
atcacgttttcagggccactgcccg

SEQ ID NO: 34739 - DNA, 25 bp, Homo sapien
acctctgacacagcactgcctgggg

SEQ ID NO: 34740 - DNA, 25 bp, Homo sapien
aagcaaaacttcctggcggccgacg

SEQ ID NO: 34741 - DNA, 25 bp, Homo sapien
ttctctgtccttcaccaggtgccta

SEQ ID NO: 34742 - DNA, 25 bp, Homo sapien
cccaattgttgagctccgaggtcac

SEQ ID NO: 34743 - DNA, 25 bp, Homo sapien
acgctctcctttgccgttaagccgg

SEQ ID NO: 34744 - DNA, 25 bp, Homo sapien
ctgcaaatgccaccgagtaaaaata

SEQ ID NO: 34745 - DNA, 25 bp, Homo sapien
acggccatcagctgcacattctgca

SEQ ID NO: 34746 - DNA, 25 bp, Homo sapien
ggcgcaacttctcttctggcgcaca

SEQ ID NO: 34747 - DNA, 25 bp, Homo sapien
cctggagcagcgcacttgagataaa

SEQ ID NO: 34748 - DNA, 25 bp, Homo sapien
cggagccctcacaatggtgcacctg

SEQ ID NO: 34749 - DNA, 25 bp, Homo sapien
gcccggaacaatcactgctctgcag

SEQ ID NO: 34750 - DNA, 25 bp, Homo sapien
attcagcccggaacaatcactgctc

SEQ ID NO: 34751 - DNA, 25 bp, Homo sapien
cctcacaatggtgcacctggcgtgg

SEQ ID NO: 34752 - DNA, 25 bp, Homo sapien
aggcaggtgtcggagccctcacaat

SEQ ID NO: 34753 - DNA, 25 bp, Homo sapien
cgccaggcaggtgtcggagccctca

SEQ ID NO: 34754 - DNA, 25 bp, Homo sapien
gctcctctcagccaggcgggtgagg

SEQ ID NO: 34755 - DNA, 25 bp, Homo sapien
gtgtcggagccctcacaatggtgca

SEQ ID NO: 34756 - DNA, 25 bp, Homo sapien
tccgggacagcagagcgaggagctg

SEQ ID NO: 34757 - DNA, 25 bp, Homo sapien
gccagggacgctcagcccggatgat

SEQ ID NO: 34758 - DNA, 25 bp, Homo sapien
cagcccggatgatgtgggttactta

SEQ ID NO: 34759 - DNA, 25 bp, Homo sapien
tgatgtgggttacttacggcttcgc

SEQ ID NO: 34760 - DNA, 25 bp, Homo sapien
tgtgggttacttacggcttcgccag

SEQ ID NO: 34761 - DNA, 25 bp, Homo sapien
caacctcagcccagtgcagcgtccg

SEQ ID NO: 34762 - DNA, 25 bp, Homo sapien
ccagtgcagcgtccgggacagcaga

SEQ ID NO: 34763 - DNA, 25 bp, Homo sapien
tcagcccagtgcggcgtcctcggag

SEQ ID NO: 34764 - DNA, 25 bp, Homo sapien
ctggccgagactctgtgctactctc

SEQ ID NO: 34765 - DNA, 25 bp, Homo sapien
ctttgtacttcgagggacgctgcca

SEQ ID NO: 34766 - DNA, 25 bp, Homo sapien
tgccggagccttcggtactttgtac

SEQ ID NO: 34767 - DNA, 25 bp, Homo sapien
ttctcactgaggacgccgtaggtgc

SEQ ID NO: 34768 - DNA, 25 bp, Homo sapien
tcttcagcttttcaggcctaggtcc

SEQ ID NO: 34769 - DNA, 25 bp, Homo sapien
ggaggtcagctcctatacagccaca

SEQ ID NO: 34770 - DNA, 25 bp, Homo sapien
cgctttgaaagtgcgcgagctccga

SEQ ID NO: 34771 - DNA, 25 bp, Homo sapien
gtcggccgaaaccatctgctacgtt

SEQ ID NO: 34772 - DNA, 25 bp, Homo sapien
tctgacgtgtcctgagggctgacac

SEQ ID NO: 34773 - DNA, 25 bp, Homo sapien
ccagcacgttgccataggtcttact

SEQ ID NO: 34774 - DNA, 25 bp, Homo sapien
tggatgacaccgtccaacaccagca

SEQ ID NO: 34775 - DNA, 25 bp, Homo sapien
tctccgtgcactggatgacaccgtc

SEQ ID NO: 34776 - DNA, 25 bp, Homo sapien
tacctgcggaagacgaggatgtcct

SEQ ID NO: 34777 - DNA, 25 bp, Homo sapien
cacctgcagtgacagggcctggccg

SEQ ID NO: 34778 - DNA, 25 bp, Homo sapien
gccaatggcaaagcggcctcgcctg

SEQ ID NO: 34779 - DNA, 25 bp, Homo sapien
ggagcccgcgctcgccaatggcaaa

SEQ ID NO: 34780 - DNA, 25 bp, Homo sapien
cgctggatctgctgctcaagctaca

SEQ ID NO: 34781 - DNA, 25 bp, Homo sapien
cgctgctcagaaacgggcccaaaaa

SEQ ID NO: 34782 - DNA, 25 bp, Homo sapien
cgcagcctcgtcaagatgtcggaca

SEQ ID NO: 34783 - DNA, 25 bp, Homo sapien
gctgaccgttagcttcacctctgca

SEQ ID NO: 34784 - DNA, 25 bp, Homo sapien
ggcggcttgatttaccagttggaca

SEQ ID NO: 34785 - DNA, 25 bp, Homo sapien
ggcagctaactttccggcactactt

SEQ ID NO: 34786 - DNA, 25 bp, Homo sapien
agtggattctagttcccaagccgca

SEQ ID NO: 34787 - DNA, 25 bp, Homo sapien
tacccggtgtccattcgatttggcc

SEQ ID NO: 34788 - DNA, 25 bp, Homo sapien
ggtggcgccattttttcagcctgca

SEQ ID NO: 34789 - DNA, 25 bp, Homo sapien
ctttcccaggatgcgagacggcttt

SEQ ID NO: 34790 - DNA, 25 bp, Homo sapien
gctttccacatttgggcctccatgg

SEQ ID NO: 34791 - DNA, 25 bp, Homo sapien
tcaccttcacaaagctgtcggcgtc

SEQ ID NO: 34792 - DNA, 25 bp, Homo sapien
tctgattatagtgtggggagcctgc

SEQ ID NO: 34793 - DNA, 25 bp, Homo sapien
cgcctgcgattaggttgggaagcct

SEQ ID NO: 34794 - DNA, 25 bp, Homo sapien
agcctgcgattagggtggcactttc

SEQ ID NO: 34795 - DNA, 25 bp, Homo sapien
ctccatggacttaggctcgcaagcg

SEQ ID NO: 34796 - DNA, 25 bp, Homo sapien
ccctcccggtgtaattctgagagga

SEQ ID NO: 34797 - DNA, 25 bp, Homo sapien
gtctggacattacgccgccctagag

SEQ ID NO: 34798 - DNA, 25 bp, Homo sapien
ggcgctgctaggattcccttctgca

SEQ ID NO: 34799 - DNA, 25 bp, Homo sapien
tcacacatccggtacggcgctgcta

SEQ ID NO: 34800 - DNA, 25 bp, Homo sapien
atcggtcgtgagttcacctcagtca

SEQ ID NO: 34801 - DNA, 25 bp, Homo sapien
tccgggctgtgaactcaaggagtcc

SEQ ID NO: 34802 - DNA, 25 bp, Homo sapien
ccctgaggaccaatcgacaggtata

SEQ ID NO: 34803 - DNA, 25 bp, Homo sapien
tccactcgggagaaccaatcggtcg

SEQ ID NO: 34804 - DNA, 25 bp, Homo sapien
acttcgcccaggtgacgggtagtag

SEQ ID NO: 34805 - DNA, 25 bp, Homo sapien
ggaccttgccgccacaccagccctg

SEQ ID NO: 34806 - DNA, 25 bp, Homo sapien
tggcctcgtggggtgtaagacccac

SEQ ID NO: 34807 - DNA, 25 bp, Homo sapien
acagacttcgcccaggtgacgggta

SEQ ID NO: 34808 - DNA, 25 bp, Homo sapien
ggccggagacagacttcgcccaggt

SEQ ID NO: 34809 - DNA, 25 bp, Homo sapien
cggctcagccgtgggctctaacgcg

SEQ ID NO: 34810 - DNA, 25 bp, Homo sapien
gctctggcggcctaaagaaggcggc

SEQ ID NO: 34811 - DNA, 25 bp, Homo sapien
gtgtaagacccacttgctgttgccc

SEQ ID NO: 34812 - DNA, 25 bp, Homo sapien
tctgggtccataaaagttgagcgtc

SEQ ID NO: 34813 - DNA, 25 bp, Homo sapien
cctctgagggatatctgggtccata

SEQ ID NO: 34814 - DNA, 25 bp, Homo sapien
aacggcaaggcttccgacctctggc

SEQ ID NO: 34815 - DNA, 25 bp, Homo sapien
gactgcagcattcttggtcggccaa

SEQ ID NO: 34816 - DNA, 25 bp, Homo sapien
tgagcgtcagtctgaagccgccctt

SEQ ID NO: 34817 - DNA, 25 bp, Homo sapien
gggctctcgcccatgctagagcgga

SEQ ID NO: 34818 - DNA, 25 bp, Homo sapien
tactcgtgctctcggagggacattt

SEQ ID NO: 34819 - DNA, 25 bp, Homo sapien
gtctcgccggccactgattcaaggc

SEQ ID NO: 34820 - DNA, 25 bp, Homo sapien
gagcgcctggtcacgatccatgaga

SEQ ID NO: 34821 - DNA, 25 bp, Homo sapien
cgcgcgcctatgtgagtgccaacac

SEQ ID NO: 34822 - DNA, 25 bp, Homo sapien
cgagcgcaagatcatggaccaccca

SEQ ID NO: 34823 - DNA, 25 bp, Homo sapien
gacgcggagcgcaacattttcacca

SEQ ID NO: 34824 - DNA, 25 bp, Homo sapien
accacgaggcctcacagcgtttcga

SEQ ID NO: 34825 - DNA, 25 bp, Homo sapien
ttcgacgctctcactctggcgctta

SEQ ID NO: 34826 - DNA, 25 bp, Homo sapien
tggcgcttaagtcccagtttggatc

SEQ ID NO: 34827 - DNA, 25 bp, Homo sapien
gatttggccgacttcacctccgaga

SEQ ID NO: 34828 - DNA, 25 bp, Homo sapien
tgtggtcttcggcattattggcgtc

SEQ ID NO: 34829 - DNA, 25 bp, Homo sapien
cgcagtgcccaaggcccgtctctca

SEQ ID NO: 34830 - DNA, 25 bp, Homo sapien
cggggccatggtctttgtggtcttc

SEQ ID NO: 34831 - DNA, 25 bp, Homo sapien
attattggcgtcaaccgcactcggc

SEQ ID NO: 34832 - DNA, 25 bp, Homo sapien
gcgtcaaccgcactcggcaggtgga

SEQ ID NO: 34833 - DNA, 25 bp, Homo sapien
tcggcaggtggacaaccacgtcatt

SEQ ID NO: 34834 - DNA, 25 bp, Homo sapien
accacgtcattggagacccggtacg

SEQ ID NO: 34835 - DNA, 25 bp, Homo sapien
gccactagtggataccggggccatg

SEQ ID NO: 34836 - DNA, 25 bp, Homo sapien
cgcccagctctttcactcggacccg

SEQ ID NO: 34837 - DNA, 25 bp, Homo sapien
aacgcagcgccagtggcgtacgctg

SEQ ID NO: 34838 - DNA, 25 bp, Homo sapien
ttcggcaagattgtggcactcaaca

SEQ ID NO: 34839 - DNA, 25 bp, Homo sapien
tgtggcactcaacacgggcgtgtcc

SEQ ID NO: 34840 - DNA, 25 bp, Homo sapien
aacacgggcgtgtccatcctctaca

SEQ ID NO: 34841 - DNA, 25 bp, Homo sapien
tgctgggcatcatggcgcccagctc

SEQ ID NO: 34842 - DNA, 25 bp, Homo sapien
cccatttgccaagttcggcaagatt

SEQ ID NO: 34843 - DNA, 25 bp, Homo sapien
ggcgtgtccatcctctacacgctga

SEQ ID NO: 34844 - DNA, 25 bp, Homo sapien
tgagctcgtagaggcaaccagcgtc

SEQ ID NO: 34845 - DNA, 25 bp, Homo sapien
ctcgtgctcggacagtagcttaacg

SEQ ID NO: 34846 - DNA, 25 bp, Homo sapien
tgaactcagccagcacgttctcgtg

SEQ ID NO: 34847 - DNA, 25 bp, Homo sapien
ccgtcactgtcttggggcactgcca

SEQ ID NO: 34848 - DNA, 25 bp, Homo sapien
gcggtattcagaactctctccacca

SEQ ID NO: 34849 - DNA, 25 bp, Homo sapien
ccactcggtttctccgcggtattca

SEQ ID NO: 34850 - DNA, 25 bp, Homo sapien
accagcccttccagtagacggagtc

SEQ ID NO: 34851 - DNA, 25 bp, Homo sapien
taacaagagtcagcctcggaggtcc

SEQ ID NO: 34852 - DNA, 25 bp, Homo sapien
ggtgagataactttcattccagata

SEQ ID NO: 34853 - DNA, 25 bp, Homo sapien
ggactcgtgctctgcaggactgcag

SEQ ID NO: 34854 - DNA, 25 bp, Homo sapien
taggcggcagcatccagaatgaaca

SEQ ID NO: 34855 - DNA, 25 bp, Homo sapien
ctgcgtacttcagagagtggtaggc

SEQ ID NO: 34856 - DNA, 25 bp, Homo sapien
ccagatactaacatgctctggaggg

SEQ ID NO: 34857 - DNA, 25 bp, Homo sapien
ctcctgggaatgattctctatttga

SEQ ID NO: 34858 - DNA, 25 bp, Homo sapien
acgggcatgtcagccaaagcaaaat

SEQ ID NO: 34859 - DNA, 25 bp, Homo sapien
gaccctgagtactccacactgcgta

SEQ ID NO: 34860 - DNA, 25 bp, Homo sapien
cccatttcgcagcaggggaagctga

SEQ ID NO: 34861 - DNA, 25 bp, Homo sapien
cccacacgggttacgcagaaggttg

SEQ ID NO: 34862 - DNA, 25 bp, Homo sapien
ttacgcagaaggttgcggcgccgct

SEQ ID NO: 34863 - DNA, 25 bp, Homo sapien
ttgctcaggaagtagaactgctgcc

SEQ ID NO: 34864 - DNA, 25 bp, Homo sapien
aactgctgccagtggtcgcgctcct

SEQ ID NO: 34865 - DNA, 25 bp, Homo sapien
accagctccttccagcgcaggcaca

SEQ ID NO: 34866 - DNA, 25 bp, Homo sapien
gcgccgcttgctcaggaagtagaac

SEQ ID NO: 34867 - DNA, 25 bp, Homo sapien
cgtttcggcccatttcgcagcaggg

SEQ ID NO: 34868 - DNA, 25 bp, Homo sapien
ctgcgagcctggcgctaaaggccgc

SEQ ID NO: 34869 - DNA, 25 bp, Homo sapien
ctctctgccagagacgcacgaagtg

SEQ ID NO: 34870 - DNA, 25 bp, Homo sapien
ctgccagagacgcacgaagtgagaa

SEQ ID NO: 34871 - DNA, 25 bp, Homo sapien
gccacaagagggcacccgcgagtca

SEQ ID NO: 34872 - DNA, 25 bp, Homo sapien
aagccgagggtgcccggcttcgcct

SEQ ID NO: 34873 - DNA, 25 bp, Homo sapien
gtctcctgcggagctgaaagccaca

SEQ ID NO: 34874 - DNA, 25 bp, Homo sapien
ggagctgaaagccacagcagggccc

SEQ ID NO: 34875 - DNA, 25 bp, Homo sapien
cacgaagtgagaaagagcggccaca

SEQ ID NO: 34876 - DNA, 25 bp, Homo sapien
ccgctcaattgggaaagcaactgga

SEQ ID NO: 34877 - DNA, 25 bp, Homo sapien
ttggggttcgccaacaatggctccc

SEQ ID NO: 34878 - DNA, 25 bp, Homo sapien
ctgcaggaacagctccgggtcgtat

SEQ ID NO: 34879 - DNA, 25 bp, Homo sapien
cccatgaattgtctctggaactgca

SEQ ID NO: 34880 - DNA, 25 bp, Homo sapien
gaccacaggactggcgcgatagaaa

SEQ ID NO: 34881 - DNA, 25 bp, Homo sapien
acacgctactgtgcggctgggaacc

SEQ ID NO: 34882 - DNA, 25 bp, Homo sapien
gcgaccgcacgtattctcccggagg

SEQ ID NO: 34883 - DNA, 25 bp, Homo sapien
gctgctccttggacgaacgagcata

SEQ ID NO: 34884 - DNA, 25 bp, Homo sapien
tacaggggtccgagcccagactttg

SEQ ID NO: 34885 - DNA, 25 bp, Homo sapien
ggtcgccatcgatgtacaggggtcc

SEQ ID NO: 34886 - DNA, 25 bp, Homo sapien
caggtaattttcctacgacgcggtg

SEQ ID NO: 34887 - DNA, 25 bp, Homo sapien
agtcggagtataggaggtgccttcc

SEQ ID NO: 34888 - DNA, 25 bp, Homo sapien
tccgatttggggcatctcgcagctc

SEQ ID NO: 34889 - DNA, 25 bp, Homo sapien
cgcagtcccagcagtctgctcgagg

SEQ ID NO: 34890 - DNA, 25 bp, Homo sapien
tccaggcgtcggctacctgggtcac

SEQ ID NO: 34891 - DNA, 25 bp, Homo sapien
ggcattttaaggcacagcgtgggaa

SEQ ID NO: 34892 - DNA, 25 bp, Homo sapien
ccgagaaaccggtgaagtaacaatg

SEQ ID NO: 34893 - DNA, 25 bp, Homo sapien
cagccacagtttctgtttccgagaa

SEQ ID NO: 34894 - DNA, 25 bp, Homo sapien
acacgcctgcgagatccggcgcttg

SEQ ID NO: 34895 - DNA, 25 bp, Homo sapien
gttcggagaactgtcaagggacctc

SEQ ID NO: 34896 - DNA, 25 bp, Homo sapien
cagcgacaacgaagccgaggccgta

SEQ ID NO: 34897 - DNA, 25 bp, Homo sapien
agacagcttcaggacacgcaggccg

SEQ ID NO: 34898 - DNA, 25 bp, Homo sapien
acaatgccactagagcttgctggga

SEQ ID NO: 34899 - DNA, 25 bp, Homo sapien
cctgggccgcataaggaaggaacta

SEQ ID NO: 34900 - DNA, 25 bp, Homo sapien
ggggcatcagcctctatccactggc

SEQ ID NO: 34901 - DNA, 25 bp, Homo sapien
tgggcgcgaagaaaacacaacgttg

SEQ ID NO: 34902 - DNA, 25 bp, Homo sapien
acgttgatctccacgttccattgga

SEQ ID NO: 34903 - DNA, 25 bp, Homo sapien
agggcatttctctcgctttagcagg

SEQ ID NO: 34904 - DNA, 25 bp, Homo sapien
ggggactaacggcagccacatctga

SEQ ID NO: 34905 - DNA, 25 bp, Homo sapien
gccacatctgagctagcccgagtca

SEQ ID NO: 34906 - DNA, 25 bp, Homo sapien
tgcccacgcaaaagcgaatcctctg

SEQ ID NO: 34907 - DNA, 25 bp, Homo sapien
tcccttcaacttcgggtgggcgcga

SEQ ID NO: 34908 - DNA, 25 bp, Homo sapien
agcccggacaaaggtgggctacctg

SEQ ID NO: 34909 - DNA, 25 bp, Homo sapien
tggcccagaactcagagcgcagctg

SEQ ID NO: 34910 - DNA, 25 bp, Homo sapien
tccagaggcgccacaactgccggag

SEQ ID NO: 34911 - DNA, 25 bp, Homo sapien
tcgctccattgttggggtccaccga

SEQ ID NO: 34912 - DNA, 25 bp, Homo sapien
tgagcgcgcagcctcgctccattgt

SEQ ID NO: 34913 - DNA, 25 bp, Homo sapien
ttccgtcccttttgacagtctaggc

SEQ ID NO: 34914 - DNA, 25 bp, Homo sapien
tggaagtgaggatgctgcctccttc

SEQ ID NO: 34915 - DNA, 25 bp, Homo sapien
cagtctaggcggaataatccttttg

SEQ ID NO: 34916 - DNA, 25 bp, Homo sapien
tgagcccaggaggtttgcacaagcc

SEQ ID NO: 34917 - DNA, 25 bp, Homo sapien
gactcaggcccaggacactcaaccc

SEQ ID NO: 34918 - DNA, 25 bp, Homo sapien
ccgggcgatttgtttgtaactagca

SEQ ID NO: 34919 - DNA, 25 bp, Homo sapien
tgccaaattccaccggaaccgcagg

SEQ ID NO: 34920 - DNA, 25 bp, Homo sapien
atcaagttggggaacagatggctga

SEQ ID NO: 34921 - DNA, 25 bp, Homo sapien
tgcacacacgaagtccggacccacg

SEQ ID NO: 34922 - DNA, 25 bp, Homo sapien
cgcgtgtcttgctctccgcgatggc

SEQ ID NO: 34923 - DNA, 25 bp, Homo sapien
aggtttgcacaagccgggcgatttg

SEQ ID NO: 34924 - DNA, 25 bp, Homo sapien
tgggcgacagaaactccaactttcg

SEQ ID NO: 34925 - DNA, 25 bp, Homo sapien
tttcacgtggtcttgagctgcgctg

SEQ ID NO: 34926 - DNA, 25 bp, Homo sapien
cccgtttcacgtggtcttgagctgc

SEQ ID NO: 34927 - DNA, 25 bp, Homo sapien
agaaactccaactttcgccagcggc

SEQ ID NO: 34928 - DNA, 25 bp, Homo sapien
aaggcgcgagctgccgacgccgtct

SEQ ID NO: 34929 - DNA, 25 bp, Homo sapien
gtctcctagcaaccaagcggcggtc

SEQ ID NO: 34930 - DNA, 25 bp, Homo sapien
tccagcccgtttcacgtggtcttga

SEQ ID NO: 34931 - DNA, 25 bp, Homo sapien
cctagcaaccaagcggcggtcacgt

SEQ ID NO: 34932 - DNA, 25 bp, Homo sapien
aggacccgaggaggacccacgcacg

SEQ ID NO: 34933 - DNA, 25 bp, Homo sapien
tcaaatccgactgggtgaaggagga

SEQ ID NO: 34934 - DNA, 25 bp, Homo sapien
cccgtctagattcaaatccgactgg

SEQ ID NO: 34935 - DNA, 25 bp, Homo sapien
cctgcggggatcgttagcggtccca

SEQ ID NO: 34936 - DNA, 25 bp, Homo sapien
agcacgctctgctctccgacgtccc

SEQ ID NO: 34937 - DNA, 25 bp, Homo sapien
caagcgcggggcagcacgctctgct

SEQ ID NO: 34938 - DNA, 25 bp, Homo sapien
cggcaaaacctgtaccaggacgtcg

SEQ ID NO: 34939 - DNA, 25 bp, Homo sapien
cctgtaccaggacgtcggtggccac

SEQ ID NO: 34940 - DNA, 25 bp, Homo sapien
atcgtcatgtgacgcgagtcctcgc

SEQ ID NO: 34941 - DNA, 25 bp, Homo sapien
aggccgtgcctttatcgtcatgtga

SEQ ID NO: 34942 - DNA, 25 bp, Homo sapien
tggccgagaatccagtcaccaggtc

SEQ ID NO: 34943 - DNA, 25 bp, Homo sapien
cagtcccgggtgactcagaacgctc

SEQ ID NO: 34944 - DNA, 25 bp, Homo sapien
gtagccattgggagttacactaatc

SEQ ID NO: 34945 - DNA, 25 bp, Homo sapien
ggagccaaagtcagtcttcgcttga

SEQ ID NO: 34946 - DNA, 25 bp, Homo sapien
gccagtcacgtgaggcgcagatcct

SEQ ID NO: 34947 - DNA, 25 bp, Homo sapien
tcaccaggtcactgagtcaccgatg

SEQ ID NO: 34948 - DNA, 25 bp, Homo sapien
ggagctgcctcttcatgccgttggc

SEQ ID NO: 34949 - DNA, 25 bp, Homo sapien
cacctgcccgtggtgaacgctgtgg

SEQ ID NO: 34950 - DNA, 25 bp, Homo sapien
ctgttcagaacgatgggcctgcgcc

SEQ ID NO: 34951 - DNA, 25 bp, Homo sapien
cacgtggtctctttgcaggatgtca

SEQ ID NO: 34952 - DNA, 25 bp, Homo sapien
aacccgcgcatgatcgtggtgagaa

SEQ ID NO: 34953 - DNA, 25 bp, Homo sapien
gatggccgaggactacccgcggtac

SEQ ID NO: 34954 - DNA, 25 bp, Homo sapien
tctcctatgccgagatggccgagga

SEQ ID NO: 34955 - DNA, 25 bp, Homo sapien
ctcccaagtcttcaacctgttcaga

SEQ ID NO: 34956 - DNA, 25 bp, Homo sapien
tgatctgaatacaaacgggccgcgg

SEQ ID NO: 34957 - DNA, 25 bp, Homo sapien
acggttgtgacaggggtcactctgc

SEQ ID NO: 34958 - DNA, 25 bp, Homo sapien
gaatggaagtccacccgctcagtcc

SEQ ID NO: 34959 - DNA, 25 bp, Homo sapien
gtccacggcagggagccaaacacca

SEQ ID NO: 34960 - DNA, 25 bp, Homo sapien
gcgacttcagcgaggctctgtctga

SEQ ID NO: 34961 - DNA, 25 bp, Homo sapien
ggggaagcgtatccaacaccgcagg

SEQ ID NO: 34962 - DNA, 25 bp, Homo sapien
cgaggctctgtctgagagtctctgc

SEQ ID NO: 34963 - DNA, 25 bp, Homo sapien
acccttcctcacagactgatctgaa

SEQ ID NO: 34964 - DNA, 25 bp, Homo sapien
agacgcggcacgaacgtacccacga

SEQ ID NO: 34965 - DNA, 25 bp, Homo sapien
tgccggttagtattgaggtgcccta

SEQ ID NO: 34966 - DNA, 25 bp, Homo sapien
ccgaggaatggaataacaggcgtcc

SEQ ID NO: 34967 - DNA, 25 bp, Homo sapien
ttcttccggtcacctgtagagcccg

SEQ ID NO: 34968 - DNA, 25 bp, Homo sapien
accagccaccggttgggcagaagca

SEQ ID NO: 34969 - DNA, 25 bp, Homo sapien
cctccctttgccagccttgtaatgg

SEQ ID NO: 34970 - DNA, 25 bp, Homo sapien
tgccctaggctttggatagacgttg

SEQ ID NO: 34971 - DNA, 25 bp, Homo sapien
ggcgcgcgtactcattggaccacgt

SEQ ID NO: 34972 - DNA, 25 bp, Homo sapien
ccggctttccgaggaccgacgtgag

SEQ ID NO: 34973 - DNA, 25 bp, Homo sapien
ccgggcagagccgaccttgtataga

SEQ ID NO: 34974 - DNA, 25 bp, Homo sapien
caggaacgcgctggagacacagaca

SEQ ID NO: 34975 - DNA, 25 bp, Homo sapien
cgcgctggagacacagacaagtccc

SEQ ID NO: 34976 - DNA, 25 bp, Homo sapien
ccgcttcttcctttcctgcaaatgt

SEQ ID NO: 34977 - DNA, 25 bp, Homo sapien
aggtgtcctaggttggcgctttctt

SEQ ID NO: 34978 - DNA, 25 bp, Homo sapien
cggggtgactcacagcgaaaacagc

SEQ ID NO: 34979 - DNA, 25 bp, Homo sapien
ttcctgcaaatgtccaggtgtccta

SEQ ID NO: 34980 - DNA, 25 bp, Homo sapien
cggtggcctccagccgtcaaacgac

SEQ ID NO: 34981 - DNA, 25 bp, Homo sapien
agccgtcaaacgacgccggcggtca

SEQ ID NO: 34982 - DNA, 25 bp, Homo sapien
cggcggtcaagcgtcgccgtgtctt

SEQ ID NO: 34983 - DNA, 25 bp, Homo sapien
tcaagcgtcgccgtgtcttttacga

SEQ ID NO: 34984 - DNA, 25 bp, Homo sapien
gcgtcgccgtgtcttttacgacaga

SEQ ID NO: 34985 - DNA, 25 bp, Homo sapien
cgccgtgtcttttacgacagatgga

SEQ ID NO: 34986 - DNA, 25 bp, Homo sapien
tgtcttttacgacagatggaaaacg

SEQ ID NO: 34987 - DNA, 25 bp, Homo sapien
gacccagcggtaccacctcaccgcg

SEQ ID NO: 34988 - DNA, 25 bp, Homo sapien
agctgctcgacagcagtcccggcag

SEQ ID NO: 34989 - DNA, 25 bp, Homo sapien
tccagggccaggaagccgttggcca

SEQ ID NO: 34990 - DNA, 25 bp, Homo sapien
cccagctgcaggcaacgcacgcggc

SEQ ID NO: 34991 - DNA, 25 bp, Homo sapien
tctccagcttcagccagcgcgctca

SEQ ID NO: 34992 - DNA, 25 bp, Homo sapien
gcagctgcacgaagggcacaaagtc

SEQ ID NO: 34993 - DNA, 25 bp, Homo sapien
aagggcacaaagtccggcgccacgg

SEQ ID NO: 34994 - DNA, 25 bp, Homo sapien
gagtcacccacagccgattggcagc

SEQ ID NO: 34995 - DNA, 25 bp, Homo sapien
agccgattggcagccacgtccaggg

SEQ ID NO: 34996 - DNA, 25 bp, Homo sapien
gttccggctccttgtccacttaatc

SEQ ID NO: 34997 - DNA, 25 bp, Homo sapien
ctgccctaataaggagaggcccgga

SEQ ID NO: 34998 - DNA, 25 bp, Homo sapien
aggcccggacttgggcatatctgca

SEQ ID NO: 34999 - DNA, 25 bp, Homo sapien
cctccctgggaacgacctgaatggg

SEQ ID NO: 35000 - DNA, 25 bp, Homo sapien
tgtccacttaatcgctggtgacttg

SEQ ID NO: 35001 - DNA, 25 bp, Homo sapien
gctggtgacttgaacaaatcacttc

SEQ ID NO: 35002 - DNA, 25 bp, Homo sapien
ctgcggttcctgcttcgggaaggaa

SEQ ID NO: 35003 - DNA, 25 bp, Homo sapien
gggcatatctgcagaaaaacccttc

SEQ ID NO: 35004 - DNA, 25 bp, Homo sapien
cgggaacctctactccacgcccttg

SEQ ID NO: 35005 - DNA, 25 bp, Homo sapien
cccatgatgcagtgggagtccgagc

SEQ ID NO: 35006 - DNA, 25 bp, Homo sapien
gggagtccgagcctctgcgtcgtcc

SEQ ID NO: 35007 - DNA, 25 bp, Homo sapien
tgagacgccgctcgaagcgccgagt

SEQ ID NO: 35008 - DNA, 25 bp, Homo sapien
cagctcacccgggtcgaggggcaat

SEQ ID NO: 35009 - DNA, 25 bp, Homo sapien
caatctgaggcgactggtgacgcgc

SEQ ID NO: 35010 - DNA, 25 bp, Homo sapien
tggggtcccctgtagcttctcatcg

SEQ ID NO: 35011 - DNA, 25 bp, Homo sapien
tggtgacgcgcttatccacttccct

SEQ ID NO: 35012 - DNA, 25 bp, Homo sapien
ttcggatcgccgagtaacgctcacc

SEQ ID NO: 35013 - DNA, 25 bp, Homo sapien
ctgaccaatcaagacggccggccga

SEQ ID NO: 35014 - DNA, 25 bp, Homo sapien
cccacgctgaaactgacacttcgga

SEQ ID NO: 35015 - DNA, 25 bp, Homo sapien
accaatcggttgtgtagctccgctc

SEQ ID NO: 35016 - DNA, 25 bp, Homo sapien
cgcaccggcctcgaaaattgaccaa

SEQ ID NO: 35017 - DNA, 25 bp, Homo sapien
gcctgactgaaactgccgctgctga

SEQ ID NO: 35018 - DNA, 25 bp, Homo sapien
aagggtaggctgcatctgcctctgc

SEQ ID NO: 35019 - DNA, 25 bp, Homo sapien
gctgaactcagcgtatccagtcccg

SEQ ID NO: 35020 - DNA, 25 bp, Homo sapien
gtccgcgctctaccctgttgtgtgc

SEQ ID NO: 35021 - DNA, 25 bp, Homo sapien
gggaggcgctctttagcccgcctac

SEQ ID NO: 35022 - DNA, 25 bp, Homo sapien
gagtgtgctggagcctgaagtccac

SEQ ID NO: 35023 - DNA, 25 bp, Homo sapien
gcgctacgagccttcccacaggtaa

SEQ ID NO: 35024 - DNA, 25 bp, Homo sapien
gggacgcaagggaggacactcctca

SEQ ID NO: 35025 - DNA, 25 bp, Homo sapien
tgacaagcaggaacaccggaatatg

SEQ ID NO: 35026 - DNA, 25 bp, Homo sapien
cggaatatgctagcacccacaggtg

SEQ ID NO: 35027 - DNA, 25 bp, Homo sapien
ttggactgagagcactgccatacgc

SEQ ID NO: 35028 - DNA, 25 bp, Homo sapien
cctcttacccgcgtcgtgacagggg

SEQ ID NO: 35029 - DNA, 25 bp, Homo sapien
gtgcgctcggggcacaactctggcc

SEQ ID NO: 35030 - DNA, 25 bp, Homo sapien
gcacacgtgcgctcggggcacaact

SEQ ID NO: 35031 - DNA, 25 bp, Homo sapien
gccttgcccgcccaggtgggtgact

SEQ ID NO: 35032 - DNA, 25 bp, Homo sapien
cgctttcagtcgagggctagcgagc

SEQ ID NO: 35033 - DNA, 25 bp, Homo sapien
ggctttcgctttcagtcgagggcta

SEQ ID NO: 35034 - DNA, 25 bp, Homo sapien
acgctggaggtatcggcccagcgat

SEQ ID NO: 35035 - DNA, 25 bp, Homo sapien
cgccgggcaccctcttcaaaagact

SEQ ID NO: 35036 - DNA, 25 bp, Homo sapien
gcctgcactcgggaacagaaccgca

SEQ ID NO: 35037 - DNA, 25 bp, Homo sapien
ctcgctgctctagaccaggtggaaa

SEQ ID NO: 35038 - DNA, 25 bp, Homo sapien
aggcaggcgtgaccgtttgccgccc

SEQ ID NO: 35039 - DNA, 25 bp, Homo sapien
atccgctgtctgagagtgctgggct

SEQ ID NO: 35040 - DNA, 25 bp, Homo sapien
cagcctcctggagatccgctgtctg

SEQ ID NO: 35041 - DNA, 25 bp, Homo sapien
actctggccggtgttgtgtgtgccc

SEQ ID NO: 35042 - DNA, 25 bp, Homo sapien
acagaaccgcatctgcacctgcagg

SEQ ID NO: 35043 - DNA, 25 bp, Homo sapien
ccggctggtactgcgcgctgagcaa

SEQ ID NO: 35044 - DNA, 25 bp, Homo sapien
gaggggcccgcaccactgcaggagc

SEQ ID NO: 35045 - DNA, 25 bp, Homo sapien
cgtcggccgctcgattggtcgggtc

SEQ ID NO: 35046 - DNA, 25 bp, Homo sapien
tcctcgataactcggcgctcggctg

SEQ ID NO: 35047 - DNA, 25 bp, Homo sapien
accctggggagagcgatgctaggag

SEQ ID NO: 35048 - DNA, 25 bp, Homo sapien
gcctcggtctgagcccctcggggta

SEQ ID NO: 35049 - DNA, 25 bp, Homo sapien
ctcggggtaaccctgggcgtctgct

SEQ ID NO: 35050 - DNA, 25 bp, Homo sapien
cccaagcacaggctcggggctggct

SEQ ID NO: 35051 - DNA, 25 bp, Homo sapien
ggggcgcctcctcgataactcggcg

SEQ ID NO: 35052 - DNA, 25 bp, Homo sapien
ggtcatgcccggctgtctgcccgcc

SEQ ID NO: 35053 - DNA, 25 bp, Homo sapien
gctcaaggtcatgcccggctgtctg

SEQ ID NO: 35054 - DNA, 25 bp, Homo sapien
ggctcaaggtcatgcccggctgtct

SEQ ID NO: 35055 - DNA, 25 bp, Homo sapien
ctattcccggtctggccgctcctca

SEQ ID NO: 35056 - DNA, 25 bp, Homo sapien
cagtccttcctattcccggtctggc

SEQ ID NO: 35057 - DNA, 25 bp, Homo sapien
gtccggttgccagtccttcctattc

SEQ ID NO: 35058 - DNA, 25 bp, Homo sapien
aggtccggttgccagtccttcctat

SEQ ID NO: 35059 - DNA, 25 bp, Homo sapien
ggacgcccaggtccggttgccagtc

SEQ ID NO: 35060 - DNA, 25 bp, Homo sapien
ggcggcgcttcgttttcttcgacaa

SEQ ID NO: 35061 - DNA, 25 bp, Homo sapien
gatctcccggtatccgcgcatttta

SEQ ID NO: 35062 - DNA, 25 bp, Homo sapien
ctcgcacactgcagatctaggacta

SEQ ID NO: 35063 - DNA, 25 bp, Homo sapien
cgtcattcacttacgcacggcgggt

SEQ ID NO: 35064 - DNA, 25 bp, Homo sapien
gccgaccacgtgattcgctggctca

SEQ ID NO: 35065 - DNA, 25 bp, Homo sapien
tcacgtgacaaagctcccggaggtg

SEQ ID NO: 35066 - DNA, 25 bp, Homo sapien
tggcatcactgtctgcgactcaggc

SEQ ID NO: 35067 - DNA, 25 bp, Homo sapien
gatccgctgcttccaagttcctttg

SEQ ID NO: 35068 - DNA, 25 bp, Homo sapien
tgcggagtgcgggatagaatccaca

SEQ ID NO: 35069 - DNA, 25 bp, Homo sapien
cagaggtgctcccattgcgggccag

SEQ ID NO: 35070 - DNA, 25 bp, Homo sapien
caccgctggcagaggtgctcccatt

SEQ ID NO: 35071 - DNA, 25 bp, Homo sapien
cggcacgctgtgctgtcaccgctgg

SEQ ID NO: 35072 - DNA, 25 bp, Homo sapien
atgcgcggcacgctgtgctgtcacc

SEQ ID NO: 35073 - DNA, 25 bp, Homo sapien
cccgatagcgatgcgcggcacgctg

SEQ ID NO: 35074 - DNA, 25 bp, Homo sapien
atagaatccacaccgccagggaggg

SEQ ID NO: 35075 - DNA, 25 bp, Homo sapien
gggatagaatccacaccgccaggga

SEQ ID NO: 35076 - DNA, 25 bp, Homo sapien
cgcaccgtcctgtcagcctgcaaca

SEQ ID NO: 35077 - DNA, 25 bp, Homo sapien
ccgccctcggtgatggattgagtga

SEQ ID NO: 35078 - DNA, 25 bp, Homo sapien
cgtttatctcacagcccgagtcaga

SEQ ID NO: 35079 - DNA, 25 bp, Homo sapien
tctcacagcccgagtcagactaaaa

SEQ ID NO: 35080 - DNA, 25 bp, Homo sapien
ctaaaacaacatcgcaggccgagcg

SEQ ID NO: 35081 - DNA, 25 bp, Homo sapien
cctcggtgatggattgagtgaccgc

SEQ ID NO: 35082 - DNA, 25 bp, Homo sapien
cgagttggcagctgaagtgtgtggt

SEQ ID NO: 35083 - DNA, 25 bp, Homo sapien
agtcagactaaaacaacatcgcagg

SEQ ID NO: 35084 - DNA, 25 bp, Homo sapien
ttgcaacacgcagccagtctgctgg

SEQ ID NO: 35085 - DNA, 25 bp, Homo sapien
gtcggtaaacagacgccgtgatgtc

SEQ ID NO: 35086 - DNA, 25 bp, Homo sapien
ggcgccgctgacctgtggctgaacc

SEQ ID NO: 35087 - DNA, 25 bp, Homo sapien
tggctgaacccggagctgtaaatga

SEQ ID NO: 35088 - DNA, 25 bp, Homo sapien
gctgtaaatgagatgcaaggtgcca

SEQ ID NO: 35089 - DNA, 25 bp, Homo sapien
ttgcccagacccgtcggtaaacaga

SEQ ID NO: 35090 - DNA, 25 bp, Homo sapien
gctgcacacacggacaggatgctgc

SEQ ID NO: 35091 - DNA, 25 bp, Homo sapien
aggatgctgcaaacgccaccagaca

SEQ ID NO: 35092 - DNA, 25 bp, Homo sapien
ccgggtgtcagtttctttacgtgca

SEQ ID NO: 35093 - DNA, 25 bp, Homo sapien
cagccgtttcggctggggaattctc

SEQ ID NO: 35094 - DNA, 25 bp, Homo sapien
cccgcggtttcaaagtgcaagatta

SEQ ID NO: 35095 - DNA, 25 bp, Homo sapien
ggagctcccaatttcagcccgcgaa

SEQ ID NO: 35096 - DNA, 25 bp, Homo sapien
ctcattgctattcttgggctcagga

SEQ ID NO: 35097 - DNA, 25 bp, Homo sapien
tgggctcaggaaattgcttaaacgc

SEQ ID NO: 35098 - DNA, 25 bp, Homo sapien
gtctgcgcggccctattcattcgct

SEQ ID NO: 35099 - DNA, 25 bp, Homo sapien
ccgggccgagcaatacaggaattaa

SEQ ID NO: 35100 - DNA, 25 bp, Homo sapien
gggctgcactcgacgtctaagttca

SEQ ID NO: 35101 - DNA, 25 bp, Homo sapien
tttccgagatctggcagtaagacgc

SEQ ID NO: 35102 - DNA, 25 bp, Homo sapien
ccaccctggcagctgatttccgaga

SEQ ID NO: 35103 - DNA, 25 bp, Homo sapien
ccaggtcgccgtagaagatgaagaa

SEQ ID NO: 35104 - DNA, 25 bp, Homo sapien
cgcagcgagttgttcctgaagtcca

SEQ ID NO: 35105 - DNA, 25 bp, Homo sapien
gtgcacgcccaccaggttgttgtta

SEQ ID NO: 35106 - DNA, 25 bp, Homo sapien
agctaccaagcccaggagcggtttc

SEQ ID NO: 35107 - DNA, 25 bp, Homo sapien
tgttgtcgttgagctccagcacctg

SEQ ID NO: 35108 - DNA, 25 bp, Homo sapien
ctatcgcggagtcaaagctgtactt

SEQ ID NO: 35109 - DNA, 25 bp, Homo sapien
cccagcgcctatcgcggagtcaaag

SEQ ID NO: 35110 - DNA, 25 bp, Homo sapien
cgtggcagagcccttgtccgcccag

SEQ ID NO: 35111 - DNA, 25 bp, Homo sapien
tacacgcttcgctggatcactggct

SEQ ID NO: 35112 - DNA, 25 bp, Homo sapien
cgcctatcgcggagtcaaagctgta

SEQ ID NO: 35113 - DNA, 25 bp, Homo sapien
tggcacccgcctgaggacaggaacg

SEQ ID NO: 35114 - DNA, 25 bp, Homo sapien
tgaggacaggaacgccagcccggtc

SEQ ID NO: 35115 - DNA, 25 bp, Homo sapien
gggcctacacgcttcgctggatcac

SEQ ID NO: 35116 - DNA, 25 bp, Homo sapien
accagacgggtcaccgcttggcccg

SEQ ID NO: 35117 - DNA, 25 bp, Homo sapien
ggcccggcctaatccaactgcgcac

SEQ ID NO: 35118 - DNA, 25 bp, Homo sapien
ttggcccggcctaatccaactgcgc

SEQ ID NO: 35119 - DNA, 25 bp, Homo sapien
ccagacgggtcaccgcttggcccgg

SEQ ID NO: 35120 - DNA, 25 bp, Homo sapien
cgaccagacgggtcaccgcttggcc

SEQ ID NO: 35121 - DNA, 25 bp, Homo sapien
cttggcccggcctaatccaactgcg

SEQ ID NO: 35122 - DNA, 25 bp, Homo sapien
gcttggcccggcctaatccaactgc

SEQ ID NO: 35123 - DNA, 25 bp, Homo sapien
tggcccggcctaatccaactgcgca

SEQ ID NO: 35124 - DNA, 25 bp, Homo sapien
aatccaactgcgcacgtcggtgggc

SEQ ID NO: 35125 - DNA, 25 bp, Homo sapien
ggacaagggcgcaattgaccagcgc

SEQ ID NO: 35126 - DNA, 25 bp, Homo sapien
acaagggcgcaattgaccagcgcgg

SEQ ID NO: 35127 - DNA, 25 bp, Homo sapien
gcatcgcagcgctggatccccgggt

SEQ ID NO: 35128 - DNA, 25 bp, Homo sapien
gggccacagcatcgcagcgctggat

SEQ ID NO: 35129 - DNA, 25 bp, Homo sapien
acgtcggtgggccacagcatcgcag

SEQ ID NO: 35130 - DNA, 25 bp, Homo sapien
caaagccacccggtctgccaaactc

SEQ ID NO: 35131 - DNA, 25 bp, Homo sapien
caactgcgcacgtcggtgggccaca

SEQ ID NO: 35132 - DNA, 25 bp, Homo sapien
gcaaagtttgctgtccggctgccta

SEQ ID NO: 35133 - DNA, 25 bp, Homo sapien
cagagacttgctggaatgcccgggc

SEQ ID NO: 35134 - DNA, 25 bp, Homo sapien
caagtggcttcctgccgtcgctgat

SEQ ID NO: 35135 - DNA, 25 bp, Homo sapien
tcctggcagaaggaggtaagaccca

SEQ ID NO: 35136 - DNA, 25 bp, Homo sapien
tcagctctgctcttcgttttgggaa

SEQ ID NO: 35137 - DNA, 25 bp, Homo sapien
gagcaacaactcaacgggaacgatg

SEQ ID NO: 35138 - DNA, 25 bp, Homo sapien
tgccaggtcccaaagacgcagctgc

SEQ ID NO: 35139 - DNA, 25 bp, Homo sapien
agctcagaatcttgctgctcggccc

SEQ ID NO: 35140 - DNA, 25 bp, Homo sapien
gggcgccgtcccaattgtcaagccg

SEQ ID NO: 35141 - DNA, 25 bp, Homo sapien
tttgtcgccgtgaagagccgcgcgc

SEQ ID NO: 35142 - DNA, 25 bp, Homo sapien
tcgggattcggtttgtcgccgtgaa

SEQ ID NO: 35143 - DNA, 25 bp, Homo sapien
tccctgcggcgaagttcgggattcg

SEQ ID NO: 35144 - DNA, 25 bp, Homo sapien
cttccgactggagtcaagatggcgg

SEQ ID NO: 35145 - DNA, 25 bp, Homo sapien
acgtcacttccgactggagtcaaga

SEQ ID NO: 35146 - DNA, 25 bp, Homo sapien
ccgccatgggatccgcggtgaccta

SEQ ID NO: 35147 - DNA, 25 bp, Homo sapien
gcccgacgtcacttccgactggagt

SEQ ID NO: 35148 - DNA, 25 bp, Homo sapien
ccgcacgcttttcagttatgcttta

SEQ ID NO: 35149 - DNA, 25 bp, Homo sapien
ctcctcgttgtcctgttgaagttgc

SEQ ID NO: 35150 - DNA, 25 bp, Homo sapien
gcgcgctagtcgttgtctttcagca

SEQ ID NO: 35151 - DNA, 25 bp, Homo sapien
ttcgtgagcaaaatgggcccatgtt

SEQ ID NO: 35152 - DNA, 25 bp, Homo sapien
accctgagatagcagctgcgattga

SEQ ID NO: 35153 - DNA, 25 bp, Homo sapien
cgctcgggctgtttcttaacttgtg

SEQ ID NO: 35154 - DNA, 25 bp, Homo sapien
acttgtgacttagctcctgggcggc

SEQ ID NO: 35155 - DNA, 25 bp, Homo sapien
aagttgctcttggtctggaacgcgc

SEQ ID NO: 35156 - DNA, 25 bp, Homo sapien
tgcggagaccaggagtcagactgta

SEQ ID NO: 35157 - DNA, 25 bp, Homo sapien
gcacactttgggcttctggacgagc

SEQ ID NO: 35158 - DNA, 25 bp, Homo sapien
gctgagccggtgaccagcacacttt

SEQ ID NO: 35159 - DNA, 25 bp, Homo sapien
ccatgtctggtaacggcaatgcggc

SEQ ID NO: 35160 - DNA, 25 bp, Homo sapien
tttccaagcggagccatgtctggta

SEQ ID NO: 35161 - DNA, 25 bp, Homo sapien
acacacagcctactttccaagcgga

SEQ ID NO: 35162 - DNA, 25 bp, Homo sapien
cggtgaccagcacactttgggcttc

SEQ ID NO: 35163 - DNA, 25 bp, Homo sapien
tcagactgtaggacgacctcgggtc

SEQ ID NO: 35164 - DNA, 25 bp, Homo sapien
cctccctggactgagacgccgcggg

SEQ ID NO: 35165 - DNA, 25 bp, Homo sapien
cgcctggcgcgtgcaggacctgggg

SEQ ID NO: 35166 - DNA, 25 bp, Homo sapien
ctccctttggcagcagccggacgcc

SEQ ID NO: 35167 - DNA, 25 bp, Homo sapien
cagggcctaggcgtcccgagtggag

SEQ ID NO: 35168 - DNA, 25 bp, Homo sapien
ctccctgctgccacgcgaggagtgg

SEQ ID NO: 35169 - DNA, 25 bp, Homo sapien
gggccgctgcagcaggtctcagtcc

SEQ ID NO: 35170 - DNA, 25 bp, Homo sapien
cgctctccctttggcagcagccgga

SEQ ID NO: 35171 - DNA, 25 bp, Homo sapien
ctcccgcgctctccctttggcagca

SEQ ID NO: 35172 - DNA, 25 bp, Homo sapien
acaggccctcgctgggatacgggcc

SEQ ID NO: 35173 - DNA, 25 bp, Homo sapien
gtggtcacgcgagggcaacccaggt

SEQ ID NO: 35174 - DNA, 25 bp, Homo sapien
ccctggctgtcgagcagggcgtcct

SEQ ID NO: 35175 - DNA, 25 bp, Homo sapien
ggggctgtctccacgagtgtttccc

SEQ ID NO: 35176 - DNA, 25 bp, Homo sapien
tccacgagtgtttcccccgagctgg

SEQ ID NO: 35177 - DNA, 25 bp, Homo sapien
gagagtgcctgggatacaggccctc

SEQ ID NO: 35178 - DNA, 25 bp, Homo sapien
gtgcctgggatacaggccctcgctg

SEQ ID NO: 35179 - DNA, 25 bp, Homo sapien
gatacaggccctcgctgggatacgg

SEQ ID NO: 35180 - DNA, 25 bp, Homo sapien
cggtgtccttcttggagcagctctc

SEQ ID NO: 35181 - DNA, 25 bp, Homo sapien
accaaccggagactggcggaactga

SEQ ID NO: 35182 - DNA, 25 bp, Homo sapien
ggcggcgaatggtaggctccattta

SEQ ID NO: 35183 - DNA, 25 bp, Homo sapien
ctccatttaaagagtgcctggtggc

SEQ ID NO: 35184 - DNA, 25 bp, Homo sapien
ccgctgtcattcctgtgccggagga

SEQ ID NO: 35185 - DNA, 25 bp, Homo sapien
tgatggaagacaataagcagctcgc

SEQ ID NO: 35186 - DNA, 25 bp, Homo sapien
ccgcgcatcatgcagctctttgtca

SEQ ID NO: 35187 - DNA, 25 bp, Homo sapien
ggtgaccaacctgcgagccgaactc

SEQ ID NO: 35188 - DNA, 25 bp, Homo sapien
ccaggagaaagtctgtgccgttatg

SEQ ID NO: 35189 - DNA, 25 bp, Homo sapien
tggcgctcactgtcggtttcgtgac

SEQ ID NO: 35190 - DNA, 25 bp, Homo sapien
gaaatgtgcgtctctcctgagtcca

SEQ ID NO: 35191 - DNA, 25 bp, Homo sapien
gctcagcaagctcctcggggaaatg

SEQ ID NO: 35192 - DNA, 25 bp, Homo sapien
cgtctcagggtgtttcagcatcatc

SEQ ID NO: 35193 - DNA, 25 bp, Homo sapien
agctgccctctcgagccagtcggag

SEQ ID NO: 35194 - DNA, 25 bp, Homo sapien
taatcgtcgcggcaaagcagaggca

SEQ ID NO: 35195 - DNA, 25 bp, Homo sapien
taagaggagccgttctaatcgtcgc

SEQ ID NO: 35196 - DNA, 25 bp, Homo sapien
cggccgaattcctcgcgtgcagcag

SEQ ID NO: 35197 - DNA, 25 bp, Homo sapien
gactgagagccgttcccacgtgaga

SEQ ID NO: 35198 - DNA, 25 bp, Homo sapien
tccggccggactgagagccctggtc

SEQ ID NO: 35199 - DNA, 25 bp, Homo sapien
gttcccacgtgagaggctccgcggc

SEQ ID NO: 35200 - DNA, 25 bp, Homo sapien
agccgctggtggcaaagttctcgca

SEQ ID NO: 35201 - DNA, 25 bp, Homo sapien
gcaaagttctcgcagcgcgcggagc

SEQ ID NO: 35202 - DNA, 25 bp, Homo sapien
ctgggaccgcacctgtgagccatgt

SEQ ID NO: 35203 - DNA, 25 bp, Homo sapien
gcacctgtgagccatgtggcggccc

SEQ ID NO: 35204 - DNA, 25 bp, Homo sapien
cgtcgatcctgggtcgtcgatcctg

SEQ ID NO: 35205 - DNA, 25 bp, Homo sapien
cgttggtcctgggtcgttggtcatg

SEQ ID NO: 35206 - DNA, 25 bp, Homo sapien
gtcgttgatccttggtcgttggtcc

SEQ ID NO: 35207 - DNA, 25 bp, Homo sapien
ggtcgtcgatcctgggtcgtcgatc

SEQ ID NO: 35208 - DNA, 25 bp, Homo sapien
gtcgtcgatcctgggtcgtcgatcc

SEQ ID NO: 35209 - DNA, 25 bp, Homo sapien
atcctgggtcgtcgatcctgggtcg

SEQ ID NO: 35210 - DNA, 25 bp, Homo sapien
gttggtcctgggtcgttgatccttg

SEQ ID NO: 35211 - DNA, 25 bp, Homo sapien
atccttggtcgttggtcctgggtcg

SEQ ID NO: 35212 - DNA, 25 bp, Homo sapien
cagaacttcccagtaggtcccagga

SEQ ID NO: 35213 - DNA, 25 bp, Homo sapien
acaccgattctctgggccctaggga

SEQ ID NO: 35214 - DNA, 25 bp, Homo sapien
tgggacttctagcttgagacattcc

SEQ ID NO: 35215 - DNA, 25 bp, Homo sapien
ccaacccggtccctgagagggcagt

SEQ ID NO: 35216 - DNA, 25 bp, Homo sapien
cactgcgttccctcggctaagaatc

SEQ ID NO: 35217 - DNA, 25 bp, Homo sapien
tcgaacccttggcttcgccagaagc

SEQ ID NO: 35218 - DNA, 25 bp, Homo sapien
cgcgtggttaggagcagaacttccc

SEQ ID NO: 35219 - DNA, 25 bp, Homo sapien
ggatcagggctctattttctcccga

SEQ ID NO: 35220 - DNA, 25 bp, Homo sapien
tcggaactgatcgtcctctctgctc

SEQ ID NO: 35221 - DNA, 25 bp, Homo sapien
ctcgcacaaggagcctgagcacgta

SEQ ID NO: 35222 - DNA, 25 bp, Homo sapien
cttcaagagcagagccgccacattc

SEQ ID NO: 35223 - DNA, 25 bp, Homo sapien
ggtgctgctgcctaactccttcaag

SEQ ID NO: 35224 - DNA, 25 bp, Homo sapien
gacatctggaatgcatcaaaggcga

SEQ ID NO: 35225 - DNA, 25 bp, Homo sapien
agcctgagcacgtaagacatctgga

SEQ ID NO: 35226 - DNA, 25 bp, Homo sapien
aggcctcgcgattgctcggaaccat

SEQ ID NO: 35227 - DNA, 25 bp, Homo sapien
tcacaaagcgtctggaatcggaact

SEQ ID NO: 35228 - DNA, 25 bp, Homo sapien
aacccagtgggcgttccctgcacgg

SEQ ID NO: 35229 - DNA, 25 bp, Homo sapien
tgggcgttccctgcacggtgccacg

SEQ ID NO: 35230 - DNA, 25 bp, Homo sapien
aggccacgccctcatctattaggct

SEQ ID NO: 35231 - DNA, 25 bp, Homo sapien
acgccctcatctattaggctggacc

SEQ ID NO: 35232 - DNA, 25 bp, Homo sapien
tcatctattaggctggaccccgcgg

SEQ ID NO: 35233 - DNA, 25 bp, Homo sapien
aggtcggagcgtgggcttcctcctc

SEQ ID NO: 35234 - DNA, 25 bp, Homo sapien
ttgccatggcaacgcgcgtacacag

SEQ ID NO: 35235 - DNA, 25 bp, Homo sapien
tggcaacgcgcgtacacaggccggc

SEQ ID NO: 35236 - DNA, 25 bp, Homo sapien
cagacctcaaccagggcatcggcga

SEQ ID NO: 35237 - DNA, 25 bp, Homo sapien
tgctgcctccggtacaccatagacg

SEQ ID NO: 35238 - DNA, 25 bp, Homo sapien
cggagactcgtatttgtgctgcctc

SEQ ID NO: 35239 - DNA, 25 bp, Homo sapien
atctcaccgcgcacgttagtctggg

SEQ ID NO: 35240 - DNA, 25 bp, Homo sapien
ttccagatcgagacccggcatctca

SEQ ID NO: 35241 - DNA, 25 bp, Homo sapien
cctacaccgagttcaaggagttctc

SEQ ID NO: 35242 - DNA, 25 bp, Homo sapien
cagctgctacagtgggcacgaagag

SEQ ID NO: 35243 - DNA, 25 bp, Homo sapien
agatgttcaagcagtaagtgcccgc

SEQ ID NO: 35244 - DNA, 25 bp, Homo sapien
agcagccggtgtacacggcccactg

SEQ ID NO: 35245 - DNA, 25 bp, Homo sapien
tcagctctttccatgagggcggtgg

SEQ ID NO: 35246 - DNA, 25 bp, Homo sapien
agtctgaagcggctcagctctttcc

SEQ ID NO: 35247 - DNA, 25 bp, Homo sapien
ttaaaagggcctttgtggtggcatg

SEQ ID NO: 35248 - DNA, 25 bp, Homo sapien
gcgggccctcttagtactcctggga

SEQ ID NO: 35249 - DNA, 25 bp, Homo sapien
gcccgacatgctagcgaggtagacc

SEQ ID NO: 35250 - DNA, 25 bp, Homo sapien
tagaccggtgaagcacgacggctca

SEQ ID NO: 35251 - DNA, 25 bp, Homo sapien
gacggctcaaacactagaacagacg

SEQ ID NO: 35252 - DNA, 25 bp, Homo sapien
atcatatggggcctgaacagctcgc

SEQ ID NO: 35253 - DNA, 25 bp, Homo sapien
tcctcgatcatatggggcctgaaca

SEQ ID NO: 35254 - DNA, 25 bp, Homo sapien
atgtcctcgatcatatggggcctga

SEQ ID NO: 35255 - DNA, 25 bp, Homo sapien
tggatgtcctcgatcatatggggcc

SEQ ID NO: 35256 - DNA, 25 bp, Homo sapien
acctggatgtcctcgatcatatggg

SEQ ID NO: 35257 - DNA, 25 bp, Homo sapien
gcacctggatgtcctcgatcatatg

SEQ ID NO: 35258 - DNA, 25 bp, Homo sapien
gcgcacctggatgtcctcgatcata

SEQ ID NO: 35259 - DNA, 25 bp, Homo sapien
tatggggcctgaacagctcgcggct

SEQ ID NO: 35260 - DNA, 25 bp, Homo sapien
agaatcgtccttgcgtcaccgctca

SEQ ID NO: 35261 - DNA, 25 bp, Homo sapien
cccagaacctgccaccgcgtcaccg

SEQ ID NO: 35262 - DNA, 25 bp, Homo sapien
cccgggacgcatctagaaggtctcg

SEQ ID NO: 35263 - DNA, 25 bp, Homo sapien
gggacgcatctagaaggtctcgccc

SEQ ID NO: 35264 - DNA, 25 bp, Homo sapien
cccaggattcgctctgcgtcatcgc

SEQ ID NO: 35265 - DNA, 25 bp, Homo sapien
ccaaggtcaatcttgcgccaccgcc

SEQ ID NO: 35266 - DNA, 25 bp, Homo sapien
ccaagggctagcctcgtgccaccgc

SEQ ID NO: 35267 - DNA, 25 bp, Homo sapien
caattctggggtcaccgcctgtccc

SEQ ID NO: 35268 - DNA, 25 bp, Homo sapien
cgtgtgactcctaacactcagagtg

SEQ ID NO: 35269 - DNA, 25 bp, Homo sapien
gggcacgttcccaagagaaacaaca

SEQ ID NO: 35270 - DNA, 25 bp, Homo sapien
ggcccaactcttcagacagcggaaa

SEQ ID NO: 35271 - DNA, 25 bp, Homo sapien
tcagagacgacgagcacgcaacagc

SEQ ID NO: 35272 - DNA, 25 bp, Homo sapien
ctcagaggaagctcaacaacagttc

SEQ ID NO: 35273 - DNA, 25 bp, Homo sapien
acaacagttctctgcgtgagccgtg

SEQ ID NO: 35274 - DNA, 25 bp, Homo sapien
tgagccgtggcagacgcaaaaccgc

SEQ ID NO: 35275 - DNA, 25 bp, Homo sapien
tgtcggtaaaatcacagcagcgctc

SEQ ID NO: 35276 - DNA, 25 bp, Homo sapien
cggtcctcgccttcagtgcgataga

SEQ ID NO: 35277 - DNA, 25 bp, Homo sapien
tcagtgcgatagacctttaagcgtc

SEQ ID NO: 35278 - DNA, 25 bp, Homo sapien
tcgcctcgctaggaggcacgttttg

SEQ ID NO: 35279 - DNA, 25 bp, Homo sapien
cacgttttggcctctttggtcacga

SEQ ID NO: 35280 - DNA, 25 bp, Homo sapien
ctttggtcacgatcagccttttggc

SEQ ID NO: 35281 - DNA, 25 bp, Homo sapien
agagcgcgcctcgtttctatagcaa

SEQ ID NO: 35282 - DNA, 25 bp, Homo sapien
tagattcgcccagtagacgccctcg

SEQ ID NO: 35283 - DNA, 25 bp, Homo sapien
cggcgaactaactggagcacggagc

SEQ ID NO: 35284 - DNA, 25 bp, Homo sapien
ccaggccggttggaggtcccagtat

SEQ ID NO: 35285 - DNA, 25 bp, Homo sapien
aacccgagccggctcaaaggtcagg

SEQ ID NO: 35286 - DNA, 25 bp, Homo sapien
gccgcgatctggctggtcccgaacg

SEQ ID NO: 35287 - DNA, 25 bp, Homo sapien
ggtctgcaccggcaggcgcatcatg

SEQ ID NO: 35288 - DNA, 25 bp, Homo sapien
ggtgctttccatgcccgacagccag

SEQ ID NO: 35289 - DNA, 25 bp, Homo sapien
gggcgcctgtctcggtgctttccat

SEQ ID NO: 35290 - DNA, 25 bp, Homo sapien
aggcgcatcatggagcagacgccca

SEQ ID NO: 35291 - DNA, 25 bp, Homo sapien
agcaagcagtccctccacgtgtacc

SEQ ID NO: 35292 - DNA, 25 bp, Homo sapien
gtgctgtagggatccaagcgcttga

SEQ ID NO: 35293 - DNA, 25 bp, Homo sapien
ctctgagcgcataggcgaggcattc

SEQ ID NO: 35294 - DNA, 25 bp, Homo sapien
ttttcgcgaaggcagttgtggctct

SEQ ID NO: 35295 - DNA, 25 bp, Homo sapien
gccctttggcagagcttttcgcgaa

SEQ ID NO: 35296 - DNA, 25 bp, Homo sapien
agattacgccgcaggcacgtgatgc

SEQ ID NO: 35297 - DNA, 25 bp, Homo sapien
ggcgtcgcctagcaaccaggagcca

SEQ ID NO: 35298 - DNA, 25 bp, Homo sapien
ctcgcacagcaacctcgggaggata

SEQ ID NO: 35299 - DNA, 25 bp, Homo sapien
agcgcttgagctgagtccgaaactc

SEQ ID NO: 35300 - DNA, 25 bp, Homo sapien
ggctttacggcagccgcgttgcggc

SEQ ID NO: 35301 - DNA, 25 bp, Homo sapien
acttccgcgcgctgtgcgagctcga

SEQ ID NO: 35302 - DNA, 25 bp, Homo sapien
cccgcagccgagagccaggtacgcc

SEQ ID NO: 35303 - DNA, 25 bp, Homo sapien
gagctgcacaacttccgcgcgctgt

SEQ ID NO: 35304 - DNA, 25 bp, Homo sapien
ggagtgactcactgagcgtgtgtga

SEQ ID NO: 35305 - DNA, 25 bp, Homo sapien
cgagcgaacgagcagccggcgccgt

SEQ ID NO: 35306 - DNA, 25 bp, Homo sapien
caggtcgacgccgacttcgagctgc

SEQ ID NO: 35307 - DNA, 25 bp, Homo sapien
tcgacgccgacttcgagctgcacaa

SEQ ID NO: 35308 - DNA, 25 bp, Homo sapien
catgcagcctcctgtggaatccgct

SEQ ID NO: 35309 - DNA, 25 bp, Homo sapien
gaggtcagcatcctcggagcttccc

SEQ ID NO: 35310 - DNA, 25 bp, Homo sapien
ttgaggtcagcatcctcggagcttc

SEQ ID NO: 35311 - DNA, 25 bp, Homo sapien
caaagttgaggtcagcatcctcgga

SEQ ID NO: 35312 - DNA, 25 bp, Homo sapien
tttaaagaacaaagttgaggtcagc

SEQ ID NO: 35313 - DNA, 25 bp, Homo sapien
gcggcctcggagctatttttaaaga

SEQ ID NO: 35314 - DNA, 25 bp, Homo sapien
cgcggcctcggagctatttttaaag

SEQ ID NO: 35315 - DNA, 25 bp, Homo sapien
gtggaatccgctgcatccccgggtc

SEQ ID NO: 35316 - DNA, 25 bp, Homo sapien
aggttatcgaccagctcaacgggca

SEQ ID NO: 35317 - DNA, 25 bp, Homo sapien
ccaatggacttctaccgctttaccg

SEQ ID NO: 35318 - DNA, 25 bp, Homo sapien
cgactttagtgaggggctttcagcc

SEQ ID NO: 35319 - DNA, 25 bp, Homo sapien
agaccagtcctttcggaccggctct

SEQ ID NO: 35320 - DNA, 25 bp, Homo sapien
aggacacctccatggagcgcttggg

SEQ ID NO: 35321 - DNA, 25 bp, Homo sapien
tgatccctgagatgaaggacacctc

SEQ ID NO: 35322 - DNA, 25 bp, Homo sapien
cgggactcgccagacactatgcttg

SEQ ID NO: 35323 - DNA, 25 bp, Homo sapien
ggccgccgctttgcgactttagtga

SEQ ID NO: 35324 - DNA, 25 bp, Homo sapien
ctgcctggagctaagtgccgagagc

SEQ ID NO: 35325 - DNA, 25 bp, Homo sapien
tggctgccggagagccaacaccacg

SEQ ID NO: 35326 - DNA, 25 bp, Homo sapien
gccggagagccaacaccacggatcg

SEQ ID NO: 35327 - DNA, 25 bp, Homo sapien
ggagagccaacaccacggatcggcc

SEQ ID NO: 35328 - DNA, 25 bp, Homo sapien
acgccttccaggtcattctctccga

SEQ ID NO: 35329 - DNA, 25 bp, Homo sapien
aggtcattctctccgaccggccctg

SEQ ID NO: 35330 - DNA, 25 bp, Homo sapien
ccctgcctggagctaagtgccgaga

SEQ ID NO: 35331 - DNA, 25 bp, Homo sapien
ccgcaccaaccctgggggctgtcgc

SEQ ID NO: 35332 - DNA, 25 bp, Homo sapien
tgctcacatctgctgtcggctggtt

SEQ ID NO: 35333 - DNA, 25 bp, Homo sapien
cggcatgggcaattccgagaaggcc

SEQ ID NO: 35334 - DNA, 25 bp, Homo sapien
ggctggttttgttgaggtcctgacc

SEQ ID NO: 35335 - DNA, 25 bp, Homo sapien
cctgaccacagaggcgcgcagcaat

SEQ ID NO: 35336 - DNA, 25 bp, Homo sapien
aaggcccacatggtgaccggtcagg

SEQ ID NO: 35337 - DNA, 25 bp, Homo sapien
tgagggtgactgtggccacaaatcc

SEQ ID NO: 35338 - DNA, 25 bp, Homo sapien
tcaaattgatcagcagcggcatggg

SEQ ID NO: 35339 - DNA, 25 bp, Homo sapien
tcccagcagcgagacgatcaaattg

SEQ ID NO: 35340 - DNA, 25 bp, Homo sapien
cctcaccgcacgctgaacctgctgc

SEQ ID NO: 35341 - DNA, 25 bp, Homo sapien
gcctccaccgccacgtctgccgcct

SEQ ID NO: 35342 - DNA, 25 bp, Homo sapien
gctctacctgctgtgccagtactcg

SEQ ID NO: 35343 - DNA, 25 bp, Homo sapien
tacctgctgtgccagtactcgctgg

SEQ ID NO: 35344 - DNA, 25 bp, Homo sapien
ctgacctgtggcctgagcttcctgc

SEQ ID NO: 35345 - DNA, 25 bp, Homo sapien
gctgctgagcctcgggctggccacg

SEQ ID NO: 35346 - DNA, 25 bp, Homo sapien
cccggcgcctccaccgccacgtctg

SEQ ID NO: 35347 - DNA, 25 bp, Homo sapien
cctgctgtgccagtactcgctgggc

SEQ ID NO: 35348 - DNA, 25 bp, Homo sapien
ctgactgtgggtcgctggctggacc

SEQ ID NO: 35349 - DNA, 25 bp, Homo sapien
gacggtgacaggcacccgcatccca

SEQ ID NO: 35350 - DNA, 25 bp, Homo sapien
atgggcggcctcttcgtgctgctgc

SEQ ID NO: 35351 - DNA, 25 bp, Homo sapien
tgggcatccttgtctccctactggg

SEQ ID NO: 35352 - DNA, 25 bp, Homo sapien
gcatccttgtctccctactgggcga

SEQ ID NO: 35353 - DNA, 25 bp, Homo sapien
tactgggcgagctctggtgtctcgt

SEQ ID NO: 35354 - DNA, 25 bp, Homo sapien
agccaggtgcagacggtgctggtgc

SEQ ID NO: 35355 - DNA, 25 bp, Homo sapien
ggacctgctgggcatccttgtctcc

SEQ ID NO: 35356 - DNA, 25 bp, Homo sapien
gccctttgcgtcccagtctcttggt

SEQ ID NO: 35357 - DNA, 25 bp, Homo sapien
ccgagcctcaccttttatggtaaag

SEQ ID NO: 35358 - DNA, 25 bp, Homo sapien
ggtgcggtcctcacgccctttgcgt

SEQ ID NO: 35359 - DNA, 25 bp, Homo sapien
acaaaaggccggagtcccgcacatg

SEQ ID NO: 35360 - DNA, 25 bp, Homo sapien
ggagtcccgcacatggatcgaatta

SEQ ID NO: 35361 - DNA, 25 bp, Homo sapien
gatcgaattaaagctccggcggcgc

SEQ ID NO: 35362 - DNA, 25 bp, Homo sapien
tgcctgcggagggtcccgcgtttcc

SEQ ID NO: 35363 - DNA, 25 bp, Homo sapien
caccttttatggtaaagcggcgcgg

SEQ ID NO: 35364 - DNA, 25 bp, Homo sapien
cggaacacgcgctcccgaaaaactg

SEQ ID NO: 35365 - DNA, 25 bp, Homo sapien
tcgactcgctgccaccggaacacgc

SEQ ID NO: 35366 - DNA, 25 bp, Homo sapien
aaactcaatcatcgactcgctgcca

SEQ ID NO: 35367 - DNA, 25 bp, Homo sapien
tgggcttaaattacacccaaactca

SEQ ID NO: 35368 - DNA, 25 bp, Homo sapien
gcgtttgctttgaaacgcggtaaga

SEQ ID NO: 35369 - DNA, 25 bp, Homo sapien
gaagaagccgcgtttgctttgaaac

SEQ ID NO: 35370 - DNA, 25 bp, Homo sapien
taagaattcagccacaaaatagttc

SEQ ID NO: 35371 - DNA, 25 bp, Homo sapien
cgaggcggctaagaattcagccaca

SEQ ID NO: 35372 - DNA, 25 bp, Homo sapien
tgaaaggaccacagagcccgataga

SEQ ID NO: 35373 - DNA, 25 bp, Homo sapien
caaccaatgctttggcggccacgct

SEQ ID NO: 35374 - DNA, 25 bp, Homo sapien
gccacgctgagtcctaacgtactga

SEQ ID NO: 35375 - DNA, 25 bp, Homo sapien
tcgcaaaagtccagtgagcgctcta

SEQ ID NO: 35376 - DNA, 25 bp, Homo sapien
gagcgctctaggtttctcatggcta

SEQ ID NO: 35377 - DNA, 25 bp, Homo sapien
gtccctttggctccatctttccaga

SEQ ID NO: 35378 - DNA, 25 bp, Homo sapien
gggcggttctctctgacaatgaagg

SEQ ID NO: 35379 - DNA, 25 bp, Homo sapien
cgcagcgttagcgtcaggccaccaa

SEQ ID NO: 35380 - DNA, 25 bp, Homo sapien
ctaacaaagggcgagctcattgccc

SEQ ID NO: 35381 - DNA, 25 bp, Homo sapien
tgcgcggtctccctagacgaattgc

SEQ ID NO: 35382 - DNA, 25 bp, Homo sapien
tatggctctcggaaggtgctgactt

SEQ ID NO: 35383 - DNA, 25 bp, Homo sapien
cgcgacgaccctatggctctcggaa

SEQ ID NO: 35384 - DNA, 25 bp, Homo sapien
ggagctttttcgagaagaaagcaca

SEQ ID NO: 35385 - DNA, 25 bp, Homo sapien
gtccctgtaggtgcaaggctttaaa

SEQ ID NO: 35386 - DNA, 25 bp, Homo sapien
agacgtattgtcttgtgacgcaccc

SEQ ID NO: 35387 - DNA, 25 bp, Homo sapien
tagccgcctccctagacgtattgtc

SEQ ID NO: 35388 - DNA, 25 bp, Homo sapien
gtgggcaacttacccgagaacgtgc

SEQ ID NO: 35389 - DNA, 25 bp, Homo sapien
cgctcggcaatgtctgacttcggga

SEQ ID NO: 35390 - DNA, 25 bp, Homo sapien
ctgcgaggcccgagagtcagaacct

SEQ ID NO: 35391 - DNA, 25 bp, Homo sapien
gcgctgacggtctcgtacgaagccg

SEQ ID NO: 35392 - DNA, 25 bp, Homo sapien
tggtccgggaaaccaggcatctctg

SEQ ID NO: 35393 - DNA, 25 bp, Homo sapien
gaacgtgcgggaagagaagatcatc

SEQ ID NO: 35394 - DNA, 25 bp, Homo sapien
tcaaacggtgagtgacacgaggccc

SEQ ID NO: 35395 - DNA, 25 bp, Homo sapien
acccacgggcgctgtgggacctcgt

SEQ ID NO: 35396 - DNA, 25 bp, Homo sapien
ctcctgtcttttaaatggaggatca

SEQ ID NO: 35397 - DNA, 25 bp, Homo sapien
taacctgcttgagctgtcctcggca

SEQ ID NO: 35398 - DNA, 25 bp, Homo sapien
tcgtggggccattcataacctgctt

SEQ ID NO: 35399 - DNA, 25 bp, Homo sapien
gggcattaaaccctcgccgctggag

SEQ ID NO: 35400 - DNA, 25 bp, Homo sapien
gttgctgttactggggcattaaacc

SEQ ID NO: 35401 - DNA, 25 bp, Homo sapien
ttactacgtcgtgcctgagaaacca

SEQ ID NO: 35402 - DNA, 25 bp, Homo sapien
tgattgtgttggtggttgctgttac

SEQ ID NO: 35403 - DNA, 25 bp, Homo sapien
ctctcccggtgtttactacgtcgtg

SEQ ID NO: 35404 - DNA, 25 bp, Homo sapien
gcgccgtcaacaaagtgcaaacaga

SEQ ID NO: 35405 - DNA, 25 bp, Homo sapien
acagtcggttccacccagggtccat

SEQ ID NO: 35406 - DNA, 25 bp, Homo sapien
aacggccacaacaggcacggtgaca

SEQ ID NO: 35407 - DNA, 25 bp, Homo sapien
tgcatctggtggtgtaacggccaca

SEQ ID NO: 35408 - DNA, 25 bp, Homo sapien
tgccacagcaagtgcagtgaccgtc

SEQ ID NO: 35409 - DNA, 25 bp, Homo sapien
ctgcgagtgcagtgaatgccacagc

SEQ ID NO: 35410 - DNA, 25 bp, Homo sapien
ggcacagtcaatgccgctgcgagtg

SEQ ID NO: 35411 - DNA, 25 bp, Homo sapien
tccatgcctgtgatcgacgatcgtc

SEQ ID NO: 35412 - DNA, 25 bp, Homo sapien
ctcaccacccacctgtgtgaatgcg

SEQ ID NO: 35413 - DNA, 25 bp, Homo sapien
ggtgaaggccttaccgcacatcaca

SEQ ID NO: 35414 - DNA, 25 bp, Homo sapien
gtgaaggccttaccgcacatcacac

SEQ ID NO: 35415 - DNA, 25 bp, Homo sapien
acatcacacactggcatggcttctc

SEQ ID NO: 35416 - DNA, 25 bp, Homo sapien
atcacacactggcatggcttctcac

SEQ ID NO: 35417 - DNA, 25 bp, Homo sapien
ggtgttggtgcctgctcctctccgt

SEQ ID NO: 35418 - DNA, 25 bp, Homo sapien
tgggcatggccgctcaccacccacc

SEQ ID NO: 35419 - DNA, 25 bp, Homo sapien
ctgggtgaaggccttaccgcacatc

SEQ ID NO: 35420 - DNA, 25 bp, Homo sapien
acctgtgtgaatgcggacgtgccgc

SEQ ID NO: 35421 - DNA, 25 bp, Homo sapien
ccgaaggtgccgcttcaggttccct

SEQ ID NO: 35422 - DNA, 25 bp, Homo sapien
ggcagtggatgcacacgtagggctt

SEQ ID NO: 35423 - DNA, 25 bp, Homo sapien
tgcaaactgtcgctggcagtggatg

SEQ ID NO: 35424 - DNA, 25 bp, Homo sapien
cggggtctgcaaactgtcgctggca

SEQ ID NO: 35425 - DNA, 25 bp, Homo sapien
cagagcgccggggtctgcaaactgt

SEQ ID NO: 35426 - DNA, 25 bp, Homo sapien
tgccgcttcaggttccctgtggcga

SEQ ID NO: 35427 - DNA, 25 bp, Homo sapien
ctgtggatccgaaggtgccgcttca

SEQ ID NO: 35428 - DNA, 25 bp, Homo sapien
aggagagacccggaccacggagaca

SEQ ID NO: 35429 - DNA, 25 bp, Homo sapien
tcttcgccttcaagtctttccggga

SEQ ID NO: 35430 - DNA, 25 bp, Homo sapien
ctgtggcacccactagtcctgggca

SEQ ID NO: 35431 - DNA, 25 bp, Homo sapien
tgctgaccaagctaggagagacccg

SEQ ID NO: 35432 - DNA, 25 bp, Homo sapien
cgactaacgggtccgactgctgacc

SEQ ID NO: 35433 - DNA, 25 bp, Homo sapien
tgtcagtgtcagctctgcgcacgca

SEQ ID NO: 35434 - DNA, 25 bp, Homo sapien
gtgatcaaagatcccgcctattttc

SEQ ID NO: 35435 - DNA, 25 bp, Homo sapien
ctgctgcaatatgcccggggcttgt

SEQ ID NO: 35436 - DNA, 25 bp, Homo sapien
gggcacttgtgctccttgtccgtgt

SEQ ID NO: 35437 - DNA, 25 bp, Homo sapien
tgatgaggcggtagctcttcccgca

SEQ ID NO: 35438 - DNA, 25 bp, Homo sapien
ggagggctggccatagtctccctca

SEQ ID NO: 35439 - DNA, 25 bp, Homo sapien
acctcgcacttgtggatgacggagc

SEQ ID NO: 35440 - DNA, 25 bp, Homo sapien
acttcttgtcgcagtgtgggcactt

SEQ ID NO: 35441 - DNA, 25 bp, Homo sapien
ggcagtacctgtgcgtcttctcatg

SEQ ID NO: 35442 - DNA, 25 bp, Homo sapien
ctccaggtggcgcatcttggaagtg

SEQ ID NO: 35443 - DNA, 25 bp, Homo sapien
gggtccgcacacctggttgaacttc

SEQ ID NO: 35444 - DNA, 25 bp, Homo sapien
ccaccgtccgcagtacgaatgaatg

SEQ ID NO: 35445 - DNA, 25 bp, Homo sapien
cgccatgttagagtcgggcggaacc

SEQ ID NO: 35446 - DNA, 25 bp, Homo sapien
ctccagagcagacaaagggcgccgc

SEQ ID NO: 35447 - DNA, 25 bp, Homo sapien
ccaccgcagagggaggtgcatcacg

SEQ ID NO: 35448 - DNA, 25 bp, Homo sapien
ccgggcgattgttgacactcacctg

SEQ ID NO: 35449 - DNA, 25 bp, Homo sapien
atgctaccagctggggtgtcatcca

SEQ ID NO: 35450 - DNA, 25 bp, Homo sapien
cgtcctcgctaggagagcgcccata

SEQ ID NO: 35451 - DNA, 25 bp, Homo sapien
tttatacagggacagcgtcggcctc

SEQ ID NO: 35452 - DNA, 25 bp, Homo sapien
ttcgtgtcacctgcggggctgcaaa

SEQ ID NO: 35453 - DNA, 25 bp, Homo sapien
ggcacgggaccctgcttcgtgtcac

SEQ ID NO: 35454 - DNA, 25 bp, Homo sapien
gaccctgcttcgtgtcacctgcggg

SEQ ID NO: 35455 - DNA, 25 bp, Homo sapien
atgcggtgacctctgcacgtgcgct

SEQ ID NO: 35456 - DNA, 25 bp, Homo sapien
ccaggtctccgagcggcgaggggac

SEQ ID NO: 35457 - DNA, 25 bp, Homo sapien
ccgcggggcgttcatgtctccgcgg

SEQ ID NO: 35458 - DNA, 25 bp, Homo sapien
ggcacggcacgggaccctgcttcgt

SEQ ID NO: 35459 - DNA, 25 bp, Homo sapien
gtgacctctgcacgtgcgctctctg

SEQ ID NO: 35460 - DNA, 25 bp, Homo sapien
aaggtgtagttcatgtggggctcca

SEQ ID NO: 35461 - DNA, 25 bp, Homo sapien
tgagacgccattgcgggcctccacg

SEQ ID NO: 35462 - DNA, 25 bp, Homo sapien
ggcctccacggtgaaggtgtagttc

SEQ ID NO: 35463 - DNA, 25 bp, Homo sapien
cgcaggtgacgctgtagacaatgtc

SEQ ID NO: 35464 - DNA, 25 bp, Homo sapien
caggtcgctcactgtcacactggtg

SEQ ID NO: 35465 - DNA, 25 bp, Homo sapien
agtagcgcacactggcctcacacgg

SEQ ID NO: 35466 - DNA, 25 bp, Homo sapien
agactcgggccagcactgttcgcag

SEQ ID NO: 35467 - DNA, 25 bp, Homo sapien
cggctggttaccaggcctgagacgc

SEQ ID NO: 35468 - DNA, 25 bp, Homo sapien
accgcacaagcgtcggcgtccttag

SEQ ID NO: 35469 - DNA, 25 bp, Homo sapien
cgccgacctttgtctgcctctcgca

SEQ ID NO: 35470 - DNA, 25 bp, Homo sapien
aatgtagtcctagaagaaccagcgc

SEQ ID NO: 35471 - DNA, 25 bp, Homo sapien
tcctagaagaaccagcgcatgtctc

SEQ ID NO: 35472 - DNA, 25 bp, Homo sapien
cagcgcatgtctcgggtccctgaca

SEQ ID NO: 35473 - DNA, 25 bp, Homo sapien
tccctgacacggagggactacattc

SEQ ID NO: 35474 - DNA, 25 bp, Homo sapien
agccaccctcggagaaaagacagct

SEQ ID NO: 35475 - DNA, 25 bp, Homo sapien
agcgtcggcgtccttagcgttccgc

SEQ ID NO: 35476 - DNA, 25 bp, Homo sapien
ggcgtgcctcgaagtcgctgctgac

SEQ ID NO: 35477 - DNA, 25 bp, Homo sapien
cttctggaagttggtgccgtagtcc

SEQ ID NO: 35478 - DNA, 25 bp, Homo sapien
gtcaatcttggtgaacaggcgcttc

SEQ ID NO: 35479 - DNA, 25 bp, Homo sapien
cacaggcaccgatatcctggaaggc

SEQ ID NO: 35480 - DNA, 25 bp, Homo sapien
agtcgctgctgacggtgatctcatc

SEQ ID NO: 35481 - DNA, 25 bp, Homo sapien
cgttcagcttcacgtggcgtgcctc

SEQ ID NO: 35482 - DNA, 25 bp, Homo sapien
gagcagcgccacacaggcaccgata

SEQ ID NO: 35483 - DNA, 25 bp, Homo sapien
atcgggcgcaatggtgtcaatcttg

SEQ ID NO: 35484 - DNA, 25 bp, Homo sapien
acctgccgcatttcctcgttctgag

SEQ ID NO: 35485 - DNA, 25 bp, Homo sapien
gagtcacccttgctcagaacgcttg

SEQ ID NO: 35486 - DNA, 25 bp, Homo sapien
gaacgcttgactttgggacttcctg

SEQ ID NO: 35487 - DNA, 25 bp, Homo sapien
agggattggcccgaacctatctcca

SEQ ID NO: 35488 - DNA, 25 bp, Homo sapien
cgtgcgaccaagctgaaaccgctta

SEQ ID NO: 35489 - DNA, 25 bp, Homo sapien
ttcattcatgccctgcgtgacgtca

SEQ ID NO: 35490 - DNA, 25 bp, Homo sapien
caccaggtaggttccaaagttgcgc

SEQ ID NO: 35491 - DNA, 25 bp, Homo sapien
cccaaaatgcgaggcctgcacagta

SEQ ID NO: 35492 - DNA, 25 bp, Homo sapien
ccgcggcgaggaactgcctctgcgt

SEQ ID NO: 35493 - DNA, 25 bp, Homo sapien
ctgcctctgcgtctcgtaaaagggg

SEQ ID NO: 35494 - DNA, 25 bp, Homo sapien
gctcgcagtttaccgcggagccgga

SEQ ID NO: 35495 - DNA, 25 bp, Homo sapien
cgcaggtgccgcctttgagggccgc

SEQ ID NO: 35496 - DNA, 25 bp, Homo sapien
gcgagcgcaagaggcgagaggaagc

SEQ ID NO: 35497 - DNA, 25 bp, Homo sapien
aagtgctgtgtagaagcgagcgcaa

SEQ ID NO: 35498 - DNA, 25 bp, Homo sapien
ggatggcccacctgccgtgggagcg

SEQ ID NO: 35499 - DNA, 25 bp, Homo sapien
ctctgcgtctcgtaaaaggggtctg

SEQ ID NO: 35500 - DNA, 25 bp, Homo sapien
tggccacgtcgctgtattcctgata

SEQ ID NO: 35501 - DNA, 25 bp, Homo sapien
tacgtcggggatatcctgccacagc

SEQ ID NO: 35502 - DNA, 25 bp, Homo sapien
agagcccgcgtcacttaacctttgc

SEQ ID NO: 35503 - DNA, 25 bp, Homo sapien
ccgcggttcggatatctggacacag

SEQ ID NO: 35504 - DNA, 25 bp, Homo sapien
tgagtgctagataccgacagttcca

SEQ ID NO: 35505 - DNA, 25 bp, Homo sapien
cccacgtacagttaaggaggaatcg

SEQ ID NO: 35506 - DNA, 25 bp, Homo sapien
aatcgccctctcgtgagtcaccagg

SEQ ID NO: 35507 - DNA, 25 bp, Homo sapien
cggcctcgtgtagtcaggtcctaga

SEQ ID NO: 35508 - DNA, 25 bp, Homo sapien
cagaagtccgagatgaaggcgagac

SEQ ID NO: 35509 - DNA, 25 bp, Homo sapien
gttacgggatatgcggcagaagtcc

SEQ ID NO: 35510 - DNA, 25 bp, Homo sapien
ttcacaaatccgtgcagctgggtgt

SEQ ID NO: 35511 - DNA, 25 bp, Homo sapien
cgggtgcccgcgtgaaattcacaaa

SEQ ID NO: 35512 - DNA, 25 bp, Homo sapien
cctgaagggcagagtgtgtttgctc

SEQ ID NO: 35513 - DNA, 25 bp, Homo sapien
ccacgtcgcgagaggccttgtatct

SEQ ID NO: 35514 - DNA, 25 bp, Homo sapien
tccgcgcatttgtccggggcagaat

SEQ ID NO: 35515 - DNA, 25 bp, Homo sapien
agaggctctcggatctcgactccga

SEQ ID NO: 35516 - DNA, 25 bp, Homo sapien
atacgcgtgcatctgtgagtgtaca

SEQ ID NO: 35517 - DNA, 25 bp, Homo sapien
tgcaactgatgggatcatacgcgtg

SEQ ID NO: 35518 - DNA, 25 bp, Homo sapien
gctcatctgtcagggcatccactgg

SEQ ID NO: 35519 - DNA, 25 bp, Homo sapien
ttggcatttctcaggcgctcatctg

SEQ ID NO: 35520 - DNA, 25 bp, Homo sapien
acctggcgagcagctttggcatttc

SEQ ID NO: 35521 - DNA, 25 bp, Homo sapien
gaaccttctcaatgtgctgcgcctg

SEQ ID NO: 35522 - DNA, 25 bp, Homo sapien
agtgtctgcgggaactcccacgcca

SEQ ID NO: 35523 - DNA, 25 bp, Homo sapien
cgtgtgtgaggatgtcgcctccaca

SEQ ID NO: 35524 - DNA, 25 bp, Homo sapien
ctccacatgagacggcgcgcgcagg

SEQ ID NO: 35525 - DNA, 25 bp, Homo sapien
gcgcacgaatcctacggccggctgg

SEQ ID NO: 35526 - DNA, 25 bp, Homo sapien
cggaaggcgcacgaatcctacggcc

SEQ ID NO: 35527 - DNA, 25 bp, Homo sapien
ccgccgagccctcagagtcggggtt

SEQ ID NO: 35528 - DNA, 25 bp, Homo sapien
aggctcagttcctcggcgtagcaca

SEQ ID NO: 35529 - DNA, 25 bp, Homo sapien
gttcctcggcgtagcacagcggctc

SEQ ID NO: 35530 - DNA, 25 bp, Homo sapien
ctgggcacctactgctgcagagggt

SEQ ID NO: 35531 - DNA, 25 bp, Homo sapien
acctactgctgcagagggttgcgca

SEQ ID NO: 35532 - DNA, 25 bp, Homo sapien
ggagcctttcatgcttctctgtgtc

SEQ ID NO: 35533 - DNA, 25 bp, Homo sapien
gtggatcctcttctctatgactccg

SEQ ID NO: 35534 - DNA, 25 bp, Homo sapien
cttttcctctgggttgtggatcctc

SEQ ID NO: 35535 - DNA, 25 bp, Homo sapien
tggctctggactaggccttttcctc

SEQ ID NO: 35536 - DNA, 25 bp, Homo sapien
actgcccatggagggtattcacaca

SEQ ID NO: 35537 - DNA, 25 bp, Homo sapien
gatagtcatcccattactgcccatg

SEQ ID NO: 35538 - DNA, 25 bp, Homo sapien
tcgcaatgctccctggggatagtca

SEQ ID NO: 35539 - DNA, 25 bp, Homo sapien
gtccgatccctagtctttcttccaa

SEQ ID NO: 35540 - DNA, 25 bp, Homo sapien
ctctagcgtcgacctgatagccgca

SEQ ID NO: 35541 - DNA, 25 bp, Homo sapien
ggcgatagcaagtcaccctgcccaa

SEQ ID NO: 35542 - DNA, 25 bp, Homo sapien
gccagtcccgggcataaagggcaga

SEQ ID NO: 35543 - DNA, 25 bp, Homo sapien
ataaagggcagaaggcgccggctcc

SEQ ID NO: 35544 - DNA, 25 bp, Homo sapien
ggttcgctccgctggcgacggtaat

SEQ ID NO: 35545 - DNA, 25 bp, Homo sapien
tgctcggggctcctcacagctggcg

SEQ ID NO: 35546 - DNA, 25 bp, Homo sapien
cagtgttgagaaaggccgtggtcac

SEQ ID NO: 35547 - DNA, 25 bp, Homo sapien
gcctcactcgaggacggcgatagca

SEQ ID NO: 35548 - DNA, 25 bp, Homo sapien
tttccgatgagccttgtggcccgag

SEQ ID NO: 35549 - DNA, 25 bp, Homo sapien
aggcatgtccggcttcgcaggaaag

SEQ ID NO: 35550 - DNA, 25 bp, Homo sapien
cggggtccattgagtaaagccttgc

SEQ ID NO: 35551 - DNA, 25 bp, Homo sapien
ctgagcgccgtgaaggcctcttaaa

SEQ ID NO: 35552 - DNA, 25 bp, Homo sapien
gggccgcgatccatttctctccttt

SEQ ID NO: 35553 - DNA, 25 bp, Homo sapien
gggcctctgtgactctttccgatga

SEQ ID NO: 35554 - DNA, 25 bp, Homo sapien
aagttcttgtgctctgaccgggacg

SEQ ID NO: 35555 - DNA, 25 bp, Homo sapien
ccgaggcaccattttaaagttcttg

SEQ ID NO: 35556 - DNA, 25 bp, Homo sapien
gtggatccagagtttcgcccgtctc

SEQ ID NO: 35557 - DNA, 25 bp, Homo sapien
tggtgatgtcacagacgcttctctt

SEQ ID NO: 35558 - DNA, 25 bp, Homo sapien
ccgctctagccgaaacctggtcaga

SEQ ID NO: 35559 - DNA, 25 bp, Homo sapien
tacgagtcggtgctctgtgtcaagc

SEQ ID NO: 35560 - DNA, 25 bp, Homo sapien
ccaaccgtggctacaggtgactacc

SEQ ID NO: 35561 - DNA, 25 bp, Homo sapien
tctttcagcgctaaccggtggcctt

SEQ ID NO: 35562 - DNA, 25 bp, Homo sapien
gccagaccaggctagctccaattta

SEQ ID NO: 35563 - DNA, 25 bp, Homo sapien
aggtgccctatcacagacggaaatc

SEQ ID NO: 35564 - DNA, 25 bp, Homo sapien
cacactcagggaaagaccggaggaa

SEQ ID NO: 35565 - DNA, 25 bp, Homo sapien
tgcgttgggagctcccgtcctcctg

SEQ ID NO: 35566 - DNA, 25 bp, Homo sapien
cctctgcggtgcgttgggagctccc

SEQ ID NO: 35567 - DNA, 25 bp, Homo sapien
ggtttccagctaacgacgcggcgcc

SEQ ID NO: 35568 - DNA, 25 bp, Homo sapien
tttggtttccagctaacgacgcggc

SEQ ID NO: 35569 - DNA, 25 bp, Homo sapien
cttctttggtttccagctaacgacg

SEQ ID NO: 35570 - DNA, 25 bp, Homo sapien
gtcctcctgcgcacactcagggaaa

SEQ ID NO: 35571 - DNA, 25 bp, Homo sapien
tgcgcacactcagggaaagaccgga

SEQ ID NO: 35572 - DNA, 25 bp, Homo sapien
ccgaaggagtcatccgcggtgcgct

SEQ ID NO: 35573 - DNA, 25 bp, Homo sapien
gcagctcgtgcttgtgtaaggtgga

SEQ ID NO: 35574 - DNA, 25 bp, Homo sapien
caggctgccgaaggagtcatccgcg

SEQ ID NO: 35575 - DNA, 25 bp, Homo sapien
gctggacgccgctctgtgtccgaca

SEQ ID NO: 35576 - DNA, 25 bp, Homo sapien
agtcatccgcggtgcgctcggagcc

SEQ ID NO: 35577 - DNA, 25 bp, Homo sapien
acgccgctctgtgtccgacaggacg

SEQ ID NO: 35578 - DNA, 25 bp, Homo sapien
cggagggcgccagacgctccctcca

SEQ ID NO: 35579 - DNA, 25 bp, Homo sapien
ccgcaggctgccgaaggagtcatcc

SEQ ID NO: 35580 - DNA, 25 bp, Homo sapien
ccaaggtttcgcagttgtaagaccg

SEQ ID NO: 35581 - DNA, 25 bp, Homo sapien
tgcggcgcttacagggaccaccctg

SEQ ID NO: 35582 - DNA, 25 bp, Homo sapien
caccctgggcggaaacgcctggtga

SEQ ID NO: 35583 - DNA, 25 bp, Homo sapien
taggctcctcctgcacgcacgaagg

SEQ ID NO: 35584 - DNA, 25 bp, Homo sapien
cacgaaggaggattccacaggaacg

SEQ ID NO: 35585 - DNA, 25 bp, Homo sapien
tgaccggtcagagagaatgcctttg

SEQ ID NO: 35586 - DNA, 25 bp, Homo sapien
ttcgcagttgtaagaccgcagcgca

SEQ ID NO: 35587 - DNA, 25 bp, Homo sapien
cctgcacgcacgaaggaggattcca

SEQ ID NO: 35588 - DNA, 25 bp, Homo sapien
aagtatgaaacgttgtgcctctgcc

SEQ ID NO: 35589 - DNA, 25 bp, Homo sapien
agtatgaaacgttgtgcctctgccc

SEQ ID NO: 35590 - DNA, 25 bp, Homo sapien
taagtatgaaacgttgtgcctctgc

SEQ ID NO: 35591 - DNA, 25 bp, Homo sapien
gtaagtatgaaacgttgtgcctctg

SEQ ID NO: 35592 - DNA, 25 bp, Homo sapien
aggtaagtatgaaacgttgtgcctc

SEQ ID NO: 35593 - DNA, 25 bp, Homo sapien
ccaggtaagtatgaaacgttgtgcc

SEQ ID NO: 35594 - DNA, 25 bp, Homo sapien
gccaggtaagtatgaaacgttgtgc

SEQ ID NO: 35595 - DNA, 25 bp, Homo sapien
gaaacgttgtgcctctgccccgaca

SEQ ID NO: 35596 - DNA, 25 bp, Homo sapien
gccagaagaacagcagaattgcctt

SEQ ID NO: 35597 - DNA, 25 bp, Homo sapien
tggagccagaagaacagcagaattg

SEQ ID NO: 35598 - DNA, 25 bp, Homo sapien
caactggcagggtctctggcgcacc

SEQ ID NO: 35599 - DNA, 25 bp, Homo sapien
cacccggcagggagggcaactggca

SEQ ID NO: 35600 - DNA, 25 bp, Homo sapien
gatttctcggcacccggcagggagg

SEQ ID NO: 35601 - DNA, 25 bp, Homo sapien
agaaactccctggtgggcgacccag

SEQ ID NO: 35602 - DNA, 25 bp, Homo sapien
cagaaactccctggtgggcgaccca

SEQ ID NO: 35603 - DNA, 25 bp, Homo sapien
cttccagaaactccctggtgggcga

SEQ ID NO: 35604 - DNA, 25 bp, Homo sapien
accattggctgtcagtcggatccga

SEQ ID NO: 35605 - DNA, 25 bp, Homo sapien
ctggtctccctcatcgggtactttg

SEQ ID NO: 35606 - DNA, 25 bp, Homo sapien
gagacttccttttcgcctgaccgcg

SEQ ID NO: 35607 - DNA, 25 bp, Homo sapien
gttccgccagacacagctaccattg

SEQ ID NO: 35608 - DNA, 25 bp, Homo sapien
ctcaagcgcctctccggagatggtc

SEQ ID NO: 35609 - DNA, 25 bp, Homo sapien
atccgagaacgacgattggctttcc

SEQ ID NO: 35610 - DNA, 25 bp, Homo sapien
ctttctagtctaggggcttcgctgc

SEQ ID NO: 35611 - DNA, 25 bp, Homo sapien
gcgcggtcacgtgctaccttttgca

SEQ ID NO: 35612 - DNA, 25 bp, Homo sapien
cggagacaaataggaacggtgtgtc

SEQ ID NO: 35613 - DNA, 25 bp, Homo sapien
atgacggacacggagacaaatagga

SEQ ID NO: 35614 - DNA, 25 bp, Homo sapien
gcggatgacggacacggagacaaat

SEQ ID NO: 35615 - DNA, 25 bp, Homo sapien
cggatgacggacacggagacaaata

SEQ ID NO: 35616 - DNA, 25 bp, Homo sapien
cacggagacaaataggaacggtgtg

SEQ ID NO: 35617 - DNA, 25 bp, Homo sapien
gacacggagacaaataggaacggtg

SEQ ID NO: 35618 - DNA, 25 bp, Homo sapien
cggacacggagacaaataggaacgg

SEQ ID NO: 35619 - DNA, 25 bp, Homo sapien
gacggacacggagacaaataggaac

SEQ ID NO: 35620 - DNA, 25 bp, Homo sapien
tctctaaagctgctcccgcggatga

SEQ ID NO: 35621 - DNA, 25 bp, Homo sapien
ctgtcagaagcgacagcttccctga

SEQ ID NO: 35622 - DNA, 25 bp, Homo sapien
aaagagcctgcaagcgacacaccga

SEQ ID NO: 35623 - DNA, 25 bp, Homo sapien
gcctgcaagcgacacaccgagggct

SEQ ID NO: 35624 - DNA, 25 bp, Homo sapien
caaggcctaacgagcgccttcgctg

SEQ ID NO: 35625 - DNA, 25 bp, Homo sapien
ctcccttcttctgtcagaagcgaca

SEQ ID NO: 35626 - DNA, 25 bp, Homo sapien
gctccgctgactggctggtgcccgt

SEQ ID NO: 35627 - DNA, 25 bp, Homo sapien
aacgagcgccttcgctggcaacgga

SEQ ID NO: 35628 - DNA, 25 bp, Homo sapien
ttcccattcacagggcagccggcag

SEQ ID NO: 35629 - DNA, 25 bp, Homo sapien
tccgcagagggaacggatttctggc

SEQ ID NO: 35630 - DNA, 25 bp, Homo sapien
cgcgctcgctcagaagctcgggcag

SEQ ID NO: 35631 - DNA, 25 bp, Homo sapien
gctcctcaggatcccgatgggcgtg

SEQ ID NO: 35632 - DNA, 25 bp, Homo sapien
ccgatgggcgtgtcaggataaccca

SEQ ID NO: 35633 - DNA, 25 bp, Homo sapien
gcgtgtcaggataacccaaggcgca

SEQ ID NO: 35634 - DNA, 25 bp, Homo sapien
cagcccctgccaggttgaagaggca

SEQ ID NO: 35635 - DNA, 25 bp, Homo sapien
cttcgcgtaacttcccattcacagg

SEQ ID NO: 35636 - DNA, 25 bp, Homo sapien
cctcgcagtggactaaactggaccg

SEQ ID NO: 35637 - DNA, 25 bp, Homo sapien
ccctcgcagtggactaaactggacc

SEQ ID NO: 35638 - DNA, 25 bp, Homo sapien
tgccctcgcagtggactaaactgga

SEQ ID NO: 35639 - DNA, 25 bp, Homo sapien
gagcccaaggatggctcccccaagt

SEQ ID NO: 35640 - DNA, 25 bp, Homo sapien
tggactaaactggaccgcgaaggga

SEQ ID NO: 35641 - DNA, 25 bp, Homo sapien
agtggactaaactggaccgcgaagg

SEQ ID NO: 35642 - DNA, 25 bp, Homo sapien
tcgcagtggactaaactggaccgcg

SEQ ID NO: 35643 - DNA, 25 bp, Homo sapien
gcagtggactaaactggaccgcgaa

SEQ ID NO: 35644 - DNA, 25 bp, Homo sapien
ggccgcctgtctcctacccatactt

SEQ ID NO: 35645 - DNA, 25 bp, Homo sapien
tccaggcctcagcttcgccgaaagg

SEQ ID NO: 35646 - DNA, 25 bp, Homo sapien
ttgttccaggcctcagcttcgccga

SEQ ID NO: 35647 - DNA, 25 bp, Homo sapien
agaactgaacctactccgtctggga

SEQ ID NO: 35648 - DNA, 25 bp, Homo sapien
ttcagggccaaatcacgcgcacgct

SEQ ID NO: 35649 - DNA, 25 bp, Homo sapien
acggcgtccgttcagggccaaatca

SEQ ID NO: 35650 - DNA, 25 bp, Homo sapien
accagcttccgctcggagtttcgca

SEQ ID NO: 35651 - DNA, 25 bp, Homo sapien
aacctactccgtctgggagcccaag

SEQ ID NO: 35652 - DNA, 25 bp, Homo sapien
acgacaactattgccggaatcctga

SEQ ID NO: 35653 - DNA, 25 bp, Homo sapien
agcggccatggtgctacactacgga

SEQ ID NO: 35654 - DNA, 25 bp, Homo sapien
tccatctaagggtccgaggcacagc

SEQ ID NO: 35655 - DNA, 25 bp, Homo sapien
taccttgccagcgttgggacgcgca

SEQ ID NO: 35656 - DNA, 25 bp, Homo sapien
tcgaccaaggtctggacgacaacta

SEQ ID NO: 35657 - DNA, 25 bp, Homo sapien
ttttgctaccagatccggcgttgta

SEQ ID NO: 35658 - DNA, 25 bp, Homo sapien
tcagcaccgatttacgccagaaaaa

SEQ ID NO: 35659 - DNA, 25 bp, Homo sapien
cctgcttagagaccttcgggagaac

SEQ ID NO: 35660 - DNA, 25 bp, Homo sapien
aagccggctgtggtgactcgtgcct

SEQ ID NO: 35661 - DNA, 25 bp, Homo sapien
actcgtgcctctgctactccagagg

SEQ ID NO: 35662 - DNA, 25 bp, Homo sapien
tgggaggatcgattcaaccaagata

SEQ ID NO: 35663 - DNA, 25 bp, Homo sapien
agaacagatataagccggctgtggt

SEQ ID NO: 35664 - DNA, 25 bp, Homo sapien
ggatcgattcaaccaagatacagtg

SEQ ID NO: 35665 - DNA, 25 bp, Homo sapien
catttatttgtctcatgggctgagc

SEQ ID NO: 35666 - DNA, 25 bp, Homo sapien
gcaagactccatcttttatttattt

SEQ ID NO: 35667 - DNA, 25 bp, Homo sapien
gcaacatggagaaacttcaactctt

SEQ ID NO: 35668 - DNA, 25 bp, Homo sapien
aaactgcgacactcacgcgggtgcc

SEQ ID NO: 35669 - DNA, 25 bp, Homo sapien
tggaaactgcgacactcacgcgggt

SEQ ID NO: 35670 - DNA, 25 bp, Homo sapien
tctcagcagctcacggtgtggaaac

SEQ ID NO: 35671 - DNA, 25 bp, Homo sapien
ggaaactgcgacactcacgcgggtg

SEQ ID NO: 35672 - DNA, 25 bp, Homo sapien
gaaactgcgacactcacgcgggtgc

SEQ ID NO: 35673 - DNA, 25 bp, Homo sapien
ctcagcagctcacggtgtggaaact

SEQ ID NO: 35674 - DNA, 25 bp, Homo sapien
tgtggaaactgcgacactcacgcgg

SEQ ID NO: 35675 - DNA, 25 bp, Homo sapien
gtggaaactgcgacactcacgcggg

SEQ ID NO: 35676 - DNA, 25 bp, Homo sapien
gtgcgcggagaacccggaagaagcg

SEQ ID NO: 35677 - DNA, 25 bp, Homo sapien
gctcccggtcaagaccctgacattg

SEQ ID NO: 35678 - DNA, 25 bp, Homo sapien
tcccggtcaagaccctgacattgcg

SEQ ID NO: 35679 - DNA, 25 bp, Homo sapien
ccggtcaagaccctgacattgcgga

SEQ ID NO: 35680 - DNA, 25 bp, Homo sapien
cggtcaagaccctgacattgcggag

SEQ ID NO: 35681 - DNA, 25 bp, Homo sapien
accctgacattgcggagggtcagga

SEQ ID NO: 35682 - DNA, 25 bp, Homo sapien
gcctccagccatcccgcccgctgtg

SEQ ID NO: 35683 - DNA, 25 bp, Homo sapien
gctgtgcgcggagaacccggaagaa

SEQ ID NO: 35684 - DNA, 25 bp, Homo sapien
agccggggcatccttcttcaaataa

SEQ ID NO: 35685 - DNA, 25 bp, Homo sapien
tttaattcgcagactagaatgtttc

SEQ ID NO: 35686 - DNA, 25 bp, Homo sapien
taattcgcagactagaatgtttcgg

SEQ ID NO: 35687 - DNA, 25 bp, Homo sapien
aattcgcagactagaatgtttcgga

SEQ ID NO: 35688 - DNA, 25 bp, Homo sapien
ttcgcagactagaatgtttcggatt

SEQ ID NO: 35689 - DNA, 25 bp, Homo sapien
tcgcagactagaatgtttcggatta

SEQ ID NO: 35690 - DNA, 25 bp, Homo sapien
cgcagactagaatgtttcggattac

SEQ ID NO: 35691 - DNA, 25 bp, Homo sapien
gccggggcatccttcttcaaataat

SEQ ID NO: 35692 - DNA, 25 bp, Homo sapien
ggggctcttggctcttctcgtcctc

SEQ ID NO: 35693 - DNA, 25 bp, Homo sapien
ggacacatacccgggcttcgggctc

SEQ ID NO: 35694 - DNA, 25 bp, Homo sapien
cactcttcggctcccagaagctgca

SEQ ID NO: 35695 - DNA, 25 bp, Homo sapien
ggccgtcggggctcttggctcttct

SEQ ID NO: 35696 - DNA, 25 bp, Homo sapien
gccgtcggggctcttggctcttctc

SEQ ID NO: 35697 - DNA, 25 bp, Homo sapien
cgtcggggctcttggctcttctcgt

SEQ ID NO: 35698 - DNA, 25 bp, Homo sapien
gtcggggctcttggctcttctcgtc

SEQ ID NO: 35699 - DNA, 25 bp, Homo sapien
cggggctcttggctcttctcgtcct

SEQ ID NO: 35700 - DNA, 25 bp, Homo sapien
gcttagttttgagtccgggtggtgc

SEQ ID NO: 35701 - DNA, 25 bp, Homo sapien
atccttgccgtctcctccgagccga

SEQ ID NO: 35702 - DNA, 25 bp, Homo sapien
gctgcccgggactgagcgtctccgt

SEQ ID NO: 35703 - DNA, 25 bp, Homo sapien
aagcgggtgtgcacagcccagcaga

SEQ ID NO: 35704 - DNA, 25 bp, Homo sapien
ggcgcgtcaaggtgactaggcatgc

SEQ ID NO: 35705 - DNA, 25 bp, Homo sapien
cccggtccgtggcagcgctgagcat

SEQ ID NO: 35706 - DNA, 25 bp, Homo sapien
cggggctaacagtcgcggatctgcc

SEQ ID NO: 35707 - DNA, 25 bp, Homo sapien
aggacacagcgtccgggaccaggct

SEQ ID NO: 35708 - DNA, 25 bp, Homo sapien
tggcaatcctgtgcctcaggcgggc

SEQ ID NO: 35709 - DNA, 25 bp, Homo sapien
cggccgtcacgccagggagcagtct

SEQ ID NO: 35710 - DNA, 25 bp, Homo sapien
ctcctacaggatgggctcgcggacc

SEQ ID NO: 35711 - DNA, 25 bp, Homo sapien
agcagtctgcctaggcgcgcctggt

SEQ ID NO: 35712 - DNA, 25 bp, Homo sapien
tagtcctcctacaggatgggctcgc

SEQ ID NO: 35713 - DNA, 25 bp, Homo sapien
tggtgcagcagcttgcccactgcct

SEQ ID NO: 35714 - DNA, 25 bp, Homo sapien
aagtagcgccgcctggcaatcctgt

SEQ ID NO: 35715 - DNA, 25 bp, Homo sapien
tcacgccagggagcagtctgcctag

SEQ ID NO: 35716 - DNA, 25 bp, Homo sapien
ccatcgggaacatcacgttgaaaga

SEQ ID NO: 35717 - DNA, 25 bp, Homo sapien
gcccatcgggaacatcacgttgaaa

SEQ ID NO: 35718 - DNA, 25 bp, Homo sapien
tcgcccatcgggaacatcacgttga

SEQ ID NO: 35719 - DNA, 25 bp, Homo sapien
gtcgcccatcgggaacatcacgttg

SEQ ID NO: 35720 - DNA, 25 bp, Homo sapien
agttgtcgcccatcgggaacatcac

SEQ ID NO: 35721 - DNA, 25 bp, Homo sapien
atcgggaacatcacgttgaaagact

SEQ ID NO: 35722 - DNA, 25 bp, Homo sapien
actcgggcttgggacggccctgctc

SEQ ID NO: 35723 - DNA, 25 bp, Homo sapien
tcgggcttgggacggccctgctcat

SEQ ID NO: 35724 - DNA, 25 bp, Homo sapien
tctcagccagtagctccgagttgtc

SEQ ID NO: 35725 - DNA, 25 bp, Homo sapien
tgggctgtgcatccagatgcagacc

SEQ ID NO: 35726 - DNA, 25 bp, Homo sapien
ttgagcagcggctgaaaccccgcag

SEQ ID NO: 35727 - DNA, 25 bp, Homo sapien
tgagaacactgtggtcagccccttg

SEQ ID NO: 35728 - DNA, 25 bp, Homo sapien
caggctcttgcctgccttaatctca

SEQ ID NO: 35729 - DNA, 25 bp, Homo sapien
tcttgcctgccttaatctcagccag

SEQ ID NO: 35730 - DNA, 25 bp, Homo sapien
ctgccttaatctcagccagtagctc

SEQ ID NO: 35731 - DNA, 25 bp, Homo sapien
cagccagtagctccgagttgtcgcc

SEQ ID NO: 35732 - DNA, 25 bp, Homo sapien
cttgtccgtctaggggctgctccaa

SEQ ID NO: 35733 - DNA, 25 bp, Homo sapien
gcttgtccgtctaggggctgctcca

SEQ ID NO: 35734 - DNA, 25 bp, Homo sapien
cccgcttgtccgtctaggggctgct

SEQ ID NO: 35735 - DNA, 25 bp, Homo sapien
ttgtccgtctaggggctgctccaac

SEQ ID NO: 35736 - DNA, 25 bp, Homo sapien
agaccccctgttctcacggtgggca

SEQ ID NO: 35737 - DNA, 25 bp, Homo sapien
cccctgttctcacggtgggcagcgg

SEQ ID NO: 35738 - DNA, 25 bp, Homo sapien
tcaggttacagacgcccgcgcacgg

SEQ ID NO: 35739 - DNA, 25 bp, Homo sapien
ccgcttgtccgtctaggggctgctc

SEQ ID NO: 35740 - DNA, 25 bp, Homo sapien
aggctccgcccgccttacagggagg

SEQ ID NO: 35741 - DNA, 25 bp, Homo sapien
cggcctgacatcacccggggcccgc

SEQ ID NO: 35742 - DNA, 25 bp, Homo sapien
tatgggctccgacggcctgacatca

SEQ ID NO: 35743 - DNA, 25 bp, Homo sapien
cagcctatgggctccgacggcctga

SEQ ID NO: 35744 - DNA, 25 bp, Homo sapien
ctccgcggagccctgtctttcgggg

SEQ ID NO: 35745 - DNA, 25 bp, Homo sapien
ctctcggctgtcagaaggactgcgg

SEQ ID NO: 35746 - DNA, 25 bp, Homo sapien
gcactccgctctcggctgtcagaag

SEQ ID NO: 35747 - DNA, 25 bp, Homo sapien
tccgctctcggctgtcagaaggact

SEQ ID NO: 35748 - DNA, 25 bp, Homo sapien
cagggatcgtaccaggttctccacc

SEQ ID NO: 35749 - DNA, 25 bp, Homo sapien
tcactaccaggatctggcagcactg

SEQ ID NO: 35750 - DNA, 25 bp, Homo sapien
gcaccgttcttggtttgggcattca

SEQ ID NO: 35751 - DNA, 25 bp, Homo sapien
cgttcttggtttgggcattcactcc

SEQ ID NO: 35752 - DNA, 25 bp, Homo sapien
acaggctcacgtcggtgcagctcac

SEQ ID NO: 35753 - DNA, 25 bp, Homo sapien
cgcgccgttcactaccaggatctgg

SEQ ID NO: 35754 - DNA, 25 bp, Homo sapien
ctgtggccgttgaagtccgacaggt

SEQ ID NO: 35755 - DNA, 25 bp, Homo sapien
taccaggttctccaccgtgcgcagg

SEQ ID NO: 35756 - DNA, 25 bp, Homo sapien
gtccgtgaggaaagagcccgcagct

SEQ ID NO: 35757 - DNA, 25 bp, Homo sapien
gaggacgcgaagagccaagagctct

SEQ ID NO: 35758 - DNA, 25 bp, Homo sapien
acgcgaagagccaagagctctgaca

SEQ ID NO: 35759 - DNA, 25 bp, Homo sapien
gaagagccaagagctctgacagctg

SEQ ID NO: 35760 - DNA, 25 bp, Homo sapien
cgtgaggaaagagcccgcagctcgc

SEQ ID NO: 35761 - DNA, 25 bp, Homo sapien
gccaagagtgtcagccggaaggatc

SEQ ID NO: 35762 - DNA, 25 bp, Homo sapien
agccaagagtgtcagccggaaggat

SEQ ID NO: 35763 - DNA, 25 bp, Homo sapien
gccaagagctctgacagctggcgcc

SEQ ID NO: 35764 - DNA, 25 bp, Homo sapien
tatcttggttgaatcgatcctccca

SEQ ID NO: 35765 - DNA, 25 bp, Homo sapien
cctcgctcagcccatgagacaaata

SEQ ID NO: 35766 - DNA, 25 bp, Homo sapien
aagagttgaagtttctccatgttgc

SEQ ID NO: 35767 - DNA, 25 bp, Homo sapien
tgttgttgtggtggctgtcttgttt

SEQ ID NO: 35768 - DNA, 25 bp, Homo sapien
ccacagccggcttatatctgttctt

SEQ ID NO: 35769 - DNA, 25 bp, Homo sapien
ggcacgagtcaccacagccggctta

SEQ ID NO: 35770 - DNA, 25 bp, Homo sapien
cctctggagtagcagaggcacgagt

SEQ ID NO: 35771 - DNA, 25 bp, Homo sapien
ctcagcccatgagacaaataaatga

SEQ ID NO: 35772 - DNA, 25 bp, Homo sapien
cgcacgtcgtctgtacaacgccgga

SEQ ID NO: 35773 - DNA, 25 bp, Homo sapien
acaacgccggatctggtagcaaaag

SEQ ID NO: 35774 - DNA, 25 bp, Homo sapien
ttctcccgaaggtctctaagcaggc

SEQ ID NO: 35775 - DNA, 25 bp, Homo sapien
cacgcgtatttttctggcgtaaatc

SEQ ID NO: 35776 - DNA, 25 bp, Homo sapien
ctgtgcctcggacccttagatggac

SEQ ID NO: 35777 - DNA, 25 bp, Homo sapien
tctgcggatccgtagtgtagcacca

SEQ ID NO: 35778 - DNA, 25 bp, Homo sapien
cggagccgtcaggattccggcaata

SEQ ID NO: 35779 - DNA, 25 bp, Homo sapien
tccggcaatagttgtcgtccagacc

SEQ ID NO: 35780 - DNA, 25 bp, Homo sapien
cacggttttacagcccggatcactg

SEQ ID NO: 35781 - DNA, 25 bp, Homo sapien
tgcagtttgcggttcttttcagaca

SEQ ID NO: 35782 - DNA, 25 bp, Homo sapien
gcgtgaagagccgatgctttaatta

SEQ ID NO: 35783 - DNA, 25 bp, Homo sapien
cggatcactggctttcttgaagttt

SEQ ID NO: 35784 - DNA, 25 bp, Homo sapien
gcaacgtctctcgtgaggtttttta

SEQ ID NO: 35785 - DNA, 25 bp, Homo sapien
ggcttggtttcagcaccctctggtc

SEQ ID NO: 35786 - DNA, 25 bp, Homo sapien
accgccgtcctgaggcactttgtgc

SEQ ID NO: 35787 - DNA, 25 bp, Homo sapien
ttcttgccgcctacctgacagcagg

SEQ ID NO: 35788 - DNA, 25 bp, Homo sapien
tagtcttcttgatggctggtgctta

SEQ ID NO: 35789 - DNA, 25 bp, Homo sapien
ttggaaacgataatagaaatggctg

SEQ ID NO: 35790 - DNA, 25 bp, Homo sapien
gcagttgaatttcttactttggaaa

SEQ ID NO: 35791 - DNA, 25 bp, Homo sapien
gctggtgcttattgggcttttttca

SEQ ID NO: 35792 - DNA, 25 bp, Homo sapien
tgggagccatagtcttcttgatggc

SEQ ID NO: 35793 - DNA, 25 bp, Homo sapien
aggatcccgcacacggcgcttagtt

SEQ ID NO: 35794 - DNA, 25 bp, Homo sapien
tccgcatccctggaagggcggcgtc

SEQ ID NO: 35795 - DNA, 25 bp, Homo sapien
gcttattgggcttttttcagtcgaa

SEQ ID NO: 35796 - DNA, 25 bp, Homo sapien
gcagctatgaggctgacccgagccc

SEQ ID NO: 35797 - DNA, 25 bp, Homo sapien
tgtctcaaagggtgcgtggacgttc

SEQ ID NO: 35798 - DNA, 25 bp, Homo sapien
tggacgttcccagacggttgtcctc

SEQ ID NO: 35799 - DNA, 25 bp, Homo sapien
tgctggcgcgtgctgtgtctcaaag

SEQ ID NO: 35800 - DNA, 25 bp, Homo sapien
tgggcgctgctcacagacgcaggcc

SEQ ID NO: 35801 - DNA, 25 bp, Homo sapien
aggcccagcactcaaggccgggcag

SEQ ID NO: 35802 - DNA, 25 bp, Homo sapien
gcctggtcgcagtcactgggcactc

SEQ ID NO: 35803 - DNA, 25 bp, Homo sapien
cggttgtcctcatcccaagagcggg

SEQ ID NO: 35804 - DNA, 25 bp, Homo sapien
tttccatggcaacgcagacaggccc

SEQ ID NO: 35805 - DNA, 25 bp, Homo sapien
aaccatggaatgctgcgtcacgctg

SEQ ID NO: 35806 - DNA, 25 bp, Homo sapien
ggaggtcacgtcacagactcgcttc

SEQ ID NO: 35807 - DNA, 25 bp, Homo sapien
gtgcaggctctcagtcgaaagtcca

SEQ ID NO: 35808 - DNA, 25 bp, Homo sapien
ccgagacgcgtcttcaggaagaaaa

SEQ ID NO: 35809 - DNA, 25 bp, Homo sapien
gccaatttacgtcatcgcgggtttc

SEQ ID NO: 35810 - DNA, 25 bp, Homo sapien
tccaactcctcggacggccaattta

SEQ ID NO: 35811 - DNA, 25 bp, Homo sapien
accagaccttccctttgcattgctg

SEQ ID NO: 35812 - DNA, 25 bp, Homo sapien
actctgggagctagcgggagacgcc

SEQ ID NO: 35813 - DNA, 25 bp, Homo sapien
aatggcgggcgttctggcaagtctc

SEQ ID NO: 35814 - DNA, 25 bp, Homo sapien
atcccggccgagaacgagagggacg

SEQ ID NO: 35815 - DNA, 25 bp, Homo sapien
tagcgggcttgataacccctgcgcc

SEQ ID NO: 35816 - DNA, 25 bp, Homo sapien
cagccgcgggtaaaggcctagcggg

SEQ ID NO: 35817 - DNA, 25 bp, Homo sapien
acggctcccggaactgggcagccgc

SEQ ID NO: 35818 - DNA, 25 bp, Homo sapien
cgagtgcctgggctcgtcctctttc

SEQ ID NO: 35819 - DNA, 25 bp, Homo sapien
ctcgtcctctttcgcgcccgctgcc

SEQ ID NO: 35820 - DNA, 25 bp, Homo sapien
gcctacccaacaggacaggactcga

SEQ ID NO: 35821 - DNA, 25 bp, Homo sapien
aggagcctggaagagcgcgcccacc

SEQ ID NO: 35822 - DNA, 25 bp, Homo sapien
cgagacctgactcccggccagtggg

SEQ ID NO: 35823 - DNA, 25 bp, Homo sapien
ctggagctcaggctgacccgagacc

SEQ ID NO: 35824 - DNA, 25 bp, Homo sapien
gaccaaagtgagcagctggtttccc

SEQ ID NO: 35825 - DNA, 25 bp, Homo sapien
gtccgttgcggacaagaccaaagtg

SEQ ID NO: 35826 - DNA, 25 bp, Homo sapien
acgcctttctttcctggcagcaaga

SEQ ID NO: 35827 - DNA, 25 bp, Homo sapien
ggacaggactcgacgcctttctttc

SEQ ID NO: 35828 - DNA, 25 bp, Homo sapien
cggtgtgtcgcttgcaggctctttt

SEQ ID NO: 35829 - DNA, 25 bp, Homo sapien
ctcagggaagctgtcgcttctgaca

SEQ ID NO: 35830 - DNA, 25 bp, Homo sapien
ctgtcgcttctgacagaagaaggga

SEQ ID NO: 35831 - DNA, 25 bp, Homo sapien
acagtctccgcagcggggttaaagc

SEQ ID NO: 35832 - DNA, 25 bp, Homo sapien
tcatccgcgggagcagctttagaga

SEQ ID NO: 35833 - DNA, 25 bp, Homo sapien
acacgggcaccagccagtcagcgga

SEQ ID NO: 35834 - DNA, 25 bp, Homo sapien
cagcgaaggcgctcgttaggccttg

SEQ ID NO: 35835 - DNA, 25 bp, Homo sapien
tccgttgccagcgaaggcgctcgtt

SEQ ID NO: 35836 - DNA, 25 bp, Homo sapien
cagggtactgagaaatcaacgattt

SEQ ID NO: 35837 - DNA, 25 bp, Homo sapien
ccgccctgcagggtactgagaaatc

SEQ ID NO: 35838 - DNA, 25 bp, Homo sapien
ccctgcagggtactgagaaatcaac

SEQ ID NO: 35839 - DNA, 25 bp, Homo sapien
ggtactgagaaatcaacgatttgta

SEQ ID NO: 35840 - DNA, 25 bp, Homo sapien
aaggcaattccgctgttctggctcc

SEQ ID NO: 35841 - DNA, 25 bp, Homo sapien
aattccgctgttctggctccagaat

SEQ ID NO: 35842 - DNA, 25 bp, Homo sapien
aggccctgccagtttcccgccctgc

SEQ ID NO: 35843 - DNA, 25 bp, Homo sapien
gcaattccgctgttctggctccaga

SEQ ID NO: 35844 - DNA, 25 bp, Homo sapien
gtaatccgaaacattctagtctgcg

SEQ ID NO: 35845 - DNA, 25 bp, Homo sapien
aatccgaaacattctagtctgcgaa

SEQ ID NO: 35846 - DNA, 25 bp, Homo sapien
tccgaaacattctagtctgcgaatt

SEQ ID NO: 35847 - DNA, 25 bp, Homo sapien
ccgaaacattctagtctgcgaatta

SEQ ID NO: 35848 - DNA, 25 bp, Homo sapien
cgaaacattctagtctgcgaattaa

SEQ ID NO: 35849 - DNA, 25 bp, Homo sapien
gaaacattctagtctgcgaattaaa

SEQ ID NO: 35850 - DNA, 25 bp, Homo sapien
taatccgaaacattctagtctgcga

SEQ ID NO: 35851 - DNA, 25 bp, Homo sapien
attatttgaagaaggatgccccggc

SEQ ID NO: 35852 - DNA, 25 bp, Homo sapien
cccaaaagacaagggcgagacagaa

SEQ ID NO: 35853 - DNA, 25 bp, Homo sapien
tcctagctgtgcgttagggctagga

SEQ ID NO: 35854 - DNA, 25 bp, Homo sapien
gcgtcctagctgtgcgttagggcta

SEQ ID NO: 35855 - DNA, 25 bp, Homo sapien
acgtgagcgtcctagctgtgcgtta

SEQ ID NO: 35856 - DNA, 25 bp, Homo sapien
accgctggctggacgtgagcgtcct

SEQ ID NO: 35857 - DNA, 25 bp, Homo sapien
acatcaccgatagggcgtttctatg

SEQ ID NO: 35858 - DNA, 25 bp, Homo sapien
ttggtgacatcaccgatagggcgtt

SEQ ID NO: 35859 - DNA, 25 bp, Homo sapien
gagggacaggcggacgtcacttccc

SEQ ID NO: 35860 - DNA, 25 bp, Homo sapien
tcgtgcttcgttcgcctggtatcct

SEQ ID NO: 35861 - DNA, 25 bp, Homo sapien
gccaggagagcgttcccaacaggct

SEQ ID NO: 35862 - DNA, 25 bp, Homo sapien
gcgctgtgtgttccgcgactgccgc

SEQ ID NO: 35863 - DNA, 25 bp, Homo sapien
ggcatgaaacgtccctctgtctggc

SEQ ID NO: 35864 - DNA, 25 bp, Homo sapien
tcgttcgcctggtatcctcgttcgt

SEQ ID NO: 35865 - DNA, 25 bp, Homo sapien
tgaaacgtccctctgtctggctggg

SEQ ID NO: 35866 - DNA, 25 bp, Homo sapien
cggccttgcaactgcgaggacttgg

SEQ ID NO: 35867 - DNA, 25 bp, Homo sapien
atcctcgttcgtgcgtgtaggaggc

SEQ ID NO: 35868 - DNA, 25 bp, Homo sapien
ttcggtctgctgtgaagaaggcaga

SEQ ID NO: 35869 - DNA, 25 bp, Homo sapien
gacccagctgcgtctgctggaggat

SEQ ID NO: 35870 - DNA, 25 bp, Homo sapien
aggccctgcggcgttccaatgagga

SEQ ID NO: 35871 - DNA, 25 bp, Homo sapien
cctgcggcgttccaatgaggagctt

SEQ ID NO: 35872 - DNA, 25 bp, Homo sapien
ggcgttccaatgaggagcttcggtc

SEQ ID NO: 35873 - DNA, 25 bp, Homo sapien
tccaatgaggagcttcggtctgctg

SEQ ID NO: 35874 - DNA, 25 bp, Homo sapien
aggagcttcggtctgctgtgaagaa

SEQ ID NO: 35875 - DNA, 25 bp, Homo sapien
cgagctgcgacgcagcctgggcgag

SEQ ID NO: 35876 - DNA, 25 bp, Homo sapien
tgcccgggacgcacccgcagaaggt

SEQ ID NO: 35877 - DNA, 25 bp, Homo sapien
acccgcagaaggtaagggcagtgcc

SEQ ID NO: 35878 - DNA, 25 bp, Homo sapien
ccgcagaaggtaagggcagtgccgc

SEQ ID NO: 35879 - DNA, 25 bp, Homo sapien
cacccgcagaaggtaagggcagtgc

SEQ ID NO: 35880 - DNA, 25 bp, Homo sapien
cgcacccgcagaaggtaagggcagt

SEQ ID NO: 35881 - DNA, 25 bp, Homo sapien
gcccgggacgcacccgcagaaggta

SEQ ID NO: 35882 - DNA, 25 bp, Homo sapien
gacgcacccgcagaaggtaagggca

SEQ ID NO: 35883 - DNA, 25 bp, Homo sapien
acgcacccgcagaaggtaagggcag

SEQ ID NO: 35884 - DNA, 25 bp, Homo sapien
cctgtgactctgtgaaaccatgttc

SEQ ID NO: 35885 - DNA, 25 bp, Homo sapien
agtgcaggctggacattttgtgacc

SEQ ID NO: 35886 - DNA, 25 bp, Homo sapien
tgagtctctctgcaacccactgagg

SEQ ID NO: 35887 - DNA, 25 bp, Homo sapien
tgtcacttgtggtcactaggctgta

SEQ ID NO: 35888 - DNA, 25 bp, Homo sapien
ctacgaagggtgcagacagtctggc

SEQ ID NO: 35889 - DNA, 25 bp, Homo sapien
atctgtgtacccgagtgagtgtcta

SEQ ID NO: 35890 - DNA, 25 bp, Homo sapien
tgtgcaggcccgcatactacgaagg

SEQ ID NO: 35891 - DNA, 25 bp, Homo sapien
taactcttatgtgtgtctccctgtg

SEQ ID NO: 35892 - DNA, 25 bp, Homo sapien
cgcagcaggacactaacatgtggtc

SEQ ID NO: 35893 - DNA, 25 bp, Homo sapien
aggcaccagctcttcgaacaatgtc

SEQ ID NO: 35894 - DNA, 25 bp, Homo sapien
cttctgttcatcctaccggggtgcc

SEQ ID NO: 35895 - DNA, 25 bp, Homo sapien
gccggtcttttcatctcaccaggta

SEQ ID NO: 35896 - DNA, 25 bp, Homo sapien
caccgctataaaggacacgtcagtc

SEQ ID NO: 35897 - DNA, 25 bp, Homo sapien
atctcggagtgagacgctttccttc

SEQ ID NO: 35898 - DNA, 25 bp, Homo sapien
tcgcgtccgtcagagactccaaagc

SEQ ID NO: 35899 - DNA, 25 bp, Homo sapien
cccacaggtcgtgcgtcctttgaca

SEQ ID NO: 35900 - DNA, 25 bp, Homo sapien
gctcatgaaggacgccttccagccg

SEQ ID NO: 35901 - DNA, 25 bp, Homo sapien
agcttaccagtaagccggtccgcct

SEQ ID NO: 35902 - DNA, 25 bp, Homo sapien
ccatggccggcaacgtgaagaagag

SEQ ID NO: 35903 - DNA, 25 bp, Homo sapien
gccggcaacgtgaagaagagctctg

SEQ ID NO: 35904 - DNA, 25 bp, Homo sapien
caacgtgaagaagagctctggggcc

SEQ ID NO: 35905 - DNA, 25 bp, Homo sapien
cctgattgggctcatgaaggacgcc

SEQ ID NO: 35906 - DNA, 25 bp, Homo sapien
attgggctcatgaaggacgccttcc

SEQ ID NO: 35907 - DNA, 25 bp, Homo sapien
ggcgcaggcccaaaggttccgccga

SEQ ID NO: 35908 - DNA, 25 bp, Homo sapien
cggcgggagaaacccagatgttgca

SEQ ID NO: 35909 - DNA, 25 bp, Homo sapien
gggtcctaacgcgagctgcccgcat

SEQ ID NO: 35910 - DNA, 25 bp, Homo sapien
aacccagatgttgcagcgccgcaca

SEQ ID NO: 35911 - DNA, 25 bp, Homo sapien
tgggaacaatcagccgcggaaactt

SEQ ID NO: 35912 - DNA, 25 bp, Homo sapien
gggttcaggaacctccgcggctgcc

SEQ ID NO: 35913 - DNA, 25 bp, Homo sapien
tgccctcggggttccatctcctggg

SEQ ID NO: 35914 - DNA, 25 bp, Homo sapien
ggggccgtcctcacgtctgtgcaaa

SEQ ID NO: 35915 - DNA, 25 bp, Homo sapien
ccaattcgcgttctctctgcagagc

SEQ ID NO: 35916 - DNA, 25 bp, Homo sapien
agccatcatccagaccacgacgtga

SEQ ID NO: 35917 - DNA, 25 bp, Homo sapien
ctgagcctctgcgaacgcagcgaga

SEQ ID NO: 35918 - DNA, 25 bp, Homo sapien
gactgccacagtagccgctgagcct

SEQ ID NO: 35919 - DNA, 25 bp, Homo sapien
cacgacgtgatagccgatgaccctc

SEQ ID NO: 35920 - DNA, 25 bp, Homo sapien
gcaaagggatcccagccatcatcca

SEQ ID NO: 35921 - DNA, 25 bp, Homo sapien
cttccaacggaagagcagcaaaggg

SEQ ID NO: 35922 - DNA, 25 bp, Homo sapien
ccacaggggcttccaacggaagagc

SEQ ID NO: 35923 - DNA, 25 bp, Homo sapien
tgaccctccatggactgccacagta

SEQ ID NO: 35924 - DNA, 25 bp, Homo sapien
cactcggggtgggatccgattaagt

SEQ ID NO: 35925 - DNA, 25 bp, Homo sapien
ggaccctcttgcacaagcgcccggc

SEQ ID NO: 35926 - DNA, 25 bp, Homo sapien
ccggcttccaatcccgcggctgagg

SEQ ID NO: 35927 - DNA, 25 bp, Homo sapien
tccctccaaggggtgacgacaactg

SEQ ID NO: 35928 - DNA, 25 bp, Homo sapien
cggactccgcactcacctgcgctca

SEQ ID NO: 35929 - DNA, 25 bp, Homo sapien
acctggacatccgtcactcggggtg

SEQ ID NO: 35930 - DNA, 25 bp, Homo sapien
cggagacacacacctcacggaggta

SEQ ID NO: 35931 - DNA, 25 bp, Homo sapien
ggggcgaccggagacacacacctca

SEQ ID NO: 35932 - DNA, 25 bp, Homo sapien
gcaagcacagcgagcgtgcgcaata

SEQ ID NO: 35933 - DNA, 25 bp, Homo sapien
ggtgtcccgtcgaacatcgcggcgc

SEQ ID NO: 35934 - DNA, 25 bp, Homo sapien
gcgcccagcctacatccactgagga

SEQ ID NO: 35935 - DNA, 25 bp, Homo sapien
actgaggacccactagccgcgtacg

SEQ ID NO: 35936 - DNA, 25 bp, Homo sapien
ccgcgtacgagcaaccaagtgggag

SEQ ID NO: 35937 - DNA, 25 bp, Homo sapien
ttgtggccggcaaccggcgcctcaa

SEQ ID NO: 35938 - DNA, 25 bp, Homo sapien
cgagcgtgcgcaatagcgcagtagc

SEQ ID NO: 35939 - DNA, 25 bp, Homo sapien
ctagccgcgtacgagcaaccaagtg

SEQ ID NO: 35940 - DNA, 25 bp, Homo sapien
ccagtcctctcgcagtgggctgcgg

SEQ ID NO: 35941 - DNA, 25 bp, Homo sapien
gggcctgtccgtcaagcgtggtccc

SEQ ID NO: 35942 - DNA, 25 bp, Homo sapien
tgagggacaactcgggctggacaaa

SEQ ID NO: 35943 - DNA, 25 bp, Homo sapien
gagtctgagcgcgtctcaggatttc

SEQ ID NO: 35944 - DNA, 25 bp, Homo sapien
ctcaggatttctgggctcgagatct

SEQ ID NO: 35945 - DNA, 25 bp, Homo sapien
gctcacctgtagacatcggtccaga

SEQ ID NO: 35946 - DNA, 25 bp, Homo sapien
gcgcagccttatccagcggccggtg

SEQ ID NO: 35947 - DNA, 25 bp, Homo sapien
ccagaggtaggtgcccagcacgtac

SEQ ID NO: 35948 - DNA, 25 bp, Homo sapien
gagcccattggctccgtgacctgca

SEQ ID NO: 35949 - DNA, 25 bp, Homo sapien
cgcgggagaaactccggagcccatt

SEQ ID NO: 35950 - DNA, 25 bp, Homo sapien
cgagctccaatcacaagccaggtct

SEQ ID NO: 35951 - DNA, 25 bp, Homo sapien
taaactgcgcgttcgcatcccgagc

SEQ ID NO: 35952 - DNA, 25 bp, Homo sapien
gctgcgagcgcgttagtcactaaac

SEQ ID NO: 35953 - DNA, 25 bp, Homo sapien
attagcgcggtaatagccgggatta

SEQ ID NO: 35954 - DNA, 25 bp, Homo sapien
aatagccgggattagcgcaggctgc

SEQ ID NO: 35955 - DNA, 25 bp, Homo sapien
cgagcccgtgtttgtcggtggtcac

SEQ ID NO: 35956 - DNA, 25 bp, Homo sapien
gctcgggcacttgacgaggacgcag

SEQ ID NO: 35957 - DNA, 25 bp, Homo sapien
ctcgggcacttgacgaggacgcagg

SEQ ID NO: 35958 - DNA, 25 bp, Homo sapien
cgggcacttgacgaggacgcaggtg

SEQ ID NO: 35959 - DNA, 25 bp, Homo sapien
ggcgagctcgggcacttgacgagga

SEQ ID NO: 35960 - DNA, 25 bp, Homo sapien
agctcgggcacttgacgaggacgca

SEQ ID NO: 35961 - DNA, 25 bp, Homo sapien
gcgagctcgggcacttgacgaggac

SEQ ID NO: 35962 - DNA, 25 bp, Homo sapien
tcgggcacttgacgaggacgcaggt

SEQ ID NO: 35963 - DNA, 25 bp, Homo sapien
gggcacttgacgaggacgcaggtgg

SEQ ID NO: 35964 - DNA, 25 bp, Homo sapien
ctcttcggtaatcccaactatttgg

SEQ ID NO: 35965 - DNA, 25 bp, Homo sapien
ccagagccaagcaaacgtgactaaa

SEQ ID NO: 35966 - DNA, 25 bp, Homo sapien
ccaagcaaacgtgactaaagggagc

SEQ ID NO: 35967 - DNA, 25 bp, Homo sapien
caaacgtgactaaagggagctgggt

SEQ ID NO: 35968 - DNA, 25 bp, Homo sapien
gtcagcagaacggtaccccgagtct

SEQ ID NO: 35969 - DNA, 25 bp, Homo sapien
tcccaactatttggtaccagagcca

SEQ ID NO: 35970 - DNA, 25 bp, Homo sapien
cggtaccccgagtctcagcaacagg

SEQ ID NO: 35971 - DNA, 25 bp, Homo sapien
aactatttggtaccagagccaagca

SEQ ID NO: 35972 - DNA, 25 bp, Homo sapien
gtgcgtaaggggctgttctctctta

SEQ ID NO: 35973 - DNA, 25 bp, Homo sapien
tctctcttattcacttctgacttga

SEQ ID NO: 35974 - DNA, 25 bp, Homo sapien
accacggcaaccaacgcgaaatgtg

SEQ ID NO: 35975 - DNA, 25 bp, Homo sapien
ggaaaccgctctccaactgtctcgg

SEQ ID NO: 35976 - DNA, 25 bp, Homo sapien
atttagtttcacaaagtcactgttc

SEQ ID NO: 35977 - DNA, 25 bp, Homo sapien
taccttttccatctgccaggcgctg

SEQ ID NO: 35978 - DNA, 25 bp, Homo sapien
cggaaaatcgacttgccggggtgca

SEQ ID NO: 35979 - DNA, 25 bp, Homo sapien
cgcgaaatgtgaaatgtgcgtaagg

SEQ ID NO: 35980 - DNA, 25 bp, Homo sapien
ggcaatgattcagcccgcggcctgc

SEQ ID NO: 35981 - DNA, 25 bp, Homo sapien
cattaaagaaggcttcgggacactt

SEQ ID NO: 35982 - DNA, 25 bp, Homo sapien
tatccgtaagttaggtttgcccaca

SEQ ID NO: 35983 - DNA, 25 bp, Homo sapien
accgagcccttttgttgcgcggagg

SEQ ID NO: 35984 - DNA, 25 bp, Homo sapien
cggcgcacaatggacgggttataaa

SEQ ID NO: 35985 - DNA, 25 bp, Homo sapien
tgtgctcgggttcggtgatgaccac

SEQ ID NO: 35986 - DNA, 25 bp, Homo sapien
actcacgacgcgctccttggtgtgc

SEQ ID NO: 35987 - DNA, 25 bp, Homo sapien
gtttgcccacaaagcatcacagttg

SEQ ID NO: 35988 - DNA, 25 bp, Homo sapien
taagcggtgacctcagccgcggcgc

SEQ ID NO: 35989 - DNA, 25 bp, Homo sapien
gtcctccgggtgtcctgggcgtgtc

SEQ ID NO: 35990 - DNA, 25 bp, Homo sapien
atcctcgcgtgtgccggagtctgcg

SEQ ID NO: 35991 - DNA, 25 bp, Homo sapien
ctttgtgagcggcgcggacgacaaa

SEQ ID NO: 35992 - DNA, 25 bp, Homo sapien
accaggggttaagcggtgacctcag

SEQ ID NO: 35993 - DNA, 25 bp, Homo sapien
cctccgcgggatcctcgcgtgtgcc

SEQ ID NO: 35994 - DNA, 25 bp, Homo sapien
caccaggggttaagcggtgacctca

SEQ ID NO: 35995 - DNA, 25 bp, Homo sapien
gttaagcggtgacctcagccgcggc

SEQ ID NO: 35996 - DNA, 25 bp, Homo sapien
tagaggaaatagaggacagcgccca

SEQ ID NO: 35997 - DNA, 25 bp, Homo sapien
ctccggctccggcagctttctctct

SEQ ID NO: 35998 - DNA, 25 bp, Homo sapien
agcaccgccaggaccaggatgcaca

SEQ ID NO: 35999 - DNA, 25 bp, Homo sapien
tctgcgccacaaagacactcctcgt

SEQ ID NO: 36000 - DNA, 25 bp, Homo sapien
gcttgcccttcttatagaggaaata

SEQ ID NO: 36001 - DNA, 25 bp, Homo sapien
tgcacggcagcttgcccttcttata

SEQ ID NO: 36002 - DNA, 25 bp, Homo sapien
gtgttgggcttacatctcctgcttc

SEQ ID NO: 36003 - DNA, 25 bp, Homo sapien
ggaccaggatgcacacaatcacagc

SEQ ID NO: 36004 - DNA, 25 bp, Homo sapien
agacagctacggcagcttccgggaa

SEQ ID NO: 36005 - DNA, 25 bp, Homo sapien
cagcaacggggccacaatgtgagta

SEQ ID NO: 36006 - DNA, 25 bp, Homo sapien
ccgggacgactacacgctgaagtgg

SEQ ID NO: 36007 - DNA, 25 bp, Homo sapien
ctcctactgcaaaagcaagggctgg

SEQ ID NO: 36008 - DNA, 25 bp, Homo sapien
tgcagactcggatgacactaacgcc

SEQ ID NO: 36009 - DNA, 25 bp, Homo sapien
tcttctacattggaggcagcaacgg

SEQ ID NO: 36010 - DNA, 25 bp, Homo sapien
gtgaggtcaagagccgagacagcta

SEQ ID NO: 36011 - DNA, 25 bp, Homo sapien
ccggggcccttcttctacattggag

SEQ ID NO: 36012 - DNA, 25 bp, Homo sapien
caagtgccaggtggtgttcttccgc

SEQ ID NO: 36013 - DNA, 25 bp, Homo sapien
ttcttccgcgtgaaggagatcctgc

SEQ ID NO: 36014 - DNA, 25 bp, Homo sapien
cgtgaaggagatcctgcactgccac

SEQ ID NO: 36015 - DNA, 25 bp, Homo sapien
actccatgttccagatcgccctgtc

SEQ ID NO: 36016 - DNA, 25 bp, Homo sapien
tggctgagtgggattccaccgagaa

SEQ ID NO: 36017 - DNA, 25 bp, Homo sapien
agtgggattccaccgagaagatcgg

SEQ ID NO: 36018 - DNA, 25 bp, Homo sapien
aagatcggggacctcttcgtggcct

SEQ ID NO: 36019 - DNA, 25 bp, Homo sapien
cccgcaagtgccaggtggtgttctt

SEQ ID NO: 36020 - DNA, 25 bp, Homo sapien
acagcgaggaggacggctccattta

SEQ ID NO: 36021 - DNA, 25 bp, Homo sapien
gcagggctaccgcaactttggcagc

SEQ ID NO: 36022 - DNA, 25 bp, Homo sapien
ggagatttgctctgtggccatcatc

SEQ ID NO: 36023 - DNA, 25 bp, Homo sapien
tccatttacgagatggccgacgacc

SEQ ID NO: 36024 - DNA, 25 bp, Homo sapien
atggcgcagctttggagcacagcga

SEQ ID NO: 36025 - DNA, 25 bp, Homo sapien
gctgacccgcaagaagggcatcctc

SEQ ID NO: 36026 - DNA, 25 bp, Homo sapien
gagcccatgcccgatagccacgtgg

SEQ ID NO: 36027 - DNA, 25 bp, Homo sapien
cgacgcccaccgcaaggagatttgc

SEQ ID NO: 36028 - DNA, 25 bp, Homo sapien
tcccacgggccattgtggaatccgt

SEQ ID NO: 36029 - DNA, 25 bp, Homo sapien
ccctggactttcgtgagaggcagca

SEQ ID NO: 36030 - DNA, 25 bp, Homo sapien
ttctttagcccgcaggtgttcgagc

SEQ ID NO: 36031 - DNA, 25 bp, Homo sapien
gtgccttggatgagagcaacaccta

SEQ ID NO: 36032 - DNA, 25 bp, Homo sapien
aacaagtgctacgtgccgcagaatc

SEQ ID NO: 36033 - DNA, 25 bp, Homo sapien
tcgccgtgactcagatgaacaagtg

SEQ ID NO: 36034 - DNA, 25 bp, Homo sapien
aatccgtggagtcctgcgagatctc

SEQ ID NO: 36035 - DNA, 25 bp, Homo sapien
cgggtggctcctgagatgttcttta

SEQ ID NO: 36036 - DNA, 25 bp, Homo sapien
cttagcggacgagagccgaacagcc

SEQ ID NO: 36037 - DNA, 25 bp, Homo sapien
gctcgggctacgagcaccggtcctg

SEQ ID NO: 36038 - DNA, 25 bp, Homo sapien
ctccgagaggctcgggctacgagca

SEQ ID NO: 36039 - DNA, 25 bp, Homo sapien
cgctgcagccgatcggactctgggc

SEQ ID NO: 36040 - DNA, 25 bp, Homo sapien
agcgcgattcggctccaaactccgg

SEQ ID NO: 36041 - DNA, 25 bp, Homo sapien
gcagagagcgcgattcggctccaaa

SEQ ID NO: 36042 - DNA, 25 bp, Homo sapien
gtctgtataatacgcggagagcgcg

SEQ ID NO: 36043 - DNA, 25 bp, Homo sapien
gccgaacagcccagaaaggattaaa

SEQ ID NO: 36044 - DNA, 25 bp, Homo sapien
ctttatgatcaataaggtctcgacc

SEQ ID NO: 36045 - DNA, 25 bp, Homo sapien
gagcctggtgccaacctcagcctgg

SEQ ID NO: 36046 - DNA, 25 bp, Homo sapien
taaatggagctgaaccctttcgcgc

SEQ ID NO: 36047 - DNA, 25 bp, Homo sapien
aaccctttcgcgcagtgagcagaga

SEQ ID NO: 36048 - DNA, 25 bp, Homo sapien
gcagagagccaacgtgaggctaaaa

SEQ ID NO: 36049 - DNA, 25 bp, Homo sapien
agactacaggctccgcgtccgggat

SEQ ID NO: 36050 - DNA, 25 bp, Homo sapien
ccgcgtagtgggtcttaaatggagc

SEQ ID NO: 36051 - DNA, 25 bp, Homo sapien
gcgaggtgccaaaaagtcgtcttta

SEQ ID NO: 36052 - DNA, 25 bp, Homo sapien
cacttctgggaagtcctgcactgga

SEQ ID NO: 36053 - DNA, 25 bp, Homo sapien
cgctgttcagccctgggaaacgttc

SEQ ID NO: 36054 - DNA, 25 bp, Homo sapien
cgcggatcgcgaatgggaaactttc

SEQ ID NO: 36055 - DNA, 25 bp, Homo sapien
tccttccaagtctgtgcccagaatg

SEQ ID NO: 36056 - DNA, 25 bp, Homo sapien
tcctggggcgttttcaactcctcca

SEQ ID NO: 36057 - DNA, 25 bp, Homo sapien
ttctcgggttctctgtctccgcagc

SEQ ID NO: 36058 - DNA, 25 bp, Homo sapien
ctccgctgctcaggatgaaggaaga

SEQ ID NO: 36059 - DNA, 25 bp, Homo sapien
ttcacgaacgtactggcggtcactg

SEQ ID NO: 36060 - DNA, 25 bp, Homo sapien
agcagtgacggcactgtggaagtac

SEQ ID NO: 36061 - DNA, 25 bp, Homo sapien
cccgagcagtgacggcactgtggaa

SEQ ID NO: 36062 - DNA, 25 bp, Homo sapien
cccgctgggtccacagcgccgagcc

SEQ ID NO: 36063 - DNA, 25 bp, Homo sapien
agccaaccacagagaacataccaga

SEQ ID NO: 36064 - DNA, 25 bp, Homo sapien
agacggtcgtgagccgtgagtttcc

SEQ ID NO: 36065 - DNA, 25 bp, Homo sapien
aacataccagagacggtcgtgagcc

SEQ ID NO: 36066 - DNA, 25 bp, Homo sapien
gagcccacctacttcctgcgccaca

SEQ ID NO: 36067 - DNA, 25 bp, Homo sapien
ccacagagaacataccagagacggt

SEQ ID NO: 36068 - DNA, 25 bp, Homo sapien
ccgccgagctcaatggctccatgta

SEQ ID NO: 36069 - DNA, 25 bp, Homo sapien
ctggagcgggttcccgccgagctca

SEQ ID NO: 36070 - DNA, 25 bp, Homo sapien
atggctccatgtatcgctgcaccgc

SEQ ID NO: 36071 - DNA, 25 bp, Homo sapien
cctggacggcagcgctgagttcgac

SEQ ID NO: 36072 - DNA, 25 bp, Homo sapien
acgcacacccggctcatcgtgtttg

SEQ ID NO: 36073 - DNA, 25 bp, Homo sapien
cccggagcccatgttcacgtggacg

SEQ ID NO: 36074 - DNA, 25 bp, Homo sapien
cacccggctcatcgtgtttggtatg

SEQ ID NO: 36075 - DNA, 25 bp, Homo sapien
cggctcatcgtgtttggtatggcgc

SEQ ID NO: 36076 - DNA, 25 bp, Homo sapien
gtcaacggctttctctaccgctttg

SEQ ID NO: 36077 - DNA, 25 bp, Homo sapien
gccacggtgcgtgccaaggaaatct

SEQ ID NO: 36078 - DNA, 25 bp, Homo sapien
ctgaactcggtggagcgttacgacc

SEQ ID NO: 36079 - DNA, 25 bp, Homo sapien
ccatcggcggagagtgtctgaactc

SEQ ID NO: 36080 - DNA, 25 bp, Homo sapien
caattatctcttcgtggtgtccggc

SEQ ID NO: 36081 - DNA, 25 bp, Homo sapien
agcccggacatctacgggtgcctga

SEQ ID NO: 36082 - DNA, 25 bp, Homo sapien
ctgttccgcttctctgcgcaggagc

SEQ ID NO: 36083 - DNA, 25 bp, Homo sapien
ggacaacctcatctactgcgtggga

SEQ ID NO: 36084 - DNA, 25 bp, Homo sapien
ctccagcgaaggaagctgccttttc

SEQ ID NO: 36085 - DNA, 25 bp, Homo sapien
ctgctcccgggatactctagaatcc

SEQ ID NO: 36086 - DNA, 25 bp, Homo sapien
ccaagagaaacacgcgacaccgctg

SEQ ID NO: 36087 - DNA, 25 bp, Homo sapien
ctaccaggcggatccggagaaacgc

SEQ ID NO: 36088 - DNA, 25 bp, Homo sapien
cccaaaataagccagcgggcgcttc

SEQ ID NO: 36089 - DNA, 25 bp, Homo sapien
ctagaatcccggctgcaaactggct

SEQ ID NO: 36090 - DNA, 25 bp, Homo sapien
gcgcttccagtatgggaatcctcca

SEQ ID NO: 36091 - DNA, 25 bp, Homo sapien
aggaggctcgtcctcccagacgcaa

SEQ ID NO: 36092 - DNA, 25 bp, Homo sapien
gctggctgccagctttctactcttg

SEQ ID NO: 36093 - DNA, 25 bp, Homo sapien
cccggcacggtaccgagaatgatgc

SEQ ID NO: 36094 - DNA, 25 bp, Homo sapien
cttgtccgcttctgcgtgggtttca

SEQ ID NO: 36095 - DNA, 25 bp, Homo sapien
ccttcgtttcgcaggtcgctagctg

SEQ ID NO: 36096 - DNA, 25 bp, Homo sapien
atcaggtcctggtgaatttcagctc

SEQ ID NO: 36097 - DNA, 25 bp, Homo sapien
acactcctgcttttccgcctggaaa

SEQ ID NO: 36098 - DNA, 25 bp, Homo sapien
tttactcgggcttccgcactctgga

SEQ ID NO: 36099 - DNA, 25 bp, Homo sapien
cccgcagggctgaaattctggtaga

SEQ ID NO: 36100 - DNA, 25 bp, Homo sapien
agaagatgttgcctctgctgtccca

SEQ ID NO: 36101 - DNA, 25 bp, Homo sapien
acaggcaacaggcacccggcgcaag

SEQ ID NO: 36102 - DNA, 25 bp, Homo sapien
ccacctcccttggtgccgcagcgtc

SEQ ID NO: 36103 - DNA, 25 bp, Homo sapien
tccgggccacccatgccgcatgccc

SEQ ID NO: 36104 - DNA, 25 bp, Homo sapien
tgctcctgcacaacggtgaggccga

SEQ ID NO: 36105 - DNA, 25 bp, Homo sapien
tccggaagagcctgcgcggccagaa

SEQ ID NO: 36106 - DNA, 25 bp, Homo sapien
tgcacaacggtgaggccgacccgcg

SEQ ID NO: 36107 - DNA, 25 bp, Homo sapien
cctgcgcggccagaagatgttgcct

SEQ ID NO: 36108 - DNA, 25 bp, Homo sapien
ggagaaactctcatgctgcggggca

SEQ ID NO: 36109 - DNA, 25 bp, Homo sapien
gcccgcgccttctttgcgctatgga

SEQ ID NO: 36110 - DNA, 25 bp, Homo sapien
tgacagttgactgaccgctgcaatc

SEQ ID NO: 36111 - DNA, 25 bp, Homo sapien
gcccgcggctccctaaatgaatttg

SEQ ID NO: 36112 - DNA, 25 bp, Homo sapien
acacgctctctaaacggtcccttga

SEQ ID NO: 36113 - DNA, 25 bp, Homo sapien
gccggagcaggcgaccagaactcca

SEQ ID NO: 36114 - DNA, 25 bp, Homo sapien
tctcggcgtcgatcaattatttata

SEQ ID NO: 36115 - DNA, 25 bp, Homo sapien
atgccggctagatgcgaagcccgcg

SEQ ID NO: 36116 - DNA, 25 bp, Homo sapien
gtctcccttcagaggtttctcccag

SEQ ID NO: 36117 - DNA, 25 bp, Homo sapien
gactagatggactttttgtgggttg

SEQ ID NO: 36118 - DNA, 25 bp, Homo sapien
gttcccattggaaggagactagatg

SEQ ID NO: 36119 - DNA, 25 bp, Homo sapien
ccagtccttatttcagttcccattg

SEQ ID NO: 36120 - DNA, 25 bp, Homo sapien
tggctaggccagtcggcccagagcc

SEQ ID NO: 36121 - DNA, 25 bp, Homo sapien
caagcggtccttggctaggccagtc

SEQ ID NO: 36122 - DNA, 25 bp, Homo sapien
ggcttactaagacaactcccatcta

SEQ ID NO: 36123 - DNA, 25 bp, Homo sapien
gaagaccctcccaaccttgaagatg

SEQ ID NO: 36124 - DNA, 25 bp, Homo sapien
ctaaaagactagtgtgcacggcgca

SEQ ID NO: 36125 - DNA, 25 bp, Homo sapien
cttgggctgtttcaaggcgtttgta

SEQ ID NO: 36126 - DNA, 25 bp, Homo sapien
tcttggaacgcaggcacgtctgaac

SEQ ID NO: 36127 - DNA, 25 bp, Homo sapien
ttcccgtgctcagccggtcttggaa

SEQ ID NO: 36128 - DNA, 25 bp, Homo sapien
ctcggttcccggattgagtgaggtt

SEQ ID NO: 36129 - DNA, 25 bp, Homo sapien
gcgcgcaagaaaagaggctcggttc

SEQ ID NO: 36130 - DNA, 25 bp, Homo sapien
aaaggcaaacactggcgctcgcgcg

SEQ ID NO: 36131 - DNA, 25 bp, Homo sapien
gcggtggatatccagtgcgaccaga

SEQ ID NO: 36132 - DNA, 25 bp, Homo sapien
ctgagcgcagcagaagagaatcttg

SEQ ID NO: 36133 - DNA, 25 bp, Homo sapien
gaagctcgccgccttccaatttagc

SEQ ID NO: 36134 - DNA, 25 bp, Homo sapien
ccgggaactgcattcagagcgttgc

SEQ ID NO: 36135 - DNA, 25 bp, Homo sapien
catcatattacagcacgtcccggcg

SEQ ID NO: 36136 - DNA, 25 bp, Homo sapien
tttgatccttcgtggcttcgcctta

SEQ ID NO: 36137 - DNA, 25 bp, Homo sapien
tcgctgcgatcctgccgcttaatta

SEQ ID NO: 36138 - DNA, 25 bp, Homo sapien
ggctgccagtgaattggccgatttc

SEQ ID NO: 36139 - DNA, 25 bp, Homo sapien
cggtgacatccgcacaaaggcagtt

SEQ ID NO: 36140 - DNA, 25 bp, Homo sapien
ggctccaattcaggccgaggtcttt

SEQ ID NO: 36141 - DNA, 25 bp, Homo sapien
ggccgtgggttctctacagtcccaa

SEQ ID NO: 36142 - DNA, 25 bp, Homo sapien
tgccttcactgcactctttgtctga

SEQ ID NO: 36143 - DNA, 25 bp, Homo sapien
ctacagaacctcacccaagtgggcg

SEQ ID NO: 36144 - DNA, 25 bp, Homo sapien
atgggacccagaccctacagaacct

SEQ ID NO: 36145 - DNA, 25 bp, Homo sapien
gcgcgataagtagctcggaaaactc

SEQ ID NO: 36146 - DNA, 25 bp, Homo sapien
ttgtctgacaccacgaaaagaccga

SEQ ID NO: 36147 - DNA, 25 bp, Homo sapien
ccaagcctccgcgagggcgacaggt

SEQ ID NO: 36148 - DNA, 25 bp, Homo sapien
ctttactatggtgtgggccgaggcc

SEQ ID NO: 36149 - DNA, 25 bp, Homo sapien
gaaagcggtttggaaactggtcagc

SEQ ID NO: 36150 - DNA, 25 bp, Homo sapien
gaggcgtcaggagttcgtcctcctc

SEQ ID NO: 36151 - DNA, 25 bp, Homo sapien
gctcgcgcctcaatggccactttag

SEQ ID NO: 36152 - DNA, 25 bp, Homo sapien
cgcctcaatggccactttagaaata

SEQ ID NO: 36153 - DNA, 25 bp, Homo sapien
cgaatgcctggtggcgctttactat

SEQ ID NO: 36154 - DNA, 25 bp, Homo sapien
gctttcatttccaccgacggccgcg

SEQ ID NO: 36155 - DNA, 25 bp, Homo sapien
aagcggctttgaagaggcgaatgcc

SEQ ID NO: 36156 - DNA, 25 bp, Homo sapien
acagtggaaaatgcggggagacaaa

SEQ ID NO: 36157 - DNA, 25 bp, Homo sapien
gcgcctttgatccatggcccgaggc

SEQ ID NO: 36158 - DNA, 25 bp, Homo sapien
cgggcagccggtaagcaagaccctt

SEQ ID NO: 36159 - DNA, 25 bp, Homo sapien
gctcgctcgtccagtcttggtcgcg

SEQ ID NO: 36160 - DNA, 25 bp, Homo sapien
tcggcggcctgcttaattcccgctg

SEQ ID NO: 36161 - DNA, 25 bp, Homo sapien
ccgagataaggacgccctcgggctc

SEQ ID NO: 36162 - DNA, 25 bp, Homo sapien
gtcaaagtgattcccaacaactgtc

SEQ ID NO: 36163 - DNA, 25 bp, Homo sapien
tgcggggagacaaaaccactcagtc

SEQ ID NO: 36164 - DNA, 25 bp, Homo sapien
agaaaatgtattcccgggctcggcg

SEQ ID NO: 36165 - DNA, 25 bp, Homo sapien
tctggaaatctaatgcgacacactc

SEQ ID NO: 36166 - DNA, 25 bp, Homo sapien
gagcccgtgcacctctggaaatcta

SEQ ID NO: 36167 - DNA, 25 bp, Homo sapien
taatgacatgtacctggagcccgtg

SEQ ID NO: 36168 - DNA, 25 bp, Homo sapien
cgtccaaactgttactaatgacatg

SEQ ID NO: 36169 - DNA, 25 bp, Homo sapien
ggattcattatcgtccaaactgtta

SEQ ID NO: 36170 - DNA, 25 bp, Homo sapien
gcgcggcctcgttatgtattcatga

SEQ ID NO: 36171 - DNA, 25 bp, Homo sapien
gcgacacactccgagagaaaatgta

SEQ ID NO: 36172 - DNA, 25 bp, Homo sapien
ttaccataaatgctcaggcggctgc

SEQ ID NO: 36173 - DNA, 25 bp, Homo sapien
gctgtgacctctggttaaagaaaga

SEQ ID NO: 36174 - DNA, 25 bp, Homo sapien
gcaatgaggctgtgacctctggtta

SEQ ID NO: 36175 - DNA, 25 bp, Homo sapien
tgcctcctgggtaggcaatgaggct

SEQ ID NO: 36176 - DNA, 25 bp, Homo sapien
cagtgattcggtctgaccagccgtc

SEQ ID NO: 36177 - DNA, 25 bp, Homo sapien
agcccgcgcagtgattcggtctgac

SEQ ID NO: 36178 - DNA, 25 bp, Homo sapien
aagagtggggccctctagctagatg

SEQ ID NO: 36179 - DNA, 25 bp, Homo sapien
cctctagctagatggcagcgtcggc

SEQ ID NO: 36180 - DNA, 25 bp, Homo sapien
accttgtctcgcagctcatcgctga

SEQ ID NO: 36181 - DNA, 25 bp, Homo sapien
tccacacggcgccagtgaagttctg

SEQ ID NO: 36182 - DNA, 25 bp, Homo sapien
ttctggcgcagcacctcattgaaga

SEQ ID NO: 36183 - DNA, 25 bp, Homo sapien
ggcgctcctctgacgtcatgttctg

SEQ ID NO: 36184 - DNA, 25 bp, Homo sapien
gcagctggccattgtcgcggccata

SEQ ID NO: 36185 - DNA, 25 bp, Homo sapien
gttccagcggaagtgcagcatcagc

SEQ ID NO: 36186 - DNA, 25 bp, Homo sapien
tgctcaccagcacaatgatccagtt

SEQ ID NO: 36187 - DNA, 25 bp, Homo sapien
cggccataggtgtcgctgctcacca

SEQ ID NO: 36188 - DNA, 25 bp, Homo sapien
acgcggaacacttctggccaccgta

SEQ ID NO: 36189 - DNA, 25 bp, Homo sapien
gggaccaacacgagcacggagcagc

SEQ ID NO: 36190 - DNA, 25 bp, Homo sapien
gtcgcccactttgatccgactgtgc

SEQ ID NO: 36191 - DNA, 25 bp, Homo sapien
gccctttgatctgcggccacagcga

SEQ ID NO: 36192 - DNA, 25 bp, Homo sapien
cgtagagacgcgagcacgcggaaca

SEQ ID NO: 36193 - DNA, 25 bp, Homo sapien
tggccaccgtactcgaaggctgagc

SEQ ID NO: 36194 - DNA, 25 bp, Homo sapien
cggtgcacgaagtggaagttctttc

SEQ ID NO: 36195 - DNA, 25 bp, Homo sapien
ttctttccgccgcactctacagggg

SEQ ID NO: 36196 - DNA, 25 bp, Homo sapien
cacgaggagtttccgcgctgagtca

SEQ ID NO: 36197 - DNA, 25 bp, Homo sapien
ctccatggcgggttcgcgctggcct

SEQ ID NO: 36198 - DNA, 25 bp, Homo sapien
ccctgtgcgagtggctcgggcttcc

SEQ ID NO: 36199 - DNA, 25 bp, Homo sapien
ttttccgggcagatggaggccgccc

SEQ ID NO: 36200 - DNA, 25 bp, Homo sapien
cagaggtggcctccggcccttttct

SEQ ID NO: 36201 - DNA, 25 bp, Homo sapien
cgcttctgggaacagaggtggcctc

SEQ ID NO: 36202 - DNA, 25 bp, Homo sapien
aggccgcccacgaggagtttccgcg

SEQ ID NO: 36203 - DNA, 25 bp, Homo sapien
cccgcgctgacgtttccgcgccgag

SEQ ID NO: 36204 - DNA, 25 bp, Homo sapien
agcggtgagatcaggcccatggcat

SEQ ID NO: 36205 - DNA, 25 bp, Homo sapien
tgccgccgattgcagtgaagttaaa

SEQ ID NO: 36206 - DNA, 25 bp, Homo sapien
agaagtcgatgagttccgctgcagc

SEQ ID NO: 36207 - DNA, 25 bp, Homo sapien
cttggcattgaaccggaagaagtcg

SEQ ID NO: 36208 - DNA, 25 bp, Homo sapien
ccggtacaccgtgctgttggtgctc

SEQ ID NO: 36209 - DNA, 25 bp, Homo sapien
atggccgccacgaagccctggggaa

SEQ ID NO: 36210 - DNA, 25 bp, Homo sapien
cgctgcagcgtcaatctccgcttgg

SEQ ID NO: 36211 - DNA, 25 bp, Homo sapien
cagctccaccgcatacttggcattg

SEQ ID NO: 36212 - DNA, 25 bp, Homo sapien
ttcgatgggagtccgactgacttct

SEQ ID NO: 36213 - DNA, 25 bp, Homo sapien
cggcagccttccaaagcggagcaga

SEQ ID NO: 36214 - DNA, 25 bp, Homo sapien
gggcgtgaactctgtcgaccagtca

SEQ ID NO: 36215 - DNA, 25 bp, Homo sapien
cctctctttatggtatgacccggga

SEQ ID NO: 36216 - DNA, 25 bp, Homo sapien
cccgaaagcgaagtcctgaaatgca

SEQ ID NO: 36217 - DNA, 25 bp, Homo sapien
gggcattacacaacacaggacaagg

SEQ ID NO: 36218 - DNA, 25 bp, Homo sapien
ccgagctcgggatcagccaaagtcc

SEQ ID NO: 36219 - DNA, 25 bp, Homo sapien
aaggctggaaacctgtccgctacca

SEQ ID NO: 36220 - DNA, 25 bp, Homo sapien
cggaagcgcacgttgagccccttca

SEQ ID NO: 36221 - DNA, 25 bp, Homo sapien
gctttctccgcagcatagactccgc

SEQ ID NO: 36222 - DNA, 25 bp, Homo sapien
gcagccgcacgcagaggactctcgg

SEQ ID NO: 36223 - DNA, 25 bp, Homo sapien
gcggttccagatgcgcgccagatgc

SEQ ID NO: 36224 - DNA, 25 bp, Homo sapien
ccgaacagcagcgagttcaccatgc

SEQ ID NO: 36225 - DNA, 25 bp, Homo sapien
gaaggtcttgtagcgcagccgccgc

SEQ ID NO: 36226 - DNA, 25 bp, Homo sapien
cctgctcgcgggagaaggtcttgta

SEQ ID NO: 36227 - DNA, 25 bp, Homo sapien
agcgagttcaccatgcgccggctgc

SEQ ID NO: 36228 - DNA, 25 bp, Homo sapien
cgttaacttctgagcctgcgcggtg

SEQ ID NO: 36229 - DNA, 25 bp, Homo sapien
catctgtgacttgacccaaggggca

SEQ ID NO: 36230 - DNA, 25 bp, Homo sapien
agggcgaatgcatctcactctcaac

SEQ ID NO: 36231 - DNA, 25 bp, Homo sapien
cagggaggccgctaaagttttgctc

SEQ ID NO: 36232 - DNA, 25 bp, Homo sapien
tctcgatgactgaggccaccagctg

SEQ ID NO: 36233 - DNA, 25 bp, Homo sapien
gctgcggcaactccttcatctcgaa

SEQ ID NO: 36234 - DNA, 25 bp, Homo sapien
gcgccgccgtcatgggtcaaaaacg

SEQ ID NO: 36235 - DNA, 25 bp, Homo sapien
tgcgggcgagaaatgcaaactcatc

SEQ ID NO: 36236 - DNA, 25 bp, Homo sapien
ctgtaaaaccgccagaggtggctga

SEQ ID NO: 36237 - DNA, 25 bp, Homo sapien
gcgcagattggaacgccaggacatc

SEQ ID NO: 36238 - DNA, 25 bp, Homo sapien
gatgcccaaatccaagcgcgacaag

SEQ ID NO: 36239 - DNA, 25 bp, Homo sapien
tgcacattgggtcaggcacacgcga

SEQ ID NO: 36240 - DNA, 25 bp, Homo sapien
tcggcacacgggaagttgccctaca

SEQ ID NO: 36241 - DNA, 25 bp, Homo sapien
atcagcagcgtagcccaaagccaga

SEQ ID NO: 36242 - DNA, 25 bp, Homo sapien
ttggtcttcgtagaccgcggccgca

SEQ ID NO: 36243 - DNA, 25 bp, Homo sapien
aggacatcctcgaggtgttccgctg

SEQ ID NO: 36244 - DNA, 25 bp, Homo sapien
agtcgctgctgcccattcggagccc

SEQ ID NO: 36245 - DNA, 25 bp, Homo sapien
tcaaccacgaggaccgtctgcactt

SEQ ID NO: 36246 - DNA, 25 bp, Homo sapien
accacgaggaccgtctgcacttgca

SEQ ID NO: 36247 - DNA, 25 bp, Homo sapien
agggtggcgaagatcccaaaggtct

SEQ ID NO: 36248 - DNA, 25 bp, Homo sapien
tggactccgctctcaaccacgagga

SEQ ID NO: 36249 - DNA, 25 bp, Homo sapien
gatcccaaaggtctgggactcctcc

SEQ ID NO: 36250 - DNA, 25 bp, Homo sapien
cgaagatcccaaaggtctgggactc

SEQ ID NO: 36251 - DNA, 25 bp, Homo sapien
tggcgaagatcccaaaggtctggga

SEQ ID NO: 36252 - DNA, 25 bp, Homo sapien
gacaggctcagctctgcaccgtgca

SEQ ID NO: 36253 - DNA, 25 bp, Homo sapien
aaggccgtgtctatctcggtgtggc

SEQ ID NO: 36254 - DNA, 25 bp, Homo sapien
tctgcacttgcaccgagcaagcagc

SEQ ID NO: 36255 - DNA, 25 bp, Homo sapien
ttgcaccgagcaagcagcgaaatgg

SEQ ID NO: 36256 - DNA, 25 bp, Homo sapien
gcttcgtaccggtgactcgcgtctt

SEQ ID NO: 36257 - DNA, 25 bp, Homo sapien
actcgcgtcttggagattttaacac

SEQ ID NO: 36258 - DNA, 25 bp, Homo sapien
atcaggggccactgttacctctgca

SEQ ID NO: 36259 - DNA, 25 bp, Homo sapien
agcgaaatggctgtggcttcgtacc

SEQ ID NO: 36260 - DNA, 25 bp, Homo sapien
tctcctcccggagggagcgcttacg

SEQ ID NO: 36261 - DNA, 25 bp, Homo sapien
agctgtcctgggtttctgtctcctc

SEQ ID NO: 36262 - DNA, 25 bp, Homo sapien
cccggagctgtcctgggtttctgtc

SEQ ID NO: 36263 - DNA, 25 bp, Homo sapien
tggcgactatcccaaaaggcgggga

SEQ ID NO: 36264 - DNA, 25 bp, Homo sapien
agggtggcgactatcccaaaaggcg

SEQ ID NO: 36265 - DNA, 25 bp, Homo sapien
tactaggaccttctgcacttgcacc

SEQ ID NO: 36266 - DNA, 25 bp, Homo sapien
cacgctcggctactaggaccttctg

SEQ ID NO: 36267 - DNA, 25 bp, Homo sapien
cgacgccgcccacgagctcgactcc

SEQ ID NO: 36268 - DNA, 25 bp, Homo sapien
tcgggcgccattcaaacggaccaat

SEQ ID NO: 36269 - DNA, 25 bp, Homo sapien
cggaccaatgagtgatcgacgtttt

SEQ ID NO: 36270 - DNA, 25 bp, Homo sapien
tgtcgcctctccttccctttggaaa

SEQ ID NO: 36271 - DNA, 25 bp, Homo sapien
gtatttcgacgctgcccgccaacga

SEQ ID NO: 36272 - DNA, 25 bp, Homo sapien
gcatccaaagctgaggtcgctccta

SEQ ID NO: 36273 - DNA, 25 bp, Homo sapien
agagcctgcgcccagcttacatcga

SEQ ID NO: 36274 - DNA, 25 bp, Homo sapien
cacctgcgtagctggactgagagcc

SEQ ID NO: 36275 - DNA, 25 bp, Homo sapien
caccgattggctggagtttgtcgtc

SEQ ID NO: 36276 - DNA, 25 bp, Homo sapien
gacaggctcagctctacacgatgca

SEQ ID NO: 36277 - DNA, 25 bp, Homo sapien
ggatctgcagctactgttacctctg

SEQ ID NO: 36278 - DNA, 25 bp, Homo sapien
tggccctcgggaatccgcagccagt

SEQ ID NO: 36279 - DNA, 25 bp, Homo sapien
tgcgccctccttgtggcgcgatatc

SEQ ID NO: 36280 - DNA, 25 bp, Homo sapien
gcactcagcatagcagcggcgcctg

SEQ ID NO: 36281 - DNA, 25 bp, Homo sapien
ctacacgatgcatggggaggatctg

SEQ ID NO: 36282 - DNA, 25 bp, Homo sapien
tatcattatccctccaaacaggcgg

SEQ ID NO: 36283 - DNA, 25 bp, Homo sapien
ttggcatctgatggcttcgtttttc

SEQ ID NO: 36284 - DNA, 25 bp, Homo sapien
acacagaaggccagcgctaactgcg

SEQ ID NO: 36285 - DNA, 25 bp, Homo sapien
aacagtgtttgctggtgcttctgcc

SEQ ID NO: 36286 - DNA, 25 bp, Homo sapien
ggtgcttctgccctccaacggcaga

SEQ ID NO: 36287 - DNA, 25 bp, Homo sapien
gggacagggactctgcacctcatca

SEQ ID NO: 36288 - DNA, 25 bp, Homo sapien
acatacctggtgttttcagggcggc

SEQ ID NO: 36289 - DNA, 25 bp, Homo sapien
acgggacacttccttgctgccgtga

SEQ ID NO: 36290 - DNA, 25 bp, Homo sapien
ccggcgagaaggaacacagaaggcc

SEQ ID NO: 36291 - DNA, 25 bp, Homo sapien
ctgcggcgccagaacagtgtttgct

SEQ ID NO: 36292 - DNA, 25 bp, Homo sapien
gcggaaaggtctcctggctgtctga

SEQ ID NO: 36293 - DNA, 25 bp, Homo sapien
ccgtgcggcctttaccatggtggcg

SEQ ID NO: 36294 - DNA, 25 bp, Homo sapien
tcctggctgtctgaggtccagtccc

SEQ ID NO: 36295 - DNA, 25 bp, Homo sapien
agcgctgccgctcgctacggcagga

SEQ ID NO: 36296 - DNA, 25 bp, Homo sapien
tcgctacggcaggatctggagcgcc

SEQ ID NO: 36297 - DNA, 25 bp, Homo sapien
cctgagcccgggcacgaattgagga

SEQ ID NO: 36298 - DNA, 25 bp, Homo sapien
cacgaattgaggagcctcgggctga

SEQ ID NO: 36299 - DNA, 25 bp, Homo sapien
gggcagggtcactgccacccaagtc

SEQ ID NO: 36300 - DNA, 25 bp, Homo sapien
tagacactgcggacacagcccggtc

SEQ ID NO: 36301 - DNA, 25 bp, Homo sapien
tgagaatcccgacccaggtgaagtg

SEQ ID NO: 36302 - DNA, 25 bp, Homo sapien
acttacccgggtaatcgcggcagca

SEQ ID NO: 36303 - DNA, 25 bp, Homo sapien
agcagcgcgtcgtgtgaacccggca

SEQ ID NO: 36304 - DNA, 25 bp, Homo sapien
ctgtgccatgctcgggtttcaagag

SEQ ID NO: 36305 - DNA, 25 bp, Homo sapien
gtttcaagagcccacagccagttgg

SEQ ID NO: 36306 - DNA, 25 bp, Homo sapien
agagcccacagccagttggacacgc

SEQ ID NO: 36307 - DNA, 25 bp, Homo sapien
tgggaccgttcatgacctgagaatc

SEQ ID NO: 36308 - DNA, 25 bp, Homo sapien
gctctcgcgagactttcaggggtcg

SEQ ID NO: 36309 - DNA, 25 bp, Homo sapien
gcagcggatcatctcgcgatatctg

SEQ ID NO: 36310 - DNA, 25 bp, Homo sapien
tgaagataggtaaggggcttttcgc

SEQ ID NO: 36311 - DNA, 25 bp, Homo sapien
tggaagacagtgtcggggcacaccc

SEQ ID NO: 36312 - DNA, 25 bp, Homo sapien
tgtcggggcacaccctcgtgccgga

SEQ ID NO: 36313 - DNA, 25 bp, Homo sapien
tcgcagagctcttgagtggaagaca

SEQ ID NO: 36314 - DNA, 25 bp, Homo sapien
tccagacaactcgtcaccttgacga

SEQ ID NO: 36315 - DNA, 25 bp, Homo sapien
cgtcaccttgacgaccaactgaaaa

SEQ ID NO: 36316 - DNA, 25 bp, Homo sapien
gtcgctccgtttccgccgctcactt

SEQ ID NO: 36317 - DNA, 25 bp, Homo sapien
agggagccaccctgacgtcggagcc

SEQ ID NO: 36318 - DNA, 25 bp, Homo sapien
ccgcacccagctccgcaggaccggc

SEQ ID NO: 36319 - DNA, 25 bp, Homo sapien
ccagggttccgtttctggatcggag

SEQ ID NO: 36320 - DNA, 25 bp, Homo sapien
cgcgcctctcggctctggacgtttc

SEQ ID NO: 36321 - DNA, 25 bp, Homo sapien
tgcccgcgtttgtgtctctgcctct

SEQ ID NO: 36322 - DNA, 25 bp, Homo sapien
ctccgtgttcggctgcccgcgtttg

SEQ ID NO: 36323 - DNA, 25 bp, Homo sapien
gtttctggatcggagtttccgcggc

SEQ ID NO: 36324 - DNA, 25 bp, Homo sapien
gtgtcgctcttcacgtctgacctga

SEQ ID NO: 36325 - DNA, 25 bp, Homo sapien
gggagcccatccgacctctgcttga

SEQ ID NO: 36326 - DNA, 25 bp, Homo sapien
acactgtgtcctcctgtagtcgctg

SEQ ID NO: 36327 - DNA, 25 bp, Homo sapien
tgagtcgcggtctgttctcacggac

SEQ ID NO: 36328 - DNA, 25 bp, Homo sapien
gcggtctgttctcacggacggtccc

SEQ ID NO: 36329 - DNA, 25 bp, Homo sapien
cgctgtgcgtggtcatcgcgctgac

SEQ ID NO: 36330 - DNA, 25 bp, Homo sapien
tgctgatcgcgctcatctgcactca

SEQ ID NO: 36331 - DNA, 25 bp, Homo sapien
actcgctgctgatcgcgctcatctg

SEQ ID NO: 36332 - DNA, 25 bp, Homo sapien
ttcggactcagacgcaggctcaggc

SEQ ID NO: 36333 - DNA, 25 bp, Homo sapien
ggccttagcctacagcaggtgctgc

SEQ ID NO: 36334 - DNA, 25 bp, Homo sapien
ggcccggccttagcctacagcaggt

SEQ ID NO: 36335 - DNA, 25 bp, Homo sapien
actcagattcggactcagacgcagg

SEQ ID NO: 36336 - DNA, 25 bp, Homo sapien
ccgccgtcaatttcttcaacatcga

SEQ ID NO: 36337 - DNA, 25 bp, Homo sapien
agctgcggccgcatccacttggcat

SEQ ID NO: 36338 - DNA, 25 bp, Homo sapien
gcaggttcctgccatgtccacgctg

SEQ ID NO: 36339 - DNA, 25 bp, Homo sapien
gctgccgccgtcaatttcttcaaca

SEQ ID NO: 36340 - DNA, 25 bp, Homo sapien
ccggcctctgcaggtgaccggcaag

SEQ ID NO: 36341 - DNA, 25 bp, Homo sapien
gaaactgcccgcgaaggactcggcc

SEQ ID NO: 36342 - DNA, 25 bp, Homo sapien
gcacttccggctctgaaaacaaacc

SEQ ID NO: 36343 - DNA, 25 bp, Homo sapien
ccgcttcctggtgggtccagtgtcc

SEQ ID NO: 36344 - DNA, 25 bp, Homo sapien
caggctctgactcgccagctgcggg

SEQ ID NO: 36345 - DNA, 25 bp, Homo sapien
acatctgtgtgtgggtccatttacc

SEQ ID NO: 36346 - DNA, 25 bp, Homo sapien
tgggtccatttaccctccaggaagc

SEQ ID NO: 36347 - DNA, 25 bp, Homo sapien
cagggttggactttgcagaaactgc

SEQ ID NO: 36348 - DNA, 25 bp, Homo sapien
attccatcatgtgaccggggtgctg

SEQ ID NO: 36349 - DNA, 25 bp, Homo sapien
gatcccaaagggtcctaatcatggc

SEQ ID NO: 36350 - DNA, 25 bp, Homo sapien
gagccagccacgctccgagtgcagg

SEQ ID NO: 36351 - DNA, 25 bp, Homo sapien
catccattcattcgggcggcccggg

SEQ ID NO: 36352 - DNA, 25 bp, Homo sapien
caggctaaggccatgtcccgaaagc

SEQ ID NO: 36353 - DNA, 25 bp, Homo sapien
ttcccaacgcttgaggcggacgctg

SEQ ID NO: 36354 - DNA, 25 bp, Homo sapien
gctgttttaccttcccaacgcttga

SEQ ID NO: 36355 - DNA, 25 bp, Homo sapien
cctaatcatggcagacgccgcgagc

SEQ ID NO: 36356 - DNA, 25 bp, Homo sapien
cctctcgcagtctgtggaccaggca

SEQ ID NO: 36357 - DNA, 25 bp, Homo sapien
gcggcgactctaaggtcaccgtacc

SEQ ID NO: 36358 - DNA, 25 bp, Homo sapien
ctactccggaccctccagttggtgg

SEQ ID NO: 36359 - DNA, 25 bp, Homo sapien
ctgagcgctcgcagggccgagcatc

SEQ ID NO: 36360 - DNA, 25 bp, Homo sapien
gcctcatagcgctggcaccgggagc

SEQ ID NO: 36361 - DNA, 25 bp, Homo sapien
ctggggatcttgttgtcgtccagtg

SEQ ID NO: 36362 - DNA, 25 bp, Homo sapien
atcgccaccgatagccgcggcggtg

SEQ ID NO: 36363 - DNA, 25 bp, Homo sapien
gccgagcatccggagagcacaggca

SEQ ID NO: 36364 - DNA, 25 bp, Homo sapien
cggtcacgccggaagcacgtggccc

SEQ ID NO: 36365 - DNA, 25 bp, Homo sapien
agcggaacggctaggtgagagcggc

SEQ ID NO: 36366 - DNA, 25 bp, Homo sapien
ctccaggccaggcaatccactccag

SEQ ID NO: 36367 - DNA, 25 bp, Homo sapien
cctgtcgcctccaggccaggcaatc

SEQ ID NO: 36368 - DNA, 25 bp, Homo sapien
ttgtttaccagcaggacagagcccg

SEQ ID NO: 36369 - DNA, 25 bp, Homo sapien
gccggttccggtcacgccggaagca

SEQ ID NO: 36370 - DNA, 25 bp, Homo sapien
cgacctggagttcacggcctccgcc

SEQ ID NO: 36371 - DNA, 25 bp, Homo sapien
aggctcgcaatccaccgacctggag

SEQ ID NO: 36372 - DNA, 25 bp, Homo sapien
agtttcccagactgctcttggtccc

SEQ ID NO: 36373 - DNA, 25 bp, Homo sapien
tgcgcaagagtctccgccactcttg

SEQ ID NO: 36374 - DNA, 25 bp, Homo sapien
gacctggggctctagcactgactaa

SEQ ID NO: 36375 - DNA, 25 bp, Homo sapien
ctcggggaccgagtttcccagactg

SEQ ID NO: 36376 - DNA, 25 bp, Homo sapien
tctccgccactcttgtccgggtggg

SEQ ID NO: 36377 - DNA, 25 bp, Homo sapien
tccgggtgggaatcaaactctagcg

SEQ ID NO: 36378 - DNA, 25 bp, Homo sapien
gactaagtcactgcacctgcgcaag

SEQ ID NO: 36379 - DNA, 25 bp, Homo sapien
tggggctctagcactgactaagtca

SEQ ID NO: 36380 - DNA, 25 bp, Homo sapien
caggatgccgacctatggagcgaga

SEQ ID NO: 36381 - DNA, 25 bp, Homo sapien
ctgccttcgagacagagacgtcctc

SEQ ID NO: 36382 - DNA, 25 bp, Homo sapien
acagagacgtcctcggactgggacc

SEQ ID NO: 36383 - DNA, 25 bp, Homo sapien
ctgggcaaggccctggtcaaaggcc

SEQ ID NO: 36384 - DNA, 25 bp, Homo sapien
gccctggtcaaaggcctgcacgaca

SEQ ID NO: 36385 - DNA, 25 bp, Homo sapien
gccatcatccgcgacttcgagcagc

SEQ ID NO: 36386 - DNA, 25 bp, Homo sapien
tgcacgacagccaacgcctgcagtg

SEQ ID NO: 36387 - DNA, 25 bp, Homo sapien
acctatggagcgagaccttccacca

SEQ ID NO: 36388 - DNA, 25 bp, Homo sapien
cttggcagcgataccttaataaata

SEQ ID NO: 36389 - DNA, 25 bp, Homo sapien
aattagcctgcgcacacttggcagc

SEQ ID NO: 36390 - DNA, 25 bp, Homo sapien
gggcacattaagagcaattagcctg

SEQ ID NO: 36391 - DNA, 25 bp, Homo sapien
gctggctctgtctccacgaaggcgt

SEQ ID NO: 36392 - DNA, 25 bp, Homo sapien
tgctgacgtcggaagatccaggcga

SEQ ID NO: 36393 - DNA, 25 bp, Homo sapien
ccgcctctcgggattggcacgtgca

SEQ ID NO: 36394 - DNA, 25 bp, Homo sapien
tattagagcgcattacgcgggcagg

SEQ ID NO: 36395 - DNA, 25 bp, Homo sapien
taacccacaatcctgccaattaaac

SEQ ID NO: 36396 - DNA, 25 bp, Homo sapien
gccttgttcccgagctgtggcctcg

SEQ ID NO: 36397 - DNA, 25 bp, Homo sapien
gctctgtgctgctcgaaggataccc

SEQ ID NO: 36398 - DNA, 25 bp, Homo sapien
acaccagcttgagaagattcccgca

SEQ ID NO: 36399 - DNA, 25 bp, Homo sapien
cttgagaagattcccgcacggccgg

SEQ ID NO: 36400 - DNA, 25 bp, Homo sapien
agctgggagctcatctgaacacgcc

SEQ ID NO: 36401 - DNA, 25 bp, Homo sapien
ggtgtcttccctgcgggaagcctgc

SEQ ID NO: 36402 - DNA, 25 bp, Homo sapien
cacagatgtcgcttagacgcccggg

SEQ ID NO: 36403 - DNA, 25 bp, Homo sapien
tccgcctcccgagggacacagatgt

SEQ ID NO: 36404 - DNA, 25 bp, Homo sapien
aggactcacatcctcggcgcgctgg

SEQ ID NO: 36405 - DNA, 25 bp, Homo sapien
gggagacctccgcaacccttgttca

SEQ ID NO: 36406 - DNA, 25 bp, Homo sapien
gcgccgaagaagttgttggtgtcct

SEQ ID NO: 36407 - DNA, 25 bp, Homo sapien
ctgcaagaagggattccgtcaggtc

SEQ ID NO: 36408 - DNA, 25 bp, Homo sapien
tagggcagcacctccgacatggtcg

SEQ ID NO: 36409 - DNA, 25 bp, Homo sapien
ccgtcaggtctgaacgggctccagc

SEQ ID NO: 36410 - DNA, 25 bp, Homo sapien
ccagaggcgagcaggactcacatcc

SEQ ID NO: 36411 - DNA, 25 bp, Homo sapien
caggagaagatctggcccacgtcgc

SEQ ID NO: 36412 - DNA, 25 bp, Homo sapien
gccttctgccggtacacggagtaca

SEQ ID NO: 36413 - DNA, 25 bp, Homo sapien
ttgcccgggtgacaatcaagctgct

SEQ ID NO: 36414 - DNA, 25 bp, Homo sapien
agcgatgacgcacgacgccggaacc

SEQ ID NO: 36415 - DNA, 25 bp, Homo sapien
actcgaaatcagtcgcccagcgatg

SEQ ID NO: 36416 - DNA, 25 bp, Homo sapien
taacctgaccggaaactcgaaatca

SEQ ID NO: 36417 - DNA, 25 bp, Homo sapien
gcgccaaggataggcctggtgaccc

SEQ ID NO: 36418 - DNA, 25 bp, Homo sapien
aacacggcgcactggccatgactga

SEQ ID NO: 36419 - DNA, 25 bp, Homo sapien
gcccaggaggatgaactggcacagc

SEQ ID NO: 36420 - DNA, 25 bp, Homo sapien
ctcaacaaggaggacccgacctaca

SEQ ID NO: 36421 - DNA, 25 bp, Homo sapien
tgggcatctccaggcaacgactgtc

SEQ ID NO: 36422 - DNA, 25 bp, Homo sapien
gctgccctggagacgtaacaaattc

SEQ ID NO: 36423 - DNA, 25 bp, Homo sapien
ctacaccgtgtggtacctgggcaac

SEQ ID NO: 36424 - DNA, 25 bp, Homo sapien
gcatcacctactgcacggcggacgg

SEQ ID NO: 36425 - DNA, 25 bp, Homo sapien
tgctcaatgccaagtgcgcctaccg

SEQ ID NO: 36426 - DNA, 25 bp, Homo sapien
gcatctgcgaagctagccctgcctg

SEQ ID NO: 36427 - DNA, 25 bp, Homo sapien
accgacgacgccgtgggcaagatct

SEQ ID NO: 36428 - DNA, 25 bp, Homo sapien
gcttcttccgccagtcggtggccgg

SEQ ID NO: 36429 - DNA, 25 bp, Homo sapien
gcctgcagctgggtcgagcgctgct

SEQ ID NO: 36430 - DNA, 25 bp, Homo sapien
cggtctcggcctgtcaggagatcca

SEQ ID NO: 36431 - DNA, 25 bp, Homo sapien
gctccctaaccgtctccgcttcttc

SEQ ID NO: 36432 - DNA, 25 bp, Homo sapien
gcccttgcggccgggcagtctttct

SEQ ID NO: 36433 - DNA, 25 bp, Homo sapien
ggctgggcctcatcgaggaaaaaca

SEQ ID NO: 36434 - DNA, 25 bp, Homo sapien
atcgaggaaaaacaggcggagagcc

SEQ ID NO: 36435 - DNA, 25 bp, Homo sapien
tgctgcgcttcacgggcaagcccgg

SEQ ID NO: 36436 - DNA, 25 bp, Homo sapien
agtctggagcccacttccctctgga

SEQ ID NO: 36437 - DNA, 25 bp, Homo sapien
gtggattccttgaaccctattggtg

SEQ ID NO: 36438 - DNA, 25 bp, Homo sapien
gtccagagccgcagctttggcgata

SEQ ID NO: 36439 - DNA, 25 bp, Homo sapien
cgtggagcactacccggaagtgatc

SEQ ID NO: 36440 - DNA, 25 bp, Homo sapien
acgttgaggttgtccagcagcacta

SEQ ID NO: 36441 - DNA, 25 bp, Homo sapien
agcgaatgagtctcccgcacgttga

SEQ ID NO: 36442 - DNA, 25 bp, Homo sapien
agagtggtcaatgccctcgatgctg

SEQ ID NO: 36443 - DNA, 25 bp, Homo sapien
tcacccttcaggctccggaagaaaa

SEQ ID NO: 36444 - DNA, 25 bp, Homo sapien
ctcggcagcttcaggtttgtttttc

SEQ ID NO: 36445 - DNA, 25 bp, Homo sapien
gctggctccacgtccaggcgatctt

SEQ ID NO: 36446 - DNA, 25 bp, Homo sapien
ggtgatgctcccagcgagctccaga

SEQ ID NO: 36447 - DNA, 25 bp, Homo sapien
ctcttgtcaggtttgtgtgttgttg

SEQ ID NO: 36448 - DNA, 25 bp, Homo sapien
tggctcctggcgctacattcgggag

SEQ ID NO: 36449 - DNA, 25 bp, Homo sapien
ccaagacacagttgtttctgacaca

SEQ ID NO: 36450 - DNA, 25 bp, Homo sapien
tggccagttcgtagaagagcaggta

SEQ ID NO: 36451 - DNA, 25 bp, Homo sapien
ttctgacacataggaagaccacaag

SEQ ID NO: 36452 - DNA, 25 bp, Homo sapien
accactctgacgcagtgtccactag

SEQ ID NO: 36453 - DNA, 25 bp, Homo sapien
aacggcgtcgctactccctggtgac

SEQ ID NO: 36454 - DNA, 25 bp, Homo sapien
ggacccgccaggaacggcgtcgcta

SEQ ID NO: 36455 - DNA, 25 bp, Homo sapien
ggaggcagtgccctacttactggac

SEQ ID NO: 36456 - DNA, 25 bp, Homo sapien
cccatccgtggcactccagggaccc

SEQ ID NO: 36457 - DNA, 25 bp, Homo sapien
tctgacgcagtgtccactaggccgc

SEQ ID NO: 36458 - DNA, 25 bp, Homo sapien
gctactccctggtgaccaccagggg

SEQ ID NO: 36459 - DNA, 25 bp, Homo sapien
cagtgccctacttactggacagcgg

SEQ ID NO: 36460 - DNA, 25 bp, Homo sapien
gatgacattgcccagtgccgagagc

SEQ ID NO: 36461 - DNA, 25 bp, Homo sapien
ctcatcgtagttgttgtccgcaggc

SEQ ID NO: 36462 - DNA, 25 bp, Homo sapien
gtcctcattgatgcgcggcttgttc

SEQ ID NO: 36463 - DNA, 25 bp, Homo sapien
tccaccagcgccgagatgacattgc

SEQ ID NO: 36464 - DNA, 25 bp, Homo sapien
agcagcgcatccttggggtcctcat

SEQ ID NO: 36465 - DNA, 25 bp, Homo sapien
gcagcgtgctgagtgtctcatcgta

SEQ ID NO: 36466 - DNA, 25 bp, Homo sapien
agcagccgcgtcagcttcgagtcac

SEQ ID NO: 36467 - DNA, 25 bp, Homo sapien
accatgagcgtcttggtgttgccgc

SEQ ID NO: 36468 - DNA, 25 bp, Homo sapien
atctcgttgtagatctgctcggtga

SEQ ID NO: 36469 - DNA, 25 bp, Homo sapien
aggaccaacgggaccagagctgacc

SEQ ID NO: 36470 - DNA, 25 bp, Homo sapien
tgggcaacgcccgtggcgtcacaag

SEQ ID NO: 36471 - DNA, 25 bp, Homo sapien
tttcgcgtccgctgccttctcgaat

SEQ ID NO: 36472 - DNA, 25 bp, Homo sapien
tccgcacagtcccagttcagagatg

SEQ ID NO: 36473 - DNA, 25 bp, Homo sapien
ttcagagatgttacgcagcttgccc

SEQ ID NO: 36474 - DNA, 25 bp, Homo sapien
cttgcccgaggctgcggctaagact

SEQ ID NO: 36475 - DNA, 25 bp, Homo sapien
tccaccagcggataggcgatctcgt

SEQ ID NO: 36476 - DNA, 25 bp, Homo sapien
tcttactcgaggacaagtgacactg

SEQ ID NO: 36477 - DNA, 25 bp, Homo sapien
actcacgcttcattctctgcagagc

SEQ ID NO: 36478 - DNA, 25 bp, Homo sapien
ctgcagagcccttgtgactccgttg

SEQ ID NO: 36479 - DNA, 25 bp, Homo sapien
tggagggtcgttgcgcatcctcctc

SEQ ID NO: 36480 - DNA, 25 bp, Homo sapien
gtgactccgttgctcgcctgtcatc

SEQ ID NO: 36481 - DNA, 25 bp, Homo sapien
aagtgacactggaccggagtgtctc

SEQ ID NO: 36482 - DNA, 25 bp, Homo sapien
ggagtgtctccgttcccagtgtgaa

SEQ ID NO: 36483 - DNA, 25 bp, Homo sapien
ttcccagtgtgaaggatcgagcctg

SEQ ID NO: 36484 - DNA, 25 bp, Homo sapien
aggcgaggtagctacaggccacagc

SEQ ID NO: 36485 - DNA, 25 bp, Homo sapien
gttcggtcctgcgttacctctgcgt

SEQ ID NO: 36486 - DNA, 25 bp, Homo sapien
aaggcagacaaaaggcgccacctcc

SEQ ID NO: 36487 - DNA, 25 bp, Homo sapien
tgaggaggagtccaccaaaagggca

SEQ ID NO: 36488 - DNA, 25 bp, Homo sapien
caaacaaaacaagggcgggagcgcg

SEQ ID NO: 36489 - DNA, 25 bp, Homo sapien
cgaaccggctccgaaaaccgctgag

SEQ ID NO: 36490 - DNA, 25 bp, Homo sapien
accactgggagctccgtaatggcgg

SEQ ID NO: 36491 - DNA, 25 bp, Homo sapien
accgcggacaccgacggatgaggct

SEQ ID NO: 36492 - DNA, 25 bp, Homo sapien
tcggagactcccgtctgccaaggtt

SEQ ID NO: 36493 - DNA, 25 bp, Homo sapien
cccgtctgccaaggtttttattgtg

SEQ ID NO: 36494 - DNA, 25 bp, Homo sapien
cctagaacggtgcagagttggccca

SEQ ID NO: 36495 - DNA, 25 bp, Homo sapien
ggcagccatcggcacctagaacggt

SEQ ID NO: 36496 - DNA, 25 bp, Homo sapien
tctgccaaggtttttattgtggtcc

SEQ ID NO: 36497 - DNA, 25 bp, Homo sapien
tgcatggcatacgtaagcagagagc

SEQ ID NO: 36498 - DNA, 25 bp, Homo sapien
cggaggcagccatcggcacctagaa

SEQ ID NO: 36499 - DNA, 25 bp, Homo sapien
gcaggaggtatgcatggcatacgta

SEQ ID NO: 36500 - DNA, 25 bp, Homo sapien
cggggacttcgcgtaaccaatgcca

SEQ ID NO: 36501 - DNA, 25 bp, Homo sapien
ggtggattttcttcactcaacgagc

SEQ ID NO: 36502 - DNA, 25 bp, Homo sapien
acgagcagagcatccaacatggcgc

SEQ ID NO: 36503 - DNA, 25 bp, Homo sapien
cggctgctcggaaaacttcggactt

SEQ ID NO: 36504 - DNA, 25 bp, Homo sapien
cttcggactttttcggaatggctcg

SEQ ID NO: 36505 - DNA, 25 bp, Homo sapien
ggtgggaagcctcttcggctctttc

SEQ ID NO: 36506 - DNA, 25 bp, Homo sapien
ggcccagcctcgaagaacaatggta

SEQ ID NO: 36507 - DNA, 25 bp, Homo sapien
agagaccggacctttcacggcaata

SEQ ID NO: 36508 - DNA, 25 bp, Homo sapien
ttcttccaccatggccggaggttcc

SEQ ID NO: 36509 - DNA, 25 bp, Homo sapien
aggcctccacggatgagttcttcca

SEQ ID NO: 36510 - DNA, 25 bp, Homo sapien
accatgcactcggtctgacgcttga

SEQ ID NO: 36511 - DNA, 25 bp, Homo sapien
acgctgtagttgctgtactgctcta

SEQ ID NO: 36512 - DNA, 25 bp, Homo sapien
tctcacccgataggccgccttgaga

SEQ ID NO: 36513 - DNA, 25 bp, Homo sapien
gatcctctacggacaggcatctgga

SEQ ID NO: 36514 - DNA, 25 bp, Homo sapien
tcggcatcgcgattggtcctcgcca

SEQ ID NO: 36515 - DNA, 25 bp, Homo sapien
cggaggttcccgtccttgtcatact

SEQ ID NO: 36516 - DNA, 25 bp, Homo sapien
aggcgttgcaccaccttcgcgggcg

SEQ ID NO: 36517 - DNA, 25 bp, Homo sapien
aaatgcagcacggactccctcagcg

SEQ ID NO: 36518 - DNA, 25 bp, Homo sapien
tgcaaggccaaatgcagcacggact

SEQ ID NO: 36519 - DNA, 25 bp, Homo sapien
cttgtacgtcgacatctgcaaggcc

SEQ ID NO: 36520 - DNA, 25 bp, Homo sapien
cagcgtggcccgcttgtacgtcgac

SEQ ID NO: 36521 - DNA, 25 bp, Homo sapien
gagagcgagtccaccaggtcctcct

SEQ ID NO: 36522 - DNA, 25 bp, Homo sapien
ggaaggcttctcagcgcggagctcc

SEQ ID NO: 36523 - DNA, 25 bp, Homo sapien
tatgcgtcgccctcggagagcgagt

SEQ ID NO: 36524 - DNA, 25 bp, Homo sapien
ggacttcagaacaacccaaaacaga

SEQ ID NO: 36525 - DNA, 25 bp, Homo sapien
accggcgttgggagctagcagaacc

SEQ ID NO: 36526 - DNA, 25 bp, Homo sapien
gcagggtccagaccttgccgagacc

SEQ ID NO: 36527 - DNA, 25 bp, Homo sapien
gaacaacccaaaacagaccgcagca

SEQ ID NO: 36528 - DNA, 25 bp, Homo sapien
aagccaagctgagtccagggacttc

SEQ ID NO: 36529 - DNA, 25 bp, Homo sapien
ctgggtctccaagccaagctgagtc

SEQ ID NO: 36530 - DNA, 25 bp, Homo sapien
tagccctccgaatgcgccgggcgtg

SEQ ID NO: 36531 - DNA, 25 bp, Homo sapien
gcccttaacccttggcgcgctggga

SEQ ID NO: 36532 - DNA, 25 bp, Homo sapien
ttccagttccgcagcagcggaggcc

SEQ ID NO: 36533 - DNA, 25 bp, Homo sapien
ggaagcccagctctcaggcggtgaa

SEQ ID NO: 36534 - DNA, 25 bp, Homo sapien
ctggtggccgtgagcttgtcccgca

SEQ ID NO: 36535 - DNA, 25 bp, Homo sapien
tcccgcagctcggagatgctgctta

SEQ ID NO: 36536 - DNA, 25 bp, Homo sapien
cgcctcgtcattggtcgtgcgcctg

SEQ ID NO: 36537 - DNA, 25 bp, Homo sapien
tggtgacgtcagtggttccagttcc

SEQ ID NO: 36538 - DNA, 25 bp, Homo sapien
gacgtgagacaccagctgacgcccg

SEQ ID NO: 36539 - DNA, 25 bp, Homo sapien
ggggctgggacagcgtctttaatcc

SEQ ID NO: 36540 - DNA, 25 bp, Homo sapien
tcaacgacctggacatgcagctgta

SEQ ID NO: 36541 - DNA, 25 bp, Homo sapien
gctcgagagcgccaagaagaacctg

SEQ ID NO: 36542 - DNA, 25 bp, Homo sapien
gtgggctgctacaacctgtccttca

SEQ ID NO: 36543 - DNA, 25 bp, Homo sapien
tgaccgagttccagcgcaagacgca

SEQ ID NO: 36544 - DNA, 25 bp, Homo sapien
cagtacctgttcgagcggacgttca

SEQ ID NO: 36545 - DNA, 25 bp, Homo sapien
gcggacgttcaacctcaagttcatc

SEQ ID NO: 36546 - DNA, 25 bp, Homo sapien
tcatccggcccttcatgcagtacaa

SEQ ID NO: 36547 - DNA, 25 bp, Homo sapien
caggagttcatggactgcccgtaca

SEQ ID NO: 36548 - DNA, 25 bp, Homo sapien
accgcggtgctactcgccaggcaga

SEQ ID NO: 36549 - DNA, 25 bp, Homo sapien
tgagcggctccaagtgcaccgtgga

SEQ ID NO: 36550 - DNA, 25 bp, Homo sapien
tactcgccaggcagaggccgttcgc

SEQ ID NO: 36551 - DNA, 25 bp, Homo sapien
gctccaagtgcaccgtggatgcgtc

SEQ ID NO: 36552 - DNA, 25 bp, Homo sapien
ccaagtgcaccgtggatgcgtcgga

SEQ ID NO: 36553 - DNA, 25 bp, Homo sapien
atccactccgccttgcacaagcacc

SEQ ID NO: 36554 - DNA, 25 bp, Homo sapien
ccgtggatgcgtcggagcgcagcct

SEQ ID NO: 36555 - DNA, 25 bp, Homo sapien
tgctactcgccaggcagaggccgtt

SEQ ID NO: 36556 - DNA, 25 bp, Homo sapien
ctgcactcggtgcatcacctaggtt

SEQ ID NO: 36557 - DNA, 25 bp, Homo sapien
gaggatcccgagactgagtgagctt

SEQ ID NO: 36558 - DNA, 25 bp, Homo sapien
tgaggatcccgagactgagtgagct

SEQ ID NO: 36559 - DNA, 25 bp, Homo sapien
tactgggatgggtaggtgaggatcc

SEQ ID NO: 36560 - DNA, 25 bp, Homo sapien
cctgttgtgcagtagaggccgccga

SEQ ID NO: 36561 - DNA, 25 bp, Homo sapien
atcacctaggttactccttttctcg

SEQ ID NO: 36562 - DNA, 25 bp, Homo sapien
actcggtgcatcacctaggttactc

SEQ ID NO: 36563 - DNA, 25 bp, Homo sapien
ggtgcatcacctaggttactccttt

SEQ ID NO: 36564 - DNA, 25 bp, Homo sapien
tgatgttcacgaaggtttttccctg

SEQ ID NO: 36565 - DNA, 25 bp, Homo sapien
tccacctggccgttgcgcggctgcg

SEQ ID NO: 36566 - DNA, 25 bp, Homo sapien
tggccgcgaacctaacaggtcccat

SEQ ID NO: 36567 - DNA, 25 bp, Homo sapien
cccatccgccacgaggctgtagata

SEQ ID NO: 36568 - DNA, 25 bp, Homo sapien
cggagagctgcgtgcaggcactgcc

SEQ ID NO: 36569 - DNA, 25 bp, Homo sapien
catccgccacgaggctgtagataga

SEQ ID NO: 36570 - DNA, 25 bp, Homo sapien
cacgatggccgcgaacctaacaggt

SEQ ID NO: 36571 - DNA, 25 bp, Homo sapien
cgatggccgcgaacctaacaggtcc

SEQ ID NO: 36572 - DNA, 25 bp, Homo sapien
gggacgccctgcaattggtcctgcc

SEQ ID NO: 36573 - DNA, 25 bp, Homo sapien
agcccattcgggacgccctgcaatt

SEQ ID NO: 36574 - DNA, 25 bp, Homo sapien
cccgtggttgaactttaatggcagg

SEQ ID NO: 36575 - DNA, 25 bp, Homo sapien
cgcagaaggaagatgccgacggtaa

SEQ ID NO: 36576 - DNA, 25 bp, Homo sapien
tgccgacggtaaagacaaaacagga

SEQ ID NO: 36577 - DNA, 25 bp, Homo sapien
cgcgcaaggagcaggtcagagccca

SEQ ID NO: 36578 - DNA, 25 bp, Homo sapien
ctctgcgcaggtaaggattcgacgc

SEQ ID NO: 36579 - DNA, 25 bp, Homo sapien
tcccacgcgcttgtgcctggacgga

SEQ ID NO: 36580 - DNA, 25 bp, Homo sapien
ggagctgccgccactccatcccgca

SEQ ID NO: 36581 - DNA, 25 bp, Homo sapien
cccaatatggcctccgtcctgagag

SEQ ID NO: 36582 - DNA, 25 bp, Homo sapien
cccgcggacgacaacctcttccacg

SEQ ID NO: 36583 - DNA, 25 bp, Homo sapien
gggcagaggggcaacgtccccaata

SEQ ID NO: 36584 - DNA, 25 bp, Homo sapien
agagaacagcgcgtgcaggcagcct

SEQ ID NO: 36585 - DNA, 25 bp, Homo sapien
tcttccacggttcctatgcctatgg

SEQ ID NO: 36586 - DNA, 25 bp, Homo sapien
ggttcctatgcctatggcactgccc

SEQ ID NO: 36587 - DNA, 25 bp, Homo sapien
aatatggcctccgtcctgagagcga

SEQ ID NO: 36588 - DNA, 25 bp, Homo sapien
cacaccgtgttctgggagcggctgc

SEQ ID NO: 36589 - DNA, 25 bp, Homo sapien
tggcctgcactcgtggcagcaccgg

SEQ ID NO: 36590 - DNA, 25 bp, Homo sapien
actcgtggcagcaccggtcgttgct

SEQ ID NO: 36591 - DNA, 25 bp, Homo sapien
ccagtccctggagtgcccgtgcgtg

SEQ ID NO: 36592 - DNA, 25 bp, Homo sapien
cgcacggacggcacaccgtgttctg

SEQ ID NO: 36593 - DNA, 25 bp, Homo sapien
gaccacgtcgttgtagaagcccggc

SEQ ID NO: 36594 - DNA, 25 bp, Homo sapien
gcttgcacggcttggagctgaccac

SEQ ID NO: 36595 - DNA, 25 bp, Homo sapien
cttggagctgaccacgtcgttgtag

SEQ ID NO: 36596 - DNA, 25 bp, Homo sapien
cgttccggcccgagcgctagaagct

SEQ ID NO: 36597 - DNA, 25 bp, Homo sapien
gtggccagtgtcagcccagaagctc

SEQ ID NO: 36598 - DNA, 25 bp, Homo sapien
ccagaagctcacacgcccaccatga

SEQ ID NO: 36599 - DNA, 25 bp, Homo sapien
acgcccaccatgacggagccttgtc

SEQ ID NO: 36600 - DNA, 25 bp, Homo sapien
gcgggccgcagctgtgccatcctga

SEQ ID NO: 36601 - DNA, 25 bp, Homo sapien
gcagctgtgccatcctgagcgcggc

SEQ ID NO: 36602 - DNA, 25 bp, Homo sapien
cccgagcgctagaagctttgggtgc

SEQ ID NO: 36603 - DNA, 25 bp, Homo sapien
cccgtggccagtgtcagcccagaag

SEQ ID NO: 36604 - DNA, 25 bp, Homo sapien
tgcgcgcactgaggtcaaacgctca

SEQ ID NO: 36605 - DNA, 25 bp, Homo sapien
ccgcagaccctctgttggagggacg

SEQ ID NO: 36606 - DNA, 25 bp, Homo sapien
agcacgacagccatgcgcgcactga

SEQ ID NO: 36607 - DNA, 25 bp, Homo sapien
cagccatgcgcgcactgaggtcaaa

SEQ ID NO: 36608 - DNA, 25 bp, Homo sapien
cccgaaggtgaagctgcgcttccgg

SEQ ID NO: 36609 - DNA, 25 bp, Homo sapien
ccggcgcagaaagggccgcttgttc

SEQ ID NO: 36610 - DNA, 25 bp, Homo sapien
gcgccacgccctacccgccgtaggc

SEQ ID NO: 36611 - DNA, 25 bp, Homo sapien
agaaagggccgcttgttcgcgccgc

SEQ ID NO: 36612 - DNA, 25 bp, Homo sapien
tcccagctcacaagggcgcacctgc

SEQ ID NO: 36613 - DNA, 25 bp, Homo sapien
gtgcgcagatcacggggccgcacct

SEQ ID NO: 36614 - DNA, 25 bp, Homo sapien
cataagaactgcaggcgacggccgc

SEQ ID NO: 36615 - DNA, 25 bp, Homo sapien
tctctaatgggtccgggagtccgcc

SEQ ID NO: 36616 - DNA, 25 bp, Homo sapien
cgggcgccaccaattggccgtcata

SEQ ID NO: 36617 - DNA, 25 bp, Homo sapien
gacccgttctctcggtgcgcagatc

SEQ ID NO: 36618 - DNA, 25 bp, Homo sapien
acgtgttctctaatgggtccgggag

SEQ ID NO: 36619 - DNA, 25 bp, Homo sapien
accaattggccgtcataagaactgc

SEQ ID NO: 36620 - DNA, 25 bp, Homo sapien
ttgaggctcagctcgggataagtga

SEQ ID NO: 36621 - DNA, 25 bp, Homo sapien
ataagtgatctttggggcccgcaga

SEQ ID NO: 36622 - DNA, 25 bp, Homo sapien
ggcgagaccgctacaggacagcgtc

SEQ ID NO: 36623 - DNA, 25 bp, Homo sapien
cacgcggacccgaacgaggcgacaa

SEQ ID NO: 36624 - DNA, 25 bp, Homo sapien
ttggccctcgcttaacgttggcagc

SEQ ID NO: 36625 - DNA, 25 bp, Homo sapien
ggcccgcgtaccttggctttgttga

SEQ ID NO: 36626 - DNA, 25 bp, Homo sapien
ccttggctttgttgagcaggagccc

SEQ ID NO: 36627 - DNA, 25 bp, Homo sapien
tcacggtgtacgaggtgcgcatgct

SEQ ID NO: 36628 - DNA, 25 bp, Homo sapien
ccgctcagggtccttgatctgaggc

SEQ ID NO: 36629 - DNA, 25 bp, Homo sapien
cgtgaattcccaccgagtcctcaga

SEQ ID NO: 36630 - DNA, 25 bp, Homo sapien
agtcctcagatcctgccgagccagg

SEQ ID NO: 36631 - DNA, 25 bp, Homo sapien
tctggggatgcaaggacatcaccgc

SEQ ID NO: 36632 - DNA, 25 bp, Homo sapien
gggcgcccaacttcgtgacgcgtgt

SEQ ID NO: 36633 - DNA, 25 bp, Homo sapien
cgcggcctggaccaagtccaacagg

SEQ ID NO: 36634 - DNA, 25 bp, Homo sapien
ggatggaggaaacgcgcccacttcc

SEQ ID NO: 36635 - DNA, 25 bp, Homo sapien
tctccagctgctgtcaagaccgggc

SEQ ID NO: 36636 - DNA, 25 bp, Homo sapien
gttgaccctcgccagcccattcgcg

SEQ ID NO: 36637 - DNA, 25 bp, Homo sapien
gcagaggccacgcggttgaccctcg

SEQ ID NO: 36638 - DNA, 25 bp, Homo sapien
ccatgggctccgcttgtctgcaggc

SEQ ID NO: 36639 - DNA, 25 bp, Homo sapien
cacaggcttcgctgggcgagaaagc

SEQ ID NO: 36640 - DNA, 25 bp, Homo sapien
cattcgcggctcttggactttgtct

SEQ ID NO: 36641 - DNA, 25 bp, Homo sapien
tgccctggctgacgccctcctcacc

SEQ ID NO: 36642 - DNA, 25 bp, Homo sapien
cccattcgcggctcttggactttgt

SEQ ID NO: 36643 - DNA, 25 bp, Homo sapien
tgtctctggactgggcagctcgccc

SEQ ID NO: 36644 - DNA, 25 bp, Homo sapien
taacttgagcctagaccggttccga

SEQ ID NO: 36645 - DNA, 25 bp, Homo sapien
agaggctactcaacgcacacacagg

SEQ ID NO: 36646 - DNA, 25 bp, Homo sapien
catgaagttttcacgctagaggcta

SEQ ID NO: 36647 - DNA, 25 bp, Homo sapien
cgaaagctatttcttgcctccggta

SEQ ID NO: 36648 - DNA, 25 bp, Homo sapien
ggcgcactacgtaccactactctaa

SEQ ID NO: 36649 - DNA, 25 bp, Homo sapien
gcagctggccagtcaatcacctgtg

SEQ ID NO: 36650 - DNA, 25 bp, Homo sapien
gtaagcggtctcgatgtgctcctgc

SEQ ID NO: 36651 - DNA, 25 bp, Homo sapien
cgagtcgccaaagaaaccagtgttg

SEQ ID NO: 36652 - DNA, 25 bp, Homo sapien
aggttctacttcgtggctccggaca

SEQ ID NO: 36653 - DNA, 25 bp, Homo sapien
ggatccgcttccagttccgcttctt

SEQ ID NO: 36654 - DNA, 25 bp, Homo sapien
agttccgcttcttcctggtctacag

SEQ ID NO: 36655 - DNA, 25 bp, Homo sapien
cactgtgcggcctgaacatcccggt

SEQ ID NO: 36656 - DNA, 25 bp, Homo sapien
tccggacaccgactgcgggctctgg

SEQ ID NO: 36657 - DNA, 25 bp, Homo sapien
gaacatcccggtgcctgtggcatcc

SEQ ID NO: 36658 - DNA, 25 bp, Homo sapien
tgcgcctggtcacgagaggccgcca

SEQ ID NO: 36659 - DNA, 25 bp, Homo sapien
cttcgtgggcgaagtcacctctttc

SEQ ID NO: 36660 - DNA, 25 bp, Homo sapien
tagcagcaaagcgtggcatcgcctc

SEQ ID NO: 36661 - DNA, 25 bp, Homo sapien
atactcgacattgtcgggctggggc

SEQ ID NO: 36662 - DNA, 25 bp, Homo sapien
ataataatatactcgacattgtcgg

SEQ ID NO: 36663 - DNA, 25 bp, Homo sapien
gcaaagcgtggcatcgcctcggttt

SEQ ID NO: 36664 - DNA, 25 bp, Homo sapien
cggtagcagcaaagcgtggcatcgc

SEQ ID NO: 36665 - DNA, 25 bp, Homo sapien
gcgtggcatcgcctcggtttcttac

SEQ ID NO: 36666 - DNA, 25 bp, Homo sapien
ggcatcgcctcggtttcttacaaaa

SEQ ID NO: 36667 - DNA, 25 bp, Homo sapien
catcgcctcggtttcttacaaaaat

SEQ ID NO: 36668 - DNA, 25 bp, Homo sapien
agggcgtccaccattcacccgcagg

SEQ ID NO: 36669 - DNA, 25 bp, Homo sapien
tcccgaggaggctgctcttacctcg

SEQ ID NO: 36670 - DNA, 25 bp, Homo sapien
gaggaggctgctcttacctcgccca

SEQ ID NO: 36671 - DNA, 25 bp, Homo sapien
cacacagccgcggaagtgagcgctc

SEQ ID NO: 36672 - DNA, 25 bp, Homo sapien
caggttgaggccctggctcttgccg

SEQ ID NO: 36673 - DNA, 25 bp, Homo sapien
gcaggctgccgtccttgttgagacg

SEQ ID NO: 36674 - DNA, 25 bp, Homo sapien
cgtccttgttgagacgctctgcaga

SEQ ID NO: 36675 - DNA, 25 bp, Homo sapien
agccgcggaagtgagcgctcatgtt

SEQ ID NO: 36676 - DNA, 25 bp, Homo sapien
aacgtggcccggatcaggagctcat

SEQ ID NO: 36677 - DNA, 25 bp, Homo sapien
ccggcgccagaattcctgggttggg

SEQ ID NO: 36678 - DNA, 25 bp, Homo sapien
gctgggcgacctccaggctgactgc

SEQ ID NO: 36679 - DNA, 25 bp, Homo sapien
acctccaggctgactgcgctgatgc

SEQ ID NO: 36680 - DNA, 25 bp, Homo sapien
actgcgctgatgctggccgccagcg

SEQ ID NO: 36681 - DNA, 25 bp, Homo sapien
tggcccggatcaggagctcatccag

SEQ ID NO: 36682 - DNA, 25 bp, Homo sapien
ccggatcaggagctcatccaggtcg

SEQ ID NO: 36683 - DNA, 25 bp, Homo sapien
tgcccatcgggccggcgccagaatt

SEQ ID NO: 36684 - DNA, 25 bp, Homo sapien
cgcgggttctctgtggccagcaggc

SEQ ID NO: 36685 - DNA, 25 bp, Homo sapien
cggcgcacgcgggttctctgtggcc

SEQ ID NO: 36686 - DNA, 25 bp, Homo sapien
ggcgcacgcgggttctctgtggcca

SEQ ID NO: 36687 - DNA, 25 bp, Homo sapien
gcgggttctctgtggccagcaggcg

SEQ ID NO: 36688 - DNA, 25 bp, Homo sapien
cacgcgggttctctgtggccagcag

SEQ ID NO: 36689 - DNA, 25 bp, Homo sapien
cgcacgcgggttctctgtggccagc

SEQ ID NO: 36690 - DNA, 25 bp, Homo sapien
gcacgcgggttctctgtggccagca

SEQ ID NO: 36691 - DNA, 25 bp, Homo sapien
gcgcacgcgggttctctgtggccag

SEQ ID NO: 36692 - DNA, 25 bp, Homo sapien
agcgagatttcgttctcagaagtga

SEQ ID NO: 36693 - DNA, 25 bp, Homo sapien
tgccacgatttcgagggaccaggga

SEQ ID NO: 36694 - DNA, 25 bp, Homo sapien
gggcgctcaaaactcctcgtgcacg

SEQ ID NO: 36695 - DNA, 25 bp, Homo sapien
ttgctgcccgtgaagaactcgctgt

SEQ ID NO: 36696 - DNA, 25 bp, Homo sapien
gaactcgctgtacttgagcacctcc

SEQ ID NO: 36697 - DNA, 25 bp, Homo sapien
gcgatcatctgcttggcctcgttca

SEQ ID NO: 36698 - DNA, 25 bp, Homo sapien
gcgttgtactcgttcatggggtcca

SEQ ID NO: 36699 - DNA, 25 bp, Homo sapien
cagcgccttcggcagagtgactgaa

SEQ ID NO: 36700 - DNA, 25 bp, Homo sapien
cacacgctggtgatgccaaagcaga

SEQ ID NO: 36701 - DNA, 25 bp, Homo sapien
accgtcaggaatgccaaacaccatg

SEQ ID NO: 36702 - DNA, 25 bp, Homo sapien
tgtgggacgagctcaaggacaccgt

SEQ ID NO: 36703 - DNA, 25 bp, Homo sapien
gtgctccaggtagaagtggccgtca

SEQ ID NO: 36704 - DNA, 25 bp, Homo sapien
aaagcgcagcctgatctggtcccgg

SEQ ID NO: 36705 - DNA, 25 bp, Homo sapien
aagtcatcgggttggtcaaagcgca

SEQ ID NO: 36706 - DNA, 25 bp, Homo sapien
gccaacgcacccttgaagtcatcgg

SEQ ID NO: 36707 - DNA, 25 bp, Homo sapien
ccggcagtacctcgttgtgggacga

SEQ ID NO: 36708 - DNA, 25 bp, Homo sapien
cagatcgtgggtcacaagaggtctc

SEQ ID NO: 36709 - DNA, 25 bp, Homo sapien
caagaggtctcaggtcagccagttg

SEQ ID NO: 36710 - DNA, 25 bp, Homo sapien
gaccggccgcagtcagatccgcagg

SEQ ID NO: 36711 - DNA, 25 bp, Homo sapien
cagtcagatccgcagggctggaagc

SEQ ID NO: 36712 - DNA, 25 bp, Homo sapien
cagagaggcgtcaacagctgcccgc

SEQ ID NO: 36713 - DNA, 25 bp, Homo sapien
ccacgaggtctcagttccctaaaga

SEQ ID NO: 36714 - DNA, 25 bp, Homo sapien
tctcagttccctaaagaatgcgggg

SEQ ID NO: 36715 - DNA, 25 bp, Homo sapien
ccacccagtcatggcggcagatcgt

SEQ ID NO: 36716 - DNA, 25 bp, Homo sapien
cctcttcttggagtatggacgagtc

SEQ ID NO: 36717 - DNA, 25 bp, Homo sapien
ggtggcacgtacctgcctcttcttg

SEQ ID NO: 36718 - DNA, 25 bp, Homo sapien
cgcagtgagcaccagctgacgaaga

SEQ ID NO: 36719 - DNA, 25 bp, Homo sapien
cgtctcgcgtcactgagtcgcgtca

SEQ ID NO: 36720 - DNA, 25 bp, Homo sapien
cgtcacggctattggcttgttccta

SEQ ID NO: 36721 - DNA, 25 bp, Homo sapien
gggccacccaggcaaccgatataca

SEQ ID NO: 36722 - DNA, 25 bp, Homo sapien
cgatatacacagagaaccacgtgga

SEQ ID NO: 36723 - DNA, 25 bp, Homo sapien
gcttgttcctactgtggcgtcatta

SEQ ID NO: 36724 - DNA, 25 bp, Homo sapien
cctcctgtccgtcgcagaggtagtc

SEQ ID NO: 36725 - DNA, 25 bp, Homo sapien
ccattgcggcatgcggcctcctggg

SEQ ID NO: 36726 - DNA, 25 bp, Homo sapien
ggatgcagtgcccattgcggcatgc

SEQ ID NO: 36727 - DNA, 25 bp, Homo sapien
tgtccgtcgcagaggtagtctctgg

SEQ ID NO: 36728 - DNA, 25 bp, Homo sapien
ggtgcgcaccacagtctagctcatc

SEQ ID NO: 36729 - DNA, 25 bp, Homo sapien
gtcgcatgatggttgtctctggccg

SEQ ID NO: 36730 - DNA, 25 bp, Homo sapien
tggctgtcgcatgatggttgtctct

SEQ ID NO: 36731 - DNA, 25 bp, Homo sapien
agtctctggggatgcagtgcccatt

SEQ ID NO: 36732 - DNA, 25 bp, Homo sapien
ctcttaacttccgggcggggcatga

SEQ ID NO: 36733 - DNA, 25 bp, Homo sapien
ttcctaacccgagtacgcttgctcg

SEQ ID NO: 36734 - DNA, 25 bp, Homo sapien
ggcagctgcgtaggtgaacgttccc

SEQ ID NO: 36735 - DNA, 25 bp, Homo sapien
cgtcctccgaggtggcagctgcgta

SEQ ID NO: 36736 - DNA, 25 bp, Homo sapien
ggtcttatcctgatctttcctcgtc

SEQ ID NO: 36737 - DNA, 25 bp, Homo sapien
catttgtgggagttagggtcttatc

SEQ ID NO: 36738 - DNA, 25 bp, Homo sapien
ccctttcctggagtcatttgtggga

SEQ ID NO: 36739 - DNA, 25 bp, Homo sapien
cggggcatgacttccggttcccgcg

SEQ ID NO: 36740 - DNA, 25 bp, Homo sapien
gcctcagagcgactcgcgggcgctt

SEQ ID NO: 36741 - DNA, 25 bp, Homo sapien
cttccgtgctggcaggctgcgttcc

SEQ ID NO: 36742 - DNA, 25 bp, Homo sapien
ggctgctcttcctttcggaggtcga

SEQ ID NO: 36743 - DNA, 25 bp, Homo sapien
tcggaggtcgagttcctagcatttc

SEQ ID NO: 36744 - DNA, 25 bp, Homo sapien
gagttcctagcatttccatccgctc

SEQ ID NO: 36745 - DNA, 25 bp, Homo sapien
ctccctgccggtttagctgaagctt

SEQ ID NO: 36746 - DNA, 25 bp, Homo sapien
tcctgcgcgctgacgtcaggtgcgt

SEQ ID NO: 36747 - DNA, 25 bp, Homo sapien
cagggcagtccaggcaccgccttga

SEQ ID NO: 36748 - DNA, 25 bp, Homo sapien
ggctaggctccaagtacaccaggtc

SEQ ID NO: 36749 - DNA, 25 bp, Homo sapien
aaacttctccttcagtgcgtgaccc

SEQ ID NO: 36750 - DNA, 25 bp, Homo sapien
cttgaactgtgcgttgcgtggcacc

SEQ ID NO: 36751 - DNA, 25 bp, Homo sapien
tttgcagctgcagcgttcagccagc

SEQ ID NO: 36752 - DNA, 25 bp, Homo sapien
gctcacagccgtcgatggccttgga

SEQ ID NO: 36753 - DNA, 25 bp, Homo sapien
ggtcctcatctgtgtgcggcttgaa

SEQ ID NO: 36754 - DNA, 25 bp, Homo sapien
gtcctgctcacagaagtcggggcta

SEQ ID NO: 36755 - DNA, 25 bp, Homo sapien
tggccttggacgtcttgttgcatgt

SEQ ID NO: 36756 - DNA, 25 bp, Homo sapien
tccggaactggtactggcactcctc

SEQ ID NO: 36757 - DNA, 25 bp, Homo sapien
ctcacgagcgtctcatttcctgctg

SEQ ID NO: 36758 - DNA, 25 bp, Homo sapien
actggtactggcactcctcaatggc

SEQ ID NO: 36759 - DNA, 25 bp, Homo sapien
ctcaatggccagctgggcaccgcgg

SEQ ID NO: 36760 - DNA, 25 bp, Homo sapien
cgttgctcacgagcgtctcatttcc

SEQ ID NO: 36761 - DNA, 25 bp, Homo sapien
cggttccggaactggtactggcact

SEQ ID NO: 36762 - DNA, 25 bp, Homo sapien
ttgcgtcaccaccttgccgaagacg

SEQ ID NO: 36763 - DNA, 25 bp, Homo sapien
ccaccttgccgaagacgggcaagga

SEQ ID NO: 36764 - DNA, 25 bp, Homo sapien
aggcgcagcgaacgcaggcacgagc

SEQ ID NO: 36765 - DNA, 25 bp, Homo sapien
ccggccagacttacagccagttgct

SEQ ID NO: 36766 - DNA, 25 bp, Homo sapien
agacttacagccagttgctcgcggc

SEQ ID NO: 36767 - DNA, 25 bp, Homo sapien
cggctgagaagacggcgaagacgag

SEQ ID NO: 36768 - DNA, 25 bp, Homo sapien
cacgagcggggactcatggtgccgc

SEQ ID NO: 36769 - DNA, 25 bp, Homo sapien
cttagcccgcgggactgggctgctc

SEQ ID NO: 36770 - DNA, 25 bp, Homo sapien
tacagccagttgctcgcggcggctg

SEQ ID NO: 36771 - DNA, 25 bp, Homo sapien
tgcccggcgcggaccagactgtcag

SEQ ID NO: 36772 - DNA, 25 bp, Homo sapien
tccctcctgggtcaccgcaccgctg

SEQ ID NO: 36773 - DNA, 25 bp, Homo sapien
tgagtgatgagctcggagccaagct

SEQ ID NO: 36774 - DNA, 25 bp, Homo sapien
cgctgagtgatgagctcggagccaa

SEQ ID NO: 36775 - DNA, 25 bp, Homo sapien
agacagctcgctgagtgatgagctc

SEQ ID NO: 36776 - DNA, 25 bp, Homo sapien
aatattgacccagcgcgcaggaagt

SEQ ID NO: 36777 - DNA, 25 bp, Homo sapien
tcacaatattgacccagcgcgcagg

SEQ ID NO: 36778 - DNA, 25 bp, Homo sapien
cagtggaaatcacaatattgaccca

SEQ ID NO: 36779 - DNA, 25 bp, Homo sapien
gaaatcacaatattgacccagcgcg

SEQ ID NO: 36780 - DNA, 25 bp, Homo sapien
gaaactgtaatcagggcctcccgca

SEQ ID NO: 36781 - DNA, 25 bp, Homo sapien
gtgtaaacgctgtcaccctgccatc

SEQ ID NO: 36782 - DNA, 25 bp, Homo sapien
agctggccctgtccgcagctcataa

SEQ ID NO: 36783 - DNA, 25 bp, Homo sapien
ggccctgtccgcagctcataaatca

SEQ ID NO: 36784 - DNA, 25 bp, Homo sapien
tgtccgcagctcataaatcacgctg

SEQ ID NO: 36785 - DNA, 25 bp, Homo sapien
aaatcacgctgccttcccggaaagc

SEQ ID NO: 36786 - DNA, 25 bp, Homo sapien
acagacagggtgacgggagacagac

SEQ ID NO: 36787 - DNA, 25 bp, Homo sapien
gctctgtgtaaacgctgtcaccctg

SEQ ID NO: 36788 - DNA, 25 bp, Homo sapien
cggcagtttgaatcggtgctgaaca

SEQ ID NO: 36789 - DNA, 25 bp, Homo sapien
cccgccgtcctagcataggtggaga

SEQ ID NO: 36790 - DNA, 25 bp, Homo sapien
ccggcgctgttgaatggcgaaagct

SEQ ID NO: 36791 - DNA, 25 bp, Homo sapien
aagctttattgttcccttcgggcag

SEQ ID NO: 36792 - DNA, 25 bp, Homo sapien
atacagacccttccgcgtggcgaac

SEQ ID NO: 36793 - DNA, 25 bp, Homo sapien
gctgtcaataaagaacggcagtttg

SEQ ID NO: 36794 - DNA, 25 bp, Homo sapien
cctaaatgaggggtgtatacagacc

SEQ ID NO: 36795 - DNA, 25 bp, Homo sapien
cgtgtcctctatggcgctgtcaata

SEQ ID NO: 36796 - DNA, 25 bp, Homo sapien
taccagcggtccttcaggttctcca

SEQ ID NO: 36797 - DNA, 25 bp, Homo sapien
agttgtcgtcaatgtcctggccctg

SEQ ID NO: 36798 - DNA, 25 bp, Homo sapien
ttgtcaccgtcctggtctgcgagac

SEQ ID NO: 36799 - DNA, 25 bp, Homo sapien
ttctgtctttcacccagttgtcgtc

SEQ ID NO: 36800 - DNA, 25 bp, Homo sapien
cgtcgtggttggagtcaatgagctc

SEQ ID NO: 36801 - DNA, 25 bp, Homo sapien
ccagaaagttccgagaggtgctgcc

SEQ ID NO: 36802 - DNA, 25 bp, Homo sapien
tgcctgaactcgagggacacagcca

SEQ ID NO: 36803 - DNA, 25 bp, Homo sapien
cgccagcacgcaaatccagaaagtt

SEQ ID NO: 36804 - DNA, 25 bp, Homo sapien
gcattgcctcggttgagtgcgcccg

SEQ ID NO: 36805 - DNA, 25 bp, Homo sapien
cgcgagagcgcgcagggcattgcct

SEQ ID NO: 36806 - DNA, 25 bp, Homo sapien
atctgcagagcagtgctcgcccagg

SEQ ID NO: 36807 - DNA, 25 bp, Homo sapien
cacagaaggggcgtgcacccgcgag

SEQ ID NO: 36808 - DNA, 25 bp, Homo sapien
agtctagcctatctgcagagcagtg

SEQ ID NO: 36809 - DNA, 25 bp, Homo sapien
acgcggagccggtagtctagcctat

SEQ ID NO: 36810 - DNA, 25 bp, Homo sapien
gccggtagtctagcctatctgcaga

SEQ ID NO: 36811 - DNA, 25 bp, Homo sapien
tagcctatctgcagagcagtgctcg

SEQ ID NO: 36812 - DNA, 25 bp, Homo sapien
ccctgagtccaagtgcgcagcgcgg

SEQ ID NO: 36813 - DNA, 25 bp, Homo sapien
cctcggtgctgattggctcggcgcc

SEQ ID NO: 36814 - DNA, 25 bp, Homo sapien
cggagtgtgtcaccacgcgaagcac

SEQ ID NO: 36815 - DNA, 25 bp, Homo sapien
gtgtcaccacgcgaagcactcggtg

SEQ ID NO: 36816 - DNA, 25 bp, Homo sapien
accacgcgaagcactcggtgttggg

SEQ ID NO: 36817 - DNA, 25 bp, Homo sapien
tgtccacagagggaatccctgggtg

SEQ ID NO: 36818 - DNA, 25 bp, Homo sapien
gccctgagccctgagtccaagtgcg

SEQ ID NO: 36819 - DNA, 25 bp, Homo sapien
tgagccctgagtccaagtgcgcagc

SEQ ID NO: 36820 - DNA, 25 bp, Homo sapien
atcgacaccattgcggccgacgaga

SEQ ID NO: 36821 - DNA, 25 bp, Homo sapien
ccggcgcgtctatgctgagatcaag

SEQ ID NO: 36822 - DNA, 25 bp, Homo sapien
tgagatcaagtttaccctgcgcgac

SEQ ID NO: 36823 - DNA, 25 bp, Homo sapien
tctactacctggagtcggaccgcga

SEQ ID NO: 36824 - DNA, 25 bp, Homo sapien
cgagagcttcacaggtgccgacctt

SEQ ID NO: 36825 - DNA, 25 bp, Homo sapien
gcgtctcaagctcaacacggaggtg

SEQ ID NO: 36826 - DNA, 25 bp, Homo sapien
cacccaagatgtactgcagcgcgga

SEQ ID NO: 36827 - DNA, 25 bp, Homo sapien
tgcgcgactgcaacagcatgcctgg

SEQ ID NO: 36828 - DNA, 25 bp, Homo sapien
ccaccgtcccgtggcaggacaagga

SEQ ID NO: 36829 - DNA, 25 bp, Homo sapien
ctacgagaaggtaccacgggcagga

SEQ ID NO: 36830 - DNA, 25 bp, Homo sapien
gccgcttcagccaggccatggaggt

SEQ ID NO: 36831 - DNA, 25 bp, Homo sapien
acccgctacgtgttccaggtccgag

SEQ ID NO: 36832 - DNA, 25 bp, Homo sapien
tccgcccatctgacgggattggccg

SEQ ID NO: 36833 - DNA, 25 bp, Homo sapien
tcctggagtatgagatcaagtacta

SEQ ID NO: 36834 - DNA, 25 bp, Homo sapien
agccgaacggcatcatcctggagta

SEQ ID NO: 36835 - DNA, 25 bp, Homo sapien
gagatgcagagctactccaccctca

SEQ ID NO: 36836 - DNA, 25 bp, Homo sapien
tcccagattgtcagtgtcctcgatg

SEQ ID NO: 36837 - DNA, 25 bp, Homo sapien
tctcctcggccagcgacgtgtggag

SEQ ID NO: 36838 - DNA, 25 bp, Homo sapien
tcagtgtcctcgatgcgctcatccg

SEQ ID NO: 36839 - DNA, 25 bp, Homo sapien
tgctcgactgttggcacaaggaccg

SEQ ID NO: 36840 - DNA, 25 bp, Homo sapien
tgcaccagctcatgctcgactgttg

SEQ ID NO: 36841 - DNA, 25 bp, Homo sapien
ccctgcaggtcatcagctctgtgga

SEQ ID NO: 36842 - DNA, 25 bp, Homo sapien
gagcggccctactggaacatgacca

SEQ ID NO: 36843 - DNA, 25 bp, Homo sapien
ctggaacatgaccaaccgggatgtg

SEQ ID NO: 36844 - DNA, 25 bp, Homo sapien
gcggcgtcaaagtggtcaccttctg

SEQ ID NO: 36845 - DNA, 25 bp, Homo sapien
gcgtcgcatacagccaacctgtgcg

SEQ ID NO: 36846 - DNA, 25 bp, Homo sapien
aacctgtgcgtgctgctgtaccgca

SEQ ID NO: 36847 - DNA, 25 bp, Homo sapien
ggccacacgtccaaaaccaatcagg

SEQ ID NO: 36848 - DNA, 25 bp, Homo sapien
tgtggctggctgtcaatgactacta

SEQ ID NO: 36849 - DNA, 25 bp, Homo sapien
tgactactacgacatggtgggcatc

SEQ ID NO: 36850 - DNA, 25 bp, Homo sapien
gctctgacagcgtcttctccggctt

SEQ ID NO: 36851 - DNA, 25 bp, Homo sapien
ccaatcaggtcaactcgggcggtgt

SEQ ID NO: 36852 - DNA, 25 bp, Homo sapien
agaaaggccgccaatcctcttaggg

SEQ ID NO: 36853 - DNA, 25 bp, Homo sapien
gcactggggtgccaccgtctccaag

SEQ ID NO: 36854 - DNA, 25 bp, Homo sapien
caagggcgccgctgtcagctgtgac

SEQ ID NO: 36855 - DNA, 25 bp, Homo sapien
acaagcggcctttgtggtctgtgcg

SEQ ID NO: 36856 - DNA, 25 bp, Homo sapien
aggccgccaatcctcttagggccag

SEQ ID NO: 36857 - DNA, 25 bp, Homo sapien
cccacggcgcgcaaagcaagcaaaa

SEQ ID NO: 36858 - DNA, 25 bp, Homo sapien
gcaagcaaaagctgcccgggaatga

SEQ ID NO: 36859 - DNA, 25 bp, Homo sapien
agaggcggccaaacaagcggccttt

SEQ ID NO: 36860 - DNA, 25 bp, Homo sapien
ggctggatggctcattctgctggct

SEQ ID NO: 36861 - DNA, 25 bp, Homo sapien
cccgggaagcgcagccatggctctg

SEQ ID NO: 36862 - DNA, 25 bp, Homo sapien
gcgctgattgactgtgccaggagga

SEQ ID NO: 36863 - DNA, 25 bp, Homo sapien
cgaagggaccatcttgccgaggctt

SEQ ID NO: 36864 - DNA, 25 bp, Homo sapien
ccatcttgccgaggctttgtagcca

SEQ ID NO: 36865 - DNA, 25 bp, Homo sapien
aggctttgtagccagcccggcgagc

SEQ ID NO: 36866 - DNA, 25 bp, Homo sapien
ggcctggtcttgctccgcacagggt

SEQ ID NO: 36867 - DNA, 25 bp, Homo sapien
tggctcattctgctggctgcgcggt

SEQ ID NO: 36868 - DNA, 25 bp, Homo sapien
catcgggcgctgcatgtgcaaagca

SEQ ID NO: 36869 - DNA, 25 bp, Homo sapien
gaatggcgccatcttccaggaaacc

SEQ ID NO: 36870 - DNA, 25 bp, Homo sapien
gccttccaggactatggcggctgca

SEQ ID NO: 36871 - DNA, 25 bp, Homo sapien
ggtggccgcgtcatgaaaatcaaca

SEQ ID NO: 36872 - DNA, 25 bp, Homo sapien
gtggataccattgcagccgacgaga

SEQ ID NO: 36873 - DNA, 25 bp, Homo sapien
gctgactttgactcggccaccaaga

SEQ ID NO: 36874 - DNA, 25 bp, Homo sapien
accaggtgtgcaacgtgtttgagtc

SEQ ID NO: 36875 - DNA, 25 bp, Homo sapien
gcccaccgcatccacgtggagatga

SEQ ID NO: 36876 - DNA, 25 bp, Homo sapien
gcgcacctcgtagaaggtcaggttg

SEQ ID NO: 36877 - DNA, 25 bp, Homo sapien
gtagccgtccagatcgccgtccttg

SEQ ID NO: 36878 - DNA, 25 bp, Homo sapien
ccagcccaggtcatagagtggcgcc

SEQ ID NO: 36879 - DNA, 25 bp, Homo sapien
aggtcaaagcccgtgtctgccatcc

SEQ ID NO: 36880 - DNA, 25 bp, Homo sapien
tctccgagacccagcgctggtagtc

SEQ ID NO: 36881 - DNA, 25 bp, Homo sapien
cagcgtgctgtaatggcatctggaa

SEQ ID NO: 36882 - DNA, 25 bp, Homo sapien
atccaaggggtagaagttgaccagc

SEQ ID NO: 36883 - DNA, 25 bp, Homo sapien
agccgcagcactctgtacgtgttga

SEQ ID NO: 36884 - DNA, 25 bp, Homo sapien
aagtctttgccggtgttgactgcgg

SEQ ID NO: 36885 - DNA, 25 bp, Homo sapien
ctctaggcaagctacacgttctttg

SEQ ID NO: 36886 - DNA, 25 bp, Homo sapien
acgttctttgctgcggtgccactct

SEQ ID NO: 36887 - DNA, 25 bp, Homo sapien
tctagccgcgagaacgccgctctat

SEQ ID NO: 36888 - DNA, 25 bp, Homo sapien
caaggcttttcggacccacggagcg

SEQ ID NO: 36889 - DNA, 25 bp, Homo sapien
cggcccgagatgttatctgggaaga

SEQ ID NO: 36890 - DNA, 25 bp, Homo sapien
gtcttgggccctgcgaccactcaga

SEQ ID NO: 36891 - DNA, 25 bp, Homo sapien
tggaaactggaatagcagagactcc

SEQ ID NO: 36892 - DNA, 25 bp, Homo sapien
ccgaaagacatcagggtgccacgcg

SEQ ID NO: 36893 - DNA, 25 bp, Homo sapien
gctcggagcccgcagttttcaccgg

SEQ ID NO: 36894 - DNA, 25 bp, Homo sapien
gactggggtcttccgctgctgcagc

SEQ ID NO: 36895 - DNA, 25 bp, Homo sapien
gcctagtgttgggaagtcttgcatg

SEQ ID NO: 36896 - DNA, 25 bp, Homo sapien
gacgtctgggtggaatgtagaccca

SEQ ID NO: 36897 - DNA, 25 bp, Homo sapien
gaccgtggcccgaagcctagtgttg

SEQ ID NO: 36898 - DNA, 25 bp, Homo sapien
gcccgcagttttcaccggggatgga

SEQ ID NO: 36899 - DNA, 25 bp, Homo sapien
atgtagacccacaggctgtccttgg

SEQ ID NO: 36900 - DNA, 25 bp, Homo sapien
tgatcttccggtcagtgttcacatc

SEQ ID NO: 36901 - DNA, 25 bp, Homo sapien
ggctgcgtgaacctgccaccaacag

SEQ ID NO: 36902 - DNA, 25 bp, Homo sapien
gtgttcacatccaccctgcaagaca

SEQ ID NO: 36903 - DNA, 25 bp, Homo sapien
gcatctccttggcactgatcttccg

SEQ ID NO: 36904 - DNA, 25 bp, Homo sapien
gtcttctccatgatccagcgctgca

SEQ ID NO: 36905 - DNA, 25 bp, Homo sapien
tccaccaggcaacgcgaaaagcgtc

SEQ ID NO: 36906 - DNA, 25 bp, Homo sapien
tgtgtcttgctctcctccatggcct

SEQ ID NO: 36907 - DNA, 25 bp, Homo sapien
gcccaggactccatggctgcgtgaa

SEQ ID NO: 36908 - DNA, 25 bp, Homo sapien
ccatgaatccggctgcggcacttca

SEQ ID NO: 36909 - DNA, 25 bp, Homo sapien
tgcgacccacttatcccaggaggaa

SEQ ID NO: 36910 - DNA, 25 bp, Homo sapien
cgtccgcgatcaagtgggcatgatg

SEQ ID NO: 36911 - DNA, 25 bp, Homo sapien
cagccaggaaatcgcgtccttgtta

SEQ ID NO: 36912 - DNA, 25 bp, Homo sapien
ggcgcttgacaggactcagcctctc

SEQ ID NO: 36913 - DNA, 25 bp, Homo sapien
ctcctgcgccagtgagccatgaatc

SEQ ID NO: 36914 - DNA, 25 bp, Homo sapien
ttctctccgcgtttcctgagcagga

SEQ ID NO: 36915 - DNA, 25 bp, Homo sapien
tgaaatactcatgggccgactgcac

SEQ ID NO: 36916 - DNA, 25 bp, Homo sapien
ggctcgcgccctcgcgatcccgcac

SEQ ID NO: 36917 - DNA, 25 bp, Homo sapien
ggcgccgcgcccgaacctggccagc

SEQ ID NO: 36918 - DNA, 25 bp, Homo sapien
cccaacgcgcgcgtgggatcccgca

SEQ ID NO: 36919 - DNA, 25 bp, Homo sapien
cctgggcgctgcctcagtcctccct

SEQ ID NO: 36920 - DNA, 25 bp, Homo sapien
cccgcccgatccacttcctcgcgcg

SEQ ID NO: 36921 - DNA, 25 bp, Homo sapien
cccggcctgcgactcgtagcagccc

SEQ ID NO: 36922 - DNA, 25 bp, Homo sapien
cgcacacccggcgtacccgcccgat

SEQ ID NO: 36923 - DNA, 25 bp, Homo sapien
tccccgctcgggatggtccggagct

SEQ ID NO: 36924 - DNA, 25 bp, Homo sapien
aacgactagaaatggcgcgcgcgcc

SEQ ID NO: 36925 - DNA, 25 bp, Homo sapien
cgcgaggcgctttgaaaacgactag

SEQ ID NO: 36926 - DNA, 25 bp, Homo sapien
ccggctgaaccaatgagggtgctca

SEQ ID NO: 36927 - DNA, 25 bp, Homo sapien
ccctgatggactgagacgcgatccc

SEQ ID NO: 36928 - DNA, 25 bp, Homo sapien
gactccgagctacggggcaatcgct

SEQ ID NO: 36929 - DNA, 25 bp, Homo sapien
ggcagctcagacgaccagtagtatc

SEQ ID NO: 36930 - DNA, 25 bp, Homo sapien
gaaaatctaggcctcgcgccgcgtg

SEQ ID NO: 36931 - DNA, 25 bp, Homo sapien
ccgccgatgcgaggccgaaaatcta

SEQ ID NO: 36932 - DNA, 25 bp, Homo sapien
cgggccttcaggatgttagcagtcc

SEQ ID NO: 36933 - DNA, 25 bp, Homo sapien
tcccgcgtacaaaagctagccagag

SEQ ID NO: 36934 - DNA, 25 bp, Homo sapien
tcctcccagtcagggcggagtattc

SEQ ID NO: 36935 - DNA, 25 bp, Homo sapien
tcttatggagactgcagcacgatta

SEQ ID NO: 36936 - DNA, 25 bp, Homo sapien
acgattaagctagaggctgccctgc

SEQ ID NO: 36937 - DNA, 25 bp, Homo sapien
gcttctcttgagtcgggccttatta

SEQ ID NO: 36938 - DNA, 25 bp, Homo sapien
cggcgcggctctgtacgcaatacaa

SEQ ID NO: 36939 - DNA, 25 bp, Homo sapien
agcagtccctgtccggttgaaggta

SEQ ID NO: 36940 - DNA, 25 bp, Homo sapien
cactagctgcccagggtgaacccta

SEQ ID NO: 36941 - DNA, 25 bp, Homo sapien
gtggcgggcactaaatatagacttc

SEQ ID NO: 36942 - DNA, 25 bp, Homo sapien
tccaaagggacgtgcacaagtcgcg

SEQ ID NO: 36943 - DNA, 25 bp, Homo sapien
agtttctctgccacttctcgggcca

SEQ ID NO: 36944 - DNA, 25 bp, Homo sapien
tgcagcctcaccgtgttcttcctgg

SEQ ID NO: 36945 - DNA, 25 bp, Homo sapien
ggccaccatcttctccagctttttg

SEQ ID NO: 36946 - DNA, 25 bp, Homo sapien
cagctttttggcgatcctcagcagc

SEQ ID NO: 36947 - DNA, 25 bp, Homo sapien
acttcaaggacttgcccgggcactg

SEQ ID NO: 36948 - DNA, 25 bp, Homo sapien
tcctctgcctgaaagtggtacgtcc

SEQ ID NO: 36949 - DNA, 25 bp, Homo sapien
cctgcatagggtggagctccaagcc

SEQ ID NO: 36950 - DNA, 25 bp, Homo sapien
cccagcaggtccaaggtgagtgact

SEQ ID NO: 36951 - DNA, 25 bp, Homo sapien
tgagtgactgcatgcgcgaaaagcg

SEQ ID NO: 36952 - DNA, 25 bp, Homo sapien
agtcgcagcactggctattcccagg

SEQ ID NO: 36953 - DNA, 25 bp, Homo sapien
agggcttcgtccttgctgttctgca

SEQ ID NO: 36954 - DNA, 25 bp, Homo sapien
tgacacccacctgcggagattgaac

SEQ ID NO: 36955 - DNA, 25 bp, Homo sapien
aagaccgggcggttaagcctgcata

SEQ ID NO: 36956 - DNA, 25 bp, Homo sapien
cccgacctgtggagtttgtcatcga

SEQ ID NO: 36957 - DNA, 25 bp, Homo sapien
tcattccacaaacgcgggccaaatc

SEQ ID NO: 36958 - DNA, 25 bp, Homo sapien
aaggcgctaggcaaacacatatgtg

SEQ ID NO: 36959 - DNA, 25 bp, Homo sapien
gctccgaagatgaaaacgcaaactg

SEQ ID NO: 36960 - DNA, 25 bp, Homo sapien
ctgcctctcagaaggggagtgactc

SEQ ID NO: 36961 - DNA, 25 bp, Homo sapien
cacatatgtgatgaggcggtcacgc

SEQ ID NO: 36962 - DNA, 25 bp, Homo sapien
ggaactcggcgacgctgaactgctc

SEQ ID NO: 36963 - DNA, 25 bp, Homo sapien
ttgtcatcgaagagacctcgaggcc

SEQ ID NO: 36964 - DNA, 25 bp, Homo sapien
cactagcttcgctgcttaaaggggc

SEQ ID NO: 36965 - DNA, 25 bp, Homo sapien
tagagatcgccgcttggagatcgcc

SEQ ID NO: 36966 - DNA, 25 bp, Homo sapien
ggtctcgactgcaccgacttccttg

SEQ ID NO: 36967 - DNA, 25 bp, Homo sapien
gcggctcgctctctagtccttgagt

SEQ ID NO: 36968 - DNA, 25 bp, Homo sapien
cgccaaacgtcgtgccgcgaaattc

SEQ ID NO: 36969 - DNA, 25 bp, Homo sapien
gcgaaattcggatctcccgcggaaa

SEQ ID NO: 36970 - DNA, 25 bp, Homo sapien
aggcggcgattgcaacactagcttc

SEQ ID NO: 36971 - DNA, 25 bp, Homo sapien
ggggcccttgcagcatagcgagtaa

SEQ ID NO: 36972 - DNA, 25 bp, Homo sapien
cgctcgaggaatgcgagttgcctga

SEQ ID NO: 36973 - DNA, 25 bp, Homo sapien
tgaggccgggaagacagataattga

SEQ ID NO: 36974 - DNA, 25 bp, Homo sapien
atgcgagttgcctgaaagaacgaag

SEQ ID NO: 36975 - DNA, 25 bp, Homo sapien
agagctcagacatccgggcgccagc

SEQ ID NO: 36976 - DNA, 25 bp, Homo sapien
cgccagcgaacacctgcgagcggcc

SEQ ID NO: 36977 - DNA, 25 bp, Homo sapien
gttctcaggtttagcctggggcatg

SEQ ID NO: 36978 - DNA, 25 bp, Homo sapien
agataattgaaggttgtccggcgcg

SEQ ID NO: 36979 - DNA, 25 bp, Homo sapien
aaggccctgtgcagggcacgtcgca

SEQ ID NO: 36980 - DNA, 25 bp, Homo sapien
ccttcctacagagacgcggcgtcgt

SEQ ID NO: 36981 - DNA, 25 bp, Homo sapien
tcgccttgagtgacacaggacatgg

SEQ ID NO: 36982 - DNA, 25 bp, Homo sapien
ccagagccggagatttgagtcagac

SEQ ID NO: 36983 - DNA, 25 bp, Homo sapien
gatcacaacctgtcagtcgcgcttt

SEQ ID NO: 36984 - DNA, 25 bp, Homo sapien
tgactgattgctaggtgggtccctc

SEQ ID NO: 36985 - DNA, 25 bp, Homo sapien
ccacttagcatccagccggcgagaa

SEQ ID NO: 36986 - DNA, 25 bp, Homo sapien
tgccttgtcggctcggagaaaaatg

SEQ ID NO: 36987 - DNA, 25 bp, Homo sapien
cggcgccgaaacctgcagatcacaa

SEQ ID NO: 36988 - DNA, 25 bp, Homo sapien
cccagttggcgccaaagaccacagg

SEQ ID NO: 36989 - DNA, 25 bp, Homo sapien
tgtacctccagctgataactccgcg

SEQ ID NO: 36990 - DNA, 25 bp, Homo sapien
acttggtctgtacctccagctgata

SEQ ID NO: 36991 - DNA, 25 bp, Homo sapien
cagggaggaaacttggtctgtacct

SEQ ID NO: 36992 - DNA, 25 bp, Homo sapien
ggaaagaagaccaaggagcagtcag

SEQ ID NO: 36993 - DNA, 25 bp, Homo sapien
ccaaagaccacaggcggagcttgcg

SEQ ID NO: 36994 - DNA, 25 bp, Homo sapien
tcagtttccgccgagcgtgccgagg

SEQ ID NO: 36995 - DNA, 25 bp, Homo sapien
gtcccaggcagaacgggcgccagca

SEQ ID NO: 36996 - DNA, 25 bp, Homo sapien
ggaagtctaaacacccacagcggcc

SEQ ID NO: 36997 - DNA, 25 bp, Homo sapien
agacctgctgttacttcccactccc

SEQ ID NO: 36998 - DNA, 25 bp, Homo sapien
cacctcctcaaacgagacagcttgg

SEQ ID NO: 36999 - DNA, 25 bp, Homo sapien
ctcaaacgagacagcttggggtttc

SEQ ID NO: 37000 - DNA, 25 bp, Homo sapien
gcttggggtttcgttacaggcacca

SEQ ID NO: 37001 - DNA, 25 bp, Homo sapien
gctggagacgcaccgagcagaagcc

SEQ ID NO: 37002 - DNA, 25 bp, Homo sapien
gacgcaccgagcagaagcctcaact

SEQ ID NO: 37003 - DNA, 25 bp, Homo sapien
ctgtgatgccgcgagccaggccttc

SEQ ID NO: 37004 - DNA, 25 bp, Homo sapien
ttgcaaacaggcttcctccggctgg

SEQ ID NO: 37005 - DNA, 25 bp, Homo sapien
cctgggcgttcacagcccgcttaaa

SEQ ID NO: 37006 - DNA, 25 bp, Homo sapien
gatgacgcgctgtaggatttccacc

SEQ ID NO: 37007 - DNA, 25 bp, Homo sapien
tccacctggctaagctgagtgcctc

SEQ ID NO: 37008 - DNA, 25 bp, Homo sapien
gttcatgtcgtccagcaagctcagc

SEQ ID NO: 37009 - DNA, 25 bp, Homo sapien
cggtcacttatagagcctgcctgga

SEQ ID NO: 37010 - DNA, 25 bp, Homo sapien
ctttattcaaaatggcccgcctcgg

SEQ ID NO: 37011 - DNA, 25 bp, Homo sapien
tgcctggaaggcacgcctctttatt

SEQ ID NO: 37012 - DNA, 25 bp, Homo sapien
gaaacccgaaggaatgtggctgttc

SEQ ID NO: 37013 - DNA, 25 bp, Homo sapien
gcgcagctgcgggacacacaatcgc

SEQ ID NO: 37014 - DNA, 25 bp, Homo sapien
cacaacagattaaagaccaggaggg

SEQ ID NO: 37015 - DNA, 25 bp, Homo sapien
aaaatagcttctccggccactggcg

SEQ ID NO: 37016 - DNA, 25 bp, Homo sapien
aagctgggactttggggactctttg

SEQ ID NO: 37017 - DNA, 25 bp, Homo sapien
ttgatagcgagtgtgtgggaaaccc

SEQ ID NO: 37018 - DNA, 25 bp, Homo sapien
aaggaatgtggctgttcggaccgcc

SEQ ID NO: 37019 - DNA, 25 bp, Homo sapien
gactttggggactctttgatagcga

SEQ ID NO: 37020 - DNA, 25 bp, Homo sapien
tgagtgggtgtcgaggaaccgccag

SEQ ID NO: 37021 - DNA, 25 bp, Homo sapien
cgccaggcagcggagaaaacaggac

SEQ ID NO: 37022 - DNA, 25 bp, Homo sapien
gcccagagcctggtggcgcagctct

SEQ ID NO: 37023 - DNA, 25 bp, Homo sapien
agccttccgatcatgggagcgcgcc

SEQ ID NO: 37024 - DNA, 25 bp, Homo sapien
tctcagccttccgatcatgggagcg

SEQ ID NO: 37025 - DNA, 25 bp, Homo sapien
cggctctcagccttccgatcatggg

SEQ ID NO: 37026 - DNA, 25 bp, Homo sapien
ttccgatcatgggagcgcgcccaga

SEQ ID NO: 37027 - DNA, 25 bp, Homo sapien
caggcagcggagaaaacaggacgcc

SEQ ID NO: 37028 - DNA, 25 bp, Homo sapien
cacttgcccggagtgctcagaagca

SEQ ID NO: 37029 - DNA, 25 bp, Homo sapien
cccgaggaatatggagcccgcaatg

SEQ ID NO: 37030 - DNA, 25 bp, Homo sapien
actagcagagccgttcgagccaagg

SEQ ID NO: 37031 - DNA, 25 bp, Homo sapien
cgcagggttgaattctgtcactttc

SEQ ID NO: 37032 - DNA, 25 bp, Homo sapien
tgccatcgttttaggagcggctccg

SEQ ID NO: 37033 - DNA, 25 bp, Homo sapien
tcagaagcacggtcaggaggctgca

SEQ ID NO: 37034 - DNA, 25 bp, Homo sapien
tgcctgctggcccaaaactagcaga

SEQ ID NO: 37035 - DNA, 25 bp, Homo sapien
tgtcactttccctgccatcgtttta

SEQ ID NO: 37036 - DNA, 25 bp, Homo sapien
aggacgcgacgcgagcccagttccg

SEQ ID NO: 37037 - DNA, 25 bp, Homo sapien
cccgagccagctgtttcctgcggga

SEQ ID NO: 37038 - DNA, 25 bp, Homo sapien
tgcggacaccgcgtgcctagcgctt

SEQ ID NO: 37039 - DNA, 25 bp, Homo sapien
gcggttactactctccggctggata

SEQ ID NO: 37040 - DNA, 25 bp, Homo sapien
tactctccggctggatatcagagcg

SEQ ID NO: 37041 - DNA, 25 bp, Homo sapien
tggatatcagagcgtggacctttcg

SEQ ID NO: 37042 - DNA, 25 bp, Homo sapien
ggtcgtgaagttcgcggccattgac

SEQ ID NO: 37043 - DNA, 25 bp, Homo sapien
ctcggagacgcggttactactctcc

SEQ ID NO: 37044 - DNA, 25 bp, Homo sapien
gcgccaggactggagtcatatacga

SEQ ID NO: 37045 - DNA, 25 bp, Homo sapien
tgtacctgcgcatcgacctggagcg

SEQ ID NO: 37046 - DNA, 25 bp, Homo sapien
cagcggcgctttttacgacgcggca

SEQ ID NO: 37047 - DNA, 25 bp, Homo sapien
tgcaatgccttaacgagagccgcga

SEQ ID NO: 37048 - DNA, 25 bp, Homo sapien
tcatcggctcgcaaagaaacgtggc

SEQ ID NO: 37049 - DNA, 25 bp, Homo sapien
aagctcgcgttctccagtctccagg

SEQ ID NO: 37050 - DNA, 25 bp, Homo sapien
ccgtgcgcatgtgagacagcgataa

SEQ ID NO: 37051 - DNA, 25 bp, Homo sapien
ttgccatgtcgcacggtcacagcca

SEQ ID NO: 37052 - DNA, 25 bp, Homo sapien
agaatcgcccaagcggcctcggaag

SEQ ID NO: 37053 - DNA, 25 bp, Homo sapien
gaaagaggagaatcgcccaagcggc

SEQ ID NO: 37054 - DNA, 25 bp, Homo sapien
gttccgtactgtcggccaggctact

SEQ ID NO: 37055 - DNA, 25 bp, Homo sapien
agcttctatccagcgaagccgggtc

SEQ ID NO: 37056 - DNA, 25 bp, Homo sapien
ctacttccggcagcgcgatggctgg

SEQ ID NO: 37057 - DNA, 25 bp, Homo sapien
tactgtcggccaggctacttccggc

SEQ ID NO: 37058 - DNA, 25 bp, Homo sapien
ccaacatggcagcttctatccagcg

SEQ ID NO: 37059 - DNA, 25 bp, Homo sapien
tgagaacccagcgactgcgcggctg

SEQ ID NO: 37060 - DNA, 25 bp, Homo sapien
ccctgggaagcacgaaagctggtct

SEQ ID NO: 37061 - DNA, 25 bp, Homo sapien
aggacaaaaggcctccgcgctgtga

SEQ ID NO: 37062 - DNA, 25 bp, Homo sapien
catgtcactcgggttacggccacta

SEQ ID NO: 37063 - DNA, 25 bp, Homo sapien
tttaagtgctgacggcccactccgg

SEQ ID NO: 37064 - DNA, 25 bp, Homo sapien
agggacgctgccaggaacacgaccc

SEQ ID NO: 37065 - DNA, 25 bp, Homo sapien
tcccagtctgtctgttggagggaag

SEQ ID NO: 37066 - DNA, 25 bp, Homo sapien
gacagcggagtgaccttgctcagcc

SEQ ID NO: 37067 - DNA, 25 bp, Homo sapien
cgcgctgtgacgaagactgcgcagc

SEQ ID NO: 37068 - DNA, 25 bp, Homo sapien
tcacccttgaaggtgtgccggcgcc

SEQ ID NO: 37069 - DNA, 25 bp, Homo sapien
cacgtgcttcttggtgctgtagtca

SEQ ID NO: 37070 - DNA, 25 bp, Homo sapien
ctgccttgctgtagccgttgccata

SEQ ID NO: 37071 - DNA, 25 bp, Homo sapien
gggtactgcaggttctgtgccattg

SEQ ID NO: 37072 - DNA, 25 bp, Homo sapien
cggccttcttctcgtcgtctgagtc

SEQ ID NO: 37073 - DNA, 25 bp, Homo sapien
cgcttggcgtcctcgtcatatttgg

SEQ ID NO: 37074 - DNA, 25 bp, Homo sapien
tcggcctcatccacggtgaagtagg

SEQ ID NO: 37075 - DNA, 25 bp, Homo sapien
tcatagctgcttccacccagtgggc

SEQ ID NO: 37076 - DNA, 25 bp, Homo sapien
caacctggacaggttggcccgagtc

SEQ ID NO: 37077 - DNA, 25 bp, Homo sapien
cactctgactaacgattggcccgga

SEQ ID NO: 37078 - DNA, 25 bp, Homo sapien
aactgcggtccgaagtcggcgtagc

SEQ ID NO: 37079 - DNA, 25 bp, Homo sapien
gaggcgttgacagcgcttcgctgaa

SEQ ID NO: 37080 - DNA, 25 bp, Homo sapien
gcggcccactcttaacgcgcaggtg

SEQ ID NO: 37081 - DNA, 25 bp, Homo sapien
cccgaacttggcttcgtcgaaccag

SEQ ID NO: 37082 - DNA, 25 bp, Homo sapien
agttgtcgcgcatgaagcgctggta

SEQ ID NO: 37083 - DNA, 25 bp, Homo sapien
cctctggtgctcaagaagggaaaga

SEQ ID NO: 37084 - DNA, 25 bp, Homo sapien
gaccgcgccatttggggctctccgg

SEQ ID NO: 37085 - DNA, 25 bp, Homo sapien
accgcgccatttggggctctccggg

SEQ ID NO: 37086 - DNA, 25 bp, Homo sapien
cggggacgtagagctccgccgccat

SEQ ID NO: 37087 - DNA, 25 bp, Homo sapien
atgagcgcgttcctctcgcgcagcg

SEQ ID NO: 37088 - DNA, 25 bp, Homo sapien
tgagcgcgttcctctcgcgcagcgt

SEQ ID NO: 37089 - DNA, 25 bp, Homo sapien
gggaccgcgccatttggggctctcc

SEQ ID NO: 37090 - DNA, 25 bp, Homo sapien
ggaccgcgccatttggggctctccg

SEQ ID NO: 37091 - DNA, 25 bp, Homo sapien
aggtcgggcgctgagcgacgcggcg

SEQ ID NO: 37092 - DNA, 25 bp, Homo sapien
catggcggcacctacttggaaaaga

SEQ ID NO: 37093 - DNA, 25 bp, Homo sapien
catggaggacgctgaccactgcagt

SEQ ID NO: 37094 - DNA, 25 bp, Homo sapien
caggctgtcctagggacggccacac

SEQ ID NO: 37095 - DNA, 25 bp, Homo sapien
gacccagggcattcaaggagcggct

SEQ ID NO: 37096 - DNA, 25 bp, Homo sapien
ctccgcgcaaacacagcaggctgga

SEQ ID NO: 37097 - DNA, 25 bp, Homo sapien
cgcgcaaagccaggataggaacaca

SEQ ID NO: 37098 - DNA, 25 bp, Homo sapien
taggaacacacaggcgagcgcacgc

SEQ ID NO: 37099 - DNA, 25 bp, Homo sapien
aagatgaccatcagcttcctccggc

SEQ ID NO: 37100 - DNA, 25 bp, Homo sapien
ctcagtggccctaattcgagaacca

SEQ ID NO: 37101 - DNA, 25 bp, Homo sapien
ctgccgcgttagttccgagcttgaa

SEQ ID NO: 37102 - DNA, 25 bp, Homo sapien
cgactccattttgtcggtagaggca

SEQ ID NO: 37103 - DNA, 25 bp, Homo sapien
caccggtggaccgagcagttactcc

SEQ ID NO: 37104 - DNA, 25 bp, Homo sapien
ggccgccggagaaaggactaagaca

SEQ ID NO: 37105 - DNA, 25 bp, Homo sapien
ccggagtatcttccatctgtcaata

SEQ ID NO: 37106 - DNA, 25 bp, Homo sapien
tcaatacaggctacaggactcagtg

SEQ ID NO: 37107 - DNA, 25 bp, Homo sapien
ggccactgggaagccaagcccttgt

SEQ ID NO: 37108 - DNA, 25 bp, Homo sapien
ggctacgcggcctcaatgccattgg

SEQ ID NO: 37109 - DNA, 25 bp, Homo sapien
cgttgccgaatggtgtgtatcgaca

SEQ ID NO: 37110 - DNA, 25 bp, Homo sapien
ccctttaggaggacgttgccgaatg

SEQ ID NO: 37111 - DNA, 25 bp, Homo sapien
agtagcttcccagtaaggcacacgc

SEQ ID NO: 37112 - DNA, 25 bp, Homo sapien
cccagagcttcaggtgcttgttctg

SEQ ID NO: 37113 - DNA, 25 bp, Homo sapien
gatgatcaataacccacggccagtc

SEQ ID NO: 37114 - DNA, 25 bp, Homo sapien
ccctgccgcctaggattcactgaga

SEQ ID NO: 37115 - DNA, 25 bp, Homo sapien
tgttcacctggacagcagtagcttc

SEQ ID NO: 37116 - DNA, 25 bp, Homo sapien
gcacttcgaaggctggtctctgaga

SEQ ID NO: 37117 - DNA, 25 bp, Homo sapien
accgcctgggtctcgcaggaaaaca

SEQ ID NO: 37118 - DNA, 25 bp, Homo sapien
tagaaccgtcgcagtcctgaccgcg

SEQ ID NO: 37119 - DNA, 25 bp, Homo sapien
gccgccgttctatctgatctccagg

SEQ ID NO: 37120 - DNA, 25 bp, Homo sapien
gcctggagcgctgaaagagttaatc

SEQ ID NO: 37121 - DNA, 25 bp, Homo sapien
tttcgccgcaaaggggcttggcaca

SEQ ID NO: 37122 - DNA, 25 bp, Homo sapien
gtcgaaaccatgattgccaggagca

SEQ ID NO: 37123 - DNA, 25 bp, Homo sapien
ccggcggtgtagttagaaaccagct

SEQ ID NO: 37124 - DNA, 25 bp, Homo sapien
cacaggcctaacattcgcgagtcca

SEQ ID NO: 37125 - DNA, 25 bp, Homo sapien
cggcagctgaatctggccagcccaa

SEQ ID NO: 37126 - DNA, 25 bp, Homo sapien
cagttgtcaccacttttcgggtgga

SEQ ID NO: 37127 - DNA, 25 bp, Homo sapien
gggcaactcccatggtggcttcttc

SEQ ID NO: 37128 - DNA, 25 bp, Homo sapien
ctagctcagccctggaattccgcaa

SEQ ID NO: 37129 - DNA, 25 bp, Homo sapien
tcccatgcggaggacatggtgcgcc

SEQ ID NO: 37130 - DNA, 25 bp, Homo sapien
gaactgcttcctacctggtccggtc

SEQ ID NO: 37131 - DNA, 25 bp, Homo sapien
ggtcgctatggcacccacaggccta

SEQ ID NO: 37132 - DNA, 25 bp, Homo sapien
tgtaaccttctcgtgagccaaagcc

SEQ ID NO: 37133 - DNA, 25 bp, Homo sapien
aacgtgctctgtgggattggtgaaa

SEQ ID NO: 37134 - DNA, 25 bp, Homo sapien
gccacggctgtctcatttgtaaaac

SEQ ID NO: 37135 - DNA, 25 bp, Homo sapien
cctccagaagccagatcgtcgggtg

SEQ ID NO: 37136 - DNA, 25 bp, Homo sapien
tctggaacagaggtgctgtctcctc

SEQ ID NO: 37137 - DNA, 25 bp, Homo sapien
cgttcttggtctaagcccgcttctg

SEQ ID NO: 37138 - DNA, 25 bp, Homo sapien
atacagacgctatgagccacggctg

SEQ ID NO: 37139 - DNA, 25 bp, Homo sapien
tctcctcgagttgtaagtttccagc

SEQ ID NO: 37140 - DNA, 25 bp, Homo sapien
agcatctgataatatccgggccgcc

SEQ ID NO: 37141 - DNA, 25 bp, Homo sapien
gagaaggtcgccagaggtcctgttt

SEQ ID NO: 37142 - DNA, 25 bp, Homo sapien
tctccgctcccggtggaaaacgaga

SEQ ID NO: 37143 - DNA, 25 bp, Homo sapien
tgtcctacggggctagcaggaaaag

SEQ ID NO: 37144 - DNA, 25 bp, Homo sapien
tcatattcctatgagctgctccggg

SEQ ID NO: 37145 - DNA, 25 bp, Homo sapien
accagccctgagtaaacgttcgtca

SEQ ID NO: 37146 - DNA, 25 bp, Homo sapien
cggggcgcagtgtacatagtaacca

SEQ ID NO: 37147 - DNA, 25 bp, Homo sapien
tgaaccgaggtaaactcgccgcgcg

SEQ ID NO: 37148 - DNA, 25 bp, Homo sapien
tgctttcatgctacatagagacgtg

SEQ ID NO: 37149 - DNA, 25 bp, Homo sapien
aggcggttcggcttctcaacctctt

SEQ ID NO: 37150 - DNA, 25 bp, Homo sapien
cggctccaacttgcaggcgtccatg

SEQ ID NO: 37151 - DNA, 25 bp, Homo sapien
agacgtgcatctgactgcttccctg

SEQ ID NO: 37152 - DNA, 25 bp, Homo sapien
cgctcgaaggatccaggtcagctgc

SEQ ID NO: 37153 - DNA, 25 bp, Homo sapien
cccgccgcaagttgcacgagtcatg

SEQ ID NO: 37154 - DNA, 25 bp, Homo sapien
tcttcttccacgcagagcggggctg

SEQ ID NO: 37155 - DNA, 25 bp, Homo sapien
tgcttcccgagcagagagctggtta

SEQ ID NO: 37156 - DNA, 25 bp, Homo sapien
ccgatgcgttgctgcgaacagcata

SEQ ID NO: 37157 - DNA, 25 bp, Homo sapien
cacgcctgtactgcagacacggtcg

SEQ ID NO: 37158 - DNA, 25 bp, Homo sapien
aggtcttctcaccacgcctgtactg

SEQ ID NO: 37159 - DNA, 25 bp, Homo sapien
ctgccgagtgaggtataggtcttct

SEQ ID NO: 37160 - DNA, 25 bp, Homo sapien
ctgcgaacagcataggtgagactct

SEQ ID NO: 37161 - DNA, 25 bp, Homo sapien
ccagacctttgattgcgcgctgtga

SEQ ID NO: 37162 - DNA, 25 bp, Homo sapien
accctccgaccgcagcgttgaatga

SEQ ID NO: 37163 - DNA, 25 bp, Homo sapien
agcataggtgagactctgccgagtg

SEQ ID NO: 37164 - DNA, 25 bp, Homo sapien
tggtcacgcgccacaaaaggacttg

SEQ ID NO: 37165 - DNA, 25 bp, Homo sapien
aaggattcctcctagagccggcgca

SEQ ID NO: 37166 - DNA, 25 bp, Homo sapien
tgggtcacgtcacattgcgcgaaca

SEQ ID NO: 37167 - DNA, 25 bp, Homo sapien
caagcctcttccactacgggtcgaa

SEQ ID NO: 37168 - DNA, 25 bp, Homo sapien
ttcaatcgcttcatggaactccagg

SEQ ID NO: 37169 - DNA, 25 bp, Homo sapien
tcgcccgcgtcactctgaggtaaca

SEQ ID NO: 37170 - DNA, 25 bp, Homo sapien
tcctctctcgtctggtaaacgcgta

SEQ ID NO: 37171 - DNA, 25 bp, Homo sapien
tgccaggctcgaccgctttacagac

SEQ ID NO: 37172 - DNA, 25 bp, Homo sapien
gtcacctggcacagcaacagcagca

SEQ ID NO: 37173 - DNA, 25 bp, Homo sapien
gagcagtcccggagcagaagcagca

SEQ ID NO: 37174 - DNA, 25 bp, Homo sapien
catggcgttgtcgatgccgctgaat

SEQ ID NO: 37175 - DNA, 25 bp, Homo sapien
tcttcgtcaaggtgagcgctcgcct

SEQ ID NO: 37176 - DNA, 25 bp, Homo sapien
agctcgacgccggacagtccagcga

SEQ ID NO: 37177 - DNA, 25 bp, Homo sapien
ctcccagccgtttgaagcggctcgg

SEQ ID NO: 37178 - DNA, 25 bp, Homo sapien
cagaggtcctttcttcggctccgga

SEQ ID NO: 37179 - DNA, 25 bp, Homo sapien
cagagcctgagctttgtaccgccca

SEQ ID NO: 37180 - DNA, 25 bp, Homo sapien
tggtgacgcacaagcagagcctgga

SEQ ID NO: 37181 - DNA, 25 bp, Homo sapien
cgcggctgcagcaaccagtacctgg

SEQ ID NO: 37182 - DNA, 25 bp, Homo sapien
tggcaactctgcgactactacctgc

SEQ ID NO: 37183 - DNA, 25 bp, Homo sapien
ctcaaggcggacgacgactccttcg

SEQ ID NO: 37184 - DNA, 25 bp, Homo sapien
acgtggccttcgagttcgtgctcaa

SEQ ID NO: 37185 - DNA, 25 bp, Homo sapien
ctacgaaaacctcacggccaaggtg

SEQ ID NO: 37186 - DNA, 25 bp, Homo sapien
cagcgtgatccgcagcacgtggctt

SEQ ID NO: 37187 - DNA, 25 bp, Homo sapien
cctggcacagcgaggacgtgtctct

SEQ ID NO: 37188 - DNA, 25 bp, Homo sapien
agggacccgctcacaccctaggtgg

SEQ ID NO: 37189 - DNA, 25 bp, Homo sapien
atcagatctgtcagggctgctgcgc

SEQ ID NO: 37190 - DNA, 25 bp, Homo sapien
ggcgccagttccctgcttctgagag

SEQ ID NO: 37191 - DNA, 25 bp, Homo sapien
ccaccggcagctagaggaagcgctt

SEQ ID NO: 37192 - DNA, 25 bp, Homo sapien
gccagccaatgtccacgcgaggtca

SEQ ID NO: 37193 - DNA, 25 bp, Homo sapien
tccttcctgtgtcgaacggacgctc

SEQ ID NO: 37194 - DNA, 25 bp, Homo sapien
tgccagacccgatcagcagcgttgt

SEQ ID NO: 37195 - DNA, 25 bp, Homo sapien
tcgacgctggcacttctgcatgtcc

SEQ ID NO: 37196 - DNA, 25 bp, Homo sapien
gagccggcccatcactggtcttgaa

SEQ ID NO: 37197 - DNA, 25 bp, Homo sapien
ccatcactggtcttgaaggttgtta

SEQ ID NO: 37198 - DNA, 25 bp, Homo sapien
ctgctggtgcaagaggccagcatgc

SEQ ID NO: 37199 - DNA, 25 bp, Homo sapien
ataatgcatcctggggtctgggaag

SEQ ID NO: 37200 - DNA, 25 bp, Homo sapien
agccagaggatgtcccgtagtagag

SEQ ID NO: 37201 - DNA, 25 bp, Homo sapien
ccacgctgaggctgctgatgctcgt

SEQ ID NO: 37202 - DNA, 25 bp, Homo sapien
agaccaccctggagcgcaggtccca

SEQ ID NO: 37203 - DNA, 25 bp, Homo sapien
ccgggataatgcatcctggggtctg

SEQ ID NO: 37204 - DNA, 25 bp, Homo sapien
aacctctacgacacgcggtgatcca

SEQ ID NO: 37205 - DNA, 25 bp, Homo sapien
acctctacgacacgcggtgatccga

SEQ ID NO: 37206 - DNA, 25 bp, Homo sapien
taaacctctacaacacgcggtgatc

SEQ ID NO: 37207 - DNA, 25 bp, Homo sapien
cgacacgcggtgatccgaacctcta

SEQ ID NO: 37208 - DNA, 25 bp, Homo sapien
acacgcggtgatccgaacctctacg

SEQ ID NO: 37209 - DNA, 25 bp, Homo sapien
cgacacgcggtgatccaaacctcta

SEQ ID NO: 37210 - DNA, 25 bp, Homo sapien
caacacgcggtgatctaaacctcta

SEQ ID NO: 37211 - DNA, 25 bp, Homo sapien
tacgacacgcggtgatccgaacctc

SEQ ID NO: 37212 - DNA, 25 bp, Homo sapien
gcgcgtcggtggcaaaagaaaaaca

SEQ ID NO: 37213 - DNA, 25 bp, Homo sapien
tgcatcgtgaaacggtacgcgcgtc

SEQ ID NO: 37214 - DNA, 25 bp, Homo sapien
cgacgaggcctgcaaaatgcgtttt

SEQ ID NO: 37215 - DNA, 25 bp, Homo sapien
gcggcctgtggctctttgaaaaaca

SEQ ID NO: 37216 - DNA, 25 bp, Homo sapien
tttcaggatcttgcaggcctcgcgg

SEQ ID NO: 37217 - DNA, 25 bp, Homo sapien
cacacgggattttgcgcgtcgtcca

SEQ ID NO: 37218 - DNA, 25 bp, Homo sapien
tgcttcgggcctgtgacttctgcaa

SEQ ID NO: 37219 - DNA, 25 bp, Homo sapien
agcccggggcaaatgctagaaattt

SEQ ID NO: 37220 - DNA, 25 bp, Homo sapien
cacctgcgacaaggagaactggctt

SEQ ID NO: 37221 - DNA, 25 bp, Homo sapien
ttgggacccttttagctatgaaata

SEQ ID NO: 37222 - DNA, 25 bp, Homo sapien
gtggaactcacctcggatgcagcta

SEQ ID NO: 37223 - DNA, 25 bp, Homo sapien
ttccggcaacaagatagagcacttc

SEQ ID NO: 37224 - DNA, 25 bp, Homo sapien
tagagcacttccgtcaaccttcaga

SEQ ID NO: 37225 - DNA, 25 bp, Homo sapien
caaccttcagacaaacgggccgata

SEQ ID NO: 37226 - DNA, 25 bp, Homo sapien
cgatacgtacgaatgggctaccata

SEQ ID NO: 37227 - DNA, 25 bp, Homo sapien
ctcccggaatttgcgcagtctctgt

SEQ ID NO: 37228 - DNA, 25 bp, Homo sapien
cgtttgtggctacgtctgtcctaga

SEQ ID NO: 37229 - DNA, 25 bp, Homo sapien
cggatgcatagtctcggacaccagc

SEQ ID NO: 37230 - DNA, 25 bp, Homo sapien
ctgcgccggaaacggatgcatagtc

SEQ ID NO: 37231 - DNA, 25 bp, Homo sapien
agactgcgcagatcccgtgcgctgc

SEQ ID NO: 37232 - DNA, 25 bp, Homo sapien
cttctccttacggagcccagaagcg

SEQ ID NO: 37233 - DNA, 25 bp, Homo sapien
gtctgaagacgcttctccttacgga

SEQ ID NO: 37234 - DNA, 25 bp, Homo sapien
ccagcagagggcctcggaagccaag

SEQ ID NO: 37235 - DNA, 25 bp, Homo sapien
agacactgggactgggtcgccagca

SEQ ID NO: 37236 - DNA, 25 bp, Homo sapien
tccacagagggtagagacactcggg

SEQ ID NO: 37237 - DNA, 25 bp, Homo sapien
agaccattgattgggaagagcggcc

SEQ ID NO: 37238 - DNA, 25 bp, Homo sapien
gcggagagagcgtccctgtccttcc

SEQ ID NO: 37239 - DNA, 25 bp, Homo sapien
gtgtgggacctgcaaccgccccata

SEQ ID NO: 37240 - DNA, 25 bp, Homo sapien
ccattctctaggtccacagagggta

SEQ ID NO: 37241 - DNA, 25 bp, Homo sapien
tctaggtccacagagggtagagaca

SEQ ID NO: 37242 - DNA, 25 bp, Homo sapien
tccgccacaaagagaccattgattg

SEQ ID NO: 37243 - DNA, 25 bp, Homo sapien
cgcacacgtcgttccagtccctccg

SEQ ID NO: 37244 - DNA, 25 bp, Homo sapien
tgcgcactgagggactacgttagca

SEQ ID NO: 37245 - DNA, 25 bp, Homo sapien
tttagtccctgctttcgaacggcga

SEQ ID NO: 37246 - DNA, 25 bp, Homo sapien
accactgcggtggtcctgagagacc

SEQ ID NO: 37247 - DNA, 25 bp, Homo sapien
gcccggccacatgtcgttcacgtag

SEQ ID NO: 37248 - DNA, 25 bp, Homo sapien
gcttctggaaaaagagcggctccta

SEQ ID NO: 37249 - DNA, 25 bp, Homo sapien
tctgagataattgcgggaccgaccc

SEQ ID NO: 37250 - DNA, 25 bp, Homo sapien
gactcctggacgaaaaccggctcga

SEQ ID NO: 37251 - DNA, 25 bp, Homo sapien
gacgcgtcaaaagtaccagaagctg

SEQ ID NO: 37252 - DNA, 25 bp, Homo sapien
ggtcaaagccgcagcaacgccgtct

SEQ ID NO: 37253 - DNA, 25 bp, Homo sapien
caccaaggagggctaccgagcacct

SEQ ID NO: 37254 - DNA, 25 bp, Homo sapien
ccagctaccggacaggcaccaagga

SEQ ID NO: 37255 - DNA, 25 bp, Homo sapien
cccgagagtgaccagctaccggaca

SEQ ID NO: 37256 - DNA, 25 bp, Homo sapien
atcgcatgtgcccttctgcacacga

SEQ ID NO: 37257 - DNA, 25 bp, Homo sapien
gcaacgccgtctctgtgtgatcgca

SEQ ID NO: 37258 - DNA, 25 bp, Homo sapien
cgggtgcaccatcgggtcaaagccg

SEQ ID NO: 37259 - DNA, 25 bp, Homo sapien
tgtgtgatcgcatgtgcccttctgc

SEQ ID NO: 37260 - DNA, 25 bp, Homo sapien
agcactcccgacgtccagctgtgaa

SEQ ID NO: 37261 - DNA, 25 bp, Homo sapien
acttctcacgcctactctcaaatgg

SEQ ID NO: 37262 - DNA, 25 bp, Homo sapien
gtactagaaaacactcgtcacctca

SEQ ID NO: 37263 - DNA, 25 bp, Homo sapien
tcagcacacagagcaacttctcacg

SEQ ID NO: 37264 - DNA, 25 bp, Homo sapien
gcctactctcaaatggcgtactcca

SEQ ID NO: 37265 - DNA, 25 bp, Homo sapien
atggcgtactccaaactagcactcc

SEQ ID NO: 37266 - DNA, 25 bp, Homo sapien
cggacgccttcctttagaacgctca

SEQ ID NO: 37267 - DNA, 25 bp, Homo sapien
agctgtgaacccagagcggcggaaa

SEQ ID NO: 37268 - DNA, 25 bp, Homo sapien
ctctgcaggcaggaaagagcttccc

SEQ ID NO: 37269 - DNA, 25 bp, Homo sapien
gcactgagtggccagccaagcgctc

SEQ ID NO: 37270 - DNA, 25 bp, Homo sapien
aagctatgtggcctcccggacgcca

SEQ ID NO: 37271 - DNA, 25 bp, Homo sapien
caggaccgaagctatgtggcctccc

SEQ ID NO: 37272 - DNA, 25 bp, Homo sapien
ctctgctgtccctggcaggaccgaa

SEQ ID NO: 37273 - DNA, 25 bp, Homo sapien
acatgccgaagcagccgtcacagct

SEQ ID NO: 37274 - DNA, 25 bp, Homo sapien
cggcgtcggagcacagcagatccca

SEQ ID NO: 37275 - DNA, 25 bp, Homo sapien
aagcagccgtcacagctccatgggc

SEQ ID NO: 37276 - DNA, 25 bp, Homo sapien
aggctgtggccgttttgttttcttg

SEQ ID NO: 37277 - DNA, 25 bp, Homo sapien
agaaaggagcgtgacccggccagct

SEQ ID NO: 37278 - DNA, 25 bp, Homo sapien
cttcacagctggacaagccgaagcc

SEQ ID NO: 37279 - DNA, 25 bp, Homo sapien
ccacttcacagctggacaagccgaa

SEQ ID NO: 37280 - DNA, 25 bp, Homo sapien
acagcacaggctcgttgccgccacc

SEQ ID NO: 37281 - DNA, 25 bp, Homo sapien
gaaccactgcacgacggggctggac

SEQ ID NO: 37282 - DNA, 25 bp, Homo sapien
ttcttggctaaaatcgggggagtga

SEQ ID NO: 37283 - DNA, 25 bp, Homo sapien
ggctccggaaccactgcacgacggg

SEQ ID NO: 37284 - DNA, 25 bp, Homo sapien
gcctactctcaaatggcgtactcca

SEQ ID NO: 37285 - DNA, 25 bp, Homo sapien
tcagcacacagagcaacttctcacg

SEQ ID NO: 37286 - DNA, 25 bp, Homo sapien
gtactagaaaacactcgtcacctca

SEQ ID NO: 37287 - DNA, 25 bp, Homo sapien
atggcgtactccaaactagcactcc

SEQ ID NO: 37288 - DNA, 25 bp, Homo sapien
agcactcccgacgtccagctgtgaa

SEQ ID NO: 37289 - DNA, 25 bp, Homo sapien
agctgtgaacccagagcggcggaaa

SEQ ID NO: 37290 - DNA, 25 bp, Homo sapien
tggtactgctgcatccgggtgtctg

SEQ ID NO: 37291 - DNA, 25 bp, Homo sapien
cggacgccttcctttagaacgctca

SEQ ID NO: 37292 - DNA, 25 bp, Homo sapien
cgagagcctacaatgccatgccgta

SEQ ID NO: 37293 - DNA, 25 bp, Homo sapien
ccgggccttccgatttcatacattg

SEQ ID NO: 37294 - DNA, 25 bp, Homo sapien
ccatgccgtacggtatgctctagta

SEQ ID NO: 37295 - DNA, 25 bp, Homo sapien
tggcgcattcttccgtccttcaaag

SEQ ID NO: 37296 - DNA, 25 bp, Homo sapien
agcggtttaccggtggcttctattg

SEQ ID NO: 37297 - DNA, 25 bp, Homo sapien
ctccatgtctgtgtgaccggcctca

SEQ ID NO: 37298 - DNA, 25 bp, Homo sapien
gctctccagcatccgcagaagggtc

SEQ ID NO: 37299 - DNA, 25 bp, Homo sapien
ccttacataatgacgcgactggctg

SEQ ID NO: 37300 - DNA, 25 bp, Homo sapien
gtcacagctctctggcttggctcca

SEQ ID NO: 37301 - DNA, 25 bp, Homo sapien
cagcccggcgttagcgctgagaagc

SEQ ID NO: 37302 - DNA, 25 bp, Homo sapien
cgaaggctgggcagtaaccaatgga

SEQ ID NO: 37303 - DNA, 25 bp, Homo sapien
accaatggacgactgtggcccaacg

SEQ ID NO: 37304 - DNA, 25 bp, Homo sapien
cccaacggggatccctcggatgcag

SEQ ID NO: 37305 - DNA, 25 bp, Homo sapien
gggatccctcggatgcagccaatgc

SEQ ID NO: 37306 - DNA, 25 bp, Homo sapien
gatgcagccaatgccctcgttgcgc

SEQ ID NO: 37307 - DNA, 25 bp, Homo sapien
cgctggaccattggcgcccgctgga

SEQ ID NO: 37308 - DNA, 25 bp, Homo sapien
ggaggactcgctccaaactccctga

SEQ ID NO: 37309 - DNA, 25 bp, Homo sapien
gggcaatagcatcccggcctccagg

SEQ ID NO: 37310 - DNA, 25 bp, Homo sapien
tctggaagtggtggctgaaatcgcc

SEQ ID NO: 37311 - DNA, 25 bp, Homo sapien
tgcggctgccgcagaagttcctctt

SEQ ID NO: 37312 - DNA, 25 bp, Homo sapien
ccacgatgctcatgaggaaagtgcc

SEQ ID NO: 37313 - DNA, 25 bp, Homo sapien
gactccgagggcttctggagccacc

SEQ ID NO: 37314 - DNA, 25 bp, Homo sapien
ttgacttcaacgcattccggagccg

SEQ ID NO: 37315 - DNA, 25 bp, Homo sapien
ccgaagcggcgaaactctcagggtt

SEQ ID NO: 37316 - DNA, 25 bp, Homo sapien
ggtttcctccaagtcgcaggctgtg

SEQ ID NO: 37317 - DNA, 25 bp, Homo sapien
cacttttgtgcaggatgagcgctct

SEQ ID NO: 37318 - DNA, 25 bp, Homo sapien
gatgagcgctctctagacagccctg

SEQ ID NO: 37319 - DNA, 25 bp, Homo sapien
aagtcgcaggctgtgtctgcctcgc

SEQ ID NO: 37320 - DNA, 25 bp, Homo sapien
tacccattccaggttcggtggctgc

SEQ ID NO: 37321 - DNA, 25 bp, Homo sapien
tgctggcgagatgcccgcttcctac

SEQ ID NO: 37322 - DNA, 25 bp, Homo sapien
ccggatgagcccgtgcacttttgtg

SEQ ID NO: 37323 - DNA, 25 bp, Homo sapien
tgcctcgcagtacccattccaggtt

SEQ ID NO: 37324 - DNA, 25 bp, Homo sapien
cagcaaagatgttcggtggcactta

SEQ ID NO: 37325 - DNA, 25 bp, Homo sapien
tggatgaatccgcagcaaatggctc

SEQ ID NO: 37326 - DNA, 25 bp, Homo sapien
cttatcagcgcggaatggctaatgg

SEQ ID NO: 37327 - DNA, 25 bp, Homo sapien
ccaggcgaagccaatattgttagga

SEQ ID NO: 37328 - DNA, 25 bp, Homo sapien
ctgcctaatttttgccagtggatca

SEQ ID NO: 37329 - DNA, 25 bp, Homo sapien
ccagtggatcatcggcctttggatg

SEQ ID NO: 37330 - DNA, 25 bp, Homo sapien
tgcagtaatgcatcacgggctgagg

SEQ ID NO: 37331 - DNA, 25 bp, Homo sapien
gcagctgctgcaaagacaaatcata

SEQ ID NO: 37332 - DNA, 25 bp, Homo sapien
gatcttctagccagtgacacttggg

SEQ ID NO: 37333 - DNA, 25 bp, Homo sapien
agacagcaactgcagcctccggagg

SEQ ID NO: 37334 - DNA, 25 bp, Homo sapien
aggagctcccgttctcctgagggga

SEQ ID NO: 37335 - DNA, 25 bp, Homo sapien
tgcgcgcggcaaagtttcactgagc

SEQ ID NO: 37336 - DNA, 25 bp, Homo sapien
aggcttctagtttcggcttcgctgc

SEQ ID NO: 37337 - DNA, 25 bp, Homo sapien
cgcgaccttccagcccgttagtaga

SEQ ID NO: 37338 - DNA, 25 bp, Homo sapien
cgagcttgaggtgagaaaggttcta

SEQ ID NO: 37339 - DNA, 25 bp, Homo sapien
tccgcggtatcggagcctacagccg

SEQ ID NO: 37340 - DNA, 25 bp, Homo sapien
ttcgtgtcatcgctgaatcttcgcg

SEQ ID NO: 37341 - DNA, 25 bp, Homo sapien
tttcaagagcggattcggaagctgc

SEQ ID NO: 37342 - DNA, 25 bp, Homo sapien
gtcctcgacctaagtggttaccaga

SEQ ID NO: 37343 - DNA, 25 bp, Homo sapien
tcgctttcatcatctccaggtgtcc

SEQ ID NO: 37344 - DNA, 25 bp, Homo sapien
cgtgttctttctgatccgctctttc

SEQ ID NO: 37345 - DNA, 25 bp, Homo sapien
tcccttgagtgcgtgcggcatattt

SEQ ID NO: 37346 - DNA, 25 bp, Homo sapien
gtgaacggttctcgacagcctcaga

SEQ ID NO: 37347 - DNA, 25 bp, Homo sapien
cgggcttaggaatttgttcgtgtca

SEQ ID NO: 37348 - DNA, 25 bp, Homo sapien
ggcgtcctctcacttagcccaggtg

SEQ ID NO: 37349 - DNA, 25 bp, Homo sapien
tggagagcaccctcgtctgcggcca

SEQ ID NO: 37350 - DNA, 25 bp, Homo sapien
tggcagataaaagagcagccgggca

SEQ ID NO: 37351 - DNA, 25 bp, Homo sapien
gtggcgtctcaggacttcctgtggc

SEQ ID NO: 37352 - DNA, 25 bp, Homo sapien
acttcctgtggcgtcacacagatgg

SEQ ID NO: 37353 - DNA, 25 bp, Homo sapien
cttctcgcacttcgggacgacggga

SEQ ID NO: 37354 - DNA, 25 bp, Homo sapien
gctgcgtttcccagctagagctcgg

SEQ ID NO: 37355 - DNA, 25 bp, Homo sapien
ccgaggccactctgctcgagatacg

SEQ ID NO: 37356 - DNA, 25 bp, Homo sapien
gcgccaaacagaggcacgtgacctc

SEQ ID NO: 37357 - DNA, 25 bp, Homo sapien
ccattctcgagaacaagggcagggc

SEQ ID NO: 37358 - DNA, 25 bp, Homo sapien
cgggcgcgcacaaaagcgccaaaca

SEQ ID NO: 37359 - DNA, 25 bp, Homo sapien
cagtttggtcctaaagccgctggtc

SEQ ID NO: 37360 - DNA, 25 bp, Homo sapien
tggctgcccgcagtttggtcctaaa

SEQ ID NO: 37361 - DNA, 25 bp, Homo sapien
tcaatcaccagctgcggtcgccagg

SEQ ID NO: 37362 - DNA, 25 bp, Homo sapien
gaagacagaagaaccctcgtggggc

SEQ ID NO: 37363 - DNA, 25 bp, Homo sapien
tccggccgcgaagacagaagaaccc

SEQ ID NO: 37364 - DNA, 25 bp, Homo sapien
acgactagggatggaagcacttggc

SEQ ID NO: 37365 - DNA, 25 bp, Homo sapien
agcccgaccgcagtactgacacgtg

SEQ ID NO: 37366 - DNA, 25 bp, Homo sapien
cagtactgacacgtgccgcgacgtc

SEQ ID NO: 37367 - DNA, 25 bp, Homo sapien
accgcacgaggtcgcgttcgcgagt

SEQ ID NO: 37368 - DNA, 25 bp, Homo sapien
cggccagtgcctgccgttagcttca

SEQ ID NO: 37369 - DNA, 25 bp, Homo sapien
actaggattgagtaagaaacgacta

SEQ ID NO: 37370 - DNA, 25 bp, Homo sapien
tagcttcaggaagaactaggattga

SEQ ID NO: 37371 - DNA, 25 bp, Homo sapien
agcacttggcactccgggtctcgga

SEQ ID NO: 37372 - DNA, 25 bp, Homo sapien
acctgccctgcgctaggaggtgccg

SEQ ID NO: 37373 - DNA, 25 bp, Homo sapien
ccactcggtggccaacgtctgccca

SEQ ID NO: 37374 - DNA, 25 bp, Homo sapien
agcacggggacgtcacaaccgcagc

SEQ ID NO: 37375 - DNA, 25 bp, Homo sapien
gcctgtaagaagcacggggacgtca

SEQ ID NO: 37376 - DNA, 25 bp, Homo sapien
gtctgcgccctgagtgcaccgagct

SEQ ID NO: 37377 - DNA, 25 bp, Homo sapien
gaagcgtactgtccagcctgtaaga

SEQ ID NO: 37378 - DNA, 25 bp, Homo sapien
ccggagccattgtccacaaacacag

SEQ ID NO: 37379 - DNA, 25 bp, Homo sapien
cattgtccacaaacacagaagcgta

SEQ ID NO: 37380 - DNA, 25 bp, Homo sapien
cgaaaccgcccaaggcctgggatgc

SEQ ID NO: 37381 - DNA, 25 bp, Homo sapien
ttcccgatgtacagtgcgcgagatt

SEQ ID NO: 37382 - DNA, 25 bp, Homo sapien
ctcaaatagtcctcaggcgtgccta

SEQ ID NO: 37383 - DNA, 25 bp, Homo sapien
gccgcgatttctgctctcgagcgga

SEQ ID NO: 37384 - DNA, 25 bp, Homo sapien
tggacgcttggaagcacttctcgtt

SEQ ID NO: 37385 - DNA, 25 bp, Homo sapien
gtcgtcgtagtttccaaggctcaaa

SEQ ID NO: 37386 - DNA, 25 bp, Homo sapien
tgagaaacgacccatgaacccgtgg

SEQ ID NO: 37387 - DNA, 25 bp, Homo sapien
cgcgagattgcgcattacaactcta

SEQ ID NO: 37388 - DNA, 25 bp, Homo sapien
tgcttctttccctcttaggcgcctg

SEQ ID NO: 37389 - DNA, 25 bp, Homo sapien
catcaaccagatagcggcagcgttc

SEQ ID NO: 37390 - DNA, 25 bp, Homo sapien
gcgttcggccacatgcccttgctgt

SEQ ID NO: 37391 - DNA, 25 bp, Homo sapien
tctggacccggtgctgtttaaggac

SEQ ID NO: 37392 - DNA, 25 bp, Homo sapien
tttaaggacccggtgtccgtgcagc

SEQ ID NO: 37393 - DNA, 25 bp, Homo sapien
tccgtgcagcgcaagaagtaccgca

SEQ ID NO: 37394 - DNA, 25 bp, Homo sapien
tatcatgtcagccagcgggcccaca

SEQ ID NO: 37395 - DNA, 25 bp, Homo sapien
ttgggacaccggagaacctatcatg

SEQ ID NO: 37396 - DNA, 25 bp, Homo sapien
tcccgacggcaggaatgtggctcct

SEQ ID NO: 37397 - DNA, 25 bp, Homo sapien
cctggcgtccaacagatgctgcttc

SEQ ID NO: 37398 - DNA, 25 bp, Homo sapien
tagaaatccgctttggtggtcccga

SEQ ID NO: 37399 - DNA, 25 bp, Homo sapien
tccttgcctcggaagagggtctcca

SEQ ID NO: 37400 - DNA, 25 bp, Homo sapien
ctgccctgggcttgatcatgttccc

SEQ ID NO: 37401 - DNA, 25 bp, Homo sapien
cagtgtctctccctaggaccggctg

SEQ ID NO: 37402 - DNA, 25 bp, Homo sapien
gtctccacccgcacagagaacagtg

SEQ ID NO: 37403 - DNA, 25 bp, Homo sapien
ggccgcgagaagtttgccagccttc

SEQ ID NO: 37404 - DNA, 25 bp, Homo sapien
gcggcagcgtctaccctgaggtaaa

SEQ ID NO: 37405 - DNA, 25 bp, Homo sapien
accgcccgcaaacatggctcagtga

SEQ ID NO: 37406 - DNA, 25 bp, Homo sapien
ccctccctgggaggcttgtcacaga

SEQ ID NO: 37407 - DNA, 25 bp, Homo sapien
agctgcccgataatggcggcctgca

SEQ ID NO: 37408 - DNA, 25 bp, Homo sapien
cccggctctgcaaatcctcgagaga

SEQ ID NO: 37409 - DNA, 25 bp, Homo sapien
tgactcggagaaaagctgcagtctc

SEQ ID NO: 37410 - DNA, 25 bp, Homo sapien
gggacggcatcctcccagatgatcg

SEQ ID NO: 37411 - DNA, 25 bp, Homo sapien
tcacagacgtgtcagcggagtcatc

SEQ ID NO: 37412 - DNA, 25 bp, Homo sapien
tcaaagtcccggatgggctcgagca

SEQ ID NO: 37413 - DNA, 25 bp, Homo sapien
ggacttgaccgccttctgcttgttg

SEQ ID NO: 37414 - DNA, 25 bp, Homo sapien
tccatgatggacaccgtgggcttcc

SEQ ID NO: 37415 - DNA, 25 bp, Homo sapien
ccgggactccgagaaaatggacttg

SEQ ID NO: 37416 - DNA, 25 bp, Homo sapien
ttgccttccatagagtccatgctga

SEQ ID NO: 37417 - DNA, 25 bp, Homo sapien
cgtcttgccatgcacgggacacttg

SEQ ID NO: 37418 - DNA, 25 bp, Homo sapien
gtcagccttggtgccattctccagg

SEQ ID NO: 37419 - DNA, 25 bp, Homo sapien
cccggactcgacaaactggatgatg

SEQ ID NO: 37420 - DNA, 25 bp, Homo sapien
gccaagtatgtcaagacgcaccagg

SEQ ID NO: 37421 - DNA, 25 bp, Homo sapien
gcttcttcaactactgcggcctgga

SEQ ID NO: 37422 - DNA, 25 bp, Homo sapien
cgcaccaggtgatagctaggcgaca

SEQ ID NO: 37423 - DNA, 25 bp, Homo sapien
cgaggcctgattccctcatcttcta

SEQ ID NO: 37424 - DNA, 25 bp, Homo sapien
ttctaccgccagaagcgggactgca

SEQ ID NO: 37425 - DNA, 25 bp, Homo sapien
actgcaaggcttcggtgaacaaaga

SEQ ID NO: 37426 - DNA, 25 bp, Homo sapien
ctggaagccgacaaagccaagtatg

SEQ ID NO: 37427 - DNA, 25 bp, Homo sapien
tcatccagtggctgtacggctgcca

SEQ ID NO: 37428 - DNA, 25 bp, Homo sapien
ctcatctcggccagtttgtgagtga

SEQ ID NO: 37429 - DNA, 25 bp, Homo sapien
acctgctggcgaacgcgtcccagaa

SEQ ID NO: 37430 - DNA, 25 bp, Homo sapien
agcctgctagtcacccttgggcgca

SEQ ID NO: 37431 - DNA, 25 bp, Homo sapien
ggggttctgccagcctgctagtcac

SEQ ID NO: 37432 - DNA, 25 bp, Homo sapien
gctgtcgggccagggttttttatca

SEQ ID NO: 37433 - DNA, 25 bp, Homo sapien
cacgcggtcacacaggctgtcgggc

SEQ ID NO: 37434 - DNA, 25 bp, Homo sapien
atgtctggacaaaagcacgcggtca

SEQ ID NO: 37435 - DNA, 25 bp, Homo sapien
agcagtctttctggatgtctggaca

SEQ ID NO: 37436 - DNA, 25 bp, Homo sapien
cccttcagtgggcacacttctggga

SEQ ID NO: 37437 - DNA, 25 bp, Homo sapien
tcctgagctcggtcactgacgtcga

SEQ ID NO: 37438 - DNA, 25 bp, Homo sapien
gcgcactctctagcccggcagatga

SEQ ID NO: 37439 - DNA, 25 bp, Homo sapien
ctgtttctggccatgggtcgctccc

SEQ ID NO: 37440 - DNA, 25 bp, Homo sapien
tgacgtagctgatcggcccggaagt

SEQ ID NO: 37441 - DNA, 25 bp, Homo sapien
agagtgacgtcatcagaggcggtcc

SEQ ID NO: 37442 - DNA, 25 bp, Homo sapien
aggcagcgcagagtcttctctcttg

SEQ ID NO: 37443 - DNA, 25 bp, Homo sapien
ttggatgagattcaccgcgagctgc

SEQ ID NO: 37444 - DNA, 25 bp, Homo sapien
aacggtgctcggtgttcatccatcg

SEQ ID NO: 37445 - DNA, 25 bp, Homo sapien
cagctggatagcattcgggcccatc

SEQ ID NO: 37446 - DNA, 25 bp, Homo sapien
ttgcgttgcccacaagcttgtagtc

SEQ ID NO: 37447 - DNA, 25 bp, Homo sapien
cctaggtcttgtggatggtgaactc

SEQ ID NO: 37448 - DNA, 25 bp, Homo sapien
agacgcccatgccaaccagtgagtg

SEQ ID NO: 37449 - DNA, 25 bp, Homo sapien
atacactgtacctgcacggccgagt

SEQ ID NO: 37450 - DNA, 25 bp, Homo sapien
ggtgaccttggccttcaacctgatc

SEQ ID NO: 37451 - DNA, 25 bp, Homo sapien
gcttctcgaccagcgatacactgta

SEQ ID NO: 37452 - DNA, 25 bp, Homo sapien
gctgcagtcagtcttcccgagtgag

SEQ ID NO: 37453 - DNA, 25 bp, Homo sapien
gctcgactcccgattggccagaggc

SEQ ID NO: 37454 - DNA, 25 bp, Homo sapien
ccttgctttgccgtccgtggttcac

SEQ ID NO: 37455 - DNA, 25 bp, Homo sapien
agcctcagtcctagtggccgacctt

SEQ ID NO: 37456 - DNA, 25 bp, Homo sapien
cgcccgctttcaggcccgtgtaagt

SEQ ID NO: 37457 - DNA, 25 bp, Homo sapien
cgtccggctctctgagcagagggta

SEQ ID NO: 37458 - DNA, 25 bp, Homo sapien
ctcggctgccgattggtcagaagag

SEQ ID NO: 37459 - DNA, 25 bp, Homo sapien
tcatgcgcagaaagatccgtccggc

SEQ ID NO: 37460 - DNA, 25 bp, Homo sapien
gcgtctacagcacgtcggtcaccgg

SEQ ID NO: 37461 - DNA, 25 bp, Homo sapien
ttgcagccgcggcatgaacttcccg

SEQ ID NO: 37462 - DNA, 25 bp, Homo sapien
tgaatgtcttcatcgggcatcctgg

SEQ ID NO: 37463 - DNA, 25 bp, Homo sapien
tgctttggaccctagcgcccgggac

SEQ ID NO: 37464 - DNA, 25 bp, Homo sapien
ctgtatcccggtgctttggacccta

SEQ ID NO: 37465 - DNA, 25 bp, Homo sapien
accggctcccgcgaagtaagtgcgc

SEQ ID NO: 37466 - DNA, 25 bp, Homo sapien
cgaaaaggacgatcagggcagccgc

SEQ ID NO: 37467 - DNA, 25 bp, Homo sapien
aaagcgcagggctgtatcccggtgc

SEQ ID NO: 37468 - DNA, 25 bp, Homo sapien
ccagcgccgcatggctccgtcccga

SEQ ID NO: 37469 - DNA, 25 bp, Homo sapien
ggggctcacactcggacgatcagcc

SEQ ID NO: 37470 - DNA, 25 bp, Homo sapien
ctcagcgcggcgagtctcggcgcca

SEQ ID NO: 37471 - DNA, 25 bp, Homo sapien
actcggacgatcagccagccgcccg

SEQ ID NO: 37472 - DNA, 25 bp, Homo sapien
cgaggaggaccacgaccgcggccca

SEQ ID NO: 37473 - DNA, 25 bp, Homo sapien
ctggccaggctgctgcgtcctctgt

SEQ ID NO: 37474 - DNA, 25 bp, Homo sapien
gcccacgtgcgtcccggccgcgtac

SEQ ID NO: 37475 - DNA, 25 bp, Homo sapien
cactccgccgcccagtaaatcctcc

SEQ ID NO: 37476 - DNA, 25 bp, Homo sapien
cctccacgcgtagtcatggtaagca

SEQ ID NO: 37477 - DNA, 25 bp, Homo sapien
gggagcgacgtctatcacgatctaa

SEQ ID NO: 37478 - DNA, 25 bp, Homo sapien
catcttgttgtcacgcggtttccta

SEQ ID NO: 37479 - DNA, 25 bp, Homo sapien
ctccaggggcagaaaggtcttaagc

SEQ ID NO: 37480 - DNA, 25 bp, Homo sapien
tgctcggattctattggcccacaga

SEQ ID NO: 37481 - DNA, 25 bp, Homo sapien
tggcccacagagtcggtattcttcg

SEQ ID NO: 37482 - DNA, 25 bp, Homo sapien
tcgcgggcgaatcccagaatgcacc

SEQ ID NO: 37483 - DNA, 25 bp, Homo sapien
ggacccgtgcacttctcattggcta

SEQ ID NO: 37484 - DNA, 25 bp, Homo sapien
cctcaaatagcacgacggccgggtc

SEQ ID NO: 37485 - DNA, 25 bp, Homo sapien
cgggtcacttacacgccgctgagca

SEQ ID NO: 37486 - DNA, 25 bp, Homo sapien
gagaagcccacctcctggtaggcca

SEQ ID NO: 37487 - DNA, 25 bp, Homo sapien
tcgcagttacgatacacgcccttct

SEQ ID NO: 37488 - DNA, 25 bp, Homo sapien
gccttgtcttctctaggtttcagta

SEQ ID NO: 37489 - DNA, 25 bp, Homo sapien
tacctttgagacgaagtgcagatcg

SEQ ID NO: 37490 - DNA, 25 bp, Homo sapien
cggagtccctgccttacctttgaga

SEQ ID NO: 37491 - DNA, 25 bp, Homo sapien
gcggcctggtcatcttcgaaagaga

SEQ ID NO: 37492 - DNA, 25 bp, Homo sapien
ggcctcacagtcacagagctgctca

SEQ ID NO: 37493 - DNA, 25 bp, Homo sapien
acatgacctcccaccactgtggtgg

SEQ ID NO: 37494 - DNA, 25 bp, Homo sapien
ccaccactgtggtggtccgcacagt

SEQ ID NO: 37495 - DNA, 25 bp, Homo sapien
tcgcctgaggacactggcctcacag

SEQ ID NO: 37496 - DNA, 25 bp, Homo sapien
tccgcacagtgcgtgtcactcggta

SEQ ID NO: 37497 - DNA, 25 bp, Homo sapien
tcactcggtattcctcgaggctccg

SEQ ID NO: 37498 - DNA, 25 bp, Homo sapien
caccactggcggcaccatgcgggag

SEQ ID NO: 37499 - DNA, 25 bp, Homo sapien
gcaccatgcgggagacctgacggcc

SEQ ID NO: 37500 - DNA, 25 bp, Homo sapien
acggcatcccgctgcgttcgtacag

SEQ ID NO: 37501 - DNA, 25 bp, Homo sapien
atgttgggccctaccggctggagaa

SEQ ID NO: 37502 - DNA, 25 bp, Homo sapien
cccagagcgatgacatcgacgggga

SEQ ID NO: 37503 - DNA, 25 bp, Homo sapien
ccctgtcctctcgacgaggcggagg

SEQ ID NO: 37504 - DNA, 25 bp, Homo sapien
gcttggctacatggctcggctgcgc

SEQ ID NO: 37505 - DNA, 25 bp, Homo sapien
cagcacgcgcagtatgttgggccct

SEQ ID NO: 37506 - DNA, 25 bp, Homo sapien
ctcgtgtcgactcggctccgttgcg

SEQ ID NO: 37507 - DNA, 25 bp, Homo sapien
cgttcgtacaggctcgtgtcgactc

SEQ ID NO: 37508 - DNA, 25 bp, Homo sapien
ctccctatgggaagcacttacggcc

SEQ ID NO: 37509 - DNA, 25 bp, Homo sapien
gggctacccgcatccgctgcatttg

SEQ ID NO: 37510 - DNA, 25 bp, Homo sapien
ccagacgttcggcaagagcccttgc

SEQ ID NO: 37511 - DNA, 25 bp, Homo sapien
tgagctagcccgagagcaagacctg

SEQ ID NO: 37512 - DNA, 25 bp, Homo sapien
gtcttgccgaatgggagggtctaac

SEQ ID NO: 37513 - DNA, 25 bp, Homo sapien
tgccattgttctgccacggtcagtg

SEQ ID NO: 37514 - DNA, 25 bp, Homo sapien
cttggaaccgggaccttagctactg

SEQ ID NO: 37515 - DNA, 25 bp, Homo sapien
ctcggccatggcgagtgaaagaccc

SEQ ID NO: 37516 - DNA, 25 bp, Homo sapien
accagcagtttgcaggttcgagctc

SEQ ID NO: 37517 - DNA, 25 bp, Homo sapien
caggtgagactgattccggtaactt

SEQ ID NO: 37518 - DNA, 25 bp, Homo sapien
accgggataggtttcttctcttctg

SEQ ID NO: 37519 - DNA, 25 bp, Homo sapien
gagcaaaactttcggggcactactg

SEQ ID NO: 37520 - DNA, 25 bp, Homo sapien
cttctgcttcatagggccgtctctg

SEQ ID NO: 37521 - DNA, 25 bp, Homo sapien
ggaactgagtcctaggctgcccaaa

SEQ ID NO: 37522 - DNA, 25 bp, Homo sapien
cttagcggggacactttaggattca

SEQ ID NO: 37523 - DNA, 25 bp, Homo sapien
gtctaggcgcccatatccacgggtg

SEQ ID NO: 37524 - DNA, 25 bp, Homo sapien
tgccagcgccacgtcatgaggaagt

SEQ ID NO: 37525 - DNA, 25 bp, Homo sapien
cactgaagccgtggggacgcgccca

SEQ ID NO: 37526 - DNA, 25 bp, Homo sapien
gccgagaagcgcctcgattcttgcc

SEQ ID NO: 37527 - DNA, 25 bp, Homo sapien
cctggctcatttccctggcgcgttt

SEQ ID NO: 37528 - DNA, 25 bp, Homo sapien
tgtcgcagcgcccaaagatgacgtg

SEQ ID NO: 37529 - DNA, 25 bp, Homo sapien
aagatgacgtgttctgccagcgcca

SEQ ID NO: 37530 - DNA, 25 bp, Homo sapien
aagtgccggcccactgaagccgtgg

SEQ ID NO: 37531 - DNA, 25 bp, Homo sapien
cgtcatgaggaagtgccggcccact

SEQ ID NO: 37532 - DNA, 25 bp, Homo sapien
ccatgttggcggctgtttatcccgc

SEQ ID NO: 37533 - DNA, 25 bp, Homo sapien
gctagtttgcaaaagacagctcttg

SEQ ID NO: 37534 - DNA, 25 bp, Homo sapien
tcctcactccctccagaggaggtga

SEQ ID NO: 37535 - DNA, 25 bp, Homo sapien
ggctcccagcgctataaaaacttta

SEQ ID NO: 37536 - DNA, 25 bp, Homo sapien
ctccctggtgcagggagcgagaatc

SEQ ID NO: 37537 - DNA, 25 bp, Homo sapien
aaagccgctgagatgcgccgtgagt

SEQ ID NO: 37538 - DNA, 25 bp, Homo sapien
ctgcgggcgggcaattcaaacccga

SEQ ID NO: 37539 - DNA, 25 bp, Homo sapien
catgcccaagagaaaggtacgtggc

SEQ ID NO: 37540 - DNA, 25 bp, Homo sapien
gcagggtatcgaaagccgatcgcca

SEQ ID NO: 37541 - DNA, 25 bp, Homo sapien
cgacatccaggccaggagcgtcgct

SEQ ID NO: 37542 - DNA, 25 bp, Homo sapien
cactcctggaccctagctcggaagg

SEQ ID NO: 37543 - DNA, 25 bp, Homo sapien
gatcgccagaggctcctcggtgcct

SEQ ID NO: 37544 - DNA, 25 bp, Homo sapien
ctcgacaaggatacggcccgacatc

SEQ ID NO: 37545 - DNA, 25 bp, Homo sapien
gagcgtcctgtccagctcccaagtg

SEQ ID NO: 37546 - DNA, 25 bp, Homo sapien
ggacattgcgcttaggggtcgcctt

SEQ ID NO: 37547 - DNA, 25 bp, Homo sapien
cctcgaagaactctcgtggggccgc

SEQ ID NO: 37548 - DNA, 25 bp, Homo sapien
tggccgctcatggagctagtgcctc

SEQ ID NO: 37549 - DNA, 25 bp, Homo sapien
ggacagttccgccaagcgccgacta

SEQ ID NO: 37550 - DNA, 25 bp, Homo sapien
cctccgatctcttgcccactgtccg

SEQ ID NO: 37551 - DNA, 25 bp, Homo sapien
cgagggcgcgagtgccctccgatct

SEQ ID NO: 37552 - DNA, 25 bp, Homo sapien
cgagcccggatcctcacaggggcgg

SEQ ID NO: 37553 - DNA, 25 bp, Homo sapien
gctcaaggagccctggccgctcatg

SEQ ID NO: 37554 - DNA, 25 bp, Homo sapien
tcatggagctagtgcctctggaccc

SEQ ID NO: 37555 - DNA, 25 bp, Homo sapien
cgtgtgcgagggacagttccgccaa

SEQ ID NO: 37556 - DNA, 25 bp, Homo sapien
gagcgcccacttccattcctggaga

SEQ ID NO: 37557 - DNA, 25 bp, Homo sapien
cgcctttcctgagcttcggtacaaa

SEQ ID NO: 37558 - DNA, 25 bp, Homo sapien
tagagctcagctttcacattcccgc

SEQ ID NO: 37559 - DNA, 25 bp, Homo sapien
cagaaacccgggtctgcggactaga

SEQ ID NO: 37560 - DNA, 25 bp, Homo sapien
cgagcgcacggagacatcaagtagt

SEQ ID NO: 37561 - DNA, 25 bp, Homo sapien
gtagtccctcagagcgaccttgtta

SEQ ID NO: 37562 - DNA, 25 bp, Homo sapien
tcaggtagttaggtctgagcgccca

SEQ ID NO: 37563 - DNA, 25 bp, Homo sapien
tcggtacaaactccgcagctagagc

SEQ ID NO: 37564 - DNA, 25 bp, Homo sapien
gcggtacatcccacccaggcgaagt

SEQ ID NO: 37565 - DNA, 25 bp, Homo sapien
cctctgccatgttccgtggacagcg

SEQ ID NO: 37566 - DNA, 25 bp, Homo sapien
ggccggagccattacctactgtgaa

SEQ ID NO: 37567 - DNA, 25 bp, Homo sapien
ccaccagcataggaggacgggcttc

SEQ ID NO: 37568 - DNA, 25 bp, Homo sapien
tggcccaccggacataaggaattca

SEQ ID NO: 37569 - DNA, 25 bp, Homo sapien
gaaaaggctctgcaggtacccaagg

SEQ ID NO: 37570 - DNA, 25 bp, Homo sapien
cccaagcactttctagaaggaatgt

SEQ ID NO: 37571 - DNA, 25 bp, Homo sapien
cgacgcgatgcacctgcggtacatc

SEQ ID NO: 37572 - DNA, 25 bp, Homo sapien
tggcggacaacaaagccctggcctg

SEQ ID NO: 37573 - DNA, 25 bp, Homo sapien
ccgagcctacagagccgggagcagc

SEQ ID NO: 37574 - DNA, 25 bp, Homo sapien
aagacgaagacagggccgggtctct

SEQ ID NO: 37575 - DNA, 25 bp, Homo sapien
cgccctcggagctgaagaaagccga

SEQ ID NO: 37576 - DNA, 25 bp, Homo sapien
cggagccggacctgaagaactcgaa

SEQ ID NO: 37577 - DNA, 25 bp, Homo sapien
cctgaagaactcgaacgggaacgcg

SEQ ID NO: 37578 - DNA, 25 bp, Homo sapien
tgaacaataacctcacggagccgcc

SEQ ID NO: 37579 - DNA, 25 bp, Homo sapien
cgtcttccaccaacaacatggcgga

SEQ ID NO: 37580 - DNA, 25 bp, Homo sapien
gcagcctccgctcactatttgaagg

SEQ ID NO: 37581 - DNA, 25 bp, Homo sapien
aatggaagccggtagaaatgagaca

SEQ ID NO: 37582 - DNA, 25 bp, Homo sapien
gcgggtcagcctccgactacaagag

SEQ ID NO: 37583 - DNA, 25 bp, Homo sapien
ccacaccgggaactcagtgaacgtc

SEQ ID NO: 37584 - DNA, 25 bp, Homo sapien
actgactctgagacagcagcctccg

SEQ ID NO: 37585 - DNA, 25 bp, Homo sapien
cgagagaactcttcaggtgtcacca

SEQ ID NO: 37586 - DNA, 25 bp, Homo sapien
cggagtcaacatggccgccgcgcag

SEQ ID NO: 37587 - DNA, 25 bp, Homo sapien
aaatgagacagacgcccggagaagc

SEQ ID NO: 37588 - DNA, 25 bp, Homo sapien
ctcgcctatagcctttcagggctcg

SEQ ID NO: 37589 - DNA, 25 bp, Homo sapien
ctatagcctttcagggctcgctccg

SEQ ID NO: 37590 - DNA, 25 bp, Homo sapien
cagagtgagcgggtcgctctccgcc

SEQ ID NO: 37591 - DNA, 25 bp, Homo sapien
ccgagctgccgctcgcggatctaag

SEQ ID NO: 37592 - DNA, 25 bp, Homo sapien
tgccgctcgcggatctaaggccgag

SEQ ID NO: 37593 - DNA, 25 bp, Homo sapien
gcactcacccgaggcgaagggacgc

SEQ ID NO: 37594 - DNA, 25 bp, Homo sapien
ctcacccgaggcgaagggacgccag

SEQ ID NO: 37595 - DNA, 25 bp, Homo sapien
cggacgcaggacagcaggacacgca

SEQ ID NO: 37596 - DNA, 25 bp, Homo sapien
caggatgcgagcaaaagacccggca

SEQ ID NO: 37597 - DNA, 25 bp, Homo sapien
aagcgctgcacgagctgtgtcttcc

SEQ ID NO: 37598 - DNA, 25 bp, Homo sapien
ccggccaggctgttcttgctctaaa

SEQ ID NO: 37599 - DNA, 25 bp, Homo sapien
cctgctagcctaggaagcgcatcga

SEQ ID NO: 37600 - DNA, 25 bp, Homo sapien
tcgctaggctttgatggctgcttcc

SEQ ID NO: 37601 - DNA, 25 bp, Homo sapien
cgacgccggcatgggctttacgtct

SEQ ID NO: 37602 - DNA, 25 bp, Homo sapien
aaaggcctgtttcatggccgacgcc

SEQ ID NO: 37603 - DNA, 25 bp, Homo sapien
agcccgctcaagctgaagcgctgca

SEQ ID NO: 37604 - DNA, 25 bp, Homo sapien
ttaacatatcccagggcagtgcgga

SEQ ID NO: 37605 - DNA, 25 bp, Homo sapien
taagtaatagcatttccagacagga

SEQ ID NO: 37606 - DNA, 25 bp, Homo sapien
ttccagacaggaaagtgactgattt

SEQ ID NO: 37607 - DNA, 25 bp, Homo sapien
agtgactgattttgaggagttatta

SEQ ID NO: 37608 - DNA, 25 bp, Homo sapien
aggagttattaacatatcccagggc

SEQ ID NO: 37609 - DNA, 25 bp, Homo sapien
gttattaacatatcccagggcagtg

SEQ ID NO: 37610 - DNA, 25 bp, Homo sapien
acatgtatataattttctcttctcc

SEQ ID NO: 37611 - DNA, 25 bp, Homo sapien
ttcagttttaagtaatagcatttcc

SEQ ID NO: 37612 - DNA, 25 bp, Homo sapien
cgtttggcaccgtgcctggtacaca

SEQ ID NO: 37613 - DNA, 25 bp, Homo sapien
actgcgagtaccagcagatcagccc

SEQ ID NO: 37614 - DNA, 25 bp, Homo sapien
ctggctgcatgaaggactgcgagta

SEQ ID NO: 37615 - DNA, 25 bp, Homo sapien
tcagagctgggcctccggccaagcg

SEQ ID NO: 37616 - DNA, 25 bp, Homo sapien
tccaccacctgaatctcggcgtttg

SEQ ID NO: 37617 - DNA, 25 bp, Homo sapien
acggcttgcttgcagaacagaaaga

SEQ ID NO: 37618 - DNA, 25 bp, Homo sapien
agtggacgcccaacaaacggcttgc

SEQ ID NO: 37619 - DNA, 25 bp, Homo sapien
aaagagccctcgagtgcgcgtctgc

SEQ ID NO: 37620 - DNA, 25 bp, Homo sapien
gtggccaccggtgacgacaagaagc

SEQ ID NO: 37621 - DNA, 25 bp, Homo sapien
gagccgggtcttctacctgaagatg

SEQ ID NO: 37622 - DNA, 25 bp, Homo sapien
ccgaggtgcgtgagtaccgggagaa

SEQ ID NO: 37623 - DNA, 25 bp, Homo sapien
agaaggtggagactgagctccaggg

SEQ ID NO: 37624 - DNA, 25 bp, Homo sapien
tccagggcgtgtgcgacaccgtgct

SEQ ID NO: 37625 - DNA, 25 bp, Homo sapien
tgctggacagccacctcatcaagga

SEQ ID NO: 37626 - DNA, 25 bp, Homo sapien
ctggacagccacctcatcaaggagg

SEQ ID NO: 37627 - DNA, 25 bp, Homo sapien
ccgagagccgggtcttctacctgaa

SEQ ID NO: 37628 - DNA, 25 bp, Homo sapien
tgcaggcgggtcacagtttcatcaa

SEQ ID NO: 37629 - DNA, 25 bp, Homo sapien
ctccggcgtgagatctaaggacagc

SEQ ID NO: 37630 - DNA, 25 bp, Homo sapien
agcggcactgagcacccgatttgca

SEQ ID NO: 37631 - DNA, 25 bp, Homo sapien
tagcgccgccaaaaaagcctagatc

SEQ ID NO: 37632 - DNA, 25 bp, Homo sapien
ctagatcttaggagagggtcacgtc

SEQ ID NO: 37633 - DNA, 25 bp, Homo sapien
ggtcacgtcccacagagttcggaga

SEQ ID NO: 37634 - DNA, 25 bp, Homo sapien
tggcggacaccacgactcgctgact

SEQ ID NO: 37635 - DNA, 25 bp, Homo sapien
ggtttcactcagacaagttgccgcc

SEQ ID NO: 37636 - DNA, 25 bp, Homo sapien
tccaggttggcttccaggtactcca

SEQ ID NO: 37637 - DNA, 25 bp, Homo sapien
agactaactcgacttccggacagcg

SEQ ID NO: 37638 - DNA, 25 bp, Homo sapien
ccgtgtcgcgcaaaaggagataaca

SEQ ID NO: 37639 - DNA, 25 bp, Homo sapien
tacgtatacctcgttggcggccagc

SEQ ID NO: 37640 - DNA, 25 bp, Homo sapien
ggagctccagtagtaaacgtcttta

SEQ ID NO: 37641 - DNA, 25 bp, Homo sapien
agccgcatttctctcgcgggtagtg

SEQ ID NO: 37642 - DNA, 25 bp, Homo sapien
gcgggaaaatcgctctcggaatttc

SEQ ID NO: 37643 - DNA, 25 bp, Homo sapien
catgcccaggcagtacgtggtcttc

SEQ ID NO: 37644 - DNA, 25 bp, Homo sapien
tagctccgtaaatgggccgagcgca

SEQ ID NO: 37645 - DNA, 25 bp, Homo sapien
gcgctcttctcggaactggctaaaa

SEQ ID NO: 37646 - DNA, 25 bp, Homo sapien
cccttaccgagatgacgcagcagca

SEQ ID NO: 37647 - DNA, 25 bp, Homo sapien
aggggataccgctcactaccaggta

SEQ ID NO: 37648 - DNA, 25 bp, Homo sapien
gcggcccgagtacatgcgaataagc

SEQ ID NO: 37649 - DNA, 25 bp, Homo sapien
gacccggtagccaagtcccgtgaga

SEQ ID NO: 37650 - DNA, 25 bp, Homo sapien
cgccatcttggattgtcacatgatc

SEQ ID NO: 37651 - DNA, 25 bp, Homo sapien
tgatcagctagaaccaagtctcgcg

SEQ ID NO: 37652 - DNA, 25 bp, Homo sapien
aggtctcacccggttcgcatcagtc

SEQ ID NO: 37653 - DNA, 25 bp, Homo sapien
ggttcgacggcatgttgctggccat

SEQ ID NO: 37654 - DNA, 25 bp, Homo sapien
tggctccgaatgtcgaccaatggtc

SEQ ID NO: 37655 - DNA, 25 bp, Homo sapien
gttgcttgccgcacggtcaatggcc

SEQ ID NO: 37656 - DNA, 25 bp, Homo sapien
ctccgctgcggaaggcggacgacta

SEQ ID NO: 37657 - DNA, 25 bp, Homo sapien
tgctggccatggctcagcagcacga

SEQ ID NO: 37658 - DNA, 25 bp, Homo sapien
cttgttgattggctccgaatgtcga

SEQ ID NO: 37659 - DNA, 25 bp, Homo sapien
gtcaatggccgcaaaccgggaggaa

SEQ ID NO: 37660 - DNA, 25 bp, Homo sapien
ccgttcagcctagtccgggtaggtg

SEQ ID NO: 37661 - DNA, 25 bp, Homo sapien
gtgagcaccagcgtttgtcccatcc

SEQ ID NO: 37662 - DNA, 25 bp, Homo sapien
cctggggacaaggaagaaccagatc

SEQ ID NO: 37663 - DNA, 25 bp, Homo sapien
agagtcccatatccgcgggcagcta

SEQ ID NO: 37664 - DNA, 25 bp, Homo sapien
cagtcctgctcgagaaacagccgtc

SEQ ID NO: 37665 - DNA, 25 bp, Homo sapien
cacactcaagggtctatgtaccgtc

SEQ ID NO: 37666 - DNA, 25 bp, Homo sapien
ttctcgttgatgctttcctcttccc

SEQ ID NO: 37667 - DNA, 25 bp, Homo sapien
gccctccctggatttctcgttgatg

SEQ ID NO: 37668 - DNA, 25 bp, Homo sapien
ggtgcaaccgatcgcactgtcgcgc

SEQ ID NO: 37669 - DNA, 25 bp, Homo sapien
cagcaagggccagactctgcgctag

SEQ ID NO: 37670 - DNA, 25 bp, Homo sapien
gcaagggccagactctgcgctagca

SEQ ID NO: 37671 - DNA, 25 bp, Homo sapien
cctgtcgcagaaggtgcaaccgatc

SEQ ID NO: 37672 - DNA, 25 bp, Homo sapien
tgtcgcagaaggtgcaaccgatcgc

SEQ ID NO: 37673 - DNA, 25 bp, Homo sapien
cgcagaaggtgcaaccgatcgcact

SEQ ID NO: 37674 - DNA, 25 bp, Homo sapien
cagaaggtgcaaccgatcgcactgt

SEQ ID NO: 37675 - DNA, 25 bp, Homo sapien
aaggtgcaaccgatcgcactgtcgc

SEQ ID NO: 37676 - DNA, 25 bp, Homo sapien
aatcccgttctggacgaggtgcgtc

SEQ ID NO: 37677 - DNA, 25 bp, Homo sapien
ccgttctggacgaggtgcgtctccc

SEQ ID NO: 37678 - DNA, 25 bp, Homo sapien
atgcccgttgagcagctgaatcccg

SEQ ID NO: 37679 - DNA, 25 bp, Homo sapien
cccgttgagcagctgaatcccgttc

SEQ ID NO: 37680 - DNA, 25 bp, Homo sapien
gttgagcagctgaatcccgttctgg

SEQ ID NO: 37681 - DNA, 25 bp, Homo sapien
ctgaatcccgttctggacgaggtgc

SEQ ID NO: 37682 - DNA, 25 bp, Homo sapien
cgcatgcccgttgagcagctgaatc

SEQ ID NO: 37683 - DNA, 25 bp, Homo sapien
gagcagctgaatcccgttctggacg

SEQ ID NO: 37684 - DNA, 25 bp, Homo sapien
cgtacttgaccgtgtaagcaaaggc

SEQ ID NO: 37685 - DNA, 25 bp, Homo sapien
aggctgcaaacccaactatcacaaa

SEQ ID NO: 37686 - DNA, 25 bp, Homo sapien
tcacaaacaagttcgccagggcgcc

SEQ ID NO: 37687 - DNA, 25 bp, Homo sapien
ccacccaggagtccgtggtgccggt

SEQ ID NO: 37688 - DNA, 25 bp, Homo sapien
cctcagcacgtacttgaccgtgtaa

SEQ ID NO: 37689 - DNA, 25 bp, Homo sapien
cactcctgcgcgatgctcctcagca

SEQ ID NO: 37690 - DNA, 25 bp, Homo sapien
tgcgcggtgccctcagtggcgcctt

SEQ ID NO: 37691 - DNA, 25 bp, Homo sapien
gtcacgctctggtgcgcggtgccct

SEQ ID NO: 37692 - DNA, 25 bp, Homo sapien
gtgcaaaacacaggctcgcagcgct

SEQ ID NO: 37693 - DNA, 25 bp, Homo sapien
gaggccgctcgcacaaagccgcgga

SEQ ID NO: 37694 - DNA, 25 bp, Homo sapien
tgcctgcagacggaaagacgggccc

SEQ ID NO: 37695 - DNA, 25 bp, Homo sapien
gggtggcaccttcaagcctgagccc

SEQ ID NO: 37696 - DNA, 25 bp, Homo sapien
acgcggacagcatcagcctcgagct

SEQ ID NO: 37697 - DNA, 25 bp, Homo sapien
cttcaccgccgacttcaagaaggtg

SEQ ID NO: 37698 - DNA, 25 bp, Homo sapien
ccaacgccgaagtgcggagagcagc

SEQ ID NO: 37699 - DNA, 25 bp, Homo sapien
ggtcctggtggtttctgttttctga

SEQ ID NO: 37700 - DNA, 25 bp, Homo sapien
tgctgcagctgcaccgcgttttctt

SEQ ID NO: 37701 - DNA, 25 bp, Homo sapien
caccgcgttttcttggcggccgagc

SEQ ID NO: 37702 - DNA, 25 bp, Homo sapien
ctggaaggactacggatccgcagga

SEQ ID NO: 37703 - DNA, 25 bp, Homo sapien
cggctcacgggtcgcgcctcaagaa

SEQ ID NO: 37704 - DNA, 25 bp, Homo sapien
tgttctataagatgcgcggacggcg

SEQ ID NO: 37705 - DNA, 25 bp, Homo sapien
ccgtgtctagctgttcgggtgtgct

SEQ ID NO: 37706 - DNA, 25 bp, Homo sapien
gtgctgtggtcatcctccctgcgca

SEQ ID NO: 37707 - DNA, 25 bp, Homo sapien
acaagcttcgccgaggtgccgaccg

SEQ ID NO: 37708 - DNA, 25 bp, Homo sapien
ttgaggaggccaccacctcggatct

SEQ ID NO: 37709 - DNA, 25 bp, Homo sapien
cgccagtgcggcaatgaggtccagc

SEQ ID NO: 37710 - DNA, 25 bp, Homo sapien
gcgctcgtggttcatgaggcacacg

SEQ ID NO: 37711 - DNA, 25 bp, Homo sapien
aggcacacggtgctctcgttgacca

SEQ ID NO: 37712 - DNA, 25 bp, Homo sapien
ttgaccacccggtgcagtgtcacca

SEQ ID NO: 37713 - DNA, 25 bp, Homo sapien
ctccaggtagcgctctagggtgcgc

SEQ ID NO: 37714 - DNA, 25 bp, Homo sapien
gccgctgctccaccaggtctggaaa

SEQ ID NO: 37715 - DNA, 25 bp, Homo sapien
aagcgggagcacatgtagcgctgca

SEQ ID NO: 37716 - DNA, 25 bp, Homo sapien
acctgcacgatctgccggggctgca

SEQ ID NO: 37717 - DNA, 25 bp, Homo sapien
agagcgtccagtcgcttcacctgtg

SEQ ID NO: 37718 - DNA, 25 bp, Homo sapien
gcccactcaggtgccgtccggggaa

SEQ ID NO: 37719 - DNA, 25 bp, Homo sapien
gcgagacaaagccagggaacacctc

SEQ ID NO: 37720 - DNA, 25 bp, Homo sapien
gtccgggccgctgccaacagcgaga

SEQ ID NO: 37721 - DNA, 25 bp, Homo sapien
gcggcccagcggactcttataggcc

SEQ ID NO: 37722 - DNA, 25 bp, Homo sapien
ggaacacctcagacggcgacgacta

SEQ ID NO: 37723 - DNA, 25 bp, Homo sapien
aatgggaatcggctcgctcagaaga

SEQ ID NO: 37724 - DNA, 25 bp, Homo sapien
cgggctagagagaccgtcggcaccc

SEQ ID NO: 37725 - DNA, 25 bp, Homo sapien
ggcggcagcagactgaagcctagct

SEQ ID NO: 37726 - DNA, 25 bp, Homo sapien
actgaagcctagctgagcccggcgc

SEQ ID NO: 37727 - DNA, 25 bp, Homo sapien
ccggcgctgtcacttataggcacca

SEQ ID NO: 37728 - DNA, 25 bp, Homo sapien
ttataggcaccagcgagcagccggt

SEQ ID NO: 37729 - DNA, 25 bp, Homo sapien
tcctggtccagctccagaactaacc

SEQ ID NO: 37730 - DNA, 25 bp, Homo sapien
tgtcgccgagggaaagaagtatcgc

SEQ ID NO: 37731 - DNA, 25 bp, Homo sapien
tcacttataggcaccagcgagcagc

SEQ ID NO: 37732 - DNA, 25 bp, Homo sapien
cctcgaaggtgacccggcgggtgct

SEQ ID NO: 37733 - DNA, 25 bp, Homo sapien
tcgtccgcctcgaaggtgacccggc

SEQ ID NO: 37734 - DNA, 25 bp, Homo sapien
attctcgtccgcctcgaaggtgacc

SEQ ID NO: 37735 - DNA, 25 bp, Homo sapien
tctcattctcgtccgcctcgaaggt

SEQ ID NO: 37736 - DNA, 25 bp, Homo sapien
ttctcattctcgtccgcctcgaagg

SEQ ID NO: 37737 - DNA, 25 bp, Homo sapien
gttctcattctcgtccgcctcgaag

SEQ ID NO: 37738 - DNA, 25 bp, Homo sapien
tgttctcattctcgtccgcctcgaa

SEQ ID NO: 37739 - DNA, 25 bp, Homo sapien
atgttctcattctcgtccgcctcga

SEQ ID NO: 37740 - DNA, 25 bp, Homo sapien
gctcctgaagttgcgccgctgccgg

SEQ ID NO: 37741 - DNA, 25 bp, Homo sapien
tgcgtccgggtaactaatggcaacc

SEQ ID NO: 37742 - DNA, 25 bp, Homo sapien
cactagcaggttagtgggcgccgcc

SEQ ID NO: 37743 - DNA, 25 bp, Homo sapien
ggcgcagtcttcgtagcgtacccgc

SEQ ID NO: 37744 - DNA, 25 bp, Homo sapien
tgcaggaactcctcgacggcgaaaa

SEQ ID NO: 37745 - DNA, 25 bp, Homo sapien
gacggacatgggctcctgaagttgc

SEQ ID NO: 37746 - DNA, 25 bp, Homo sapien
agacctgacaggtacgggtcaccgc

SEQ ID NO: 37747 - DNA, 25 bp, Homo sapien
acagctggaggagataaacagagga

SEQ ID NO: 37748 - DNA, 25 bp, Homo sapien
tgagagcatcccttctgcagccgcg

SEQ ID NO: 37749 - DNA, 25 bp, Homo sapien
agactgcgaactgcctgagagcatc

SEQ ID NO: 37750 - DNA, 25 bp, Homo sapien
cccatctccgggaagtgacgccatg

SEQ ID NO: 37751 - DNA, 25 bp, Homo sapien
agttctctgctcttgttgccgccgc

SEQ ID NO: 37752 - DNA, 25 bp, Homo sapien
cggccgagacggacatgaagcaata

SEQ ID NO: 37753 - DNA, 25 bp, Homo sapien
tgaagcaatatcaaggctccggcgg

SEQ ID NO: 37754 - DNA, 25 bp, Homo sapien
tcacgtgagtctcttccggcatccg

SEQ ID NO: 37755 - DNA, 25 bp, Homo sapien
gcagcaagccttttcctcgggtctg

SEQ ID NO: 37756 - DNA, 25 bp, Homo sapien
gttatccagtgttgtcagcctcgtg

SEQ ID NO: 37757 - DNA, 25 bp, Homo sapien
cgagacaatccctgtaaagcgctta

SEQ ID NO: 37758 - DNA, 25 bp, Homo sapien
agcctgggtcgcaacatctttctgg

SEQ ID NO: 37759 - DNA, 25 bp, Homo sapien
gtcaaaagctacctcctcccggata

SEQ ID NO: 37760 - DNA, 25 bp, Homo sapien
ctcccggataagcagagcaagcgca

SEQ ID NO: 37761 - DNA, 25 bp, Homo sapien
gggcccattaactcgttatccagtg

SEQ ID NO: 37762 - DNA, 25 bp, Homo sapien
taaagctcacctcctgtcctcagta

SEQ ID NO: 37763 - DNA, 25 bp, Homo sapien
cagtaacgtcattgcccggaggatc

SEQ ID NO: 37764 - DNA, 25 bp, Homo sapien
attcgatgttcaccgcgcccagcaa

SEQ ID NO: 37765 - DNA, 25 bp, Homo sapien
cgaacatccagtgtggacggatctg

SEQ ID NO: 37766 - DNA, 25 bp, Homo sapien
tgccggtatgggagatgtccattta

SEQ ID NO: 37767 - DNA, 25 bp, Homo sapien
tgggagatgtccatttagtcacgcc

SEQ ID NO: 37768 - DNA, 25 bp, Homo sapien
tacccggtcctagcacacccagggc

SEQ ID NO: 37769 - DNA, 25 bp, Homo sapien
tgcccgcacagcacggctgagcagt

SEQ ID NO: 37770 - DNA, 25 bp, Homo sapien
cacggctgagcagtgagtccagaac

SEQ ID NO: 37771 - DNA, 25 bp, Homo sapien
gagtccagaacgaacatccagtgtg

SEQ ID NO: 37772 - DNA, 25 bp, Homo sapien
gaccatgaaaggctgcgcaccactg

SEQ ID NO: 37773 - DNA, 25 bp, Homo sapien
aagcacagctggacgtcctgagccg

SEQ ID NO: 37774 - DNA, 25 bp, Homo sapien
taagccggagcatccaacggacgtc

SEQ ID NO: 37775 - DNA, 25 bp, Homo sapien
tggaatccgggttcgtcacccaggc

SEQ ID NO: 37776 - DNA, 25 bp, Homo sapien
actcataatcaaactgccgggcgcg

SEQ ID NO: 37777 - DNA, 25 bp, Homo sapien
gggatctccttgatggcgatgcgca

SEQ ID NO: 37778 - DNA, 25 bp, Homo sapien
gggctcgaactctcaggtcctacga

SEQ ID NO: 37779 - DNA, 25 bp, Homo sapien
gtgcatagaggaagcagcagcgctc

SEQ ID NO: 37780 - DNA, 25 bp, Homo sapien
caggaccaggagttggcgccactcc

SEQ ID NO: 37781 - DNA, 25 bp, Homo sapien
ctaaaaagggcgagcaggaccagga

SEQ ID NO: 37782 - DNA, 25 bp, Homo sapien
ggcttcctaaaaagggcgagcagga

SEQ ID NO: 37783 - DNA, 25 bp, Homo sapien
tcgcgatctgtccagaaggaagctc

SEQ ID NO: 37784 - DNA, 25 bp, Homo sapien
tccttgcagcgcttacacttcgcga

SEQ ID NO: 37785 - DNA, 25 bp, Homo sapien
tgcagcgcttacacttcgcgatctg

SEQ ID NO: 37786 - DNA, 25 bp, Homo sapien
gtgttccgcgggatcgagacccgcc

SEQ ID NO: 37787 - DNA, 25 bp, Homo sapien
gcgcttacacttcgcgatctgtcca

SEQ ID NO: 37788 - DNA, 25 bp, Homo sapien
cgacagtcagcgcagggcgatcagt

SEQ ID NO: 37789 - DNA, 25 bp, Homo sapien
cgcggagccttaccactcgagaata

SEQ ID NO: 37790 - DNA, 25 bp, Homo sapien
aggcaccgggtctttcttaatgcga

SEQ ID NO: 37791 - DNA, 25 bp, Homo sapien
gggctcggcacagatgtaaggcacc

SEQ ID NO: 37792 - DNA, 25 bp, Homo sapien
tgctggtgctgctcatctgttaaaa

SEQ ID NO: 37793 - DNA, 25 bp, Homo sapien
tctgcagcccgccattcattcaggg

SEQ ID NO: 37794 - DNA, 25 bp, Homo sapien
tcggagccctcttactgctggtgct

SEQ ID NO: 37795 - DNA, 25 bp, Homo sapien
atgcgaaggtagtcctgcttcagcc

SEQ ID NO: 37796 - DNA, 25 bp, Homo sapien
accgctccgactgaagggtgcctaa

SEQ ID NO: 37797 - DNA, 25 bp, Homo sapien
aatctcccacgggatctagggatcc

SEQ ID NO: 37798 - DNA, 25 bp, Homo sapien
acccgcgttgtagaaggcatccaga

SEQ ID NO: 37799 - DNA, 25 bp, Homo sapien
cgggtcagcacgtagaccacgctga

SEQ ID NO: 37800 - DNA, 25 bp, Homo sapien
tccgttcggaatcggagaatctccc

SEQ ID NO: 37801 - DNA, 25 bp, Homo sapien
tcttgggatctggaatccgttcgga

SEQ ID NO: 37802 - DNA, 25 bp, Homo sapien
cctgggccggcagatcaggaatctt

SEQ ID NO: 37803 - DNA, 25 bp, Homo sapien
gggatccggaatacggcctgacgtc

SEQ ID NO: 37804 - DNA, 25 bp, Homo sapien
cacagagcgcagtccgcaaggcgcg

SEQ ID NO: 37805 - DNA, 25 bp, Homo sapien
gtcccggagcctccatgggctcgcg

SEQ ID NO: 37806 - DNA, 25 bp, Homo sapien
gcgcgtccctcccagactgggctcg

SEQ ID NO: 37807 - DNA, 25 bp, Homo sapien
agcaacagccgccacagagcgcagt

SEQ ID NO: 37808 - DNA, 25 bp, Homo sapien
tggccgggatcggtggacagctgcc

SEQ ID NO: 37809 - DNA, 25 bp, Homo sapien
cgagttaccagccacagccagctgg

SEQ ID NO: 37810 - DNA, 25 bp, Homo sapien
ccagctgggcacataggaggaggca

SEQ ID NO: 37811 - DNA, 25 bp, Homo sapien
ctagccagaccctgccgcgagttac

SEQ ID NO: 37812 - DNA, 25 bp, Homo sapien
tggctgatcggaccgctgacgtcac

SEQ ID NO: 37813 - DNA, 25 bp, Homo sapien
ctgacgtcaccgaaccggtggccgg

SEQ ID NO: 37814 - DNA, 25 bp, Homo sapien
ccattggctgatcggaccgctgacg

SEQ ID NO: 37815 - DNA, 25 bp, Homo sapien
ccttattactatgccgcgcaacgcg

SEQ ID NO: 37816 - DNA, 25 bp, Homo sapien
cgaggccttattactatgccgcgca

SEQ ID NO: 37817 - DNA, 25 bp, Homo sapien
gcggtgcgaggccttattactatgc

SEQ ID NO: 37818 - DNA, 25 bp, Homo sapien
ccacggtcgctttttatgaatgggg

SEQ ID NO: 37819 - DNA, 25 bp, Homo sapien
ccgcagccacggtcgctttttatga

SEQ ID NO: 37820 - DNA, 25 bp, Homo sapien
acccgggcgacttccgcaatcggag

SEQ ID NO: 37821 - DNA, 25 bp, Homo sapien
cggcctctgccagtccgcagtagga

SEQ ID NO: 37822 - DNA, 25 bp, Homo sapien
cgcagtaggagtcccggcacccagt

SEQ ID NO: 37823 - DNA, 25 bp, Homo sapien
tctacccaaggggacttgttgctca

SEQ ID NO: 37824 - DNA, 25 bp, Homo sapien
tcggggcattccattggcctgagta

SEQ ID NO: 37825 - DNA, 25 bp, Homo sapien
tggcctgagtaaaacgccagttaaa

SEQ ID NO: 37826 - DNA, 25 bp, Homo sapien
cgccagttaaataactacgcaaaag

SEQ ID NO: 37827 - DNA, 25 bp, Homo sapien
ctacgcaaaagacgtactcacgggt

SEQ ID NO: 37828 - DNA, 25 bp, Homo sapien
tgctgtgcttttatgtcggtctccg

SEQ ID NO: 37829 - DNA, 25 bp, Homo sapien
ccgtggccgccccattagtatgcgg

SEQ ID NO: 37830 - DNA, 25 bp, Homo sapien
ctctgcgcgccatggcaacagctcc

SEQ ID NO: 37831 - DNA, 25 bp, Homo sapien
gtgcagccgcccatgggcgtgtccc

SEQ ID NO: 37832 - DNA, 25 bp, Homo sapien
cttgaggacgttctgcccgcgcctg

SEQ ID NO: 37833 - DNA, 25 bp, Homo sapien
gtgtgcccctcagtgggtccctcgg

SEQ ID NO: 37834 - DNA, 25 bp, Homo sapien
ccctaggccttaggcaaggggctca

SEQ ID NO: 37835 - DNA, 25 bp, Homo sapien
ccggcctgctgtgcttttatgtcgg

SEQ ID NO: 37836 - DNA, 25 bp, Homo sapien
tgcttgccatcaagctcgggagcac

SEQ ID NO: 37837 - DNA, 25 bp, Homo sapien
caggtgggcgagtatgccttctgca

SEQ ID NO: 37838 - DNA, 25 bp, Homo sapien
atgccttctgcaggccggcgtcaaa

SEQ ID NO: 37839 - DNA, 25 bp, Homo sapien
caggccggcgtcaaacaccgtgggt

SEQ ID NO: 37840 - DNA, 25 bp, Homo sapien
aagtcacaggggtctcgctctccca

SEQ ID NO: 37841 - DNA, 25 bp, Homo sapien
acgggttcatggagtagggtcctat

SEQ ID NO: 37842 - DNA, 25 bp, Homo sapien
agccttggccaaaggtgccatcgga

SEQ ID NO: 37843 - DNA, 25 bp, Homo sapien
cagcggtgggaaatgcttgccatca

SEQ ID NO: 37844 - DNA, 25 bp, Homo sapien
tacagccgcactccagggacagcta

SEQ ID NO: 37845 - DNA, 25 bp, Homo sapien
ctcccggagattggtagcacctgga

SEQ ID NO: 37846 - DNA, 25 bp, Homo sapien
tagcacctggagtgatgtcgctagg

SEQ ID NO: 37847 - DNA, 25 bp, Homo sapien
ctggacgcgtacaaaaggcgacttg

SEQ ID NO: 37848 - DNA, 25 bp, Homo sapien
ggatgcctgcgccttctcaaacata

SEQ ID NO: 37849 - DNA, 25 bp, Homo sapien
gaagggcgaggccttcaacggtctc

SEQ ID NO: 37850 - DNA, 25 bp, Homo sapien
tctcaggtcgctcgcgtgttcagcc

SEQ ID NO: 37851 - DNA, 25 bp, Homo sapien
ggcgacttgttctttctcgggatgc

SEQ ID NO: 37852 - DNA, 25 bp, Homo sapien
ccgcgctctccagctgcaggaaatt

SEQ ID NO: 37853 - DNA, 25 bp, Homo sapien
cagacccgaaaagagaggccgagga

SEQ ID NO: 37854 - DNA, 25 bp, Homo sapien
tgcaggaaattccagaagctctcca

SEQ ID NO: 37855 - DNA, 25 bp, Homo sapien
ccgaaggagagccacatgccggccg

SEQ ID NO: 37856 - DNA, 25 bp, Homo sapien
tcctgcagagagcactggcggcccg

SEQ ID NO: 37857 - DNA, 25 bp, Homo sapien
gcggactgaggcctaactggatagc

SEQ ID NO: 37858 - DNA, 25 bp, Homo sapien
ttattaatagcgtgcctggctcggg

SEQ ID NO: 37859 - DNA, 25 bp, Homo sapien
tggcaggctaagctgcccactgatc

SEQ ID NO: 37860 - DNA, 25 bp, Homo sapien
tgaggacagaaagcagacgctggct

SEQ ID NO: 37861 - DNA, 25 bp, Homo sapien
tgcctttctctgctctccaagctgg

SEQ ID NO: 37862 - DNA, 25 bp, Homo sapien
ggtggtagctggattccctctctcc

SEQ ID NO: 37863 - DNA, 25 bp, Homo sapien
cccgtgcgctgcacaaaagagcctg

SEQ ID NO: 37864 - DNA, 25 bp, Homo sapien
ctgtctctcagactgtctctatttc

SEQ ID NO: 37865 - DNA, 25 bp, Homo sapien
ccaatagcaaacctgggagggaacg

SEQ ID NO: 37866 - DNA, 25 bp, Homo sapien
gctgcacaaaagagcctggccggcc

SEQ ID NO: 37867 - DNA, 25 bp, Homo sapien
attctccgccgctaactccgctgga

SEQ ID NO: 37868 - DNA, 25 bp, Homo sapien
cttcccggtgcgctccgccaggtaa

SEQ ID NO: 37869 - DNA, 25 bp, Homo sapien
cacgtcaccgctagatccctcttga

SEQ ID NO: 37870 - DNA, 25 bp, Homo sapien
gatgcgatcgccgtccctgcgaggc

SEQ ID NO: 37871 - DNA, 25 bp, Homo sapien
gccgccgtcacagcctcgtcctccg

SEQ ID NO: 37872 - DNA, 25 bp, Homo sapien
gcgcggagatgcgatcgccgtccct

SEQ ID NO: 37873 - DNA, 25 bp, Homo sapien
ataacggtgcctggctccggctctt

SEQ ID NO: 37874 - DNA, 25 bp, Homo sapien
tcctccgcttcctgttgccgcgatc

SEQ ID NO: 37875 - DNA, 25 bp, Homo sapien
gccaggtaaccgctcggcgcgaact

SEQ ID NO: 37876 - DNA, 25 bp, Homo sapien
ggcccagcgtctgcggcttcatgat

SEQ ID NO: 37877 - DNA, 25 bp, Homo sapien
tgcggctgatctcccaggcgtcctt

SEQ ID NO: 37878 - DNA, 25 bp, Homo sapien
aggctgtcttgtcaggaccctctcc

SEQ ID NO: 37879 - DNA, 25 bp, Homo sapien
caccttagtgctgccgttccacgtg

SEQ ID NO: 37880 - DNA, 25 bp, Homo sapien
tgcaccagcttgtcgtgccgcagca

SEQ ID NO: 37881 - DNA, 25 bp, Homo sapien
cacggcgtacagctgcaccagcttg

SEQ ID NO: 37882 - DNA, 25 bp, Homo sapien
tcggtcacgatgtagatgggctcct

SEQ ID NO: 37883 - DNA, 25 bp, Homo sapien
ctcctgaccgtgacacatgaactcg

SEQ ID NO: 37884 - DNA, 25 bp, Homo sapien
agagctctctcgttcagggacccga

SEQ ID NO: 37885 - DNA, 25 bp, Homo sapien
tccactgacgaaccaggatcgaggc

SEQ ID NO: 37886 - DNA, 25 bp, Homo sapien
acagactcccgtgatccactgacga

SEQ ID NO: 37887 - DNA, 25 bp, Homo sapien
acccgagagtgacacgcgtggcatc

SEQ ID NO: 37888 - DNA, 25 bp, Homo sapien
tgtcccagctgacgggaaacccggc

SEQ ID NO: 37889 - DNA, 25 bp, Homo sapien
ttgggctccagggagctcagagctc

SEQ ID NO: 37890 - DNA, 25 bp, Homo sapien
gcggaaccagcctagcttctgcttc

SEQ ID NO: 37891 - DNA, 25 bp, Homo sapien
acgcgtggcatctctttgcaaccca

SEQ ID NO: 37892 - DNA, 25 bp, Homo sapien
aattcccggatccagcggggagcgc

SEQ ID NO: 37893 - DNA, 25 bp, Homo sapien
cccaccagaccgaggattccaaaag

SEQ ID NO: 37894 - DNA, 25 bp, Homo sapien
ccctgcgggcactcgcggtcaaagg

SEQ ID NO: 37895 - DNA, 25 bp, Homo sapien
actcgcggtcaaaggcaggatttcc

SEQ ID NO: 37896 - DNA, 25 bp, Homo sapien
tcggggcggcagcaattcccggatc

SEQ ID NO: 37897 - DNA, 25 bp, Homo sapien
tgcagcccggaacctaccgcaaggg

SEQ ID NO: 37898 - DNA, 25 bp, Homo sapien
gctaacgttaccctgcgggctgtgg

SEQ ID NO: 37899 - DNA, 25 bp, Homo sapien
tcaaaggcaggatttccgtcggggc

SEQ ID NO: 37900 - DNA, 25 bp, Homo sapien
gcagggagacagtcacgccctagcc

SEQ ID NO: 37901 - DNA, 25 bp, Homo sapien
acgctgtcgcttacctggagcccaa

SEQ ID NO: 37902 - DNA, 25 bp, Homo sapien
gtcgcttacctggagcccaattctg

SEQ ID NO: 37903 - DNA, 25 bp, Homo sapien
ttacctggagcccaattctgcccgg

SEQ ID NO: 37904 - DNA, 25 bp, Homo sapien
aagccgcctcggacttctcttattg

SEQ ID NO: 37905 - DNA, 25 bp, Homo sapien
cgcctcggacttctcttattgcagt

SEQ ID NO: 37906 - DNA, 25 bp, Homo sapien
gtggcagggagacagtcacgcccta

SEQ ID NO: 37907 - DNA, 25 bp, Homo sapien
tctcttattgcagtcacggccggcg

SEQ ID NO: 37908 - DNA, 25 bp, Homo sapien
aaataattcccgtgtgaattgcgcg

SEQ ID NO: 37909 - DNA, 25 bp, Homo sapien
aaatagacgcgctgcagcgagcgcc

SEQ ID NO: 37910 - DNA, 25 bp, Homo sapien
cagtctccacctcgccggcttcatg

SEQ ID NO: 37911 - DNA, 25 bp, Homo sapien
ggcttcatgaacgtgccccgggaga

SEQ ID NO: 37912 - DNA, 25 bp, Homo sapien
caccatctctactccgacggctgcg

SEQ ID NO: 37913 - DNA, 25 bp, Homo sapien
tggccaccgcgcttgccaatcagga

SEQ ID NO: 37914 - DNA, 25 bp, Homo sapien
ccgcgcttgccaatcaggaagtgag

SEQ ID NO: 37915 - DNA, 25 bp, Homo sapien
ccgcccagtggccttgcctgggaaa

SEQ ID NO: 37916 - DNA, 25 bp, Homo sapien
gaccagctcatcagcgaggcagcca

SEQ ID NO: 37917 - DNA, 25 bp, Homo sapien
attcaggatcgcagaccagctcatc

SEQ ID NO: 37918 - DNA, 25 bp, Homo sapien
gtcagggccttccagaacccggagc

SEQ ID NO: 37919 - DNA, 25 bp, Homo sapien
aggcagccaccgagttggccgcgat

SEQ ID NO: 37920 - DNA, 25 bp, Homo sapien
tcctccgacggccatgaaggtcagg

SEQ ID NO: 37921 - DNA, 25 bp, Homo sapien
ctgcccgagatcctcgccctccaga

SEQ ID NO: 37922 - DNA, 25 bp, Homo sapien
cggccatgaaggtcagggccttcca

SEQ ID NO: 37923 - DNA, 25 bp, Homo sapien
aggctctgcagcgtggccactagcc

SEQ ID NO: 37924 - DNA, 25 bp, Homo sapien
cataatcgcggcctggagcgtcaca

SEQ ID NO: 37925 - DNA, 25 bp, Homo sapien
tagggcggagcctaagctcttccga

SEQ ID NO: 37926 - DNA, 25 bp, Homo sapien
cgcgtgactgcgctttacataatcg

SEQ ID NO: 37927 - DNA, 25 bp, Homo sapien
gtactccaggccagaccgaatcaga

SEQ ID NO: 37928 - DNA, 25 bp, Homo sapien
gggttgtgcctcagactgtcagata

SEQ ID NO: 37929 - DNA, 25 bp, Homo sapien
ccgaatcagagtgggcgaaagctcc

SEQ ID NO: 37930 - DNA, 25 bp, Homo sapien
tgatcgacgtcaaagcccaccagtg

SEQ ID NO: 37931 - DNA, 25 bp, Homo sapien
cttagcaaccgtggggattgttctc

SEQ ID NO: 37932 - DNA, 25 bp, Homo sapien
acttcagcagcatcatccagacgtg

SEQ ID NO: 37933 - DNA, 25 bp, Homo sapien
agtgcgcacgcagccttagctcctt

SEQ ID NO: 37934 - DNA, 25 bp, Homo sapien
tgcagcggcaacatccagcggatca

SEQ ID NO: 37935 - DNA, 25 bp, Homo sapien
cagtttctccgtcagcctgcgggtc

SEQ ID NO: 37936 - DNA, 25 bp, Homo sapien
tgtagagcgagcaggtctcagctcc

SEQ ID NO: 37937 - DNA, 25 bp, Homo sapien
atcagccaagccagtgagccggggt

SEQ ID NO: 37938 - DNA, 25 bp, Homo sapien
ctcagctcctcgtcatgtcatacgg

SEQ ID NO: 37939 - DNA, 25 bp, Homo sapien
tacggtcccttagacatgtaccgga

SEQ ID NO: 37940 - DNA, 25 bp, Homo sapien
gaacttacgcccaactcttgactga

SEQ ID NO: 37941 - DNA, 25 bp, Homo sapien
ggctcaaaggcgctcacttaggcag

SEQ ID NO: 37942 - DNA, 25 bp, Homo sapien
aaaaactgtttgctgcaccgggccg

SEQ ID NO: 37943 - DNA, 25 bp, Homo sapien
ttttctgctgcgagccgaacggctc

SEQ ID NO: 37944 - DNA, 25 bp, Homo sapien
tgttcgactgcccaacctggtgagt

SEQ ID NO: 37945 - DNA, 25 bp, Homo sapien
cggtcttccagtttcccggcgtgct

SEQ ID NO: 37946 - DNA, 25 bp, Homo sapien
ggatgccgcttttcccttctcggtc

SEQ ID NO: 37947 - DNA, 25 bp, Homo sapien
tcttgactgagtgcctggtgctctc

SEQ ID NO: 37948 - DNA, 25 bp, Homo sapien
cggggaccatggagccggtgccgct

SEQ ID NO: 37949 - DNA, 25 bp, Homo sapien
agacccggagaagacgttagcaatc

SEQ ID NO: 37950 - DNA, 25 bp, Homo sapien
gcagagacccggagaagacgttagc

SEQ ID NO: 37951 - DNA, 25 bp, Homo sapien
tccgagcactcccttggtgtggggc

SEQ ID NO: 37952 - DNA, 25 bp, Homo sapien
cctccgagcactcccttggtgtggg

SEQ ID NO: 37953 - DNA, 25 bp, Homo sapien
tcccgcgcgtgctgcgggtctgctc

SEQ ID NO: 37954 - DNA, 25 bp, Homo sapien
gcaggacttcgtgcgcgccttggac

SEQ ID NO: 37955 - DNA, 25 bp, Homo sapien
acccggagaagacgttagcaatccg

SEQ ID NO: 37956 - DNA, 25 bp, Homo sapien
gcatgtctcggcactcaggggccca

SEQ ID NO: 37957 - DNA, 25 bp, Homo sapien
ccgcctctggcgattgcggaagagt

SEQ ID NO: 37958 - DNA, 25 bp, Homo sapien
aactggactcgaaggggcatgtctc

SEQ ID NO: 37959 - DNA, 25 bp, Homo sapien
gtcgacttagtacaaactggactcg

SEQ ID NO: 37960 - DNA, 25 bp, Homo sapien
gcggtctctggtgaaagtcgactta

SEQ ID NO: 37961 - DNA, 25 bp, Homo sapien
cccggcacgatgtcctcgggatctg

SEQ ID NO: 37962 - DNA, 25 bp, Homo sapien
gtaattttcaaagagcctcccggca

SEQ ID NO: 37963 - DNA, 25 bp, Homo sapien
gcagaacgcgtgcagccagaagaca

SEQ ID NO: 37964 - DNA, 25 bp, Homo sapien
ctgcgctcccagttggctccaaaag

SEQ ID NO: 37965 - DNA, 25 bp, Homo sapien
gctcgcttcagccaatcggtgctca

SEQ ID NO: 37966 - DNA, 25 bp, Homo sapien
tgcccatgctccagaaaacgcgtac

SEQ ID NO: 37967 - DNA, 25 bp, Homo sapien
agcctccgcggccatctttacgaag

SEQ ID NO: 37968 - DNA, 25 bp, Homo sapien
tgtgatcccaccctcgtcaagtgcg

SEQ ID NO: 37969 - DNA, 25 bp, Homo sapien
cgtgctcaggttcgcgccaaactat

SEQ ID NO: 37970 - DNA, 25 bp, Homo sapien
tggtcacgattctccgcaaagaggc

SEQ ID NO: 37971 - DNA, 25 bp, Homo sapien
gtgctcacggatgctacgcttgttc

SEQ ID NO: 37972 - DNA, 25 bp, Homo sapien
ctcagtcagctactctgctggggtc

SEQ ID NO: 37973 - DNA, 25 bp, Homo sapien
accacctgtctgtatgcctctggca

SEQ ID NO: 37974 - DNA, 25 bp, Homo sapien
tgcacacagtgctggaccgcatcgc

SEQ ID NO: 37975 - DNA, 25 bp, Homo sapien
ctgggagctcgagtaccagctgacc

SEQ ID NO: 37976 - DNA, 25 bp, Homo sapien
acactgcagcgctactacgtctata

SEQ ID NO: 37977 - DNA, 25 bp, Homo sapien
gcctgcagcatgcagcacgtgtgtg

SEQ ID NO: 37978 - DNA, 25 bp, Homo sapien
cgccaggtggacattgacgcttaca

SEQ ID NO: 37979 - DNA, 25 bp, Homo sapien
atcgctggcgaccagagcacactgc

SEQ ID NO: 37980 - DNA, 25 bp, Homo sapien
atgcaaacgcgactgtgcacctgtg

SEQ ID NO: 37981 - DNA, 25 bp, Homo sapien
ccgcgctcacagtgtcacgatgtca

SEQ ID NO: 37982 - DNA, 25 bp, Homo sapien
gcctgcactgcgatggccaacgggt

SEQ ID NO: 37983 - DNA, 25 bp, Homo sapien
ctcctggatacacctgcggaactgg

SEQ ID NO: 37984 - DNA, 25 bp, Homo sapien
cgtccgctccgttttgcagcaggaa

SEQ ID NO: 37985 - DNA, 25 bp, Homo sapien
gcaggaactcacagacgatcaagga

SEQ ID NO: 37986 - DNA, 25 bp, Homo sapien
gggcaactcagacggagccacggca

SEQ ID NO: 37987 - DNA, 25 bp, Homo sapien
tgtgggcgccacagaagatgcaaac

SEQ ID NO: 37988 - DNA, 25 bp, Homo sapien
gccatttgaagcctgcgaagcgaag

SEQ ID NO: 37989 - DNA, 25 bp, Homo sapien
tgctctccgggtatccctggatcga

SEQ ID NO: 37990 - DNA, 25 bp, Homo sapien
ggcgcacgcgttgttgcaaagtctc

SEQ ID NO: 37991 - DNA, 25 bp, Homo sapien
caatacaggtgtgagggatcgcagc

SEQ ID NO: 37992 - DNA, 25 bp, Homo sapien
aagggcagtcggtcttcaggcctag

SEQ ID NO: 37993 - DNA, 25 bp, Homo sapien
agcagagcatcgagcggcttttagc

SEQ ID NO: 37994 - DNA, 25 bp, Homo sapien
tgcaaagtctcgcacttagggatta

SEQ ID NO: 37995 - DNA, 25 bp, Homo sapien
gactcggatcgctggcgtgaaccca

SEQ ID NO: 37996 - DNA, 25 bp, Homo sapien
gctaggaaccggaagtaagcggcca

SEQ ID NO: 37997 - DNA, 25 bp, Homo sapien
ggaagcttttaggctccgcccactc

SEQ ID NO: 37998 - DNA, 25 bp, Homo sapien
acctctgggcgcatgtgttgagtct

SEQ ID NO: 37999 - DNA, 25 bp, Homo sapien
tccactagaaacctctgggcgcatg

SEQ ID NO: 38000 - DNA, 25 bp, Homo sapien
aagcggccagagtcacctcacaatc

SEQ ID NO: 38001 - DNA, 25 bp, Homo sapien
acccggatgcgcatcgctaggaacc

SEQ ID NO: 38002 - DNA, 25 bp, Homo sapien
accgcggcgttagcgtgacccggat

SEQ ID NO: 38003 - DNA, 25 bp, Homo sapien
aatccacacctcgttccactagaaa

SEQ ID NO: 38004 - DNA, 25 bp, Homo sapien
gctatcagtgggagacgctcacaca

SEQ ID NO: 38005 - DNA, 25 bp, Homo sapien
gtgccactactcctcactctgtgtt

SEQ ID NO: 38006 - DNA, 25 bp, Homo sapien
tctgtgttcacctcactgtagaagg

SEQ ID NO: 38007 - DNA, 25 bp, Homo sapien
ataaatgcttcctcggtgctgcctc

SEQ ID NO: 38008 - DNA, 25 bp, Homo sapien
ggcgtcgcctcacgtgattcttaca

SEQ ID NO: 38009 - DNA, 25 bp, Homo sapien
gcgcccgcactatgttggacacact

SEQ ID NO: 38010 - DNA, 25 bp, Homo sapien
aggaatcgcccaacggtccaggcca

SEQ ID NO: 38011 - DNA, 25 bp, Homo sapien
gccactgcctttgtccactgggaaa

SEQ ID NO: 38012 - DNA, 25 bp, Homo sapien
tctctgcagtccgagaatgtcgacc

SEQ ID NO: 38013 - DNA, 25 bp, Homo sapien
cccgtgattcgctactcctgtgttc

SEQ ID NO: 38014 - DNA, 25 bp, Homo sapien
ttgcttccgtacctttaccagtgtc

SEQ ID NO: 38015 - DNA, 25 bp, Homo sapien
ggccgtccctgccattagcgcgtaa

SEQ ID NO: 38016 - DNA, 25 bp, Homo sapien
cgcgtaacgagagactgcttgctgc

SEQ ID NO: 38017 - DNA, 25 bp, Homo sapien
ccgaggcttcggctcggatcaggta

SEQ ID NO: 38018 - DNA, 25 bp, Homo sapien
ggcggatcccatctttgcttccgta

SEQ ID NO: 38019 - DNA, 25 bp, Homo sapien
ctccgtcgaccagattgggtgcttg

SEQ ID NO: 38020 - DNA, 25 bp, Homo sapien
ttgttaacgctgaaaccgcactggg

SEQ ID NO: 38021 - DNA, 25 bp, Homo sapien
ctgttgctgagcgaaaagtctgttc

SEQ ID NO: 38022 - DNA, 25 bp, Homo sapien
cggtttacgtaagaggagcctgttg

SEQ ID NO: 38023 - DNA, 25 bp, Homo sapien
atcttcctgctcattggccggtgcg

SEQ ID NO: 38024 - DNA, 25 bp, Homo sapien
tgcgggctactattggctgccaaga

SEQ ID NO: 38025 - DNA, 25 bp, Homo sapien
gattcgtttccgtacgcagcctgga

SEQ ID NO: 38026 - DNA, 25 bp, Homo sapien
cagagcctggcgacttcgaagactc

SEQ ID NO: 38027 - DNA, 25 bp, Homo sapien
gttctgcaattttcgctaaggagtt

SEQ ID NO: 38028 - DNA, 25 bp, Homo sapien
ctgcggacttccgaggccgtgaaaa

SEQ ID NO: 38029 - DNA, 25 bp, Homo sapien
ccaaagcggccgttctcggattccg

SEQ ID NO: 38030 - DNA, 25 bp, Homo sapien
ccgcgcagagctcaaggactacctg

SEQ ID NO: 38031 - DNA, 25 bp, Homo sapien
acccgggttgcatcaactggcagcc

SEQ ID NO: 38032 - DNA, 25 bp, Homo sapien
gggaagagtccagcaccaaagcggc

SEQ ID NO: 38033 - DNA, 25 bp, Homo sapien
ctggccagtgaaagtcgacctcatc

SEQ ID NO: 38034 - DNA, 25 bp, Homo sapien
tcttcaagtccaggcaaatcccggc

SEQ ID NO: 38035 - DNA, 25 bp, Homo sapien
agctttgggctcctgagcgtcttca

SEQ ID NO: 38036 - DNA, 25 bp, Homo sapien
acggcagtttcgaggtttgtgagac

SEQ ID NO: 38037 - DNA, 25 bp, Homo sapien
cagcccggaattttgcgcatgcgcc

SEQ ID NO: 38038 - DNA, 25 bp, Homo sapien
tcgtcgctcaaaagctcctaggtgc

SEQ ID NO: 38039 - DNA, 25 bp, Homo sapien
ggaggccgccatctttcatacagca

SEQ ID NO: 38040 - DNA, 25 bp, Homo sapien
agtgctggtatctaatcgtcgctca

SEQ ID NO: 38041 - DNA, 25 bp, Homo sapien
gcatgcgcctctgattgtctgtccg

SEQ ID NO: 38042 - DNA, 25 bp, Homo sapien
tgtctgtccgcaatgaagctcttcg

SEQ ID NO: 38043 - DNA, 25 bp, Homo sapien
gccttctcggcacccatacgtttgg

SEQ ID NO: 38044 - DNA, 25 bp, Homo sapien
acggctgctgcggaagaggaaaaac

SEQ ID NO: 38045 - DNA, 25 bp, Homo sapien
aagccgccgggctaataactcctcg

SEQ ID NO: 38046 - DNA, 25 bp, Homo sapien
tgaggtccgtacctcgcagagcccg

SEQ ID NO: 38047 - DNA, 25 bp, Homo sapien
gggctcgctcgcagccggacacaga

SEQ ID NO: 38048 - DNA, 25 bp, Homo sapien
gcgctgtttcccgaatgccaccagg

SEQ ID NO: 38049 - DNA, 25 bp, Homo sapien
gccggacacagactgccttcagctg

SEQ ID NO: 38050 - DNA, 25 bp, Homo sapien
gctctgctcccgtagttcctccagt

SEQ ID NO: 38051 - DNA, 25 bp, Homo sapien
tgcgtctccagattcgccgccgaac

SEQ ID NO: 38052 - DNA, 25 bp, Homo sapien
cgcatgcccagagaggtcgtaagga

SEQ ID NO: 38053 - DNA, 25 bp, Homo sapien
ctgctccctggggatccggttacag

SEQ ID NO: 38054 - DNA, 25 bp, Homo sapien
cctttgtgtccgtgcatggagtctc

SEQ ID NO: 38055 - DNA, 25 bp, Homo sapien
ctttcttggctctgcgagagggtcc

SEQ ID NO: 38056 - DNA, 25 bp, Homo sapien
caggacgcgctcagtatcaggctgc

SEQ ID NO: 38057 - DNA, 25 bp, Homo sapien
ttcagcgagcaagggaaagtgagca

SEQ ID NO: 38058 - DNA, 25 bp, Homo sapien
attttgttcagcttgccgggcaacc

SEQ ID NO: 38059 - DNA, 25 bp, Homo sapien
ggacgcacgcttcccgccattttgt

SEQ ID NO: 38060 - DNA, 25 bp, Homo sapien
cagagcgcatgctctggggcagttc

SEQ ID NO: 38061 - DNA, 25 bp, Homo sapien
aggatggttttgtccggcatgcgct

SEQ ID NO: 38062 - DNA, 25 bp, Homo sapien
caccaaggtaggtctcgcctgggac

SEQ ID NO: 38063 - DNA, 25 bp, Homo sapien
agcgccggagttccttgtggccgac

SEQ ID NO: 38064 - DNA, 25 bp, Homo sapien
tccacgcgggcctaagtcgctgccc

SEQ ID NO: 38065 - DNA, 25 bp, Homo sapien
tttgtccggcatgcgcttggagaag

SEQ ID NO: 38066 - DNA, 25 bp, Homo sapien
ggccgacgtgcaccaaggtaggtct

SEQ ID NO: 38067 - DNA, 25 bp, Homo sapien
gagattcaaactgcgcgagcgcggc

SEQ ID NO: 38068 - DNA, 25 bp, Homo sapien
ctgaccagaaaacccgaccaggtgg

SEQ ID NO: 38069 - DNA, 25 bp, Homo sapien
cctcccgcaaatgccgctgtccgct

SEQ ID NO: 38070 - DNA, 25 bp, Homo sapien
gcgcacctcccgcaaatgccgctgt

SEQ ID NO: 38071 - DNA, 25 bp, Homo sapien
gggccgcctttggcccacagagagc

SEQ ID NO: 38072 - DNA, 25 bp, Homo sapien
ctcagcggtggccacatcctcgggg

SEQ ID NO: 38073 - DNA, 25 bp, Homo sapien
ggctcctcagcggtggccacatcct

SEQ ID NO: 38074 - DNA, 25 bp, Homo sapien
tgccaaggtgcctgcgggccgagcc

SEQ ID NO: 38075 - DNA, 25 bp, Homo sapien
ccgctcctgccaaggtgcctgcggg

SEQ ID NO: 38076 - DNA, 25 bp, Homo sapien
cgttgcgcaactcagggcgtttgca

SEQ ID NO: 38077 - DNA, 25 bp, Homo sapien
gatgtctctggacgcgggttccaaa

SEQ ID NO: 38078 - DNA, 25 bp, Homo sapien
tttaagtaggtttcccaggcgcagc

SEQ ID NO: 38079 - DNA, 25 bp, Homo sapien
ccagtacgtgggcaccgactttaag

SEQ ID NO: 38080 - DNA, 25 bp, Homo sapien
cgcgctatcttgtgtacttccagta

SEQ ID NO: 38081 - DNA, 25 bp, Homo sapien
ctgggctccgccatgagttcggcgc

SEQ ID NO: 38082 - DNA, 25 bp, Homo sapien
agtgaacgaatgcacgcccgcgaga

SEQ ID NO: 38083 - DNA, 25 bp, Homo sapien
cgatagaggtagagcgcctgcgctc

SEQ ID NO: 38084 - DNA, 25 bp, Homo sapien
gagctgaacacactgcccgacccgg

SEQ ID NO: 38085 - DNA, 25 bp, Homo sapien
cgatccggaagcctagcgcccagtg

SEQ ID NO: 38086 - DNA, 25 bp, Homo sapien
gacaaggaagcatctcggtttcgcg

SEQ ID NO: 38087 - DNA, 25 bp, Homo sapien
ctagcgcccagtgggttgcaggaaa

SEQ ID NO: 38088 - DNA, 25 bp, Homo sapien
aggcgcatgctctgtagcggtctcc

SEQ ID NO: 38089 - DNA, 25 bp, Homo sapien
tccggggtctgaagacaaggaagca

SEQ ID NO: 38090 - DNA, 25 bp, Homo sapien
tgctctgtagcggtctccgcagcca

SEQ ID NO: 38091 - DNA, 25 bp, Homo sapien
cagaagccgtcggaggcgcatgctc

SEQ ID NO: 38092 - DNA, 25 bp, Homo sapien
ctctgggatgtctttcagtctggaa

SEQ ID NO: 38093 - DNA, 25 bp, Homo sapien
tgcagctagtaagtcgacaccggga

SEQ ID NO: 38094 - DNA, 25 bp, Homo sapien
ccgcgagcaagagcttatataggcc

SEQ ID NO: 38095 - DNA, 25 bp, Homo sapien
agcccgcgaagcgagaaccgccaga

SEQ ID NO: 38096 - DNA, 25 bp, Homo sapien
tccgagcggaagaagcgccttcacc

SEQ ID NO: 38097 - DNA, 25 bp, Homo sapien
cctctggagttgtctctgggatgtc

SEQ ID NO: 38098 - DNA, 25 bp, Homo sapien
tctggaaatgaaccctgtgtgctgg

SEQ ID NO: 38099 - DNA, 25 bp, Homo sapien
ttcacctttcagtgcccggcgctgg

SEQ ID NO: 38100 - DNA, 25 bp, Homo sapien
tgagcgtgctttaggccacggcaac

SEQ ID NO: 38101 - DNA, 25 bp, Homo sapien
ctcccgagaggccaactcagaggtc

SEQ ID NO: 38102 - DNA, 25 bp, Homo sapien
tcccgcccggtccactggggccaga

SEQ ID NO: 38103 - DNA, 25 bp, Homo sapien
cgagaggccaactcagaggtcaggc

SEQ ID NO: 38104 - DNA, 25 bp, Homo sapien
ttaggccacggcaactcccgagagg

SEQ ID NO: 38105 - DNA, 25 bp, Homo sapien
cctgctcggagtcatttttcccacg

SEQ ID NO: 38106 - DNA, 25 bp, Homo sapien
ggagtcatttttcccacgaacactg

SEQ ID NO: 38107 - DNA, 25 bp, Homo sapien
gctcggtgagcgtgctttaggccac

SEQ ID NO: 38108 - DNA, 25 bp, Homo sapien
aattgacgccctcggatggctttga

SEQ ID NO: 38109 - DNA, 25 bp, Homo sapien
cccggcgttaagaatccttcactag

SEQ ID NO: 38110 - DNA, 25 bp, Homo sapien
ctccgacacgtggtggcgatattga

SEQ ID NO: 38111 - DNA, 25 bp, Homo sapien
gtacaccctgcagcttgcgctttta

SEQ ID NO: 38112 - DNA, 25 bp, Homo sapien
ctctgcgtattccaacccggcgtta

SEQ ID NO: 38113 - DNA, 25 bp, Homo sapien
cttcccgacgctgcttatttatcta

SEQ ID NO: 38114 - DNA, 25 bp, Homo sapien
ctatcggtagcatgacgggtaattg

SEQ ID NO: 38115 - DNA, 25 bp, Homo sapien
tgcgcttttaactgcttgtggttga

SEQ ID NO: 38116 - DNA, 25 bp, Homo sapien
cagcctcttggagcaggtacaggcc

SEQ ID NO: 38117 - DNA, 25 bp, Homo sapien
ttggacaacttgctgctcggcgacg

SEQ ID NO: 38118 - DNA, 25 bp, Homo sapien
tgaatgtgagagtcagcgctcgcgc

SEQ ID NO: 38119 - DNA, 25 bp, Homo sapien
ggcgcgcgcgtaaaagcatagagac

SEQ ID NO: 38120 - DNA, 25 bp, Homo sapien
acgggcattgagctcttgggctaga

SEQ ID NO: 38121 - DNA, 25 bp, Homo sapien
tgagagccatgtcggccagcagcct

SEQ ID NO: 38122 - DNA, 25 bp, Homo sapien
cctcggccattgtgtgaggcgagaa

SEQ ID NO: 38123 - DNA, 25 bp, Homo sapien
ccgcccgtgaggatctgagagccat

SEQ ID NO: 38124 - DNA, 25 bp, Homo sapien
tgagctgcggctcaagatggtgtcc

SEQ ID NO: 38125 - DNA, 25 bp, Homo sapien
tgtagccaggttccctccatgcttc

SEQ ID NO: 38126 - DNA, 25 bp, Homo sapien
cccgtcgcagcctggtttttgtacg

SEQ ID NO: 38127 - DNA, 25 bp, Homo sapien
ttctgcccggctgtagccaggttcc

SEQ ID NO: 38128 - DNA, 25 bp, Homo sapien
cggttgtgccaccttgagctgcggc

SEQ ID NO: 38129 - DNA, 25 bp, Homo sapien
gcctggtttttgtacgccttctctc

SEQ ID NO: 38130 - DNA, 25 bp, Homo sapien
gccttctctctgacggcggttgtgc

SEQ ID NO: 38131 - DNA, 25 bp, Homo sapien
tcaagatggtgtccgcccttgcttc

SEQ ID NO: 38132 - DNA, 25 bp, Homo sapien
cggcgccaccggattccatttgtaa

SEQ ID NO: 38133 - DNA, 25 bp, Homo sapien
aaacttattagtgtgcgctcgcggg

SEQ ID NO: 38134 - DNA, 25 bp, Homo sapien
caaccggcgccgcatgctaatcagg

SEQ ID NO: 38135 - DNA, 25 bp, Homo sapien
cggagcgcagcttctgccttttatt

SEQ ID NO: 38136 - DNA, 25 bp, Homo sapien
gcggcgggaatactaatgcacccta

SEQ ID NO: 38137 - DNA, 25 bp, Homo sapien
taggccttggttactctggcaactc

SEQ ID NO: 38138 - DNA, 25 bp, Homo sapien
tcaggacttcgcacaagggcagctc

SEQ ID NO: 38139 - DNA, 25 bp, Homo sapien
gccttttattgcaagcggcgccacc

SEQ ID NO: 38140 - DNA, 25 bp, Homo sapien
tccgcatttcctgcaggggcacctg

SEQ ID NO: 38141 - DNA, 25 bp, Homo sapien
ccacttacatcgaggggaacacagg

SEQ ID NO: 38142 - DNA, 25 bp, Homo sapien
ggtggggatcacgaacttgagaccc

SEQ ID NO: 38143 - DNA, 25 bp, Homo sapien
cggcatcgtccggtgagtccgctgc

SEQ ID NO: 38144 - DNA, 25 bp, Homo sapien
tgtcatgttcggcatcgtccggtga

SEQ ID NO: 38145 - DNA, 25 bp, Homo sapien
gctgggcaacgtgcttgtcatgttc

SEQ ID NO: 38146 - DNA, 25 bp, Homo sapien
ctcgagccggcggagcatccctagg

SEQ ID NO: 38147 - DNA, 25 bp, Homo sapien
acaggaatgtgtgtcatcgtgtgta

SEQ ID NO: 38148 - DNA, 25 bp, Homo sapien
cgacgagaacttcaagcgctgcttc

SEQ ID NO: 38149 - DNA, 25 bp, Homo sapien
atcaccgtgtgctatggcctcatgc

SEQ ID NO: 38150 - DNA, 25 bp, Homo sapien
ctccaaggagaaggaccgcagcctg

SEQ ID NO: 38151 - DNA, 25 bp, Homo sapien
ggtgaccaagatctgcgtgttcctc

SEQ ID NO: 38152 - DNA, 25 bp, Homo sapien
acccggaggccacatgagtcccagt

SEQ ID NO: 38153 - DNA, 25 bp, Homo sapien
gtgctctacgctttcctcgacgaga

SEQ ID NO: 38154 - DNA, 25 bp, Homo sapien
gtgttgggcgcccatccacatcttc

SEQ ID NO: 38155 - DNA, 25 bp, Homo sapien
atcgcgctgggctacgccaatagca

SEQ ID NO: 38156 - DNA, 25 bp, Homo sapien
tgatcggcagttgcctgcgccaatc

SEQ ID NO: 38157 - DNA, 25 bp, Homo sapien
cggcccttacgtaactgactttgag

SEQ ID NO: 38158 - DNA, 25 bp, Homo sapien
gctcggatccggagctagacacgtc

SEQ ID NO: 38159 - DNA, 25 bp, Homo sapien
aggagtctgggcatcttaaagttca

SEQ ID NO: 38160 - DNA, 25 bp, Homo sapien
ttccagaatccgaacttggggtcca

SEQ ID NO: 38161 - DNA, 25 bp, Homo sapien
tccagcggtcccgaattccagaatc

SEQ ID NO: 38162 - DNA, 25 bp, Homo sapien
gcctcacgatggagttgccctgtca

SEQ ID NO: 38163 - DNA, 25 bp, Homo sapien
gggcaaagtggcaggaacctcttaa

SEQ ID NO: 38164 - DNA, 25 bp, Homo sapien
tccctccgctggtgcgtttagtcag

SEQ ID NO: 38165 - DNA, 25 bp, Homo sapien
tcctgccattgttcgtcgggctgca

SEQ ID NO: 38166 - DNA, 25 bp, Homo sapien
gcctcgggaggaaaccaaatgcgga

SEQ ID NO: 38167 - DNA, 25 bp, Homo sapien
cggcgcggcccaatagaaatttact

SEQ ID NO: 38168 - DNA, 25 bp, Homo sapien
cccagcgagcagagggttaaatcta

SEQ ID NO: 38169 - DNA, 25 bp, Homo sapien
gccaccgacgcctgcatcattgaaa

SEQ ID NO: 38170 - DNA, 25 bp, Homo sapien
ctgtctgcagaagtcaggcggaatc

SEQ ID NO: 38171 - DNA, 25 bp, Homo sapien
tttagtcagtcagccagcagcagcc

SEQ ID NO: 38172 - DNA, 25 bp, Homo sapien
acagtggttaccaccaggaggtgcc

SEQ ID NO: 38173 - DNA, 25 bp, Homo sapien
ttccgctgcccgctgaggatcttgt

SEQ ID NO: 38174 - DNA, 25 bp, Homo sapien
tacggagctcctgctcgatcttctg

SEQ ID NO: 38175 - DNA, 25 bp, Homo sapien
aggaactccatcttcttggcctcgc

SEQ ID NO: 38176 - DNA, 25 bp, Homo sapien
cgcgtgtgcgctgaatgacatgtac

SEQ ID NO: 38177 - DNA, 25 bp, Homo sapien
ctgcatcttgacctccagctacaga

SEQ ID NO: 38178 - DNA, 25 bp, Homo sapien
ccgtctcgccattggccggcatgta

SEQ ID NO: 38179 - DNA, 25 bp, Homo sapien
tgacatgtactccacctgcatcttg

SEQ ID NO: 38180 - DNA, 25 bp, Homo sapien
ccgagaggcaagagccagacgccaa

SEQ ID NO: 38181 - DNA, 25 bp, Homo sapien
aggcttcagcctcgcaagatgccga

SEQ ID NO: 38182 - DNA, 25 bp, Homo sapien
cccagtccgactggaggctcctgag

SEQ ID NO: 38183 - DNA, 25 bp, Homo sapien
gccttgtagctgaaaggaccggacg

SEQ ID NO: 38184 - DNA, 25 bp, Homo sapien
tgccgccgggtactcctaagaacag

SEQ ID NO: 38185 - DNA, 25 bp, Homo sapien
gtcggcccagtttccatgatgcggg

SEQ ID NO: 38186 - DNA, 25 bp, Homo sapien
ggaatttccggcctaggattgatta

SEQ ID NO: 38187 - DNA, 25 bp, Homo sapien
accacagtggggaagaccgagcctc

SEQ ID NO: 38188 - DNA, 25 bp, Homo sapien
ttagcgggctctgaacgcagactcc

SEQ ID NO: 38189 - DNA, 25 bp, Homo sapien
tcatacagcagtgtgttggcgcaga

SEQ ID NO: 38190 - DNA, 25 bp, Homo sapien
gggctgcaaatctgccgcctgcgtc

SEQ ID NO: 38191 - DNA, 25 bp, Homo sapien
cagatttctggctctgcgcagccta

SEQ ID NO: 38192 - DNA, 25 bp, Homo sapien
acgaacaggccgacgcccatgatca

SEQ ID NO: 38193 - DNA, 25 bp, Homo sapien
tccaagtctcggttctcatacagca

SEQ ID NO: 38194 - DNA, 25 bp, Homo sapien
cctctagcttcagggcgccaggttc

SEQ ID NO: 38195 - DNA, 25 bp, Homo sapien
ttggcgcagatgaacacgaacaggc

SEQ ID NO: 38196 - DNA, 25 bp, Homo sapien
agcgcacagcccgacagaagatgct

SEQ ID NO: 38197 - DNA, 25 bp, Homo sapien
tgcctccgactggagcgctcaaggc

SEQ ID NO: 38198 - DNA, 25 bp, Homo sapien
tgctcgcgtccgcttcctaaagaac

SEQ ID NO: 38199 - DNA, 25 bp, Homo sapien
gtccaaagcctggtttcacagattg

SEQ ID NO: 38200 - DNA, 25 bp, Homo sapien
acagattgcaactacggcccaggga

SEQ ID NO: 38201 - DNA, 25 bp, Homo sapien
ttgtccctgagtttgcagccctttc

SEQ ID NO: 38202 - DNA, 25 bp, Homo sapien
tcatcgcttcaagccagaactggcg

SEQ ID NO: 38203 - DNA, 25 bp, Homo sapien
agcttaagccctcccgattgctggc

SEQ ID NO: 38204 - DNA, 25 bp, Homo sapien
ggggacccacaaaacgctgtggcta

SEQ ID NO: 38205 - DNA, 25 bp, Homo sapien
ccgccgcgttcagcgaagggaagca

SEQ ID NO: 38206 - DNA, 25 bp, Homo sapien
gctgtggctaaaccgcatggcgcca

SEQ ID NO: 38207 - DNA, 25 bp, Homo sapien
tctgggcctcaggattcaaggatgc

SEQ ID NO: 38208 - DNA, 25 bp, Homo sapien
cgtggcctgcgacagaaagaaaacc

SEQ ID NO: 38209 - DNA, 25 bp, Homo sapien
ctcttgcaaacagtccgtggcctgc

SEQ ID NO: 38210 - DNA, 25 bp, Homo sapien
aggatgcgccctcttgcaaacagtc

SEQ ID NO: 38211 - DNA, 25 bp, Homo sapien
gcatggcgccaagcccgatcggagc

SEQ ID NO: 38212 - DNA, 25 bp, Homo sapien
ggcggccgatgtacacccgcggcat

SEQ ID NO: 38213 - DNA, 25 bp, Homo sapien
caggatcttcccgtagcccttaaag

SEQ ID NO: 38214 - DNA, 25 bp, Homo sapien
gcccttaaagaagcgctccacatcg

SEQ ID NO: 38215 - DNA, 25 bp, Homo sapien
gcatcccggcaacggcagtgatggc

SEQ ID NO: 38216 - DNA, 25 bp, Homo sapien
ggcgacgtacgcgagcacgcagctc

SEQ ID NO: 38217 - DNA, 25 bp, Homo sapien
agagagcgcgcgttcgcttcccgct

SEQ ID NO: 38218 - DNA, 25 bp, Homo sapien
gagctcgccaaaggggttcctgcac

SEQ ID NO: 38219 - DNA, 25 bp, Homo sapien
cggaagtgtccgcacctcctagagc

SEQ ID NO: 38220 - DNA, 25 bp, Homo sapien
ttcggcgccgtctcttactcgacga

SEQ ID NO: 38221 - DNA, 25 bp, Homo sapien
tacgtcatcttccagcgaccgcgcg

SEQ ID NO: 38222 - DNA, 25 bp, Homo sapien
gggtactgcagacccacatgctcgc

SEQ ID NO: 38223 - DNA, 25 bp, Homo sapien
ccacagggtactgcagacccacatg

SEQ ID NO: 38224 - DNA, 25 bp, Homo sapien
cggcaggtccgtgacagccagaagc

SEQ ID NO: 38225 - DNA, 25 bp, Homo sapien
ggtgcccatagacaagcgcccggac

SEQ ID NO: 38226 - DNA, 25 bp, Homo sapien
ccttccttcgctgcccaagtggtgg

SEQ ID NO: 38227 - DNA, 25 bp, Homo sapien
tactcgacgaccttggctggatccc

SEQ ID NO: 38228 - DNA, 25 bp, Homo sapien
tctggatcccgcctgagtgtggatc

SEQ ID NO: 38229 - DNA, 25 bp, Homo sapien
ttgcattttgtatgcctggccggga

SEQ ID NO: 38230 - DNA, 25 bp, Homo sapien
tgtgtttgtgttatgcctgtggcca

SEQ ID NO: 38231 - DNA, 25 bp, Homo sapien
cgtgtgtgcttttgagatccgtgta

SEQ ID NO: 38232 - DNA, 25 bp, Homo sapien
catgtcggactgtttgttgtttcgc

SEQ ID NO: 38233 - DNA, 25 bp, Homo sapien
tgttgtttcgcaagttccgcgcggc

SEQ ID NO: 38234 - DNA, 25 bp, Homo sapien
tgcgggagttgtatctgctaatgtg

SEQ ID NO: 38235 - DNA, 25 bp, Homo sapien
ggtccgagtgaatgccaagtgtgcc

SEQ ID NO: 38236 - DNA, 25 bp, Homo sapien
agcccgagtagtcccggaggccaca

SEQ ID NO: 38237 - DNA, 25 bp, Homo sapien
cttttcaaaaagatcaaggagcctg

SEQ ID NO: 38238 - DNA, 25 bp, Homo sapien
ctccagatttcggatccagtcactt

SEQ ID NO: 38239 - DNA, 25 bp, Homo sapien
acagcgtcgacacctctccagattt

SEQ ID NO: 38240 - DNA, 25 bp, Homo sapien
gcctggagtgggagaaaaccaccaa

SEQ ID NO: 38241 - DNA, 25 bp, Homo sapien
ccagccggaacttgtacagcgtcga

SEQ ID NO: 38242 - DNA, 25 bp, Homo sapien
ggagcccgaccagctcgcgcagaga

SEQ ID NO: 38243 - DNA, 25 bp, Homo sapien
gcgacgctcagcaacgggaagctgt

SEQ ID NO: 38244 - DNA, 25 bp, Homo sapien
ccaggaacctatgtccgcgcggtgt

SEQ ID NO: 38245 - DNA, 25 bp, Homo sapien
gcaggacctgtaccgctgtgtgtcc

SEQ ID NO: 38246 - DNA, 25 bp, Homo sapien
tagctctgctctgcgctttcttggg

SEQ ID NO: 38247 - DNA, 25 bp, Homo sapien
cttcctcttgcaagtgagcgggagc

SEQ ID NO: 38248 - DNA, 25 bp, Homo sapien
gaacgcgtcgttccagtgcatggcc

SEQ ID NO: 38249 - DNA, 25 bp, Homo sapien
ggcccagctcacgatgcagctctaa

SEQ ID NO: 38250 - DNA, 25 bp, Homo sapien
ggcgtctctaacttcgcggagctca

SEQ ID NO: 38251 - DNA, 25 bp, Homo sapien
gctcatcgtcaagggtcagctggtg

SEQ ID NO: 38252 - DNA, 25 bp, Homo sapien
aaggagattgagtaccgcatggcgc

SEQ ID NO: 38253 - DNA, 25 bp, Homo sapien
tgctgctcacgcgtcccggagacgg

SEQ ID NO: 38254 - DNA, 25 bp, Homo sapien
tatgagatcagcgtgctgctcacgc

SEQ ID NO: 38255 - DNA, 25 bp, Homo sapien
agctcaacaccaactccatcattgg

SEQ ID NO: 38256 - DNA, 25 bp, Homo sapien
agacctacaagctgtggcacctcga

SEQ ID NO: 38257 - DNA, 25 bp, Homo sapien
ccatcattggcgacgggccgatcgt

SEQ ID NO: 38258 - DNA, 25 bp, Homo sapien
aggtgcacgccgtcagcctgcagac

SEQ ID NO: 38259 - DNA, 25 bp, Homo sapien
cccgacacagagtatgagatcagcg

SEQ ID NO: 38260 - DNA, 25 bp, Homo sapien
caaagcccgtccctcgcggtgaggg

SEQ ID NO: 38261 - DNA, 25 bp, Homo sapien
gcccatcaaggggagccggacattt

SEQ ID NO: 38262 - DNA, 25 bp, Homo sapien
caaggggagccggacatttatccgc

SEQ ID NO: 38263 - DNA, 25 bp, Homo sapien
actctgcccatcaaggggagccgga

SEQ ID NO: 38264 - DNA, 25 bp, Homo sapien
gctgactctgcccatcaaggggagc

SEQ ID NO: 38265 - DNA, 25 bp, Homo sapien
ggggtgctgactctgcccatcaagg

SEQ ID NO: 38266 - DNA, 25 bp, Homo sapien
ccagggccatctcagggaccgtgtc

SEQ ID NO: 38267 - DNA, 25 bp, Homo sapien
agccggacatttatccgccaaagcc

SEQ ID NO: 38268 - DNA, 25 bp, Homo sapien
ttccagtccctgacagtccctggga

SEQ ID NO: 38269 - DNA, 25 bp, Homo sapien
ggccctgtccacaggctggacctga

SEQ ID NO: 38270 - DNA, 25 bp, Homo sapien
ccagcaccagcgtgatgagcaaagc

SEQ ID NO: 38271 - DNA, 25 bp, Homo sapien
tcggaccaatcaactcctgggttgc

SEQ ID NO: 38272 - DNA, 25 bp, Homo sapien
acagctaattggaccggggtggaca

SEQ ID NO: 38273 - DNA, 25 bp, Homo sapien
gacacctgaacccagtcggaccaat

SEQ ID NO: 38274 - DNA, 25 bp, Homo sapien
gtcgaggaacccgacaaatgaatta

SEQ ID NO: 38275 - DNA, 25 bp, Homo sapien
cccgggcacctgcatatgatgtgtg

SEQ ID NO: 38276 - DNA, 25 bp, Homo sapien
ctcagttcccgccgttttataggct

SEQ ID NO: 38277 - DNA, 25 bp, Homo sapien
gccctgatgttgccgtgtaactcag

SEQ ID NO: 38278 - DNA, 25 bp, Homo sapien
ccctgatgttgccgtgtaactcagt

SEQ ID NO: 38279 - DNA, 25 bp, Homo sapien
ctgatgttgccgtgtaactcagttc

SEQ ID NO: 38280 - DNA, 25 bp, Homo sapien
tcagttcccgccgttttataggcta

SEQ ID NO: 38281 - DNA, 25 bp, Homo sapien
cgccccccgacgctgactttttctg

SEQ ID NO: 38282 - DNA, 25 bp, Homo sapien
cgccctgatgttgccgtgtaactca

SEQ ID NO: 38283 - DNA, 25 bp, Homo sapien
cctgatgttgccgtgtaactcagtt

SEQ ID NO: 38284 - DNA, 25 bp, Homo sapien
ttctgtcttcactttagcgctggct

SEQ ID NO: 38285 - DNA, 25 bp, Homo sapien
tctgtcttcactttagcgctggctc

SEQ ID NO: 38286 - DNA, 25 bp, Homo sapien
ctctgcgcctgccacggcctcgtcc

SEQ ID NO: 38287 - DNA, 25 bp, Homo sapien
cagtctctgcgcctgccacggcctc

SEQ ID NO: 38288 - DNA, 25 bp, Homo sapien
tcagcgcggactctcagtctctgcg

SEQ ID NO: 38289 - DNA, 25 bp, Homo sapien
cttggcccgcctcagcgcggactct

SEQ ID NO: 38290 - DNA, 25 bp, Homo sapien
gtcttcactttagcgctggctccgc

SEQ ID NO: 38291 - DNA, 25 bp, Homo sapien
ctgtcttcactttagcgctggctcc

SEQ ID NO: 38292 - DNA, 25 bp, Homo sapien
tctggccatttcaatgccgctcgga

SEQ ID NO: 38293 - DNA, 25 bp, Homo sapien
aagcgctctgagggcaccagcctgt

SEQ ID NO: 38294 - DNA, 25 bp, Homo sapien
agtctctggccgctccaagcgctct

SEQ ID NO: 38295 - DNA, 25 bp, Homo sapien
ccgggagctccagcgagtctctggc

SEQ ID NO: 38296 - DNA, 25 bp, Homo sapien
cgcatcctcgcgctgacgcctcctg

SEQ ID NO: 38297 - DNA, 25 bp, Homo sapien
agtctggtctgggacccgcatcctc

SEQ ID NO: 38298 - DNA, 25 bp, Homo sapien
ggtgggttcataagccggtgcatac

SEQ ID NO: 38299 - DNA, 25 bp, Homo sapien
ttcaatgccgctcggacagagcctg

SEQ ID NO: 38300 - DNA, 25 bp, Homo sapien
gaggactgccgggtcgcacagccag

SEQ ID NO: 38301 - DNA, 25 bp, Homo sapien
acgatgaccacctgcgacacgcggg

SEQ ID NO: 38302 - DNA, 25 bp, Homo sapien
gaagcccacgggactgtccaggaga

SEQ ID NO: 38303 - DNA, 25 bp, Homo sapien
atgaccacctgcgacacgcggggcg

SEQ ID NO: 38304 - DNA, 25 bp, Homo sapien
actccgatggcgaacagctcgacgc

SEQ ID NO: 38305 - DNA, 25 bp, Homo sapien
atggcgaacagctcgacgccgctgg

SEQ ID NO: 38306 - DNA, 25 bp, Homo sapien
cagacacgtcctgcacgctgtcctg

SEQ ID NO: 38307 - DNA, 25 bp, Homo sapien
cgtctgtcaccacgatgaccacctg

SEQ ID NO: 38308 - DNA, 25 bp, Homo sapien
tgcttcacggtgctggcatagttga

SEQ ID NO: 38309 - DNA, 25 bp, Homo sapien
cctgggacaggaataccttcacttt

SEQ ID NO: 38310 - DNA, 25 bp, Homo sapien
ctctgcatcgccgaaggctttggtg

SEQ ID NO: 38311 - DNA, 25 bp, Homo sapien
ctcaaattcaacaggccgaacgctg

SEQ ID NO: 38312 - DNA, 25 bp, Homo sapien
cgaacgctgcgagagctgtcgacaa

SEQ ID NO: 38313 - DNA, 25 bp, Homo sapien
ctgtcgacaacaaacaccaggtctg

SEQ ID NO: 38314 - DNA, 25 bp, Homo sapien
atagttgaccatgcccacccgggtg

SEQ ID NO: 38315 - DNA, 25 bp, Homo sapien
cgtccagcgactcgatgacctggga

SEQ ID NO: 38316 - DNA, 25 bp, Homo sapien
cacagtggcacggacccggcactga

SEQ ID NO: 38317 - DNA, 25 bp, Homo sapien
cccggcactgacgtggtggctctca

SEQ ID NO: 38318 - DNA, 25 bp, Homo sapien
gacccggcactgacgtggtggctct

SEQ ID NO: 38319 - DNA, 25 bp, Homo sapien
acagtggcacggacccggcactgac

SEQ ID NO: 38320 - DNA, 25 bp, Homo sapien
ccggcactgacgtggtggctctcac

SEQ ID NO: 38321 - DNA, 25 bp, Homo sapien
tctcacagtggcacggacccggcac

SEQ ID NO: 38322 - DNA, 25 bp, Homo sapien
acccggcactgacgtggtggctctc

SEQ ID NO: 38323 - DNA, 25 bp, Homo sapien
cagtggcacggacccggcactgacg

SEQ ID NO: 38324 - DNA, 25 bp, Homo sapien
ggttaagctccagcttagcgggtcc

SEQ ID NO: 38325 - DNA, 25 bp, Homo sapien
gtccagccagcggatccggactgtg

SEQ ID NO: 38326 - DNA, 25 bp, Homo sapien
tcgccggggttaagctccagcttag

SEQ ID NO: 38327 - DNA, 25 bp, Homo sapien
agcctgggggcctcacggagacacc

SEQ ID NO: 38328 - DNA, 25 bp, Homo sapien
gccgcagccgcgcatttcattattg

SEQ ID NO: 38329 - DNA, 25 bp, Homo sapien
agccgcgcatttcattattgccttg

SEQ ID NO: 38330 - DNA, 25 bp, Homo sapien
tcattattgccttggccgtggcctc

SEQ ID NO: 38331 - DNA, 25 bp, Homo sapien
gatccggactgtgggatgcttccca

SEQ ID NO: 38332 - DNA, 25 bp, Homo sapien
tcacgtgttgttgttgggccgggaa

SEQ ID NO: 38333 - DNA, 25 bp, Homo sapien
gaggcccgaggcgttcccctctgga

SEQ ID NO: 38334 - DNA, 25 bp, Homo sapien
ctctgccgggctctcgaggcccgag

SEQ ID NO: 38335 - DNA, 25 bp, Homo sapien
tcacgcagcggacgtgacacgtgcg

SEQ ID NO: 38336 - DNA, 25 bp, Homo sapien
gcttccgggtcaatgcaggacactg

SEQ ID NO: 38337 - DNA, 25 bp, Homo sapien
gctgcttccgggtcaatgcaggaca

SEQ ID NO: 38338 - DNA, 25 bp, Homo sapien
ccgggtcaatgcaggacactgggct

SEQ ID NO: 38339 - DNA, 25 bp, Homo sapien
tcccattcacgcagcggacgtgaca

SEQ ID NO: 38340 - DNA, 25 bp, Homo sapien
cagcgcaggggtcccgcttcgtccc

SEQ ID NO: 38341 - DNA, 25 bp, Homo sapien
gagatgcgccccccgaagatgacca

SEQ ID NO: 38342 - DNA, 25 bp, Homo sapien
ctgaggacccgcgatcgggttccct

SEQ ID NO: 38343 - DNA, 25 bp, Homo sapien
acagttcccggagccactgggaggt

SEQ ID NO: 38344 - DNA, 25 bp, Homo sapien
agacagttcccggagccactgggag

SEQ ID NO: 38345 - DNA, 25 bp, Homo sapien
cggggagacagttcccggagccact

SEQ ID NO: 38346 - DNA, 25 bp, Homo sapien
gccagcgcaggggtcccgcttcgtc

SEQ ID NO: 38347 - DNA, 25 bp, Homo sapien
tgaggacccgcgatcgggttccctc

SEQ ID NO: 38348 - DNA, 25 bp, Homo sapien
gacacctgagtgagcagccggcctc

SEQ ID NO: 38349 - DNA, 25 bp, Homo sapien
cgcggccgccgtgctaggtagaagg

SEQ ID NO: 38350 - DNA, 25 bp, Homo sapien
acccggacacctgagtgagcagccg

SEQ ID NO: 38351 - DNA, 25 bp, Homo sapien
gcacccggacacctgagtgagcagc

SEQ ID NO: 38352 - DNA, 25 bp, Homo sapien
gccgagtgggcacccggacacctga

SEQ ID NO: 38353 - DNA, 25 bp, Homo sapien
tggctccctgaagtcgccgagcgga

SEQ ID NO: 38354 - DNA, 25 bp, Homo sapien
ggcctggctccctgaagtcgccgag

SEQ ID NO: 38355 - DNA, 25 bp, Homo sapien
agcagccggcctcgccgatcccggg

SEQ ID NO: 38356 - DNA, 25 bp, Homo sapien
aaactcgcaggcaacacaaacgctg

SEQ ID NO: 38357 - DNA, 25 bp, Homo sapien
caccacagctagcagggttcgcgga

SEQ ID NO: 38358 - DNA, 25 bp, Homo sapien
ttgcgccggtgacgctccaccgagt

SEQ ID NO: 38359 - DNA, 25 bp, Homo sapien
agcggtaggatgaagatggatttca

SEQ ID NO: 38360 - DNA, 25 bp, Homo sapien
cctgtgtgaactcgggaaactcgca

SEQ ID NO: 38361 - DNA, 25 bp, Homo sapien
ggttgccatgccaacccagggcctg

SEQ ID NO: 38362 - DNA, 25 bp, Homo sapien
acctttcactccgacaacatggcgg

SEQ ID NO: 38363 - DNA, 25 bp, Homo sapien
cggctctggaacaggttgcctggtt

SEQ ID NO: 38364 - DNA, 25 bp, Homo sapien
tggagacccggaagcttagagggcc

SEQ ID NO: 38365 - DNA, 25 bp, Homo sapien
cccgccacacgtctgtcctgagaac

SEQ ID NO: 38366 - DNA, 25 bp, Homo sapien
agtcgccgctagagcggggcccttt

SEQ ID NO: 38367 - DNA, 25 bp, Homo sapien
ggttcagggcgcgatcctctctggg

SEQ ID NO: 38368 - DNA, 25 bp, Homo sapien
cgcgatcctctctgggggaatccgc

SEQ ID NO: 38369 - DNA, 25 bp, Homo sapien
actatccctgagcgccgcactgttg

SEQ ID NO: 38370 - DNA, 25 bp, Homo sapien
cacacgtctgtcctgagaacccgca

SEQ ID NO: 38371 - DNA, 25 bp, Homo sapien
ggccgcgctccacccgctttgggcc

SEQ ID NO: 38372 - DNA, 25 bp, Homo sapien
ggcgcctggtatccgtaggagtcaa

SEQ ID NO: 38373 - DNA, 25 bp, Homo sapien
cccgacctgcgggaaacaaaggcag

SEQ ID NO: 38374 - DNA, 25 bp, Homo sapien
ctgtaaatgcgacgtcttctggggc

SEQ ID NO: 38375 - DNA, 25 bp, Homo sapien
aggctgcagctgtaaatgcgacgtc

SEQ ID NO: 38376 - DNA, 25 bp, Homo sapien
cgtgacccacgtgtacagaggctgc

SEQ ID NO: 38377 - DNA, 25 bp, Homo sapien
ttagggagagtggatcccaaaagta

SEQ ID NO: 38378 - DNA, 25 bp, Homo sapien
cgtaggagtcaaagccgccgatgaa

SEQ ID NO: 38379 - DNA, 25 bp, Homo sapien
cgccgatgaagtcaactgcggaaga

SEQ ID NO: 38380 - DNA, 25 bp, Homo sapien
cagcagaaggcgaccagcgtgcagc

SEQ ID NO: 38381 - DNA, 25 bp, Homo sapien
ctcgcgcacaggacgcacttgggga

SEQ ID NO: 38382 - DNA, 25 bp, Homo sapien
agcgcacacaaagagacagcccggc

SEQ ID NO: 38383 - DNA, 25 bp, Homo sapien
cgcccgaccgctccgagactccaga

SEQ ID NO: 38384 - DNA, 25 bp, Homo sapien
ggggactcgcgcacaggacgcactt

SEQ ID NO: 38385 - DNA, 25 bp, Homo sapien
acgcgacgcttaccagctgcaggca

SEQ ID NO: 38386 - DNA, 25 bp, Homo sapien
ctcctttgtctagcgggccgtccgt

SEQ ID NO: 38387 - DNA, 25 bp, Homo sapien
cgactgcctgggcacgcgacgctta

SEQ ID NO: 38388 - DNA, 25 bp, Homo sapien
acgaaagcgcacagcgagcgcgaag

SEQ ID NO: 38389 - DNA, 25 bp, Homo sapien
cgaaagcgcacagcgagcgcgaagg

SEQ ID NO: 38390 - DNA, 25 bp, Homo sapien
aaagcgcacagcgagcgcgaaggcc

SEQ ID NO: 38391 - DNA, 25 bp, Homo sapien
aagcgcacagcgagcgcgaaggccc

SEQ ID NO: 38392 - DNA, 25 bp, Homo sapien
agcgcacagcgagcgcgaaggcccc

SEQ ID NO: 38393 - DNA, 25 bp, Homo sapien
cgcacagcgagcgcgaaggccccgc

SEQ ID NO: 38394 - DNA, 25 bp, Homo sapien
gcgtcactgccggaggcccggggtg

SEQ ID NO: 38395 - DNA, 25 bp, Homo sapien
gacgaaagcgcacagcgagcgcgaa

SEQ ID NO: 38396 - DNA, 25 bp, Homo sapien
tcgtagcgctcgctcgacagggtct

SEQ ID NO: 38397 - DNA, 25 bp, Homo sapien
gcacctggctccacgagaaacggga

SEQ ID NO: 38398 - DNA, 25 bp, Homo sapien
acccaagggcgtgactctgatctca

SEQ ID NO: 38399 - DNA, 25 bp, Homo sapien
gtcaaggcaccgacgaaagcgcaca

SEQ ID NO: 38400 - DNA, 25 bp, Homo sapien
gggcctcctgattgggcagcatcca

SEQ ID NO: 38401 - DNA, 25 bp, Homo sapien
gggcagcatccaaccaatcagggcg

SEQ ID NO: 38402 - DNA, 25 bp, Homo sapien
atccagtccggtgccatctgaagcc

SEQ ID NO: 38403 - DNA, 25 bp, Homo sapien
ttcccaggtgagactcgtagcgctc

SEQ ID NO: 38404 - DNA, 25 bp, Homo sapien
accgccctcggatagtctcttgtta

SEQ ID NO: 38405 - DNA, 25 bp, Homo sapien
acctggagctgacgcctagtacgta

SEQ ID NO: 38406 - DNA, 25 bp, Homo sapien
ggcgtttagttcagcgcagcgactc

SEQ ID NO: 38407 - DNA, 25 bp, Homo sapien
ctgacgtcatgagagtgcgatacca

SEQ ID NO: 38408 - DNA, 25 bp, Homo sapien
ggcgccacgcaattggttccaaatt

SEQ ID NO: 38409 - DNA, 25 bp, Homo sapien
tgctgttctatcatggcggcaaccg

SEQ ID NO: 38410 - DNA, 25 bp, Homo sapien
ggggaacacgtacgcagcattcgca

SEQ ID NO: 38411 - DNA, 25 bp, Homo sapien
gggcccttacgcttctgctgttcta

SEQ ID NO: 38412 - DNA, 25 bp, Homo sapien
acgccctggttctctgtgtaggtcg

SEQ ID NO: 38413 - DNA, 25 bp, Homo sapien
ccggactttcttagctgccctcgag

SEQ ID NO: 38414 - DNA, 25 bp, Homo sapien
tttaccgtcctcagtctggctcgcg

SEQ ID NO: 38415 - DNA, 25 bp, Homo sapien
cgactgtctttgtccgtctgctgtc

SEQ ID NO: 38416 - DNA, 25 bp, Homo sapien
cgttcgtatttgtctggttcctgtc

SEQ ID NO: 38417 - DNA, 25 bp, Homo sapien
acctggagagactaagcctggagcc

SEQ ID NO: 38418 - DNA, 25 bp, Homo sapien
cttctgttctgctccgagtagtttc

SEQ ID NO: 38419 - DNA, 25 bp, Homo sapien
tctgtgtccgtcgttcgtccgactg

SEQ ID NO: 38420 - DNA, 25 bp, Homo sapien
agaggggccacttccgcatcgtgcg

SEQ ID NO: 38421 - DNA, 25 bp, Homo sapien
cgcggcgtcaatgagtgcgacatcg

SEQ ID NO: 38422 - DNA, 25 bp, Homo sapien
caatgagtgcgacatcgagagcttc

SEQ ID NO: 38423 - DNA, 25 bp, Homo sapien
gtgcgacatcgagagcttcgtgctg

SEQ ID NO: 38424 - DNA, 25 bp, Homo sapien
ggcatggaggacatgggtcatcact

SEQ ID NO: 38425 - DNA, 25 bp, Homo sapien
acatgggtcatcactgaggctgcgg

SEQ ID NO: 38426 - DNA, 25 bp, Homo sapien
ggtcatcactgaggctgcgggcacc

SEQ ID NO: 38427 - DNA, 25 bp, Homo sapien
taatcccggcgcgggttccgctgac

SEQ ID NO: 38428 - DNA, 25 bp, Homo sapien
cccgcgtcagtgtccacagtgcagt

SEQ ID NO: 38429 - DNA, 25 bp, Homo sapien
tcgacggccactactacaccatggg

SEQ ID NO: 38430 - DNA, 25 bp, Homo sapien
cgttaagattctggcgggttagcac

SEQ ID NO: 38431 - DNA, 25 bp, Homo sapien
gccagtgcgtccctctgcacaagtg

SEQ ID NO: 38432 - DNA, 25 bp, Homo sapien
gcggggacgtctactgcttcaacaa

SEQ ID NO: 38433 - DNA, 25 bp, Homo sapien
cgagcttcagccactactccgtgtg

SEQ ID NO: 38434 - DNA, 25 bp, Homo sapien
tagcactccgggtccattcaccttg

SEQ ID NO: 38435 - DNA, 25 bp, Homo sapien
gtgctgcacacctttgacggcgcct

SEQ ID NO: 38436 - DNA, 25 bp, Homo sapien
tcacgggcatcacctgaaaggaatg

SEQ ID NO: 38437 - DNA, 25 bp, Homo sapien
caaggctgaggctaaggctccggct

SEQ ID NO: 38438 - DNA, 25 bp, Homo sapien
acgggtaccttccaaggaagctctg

SEQ ID NO: 38439 - DNA, 25 bp, Homo sapien
cccgcgaggctggaattttctacgg

SEQ ID NO: 38440 - DNA, 25 bp, Homo sapien
cttcctgtttgccaggacgtccaga

SEQ ID NO: 38441 - DNA, 25 bp, Homo sapien
gccgcctttgtctcgcttcctgttt

SEQ ID NO: 38442 - DNA, 25 bp, Homo sapien
tcacctgaaaggaatgcgggcgccg

SEQ ID NO: 38443 - DNA, 25 bp, Homo sapien
ggcaccctcagtcgccgagggactg

SEQ ID NO: 38444 - DNA, 25 bp, Homo sapien
agccaagaccgtctgggggctccca

SEQ ID NO: 38445 - DNA, 25 bp, Homo sapien
ccaggggtctccagggatccgcaac

SEQ ID NO: 38446 - DNA, 25 bp, Homo sapien
tctcctctaggcaggctccgagtgc

SEQ ID NO: 38447 - DNA, 25 bp, Homo sapien
ctgggagactggctcctcggccagc

SEQ ID NO: 38448 - DNA, 25 bp, Homo sapien
cttcctcgcaggaaggcgaagtccc

SEQ ID NO: 38449 - DNA, 25 bp, Homo sapien
agttgccgcggatcgtgctgagccc

SEQ ID NO: 38450 - DNA, 25 bp, Homo sapien
agcccgcgcagttgccgcggatcgt

SEQ ID NO: 38451 - DNA, 25 bp, Homo sapien
cccttgctcgcaaggggtcgtcagt

SEQ ID NO: 38452 - DNA, 25 bp, Homo sapien
ttttcggttctctacagcgcaaggc

SEQ ID NO: 38453 - DNA, 25 bp, Homo sapien
agtagctcctgagtttccgcagatg

SEQ ID NO: 38454 - DNA, 25 bp, Homo sapien
tataacctggcaaatgggacgcatg

SEQ ID NO: 38455 - DNA, 25 bp, Homo sapien
gctgcggtagccatgttataacctg

SEQ ID NO: 38456 - DNA, 25 bp, Homo sapien
gcgctaatgttcctccttttcctga

SEQ ID NO: 38457 - DNA, 25 bp, Homo sapien
tccgcgcctgtcaatcttgggtgct

SEQ ID NO: 38458 - DNA, 25 bp, Homo sapien
gctggccatggtgattctgacgtca

SEQ ID NO: 38459 - DNA, 25 bp, Homo sapien
tgtgcggtccttcatgacgtgagca

SEQ ID NO: 38460 - DNA, 25 bp, Homo sapien
ctgccagggacactaatggaacaca

SEQ ID NO: 38461 - DNA, 25 bp, Homo sapien
atcctcgagctaggcgggaccctac

SEQ ID NO: 38462 - DNA, 25 bp, Homo sapien
agcgatcctcgagctaggcgggacc

SEQ ID NO: 38463 - DNA, 25 bp, Homo sapien
gggacactaatggaacacagctgga

SEQ ID NO: 38464 - DNA, 25 bp, Homo sapien
gggcctgccagggacactaatggaa

SEQ ID NO: 38465 - DNA, 25 bp, Homo sapien
cctgccggggactgccggccactcc

SEQ ID NO: 38466 - DNA, 25 bp, Homo sapien
agcttcctggcgctcgagctctccc

SEQ ID NO: 38467 - DNA, 25 bp, Homo sapien
taatggaacacagctggaccggccc

SEQ ID NO: 38468 - DNA, 25 bp, Homo sapien
gaagaagaaggctctcccgacacgg

SEQ ID NO: 38469 - DNA, 25 bp, Homo sapien
ccagacgcacgaaaacaaccaaata

SEQ ID NO: 38470 - DNA, 25 bp, Homo sapien
ccaaataaatcaggcccaggaactc

SEQ ID NO: 38471 - DNA, 25 bp, Homo sapien
atgccgggccatcgaggcgtcctca

SEQ ID NO: 38472 - DNA, 25 bp, Homo sapien
ggctctcccgacacggtgactcagg

SEQ ID NO: 38473 - DNA, 25 bp, Homo sapien
cggtctatttttagagccggctctg

SEQ ID NO: 38474 - DNA, 25 bp, Homo sapien
ctctgggcctgagcgcagactgaag

SEQ ID NO: 38475 - DNA, 25 bp, Homo sapien
ctcctgggtgggcacgttcctgcgc

SEQ ID NO: 38476 - DNA, 25 bp, Homo sapien
cactgcaaggaagcacgtggccggt

SEQ ID NO: 38477 - DNA, 25 bp, Homo sapien
ccacacgccgtgcactgcaaggaag

SEQ ID NO: 38478 - DNA, 25 bp, Homo sapien
caatcaggagctccgcagctctgcg

SEQ ID NO: 38479 - DNA, 25 bp, Homo sapien
acacgccgtgcactgcaaggaagca

SEQ ID NO: 38480 - DNA, 25 bp, Homo sapien
cacgccgtgcactgcaaggaagcac

SEQ ID NO: 38481 - DNA, 25 bp, Homo sapien
gccgtgcactgcaaggaagcacgtg

SEQ ID NO: 38482 - DNA, 25 bp, Homo sapien
tgcactgcaaggaagcacgtggccg

SEQ ID NO: 38483 - DNA, 25 bp, Homo sapien
gcccatccgcccaccaatcaggagc

SEQ ID NO: 38484 - DNA, 25 bp, Homo sapien
tcttgtcgaagtgcaggaaggtaaa

SEQ ID NO: 38485 - DNA, 25 bp, Homo sapien
cgacaaagcggaaggctagggcagc

SEQ ID NO: 38486 - DNA, 25 bp, Homo sapien
ctcggagggctcagccgacaggcac

SEQ ID NO: 38487 - DNA, 25 bp, Homo sapien
cctgagccgctgcacagctccaacc

SEQ ID NO: 38488 - DNA, 25 bp, Homo sapien
gctgcacgaagttcttgtcgaagtg

SEQ ID NO: 38489 - DNA, 25 bp, Homo sapien
ggcacagctgcacgaagttcttgtc

SEQ ID NO: 38490 - DNA, 25 bp, Homo sapien
ccgacaggcacagctgcacgaagtt

SEQ ID NO: 38491 - DNA, 25 bp, Homo sapien
acgaagttcttgtcgaagtgcagga

SEQ ID NO: 38492 - DNA, 25 bp, Homo sapien
agcgtgtctacaacgtctcccagaa

SEQ ID NO: 38493 - DNA, 25 bp, Homo sapien
tcggcctattacacgcgtgcgcagc

SEQ ID NO: 38494 - DNA, 25 bp, Homo sapien
ctggttaggaaccacagactgtgac

SEQ ID NO: 38495 - DNA, 25 bp, Homo sapien
ctgcgggaacaggagatcctctgtc

SEQ ID NO: 38496 - DNA, 25 bp, Homo sapien
gcaccggctttcctgctgcagatct

SEQ ID NO: 38497 - DNA, 25 bp, Homo sapien
cgtggtctccaagctgcggatcatg

SEQ ID NO: 38498 - DNA, 25 bp, Homo sapien
agagcgagcactaccgcagcctgca

SEQ ID NO: 38499 - DNA, 25 bp, Homo sapien
tgcccacacgcgaggtcttcctgga

SEQ ID NO: 38500 - DNA, 25 bp, Homo sapien
tggcagctccaattcgcccgcccgt

SEQ ID NO: 38501 - DNA, 25 bp, Homo sapien
gatgactcccattcacgctgggtgg

SEQ ID NO: 38502 - DNA, 25 bp, Homo sapien
tccgtcgcgtttatccacctggcag

SEQ ID NO: 38503 - DNA, 25 bp, Homo sapien
tttgggtcctctgccagcgctcgga

SEQ ID NO: 38504 - DNA, 25 bp, Homo sapien
ctagagctctgtcgccctgggggac

SEQ ID NO: 38505 - DNA, 25 bp, Homo sapien
gggacgcacaccctccatcctgcct

SEQ ID NO: 38506 - DNA, 25 bp, Homo sapien
cccgctccgactgccagagagggtc

SEQ ID NO: 38507 - DNA, 25 bp, Homo sapien
gcgacgcgcacatccgtcgcgttta

SEQ ID NO: 38508 - DNA, 25 bp, Homo sapien
catggatggggacaggaaagactcc

SEQ ID NO: 38509 - DNA, 25 bp, Homo sapien
ccggcattcagaccgtgacgggaaa

SEQ ID NO: 38510 - DNA, 25 bp, Homo sapien
actgcccggatccaggccgagatag

SEQ ID NO: 38511 - DNA, 25 bp, Homo sapien
gactcgagacagcaagcacggtctg

SEQ ID NO: 38512 - DNA, 25 bp, Homo sapien
gcgcaagtttgccatccctaagtcg

SEQ ID NO: 38513 - DNA, 25 bp, Homo sapien
gggcgaacgctgaacgaactcagtt

SEQ ID NO: 38514 - DNA, 25 bp, Homo sapien
ggccgagattagagattcaccagcg

SEQ ID NO: 38515 - DNA, 25 bp, Homo sapien
gcacggtctgtgtcagaattctgga

SEQ ID NO: 38516 - DNA, 25 bp, Homo sapien
gcctgcaccggggattctccagaaa

SEQ ID NO: 38517 - DNA, 25 bp, Homo sapien
ttctccagaaacacaggcgtgcctg

SEQ ID NO: 38518 - DNA, 25 bp, Homo sapien
cggctactcagaagccctcggactg

SEQ ID NO: 38519 - DNA, 25 bp, Homo sapien
atgcagcagaaaactcggccgcctg

SEQ ID NO: 38520 - DNA, 25 bp, Homo sapien
ttgccctcggcttctgaactttgta

SEQ ID NO: 38521 - DNA, 25 bp, Homo sapien
cggacgcgttaagctctcccaggtc

SEQ ID NO: 38522 - DNA, 25 bp, Homo sapien
gcgagggacgtttctgcacttgccc

SEQ ID NO: 38523 - DNA, 25 bp, Homo sapien
tactttggtcctgtgtccctgcagc

SEQ ID NO: 38524 - DNA, 25 bp, Homo sapien
ctcgcagagcggtgacagttgcaga

SEQ ID NO: 38525 - DNA, 25 bp, Homo sapien
gtgacggacacagagtccgtgtttg

SEQ ID NO: 38526 - DNA, 25 bp, Homo sapien
tgacggtcgcagagtctgtgttttg

SEQ ID NO: 38527 - DNA, 25 bp, Homo sapien
gtgacggtcgcagagtctgtgtttt

SEQ ID NO: 38528 - DNA, 25 bp, Homo sapien
gtgacagttgcagagtccgtgtttg

SEQ ID NO: 38529 - DNA, 25 bp, Homo sapien
cggtgacagttgcagagtccgtgtt

SEQ ID NO: 38530 - DNA, 25 bp, Homo sapien
tgacagttgcagagtccgtgtttgg

SEQ ID NO: 38531 - DNA, 25 bp, Homo sapien
cagagcggtgacagttgcagagtcc

SEQ ID NO: 38532 - DNA, 25 bp, Homo sapien
cagagcttcaggaaccaccgagatg

SEQ ID NO: 38533 - DNA, 25 bp, Homo sapien
gcctgccggagacacaggttttctg

SEQ ID NO: 38534 - DNA, 25 bp, Homo sapien
ccgcttttgatgtcgtcaggctctc

SEQ ID NO: 38535 - DNA, 25 bp, Homo sapien
agacttcggtgcttcaaaggcctca

SEQ ID NO: 38536 - DNA, 25 bp, Homo sapien
gtcagtcgtgcctccacagagcttc

SEQ ID NO: 38537 - DNA, 25 bp, Homo sapien
gccgtgaaagcacccagcgtagtca

SEQ ID NO: 38538 - DNA, 25 bp, Homo sapien
accagcggctccaaaagcagaggga

SEQ ID NO: 38539 - DNA, 25 bp, Homo sapien
tcactgctgagcacgagacgccgct

SEQ ID NO: 38540 - DNA, 25 bp, Homo sapien
gtgtccctgcaagcgtttgtgcctg

SEQ ID NO: 38541 - DNA, 25 bp, Homo sapien
ccgagtctgtctatatgagcctgtg

SEQ ID NO: 38542 - DNA, 25 bp, Homo sapien
gcctttgcctctgcgagtgcgtatt

SEQ ID NO: 38543 - DNA, 25 bp, Homo sapien
gtgcgtatttttaggaccgagtctg

SEQ ID NO: 38544 - DNA, 25 bp, Homo sapien
ctgggctatgtgtgactcagggacc

SEQ ID NO: 38545 - DNA, 25 bp, Homo sapien
ggaccagtctatgagcctgcctgtg

SEQ ID NO: 38546 - DNA, 25 bp, Homo sapien
acgagtctatgagccgatacctgtg

SEQ ID NO: 38547 - DNA, 25 bp, Homo sapien
ctgtgcctttgagccgatacctgtg

SEQ ID NO: 38548 - DNA, 25 bp, Homo sapien
ggagcctagcaaccgtcagtcacgc

SEQ ID NO: 38549 - DNA, 25 bp, Homo sapien
tgcatagcaacgtccctggagccta

SEQ ID NO: 38550 - DNA, 25 bp, Homo sapien
aaagtcaccgggagagcagtgtcgc

SEQ ID NO: 38551 - DNA, 25 bp, Homo sapien
aggaccctcagaaactgcgtccagc

SEQ ID NO: 38552 - DNA, 25 bp, Homo sapien
gcagagtgtgaaccggaaggaccct

SEQ ID NO: 38553 - DNA, 25 bp, Homo sapien
ctagcaacgtcatgcctaatcctcg

SEQ ID NO: 38554 - DNA, 25 bp, Homo sapien
agggttcttcactccggagccaaga

SEQ ID NO: 38555 - DNA, 25 bp, Homo sapien
cgtgcacaaagacgcagggttcttc

SEQ ID NO: 38556 - DNA, 25 bp, Homo sapien
tgtctccggcctgcactaatggctg

SEQ ID NO: 38557 - DNA, 25 bp, Homo sapien
gccctaaggcctcgggtcagatcct

SEQ ID NO: 38558 - DNA, 25 bp, Homo sapien
ggttctttctcgctacttggcccta

SEQ ID NO: 38559 - DNA, 25 bp, Homo sapien
ctgcaaggtcgaagggttctttctc

SEQ ID NO: 38560 - DNA, 25 bp, Homo sapien
cctgcagccgaggtgtgacctgcaa

SEQ ID NO: 38561 - DNA, 25 bp, Homo sapien
ctacggaaggcgagtccatgtgatc

SEQ ID NO: 38562 - DNA, 25 bp, Homo sapien
ctccgcgttcgctgactggctggct

SEQ ID NO: 38563 - DNA, 25 bp, Homo sapien
ctcccggacagacgacggttacagc

SEQ ID NO: 38564 - DNA, 25 bp, Homo sapien
gagccgctgcagttcgcactctgcg

SEQ ID NO: 38565 - DNA, 25 bp, Homo sapien
gctccaccgccatcaagtgggactg

SEQ ID NO: 38566 - DNA, 25 bp, Homo sapien
ttcatctttcacgtggggcagcgga

SEQ ID NO: 38567 - DNA, 25 bp, Homo sapien
cggggccgatccacagtcaggatcc

SEQ ID NO: 38568 - DNA, 25 bp, Homo sapien
tgcggcctcctcaggcactagagct

SEQ ID NO: 38569 - DNA, 25 bp, Homo sapien
aacgacttcgggaactggcaacgag

SEQ ID NO: 38570 - DNA, 25 bp, Homo sapien
cgtgactcagcctctttagttcatc

SEQ ID NO: 38571 - DNA, 25 bp, Homo sapien
ttcggccagagaagaaaacgacttc

SEQ ID NO: 38572 - DNA, 25 bp, Homo sapien
tggatcgcacatcctcccagatgca

SEQ ID NO: 38573 - DNA, 25 bp, Homo sapien
gcgtcgctttctcgctccttggatc

SEQ ID NO: 38574 - DNA, 25 bp, Homo sapien
actcatggccgagaaggactcgctc

SEQ ID NO: 38575 - DNA, 25 bp, Homo sapien
ttcactcacgccatgcagctgctga

SEQ ID NO: 38576 - DNA, 25 bp, Homo sapien
cctcatttttgggagcctggattcc

SEQ ID NO: 38577 - DNA, 25 bp, Homo sapien
cacagcctcggtcaagatggagcca

SEQ ID NO: 38578 - DNA, 25 bp, Homo sapien
cgggcgcgcagattcttccagaaat

SEQ ID NO: 38579 - DNA, 25 bp, Homo sapien
tgtcttgatggatagtgctgagctc

SEQ ID NO: 38580 - DNA, 25 bp, Homo sapien
aggaccagctcgtcggggctagaaa

SEQ ID NO: 38581 - DNA, 25 bp, Homo sapien
ccagcccgccttgtatgcaaatgta

SEQ ID NO: 38582 - DNA, 25 bp, Homo sapien
tcttgagtctcttcaccagcagctg

SEQ ID NO: 38583 - DNA, 25 bp, Homo sapien
ctccgacatattgcccgcaggagct

SEQ ID NO: 38584 - DNA, 25 bp, Homo sapien
atggccaggctgctaattgctgctc

SEQ ID NO: 38585 - DNA, 25 bp, Homo sapien
taattgctgctccacgcggacagga

SEQ ID NO: 38586 - DNA, 25 bp, Homo sapien
cttcagcgctaagggtggagattct

SEQ ID NO: 38587 - DNA, 25 bp, Homo sapien
gaccggtcagggatatggtccaccc

SEQ ID NO: 38588 - DNA, 25 bp, Homo sapien
ttggccaacgcgtgtcttgactaga

SEQ ID NO: 38589 - DNA, 25 bp, Homo sapien
cctgaactcagggaagtcctaccta

SEQ ID NO: 38590 - DNA, 25 bp, Homo sapien
gcggcgctaaggtagctttctcctg

SEQ ID NO: 38591 - DNA, 25 bp, Homo sapien
acctacgtagcgaggtggagtcctc

SEQ ID NO: 38592 - DNA, 25 bp, Homo sapien
cgagccagcactaggccggtaagca

SEQ ID NO: 38593 - DNA, 25 bp, Homo sapien
ctgaaggccgggagaacggaatcaa

SEQ ID NO: 38594 - DNA, 25 bp, Homo sapien
atcaaggcggaaatagtgtggttcg

SEQ ID NO: 38595 - DNA, 25 bp, Homo sapien
gtcttgactagattcagtggctccc

SEQ ID NO: 38596 - DNA, 25 bp, Homo sapien
tgacccgccaagaccagagagccgt

SEQ ID NO: 38597 - DNA, 25 bp, Homo sapien
cctgcgtaaagagggacgcgtagtc

SEQ ID NO: 38598 - DNA, 25 bp, Homo sapien
cggcagcagttactcggggtttccg

SEQ ID NO: 38599 - DNA, 25 bp, Homo sapien
atgttctcggcctgtggggaaatca

SEQ ID NO: 38600 - DNA, 25 bp, Homo sapien
tcggcctgtggggaaatcacgccaa

SEQ ID NO: 38601 - DNA, 25 bp, Homo sapien
cgccacgtcagtctccggccctgag

SEQ ID NO: 38602 - DNA, 25 bp, Homo sapien
gagggacgcgtagtcttttccctgc

SEQ ID NO: 38603 - DNA, 25 bp, Homo sapien
caagaccagagagccgttggcgccc

SEQ ID NO: 38604 - DNA, 25 bp, Homo sapien
cgtttgcttgcgtgccatgcatgtg

SEQ ID NO: 38605 - DNA, 25 bp, Homo sapien
cgtgtgccacacgtcgtttgcttgc

SEQ ID NO: 38606 - DNA, 25 bp, Homo sapien
gtgccattcgtgtgcaccgtacacg

SEQ ID NO: 38607 - DNA, 25 bp, Homo sapien
cacttgccgtgcgtgtgccatttgt

SEQ ID NO: 38608 - DNA, 25 bp, Homo sapien
ccatgcgcgtgtgccatgcacttgc

SEQ ID NO: 38609 - DNA, 25 bp, Homo sapien
atgtgccgttttgtgtgtgccatgc

SEQ ID NO: 38610 - DNA, 25 bp, Homo sapien
cgtgtgtgtgccatttgcatgtgcc

SEQ ID NO: 38611 - DNA, 25 bp, Homo sapien
tgtgtatgtgccgtttccgtgtgta

SEQ ID NO: 38612 - DNA, 25 bp, Homo sapien
cgatgagtttggcacatggctttgg

SEQ ID NO: 38613 - DNA, 25 bp, Homo sapien
acgctctgtcttcgagcgcggctgc

SEQ ID NO: 38614 - DNA, 25 bp, Homo sapien
cgggtctgacgctctgtcttcgagc

SEQ ID NO: 38615 - DNA, 25 bp, Homo sapien
ttgcaccgaagcatcactcgagacc

SEQ ID NO: 38616 - DNA, 25 bp, Homo sapien
cggagggaacttgcaccgaagcatc

SEQ ID NO: 38617 - DNA, 25 bp, Homo sapien
gcttgggaaatagatccccggtcgc

SEQ ID NO: 38618 - DNA, 25 bp, Homo sapien
tttggcacatggctttggagcccgg

SEQ ID NO: 38619 - DNA, 25 bp, Homo sapien
gaatgacgcgggtctgacgctctgt

SEQ ID NO: 38620 - DNA, 25 bp, Homo sapien
atcaacttcgacaagtggtcggccc

SEQ ID NO: 38621 - DNA, 25 bp, Homo sapien
gagcagattctcatcaacgaccgga

SEQ ID NO: 38622 - DNA, 25 bp, Homo sapien
cgctgtttccgtcgcaacgtgattc

SEQ ID NO: 38623 - DNA, 25 bp, Homo sapien
acgtgattcagtgcgacccgcgcca

SEQ ID NO: 38624 - DNA, 25 bp, Homo sapien
atttcgcccgtctacttctacatta

SEQ ID NO: 38625 - DNA, 25 bp, Homo sapien
acccgcgccaatgcaagtcagacga

SEQ ID NO: 38626 - DNA, 25 bp, Homo sapien
tgcgcggctgcttcagcaccaagac

SEQ ID NO: 38627 - DNA, 25 bp, Homo sapien
atctgccagaaactgcccgacatct

SEQ ID NO: 38628 - DNA, 25 bp, Homo sapien
cacgatccttgacgggcacagccag

SEQ ID NO: 38629 - DNA, 25 bp, Homo sapien
atccagtctggcatcgtccctcgag

SEQ ID NO: 38630 - DNA, 25 bp, Homo sapien
aggactggtccaaagcgccacgatc

SEQ ID NO: 38631 - DNA, 25 bp, Homo sapien
ccctcggttatggaggtaccgcctg

SEQ ID NO: 38632 - DNA, 25 bp, Homo sapien
gcgacgccgaccaatgacgtacttc

SEQ ID NO: 38633 - DNA, 25 bp, Homo sapien
aactgcgcgccaacctctggagata

SEQ ID NO: 38634 - DNA, 25 bp, Homo sapien
cagcgagatgctaccacgttcagtc

SEQ ID NO: 38635 - DNA, 25 bp, Homo sapien
tcctttagggaaatcatggggtctc

SEQ ID NO: 38636 - DNA, 25 bp, Homo sapien
agagccaacacctgccctgaatgca

SEQ ID NO: 38637 - DNA, 25 bp, Homo sapien
cccagggaagctagggagatgaatc

SEQ ID NO: 38638 - DNA, 25 bp, Homo sapien
gatgaatccaggagtccggcctctg

SEQ ID NO: 38639 - DNA, 25 bp, Homo sapien
tggcaacgccgctgtcttctacttc

SEQ ID NO: 38640 - DNA, 25 bp, Homo sapien
cgctgtcttctacttccgggaacga

SEQ ID NO: 38641 - DNA, 25 bp, Homo sapien
acccataatccggaagtgacctcga

SEQ ID NO: 38642 - DNA, 25 bp, Homo sapien
cggtcttactcacgttgcggccttc

SEQ ID NO: 38643 - DNA, 25 bp, Homo sapien
gcagacgagtgagtcaccctgaccc

SEQ ID NO: 38644 - DNA, 25 bp, Homo sapien
tatctggggcacaagctgaagtcct

SEQ ID NO: 38645 - DNA, 25 bp, Homo sapien
agggcatcatcgtccaccaagtatg

SEQ ID NO: 38646 - DNA, 25 bp, Homo sapien
tcgcaggtctttacagcacagggtg

SEQ ID NO: 38647 - DNA, 25 bp, Homo sapien
ggagtcgcccaatctcaggcccttg

SEQ ID NO: 38648 - DNA, 25 bp, Homo sapien
tacgccgcgaattgaccgggccaaa

SEQ ID NO: 38649 - DNA, 25 bp, Homo sapien
cctgccatttagctgcggctgcgga

SEQ ID NO: 38650 - DNA, 25 bp, Homo sapien
ctgcggagcctctttgaacagaagc

SEQ ID NO: 38651 - DNA, 25 bp, Homo sapien
ctacgcgagacagggagagcttaaa

SEQ ID NO: 38652 - DNA, 25 bp, Homo sapien
gatggaccaagcctgtcacctgcac

SEQ ID NO: 38653 - DNA, 25 bp, Homo sapien
cgactgaagatggaccaagcctgtc

SEQ ID NO: 38654 - DNA, 25 bp, Homo sapien
agctgcaccgactgaagatggacca

SEQ ID NO: 38655 - DNA, 25 bp, Homo sapien
ccgagggcctgtccagtaggctcac

SEQ ID NO: 38656 - DNA, 25 bp, Homo sapien
agggcctgtccagtaggctcacgcc

SEQ ID NO: 38657 - DNA, 25 bp, Homo sapien
gggcccagctgcaccgactgaagat

SEQ ID NO: 38658 - DNA, 25 bp, Homo sapien
tgcaccgactgaagatggaccaagc

SEQ ID NO: 38659 - DNA, 25 bp, Homo sapien
tcacgcgcatgaacatcagcgcccg

SEQ ID NO: 38660 - DNA, 25 bp, Homo sapien
cgtcgctttgtccatccattcattc

SEQ ID NO: 38661 - DNA, 25 bp, Homo sapien
gccagactcactgcgttctttcgtc

SEQ ID NO: 38662 - DNA, 25 bp, Homo sapien
ttcaagaacctgagccgcaaggacg

SEQ ID NO: 38663 - DNA, 25 bp, Homo sapien
agatccgacgacagccgacggcctt

SEQ ID NO: 38664 - DNA, 25 bp, Homo sapien
gaacagcctggagcccgaaccgtaa

SEQ ID NO: 38665 - DNA, 25 bp, Homo sapien
cccttgggacaaaattcgaggctca

SEQ ID NO: 38666 - DNA, 25 bp, Homo sapien
gatcgttttcactgtcggtccggga

SEQ ID NO: 38667 - DNA, 25 bp, Homo sapien
ttttgtggccaaagcgaacagcctg

SEQ ID NO: 38668 - DNA, 25 bp, Homo sapien
cgcttttcacgacgaagtgggactg

SEQ ID NO: 38669 - DNA, 25 bp, Homo sapien
agtgggactgttaagtttacagagc

SEQ ID NO: 38670 - DNA, 25 bp, Homo sapien
taagtttacagagctgctttcctcc

SEQ ID NO: 38671 - DNA, 25 bp, Homo sapien
cccatctgtcgcagaccttggtaca

SEQ ID NO: 38672 - DNA, 25 bp, Homo sapien
ccgtgtctgcgcaagctgattggct

SEQ ID NO: 38673 - DNA, 25 bp, Homo sapien
tcgcagaccttggtacaggcccagg

SEQ ID NO: 38674 - DNA, 25 bp, Homo sapien
gcacccggaggaaagtctgttacta

SEQ ID NO: 38675 - DNA, 25 bp, Homo sapien
tacgacggtgagcaccgtcctcgcg

SEQ ID NO: 38676 - DNA, 25 bp, Homo sapien
tcccgctttgtgtaagtggccccca

SEQ ID NO: 38677 - DNA, 25 bp, Homo sapien
tctctctgcacctggacggcctatt

SEQ ID NO: 38678 - DNA, 25 bp, Homo sapien
tctgcacctggacggcctattttcc

SEQ ID NO: 38679 - DNA, 25 bp, Homo sapien
ccgccgagctgcctatatataagcg

SEQ ID NO: 38680 - DNA, 25 bp, Homo sapien
ggacatttaaatgcgcgcccaatcg

SEQ ID NO: 38681 - DNA, 25 bp, Homo sapien
taaatgcgcgcccaatcgaggggcg

(The sequence listing continues in the following parts.)

What is claimed is:

1. An array consisting of a plurality of experimental probes each consisting of a different sequence from SEQ ID NO. 1-222,822.

2. The array of claim 1 further consisting of each of the sequences in SEQ ID NO. 1-222,822, wherein each sequence is present in a different feature of the array.

3. An array of probes consisting of:
    more than 250,000 different experimental probe features, wherein
    (a) each experimental probe feature comprises a plurality of copies of a nucleic acid probe that is different in sequence from the probes of every other feature of the array;
    (b) each probe feature is at a known or determinable location in the array; and
    (c) at least 90% of the probe features contain full length probes that are perfectly complementary to a CpG island, wherein a CpG island is a genomic region that is at least 200 bases and has a GC content of at least 50% over its length.

4. The array of claim 3 wherein the full length probes are between 20 and 100 bases in length and are complementary to human, mouse and rat genomic sequences.

5. The array of claim 3 further comprising a plurality of control features.

6. The array of claim 5 wherein the control features comprise one or more types of control features selected from the group of control feature types comprising:
    GC content matched anti-genomic controls, bacterial genome controls, *Arabidopsis* genome controls, *Pseudomonas* genome controls;
    18S rRNA gene controls, 28S rRNA gene controls; and
    probes to one or more genes that are known to be regulated by methylation.

7. The array of claim 3 wherein each probe is between 20 and 100 bases, wherein the array comprises at least 300,000 probes and wherein at least 80% of the probes comprise at least one CG dinucleotide.

8. The array of claim 7 wherein at least 50% of the probes comprise at least two CG dinucleotides.

9. The array of claim 7 wherein at least 20% of the probes comprise at least three CG dinucleotides.

* * * * *